United States Patent 9,328,346 (POLYCOMB-ASSOCIATED NON-CODING RNAS) - sequence listing, part 85

SEQ ID NO: 15882 - RNA, 10336 nt, Homo sapiens
cccgucucuagcucagaggccccacuggacccucggcucuuccuuggacuucuuguguguucugugagcuucgcuggauucagggucuugggcaucagaggugagagggugggaagguagguggagguugauucucacuguggggaaacuccgaccacagcuuggcuugggggcccccaggccaccccgccaccccaggcugagaguguaaaaggcagcggguguuauacacacgucccaguucugggggguugcucaaucucuguugugggggguggggcaugucagugaucggggacaaagagaggacccuacccccggauccuugugagccccugcuuggugucugaguccagaaguaaauguggccaucuccagcccagaacccuccauggcuccugccugacucagaguaaaacccaaguccuccuccgggcccacaggacccuucacacuuugcccugacacuucuuaccuccuccugcuucccccuucucucuuccggccucauagacauuucugccauuucuuuuuuuuuuuuuuuuuuuuuuugagacagagucucgcucugucacccaggcuggagugcaguggcgcgaucucagcucacugcaagcuccgccuuccggguucacgccauucuccugccucagucucuggaguggcuggggcuacaggcgcucgccaccaugcccggcuaauuuuuuuuuuuuuuuuuguauuuuuaguagagacggaauuucacuguguuagccaggauggucucgaucuccugaccccgugauccaccugccuuggccucccaagugcugggauuacaggcgugagccaccgcaccuggccuuuuuuuuuuuuuuuuuuuugagccuugcucugucgcccagguuggagugcaauggcgcaaucucugcucacugcaacaucggccuccugaguucaagugacucucccaccucagccuccugaguaguagcugggauuacaggcaugcauuaccaugcccagcuaauuuuuguauuuuuaguagagacgggguuucaccauguuggccaggcuggucuugaacucucgaccucaggugauccucccgccucggccucccaaagugcugggauuacaggcgugagccaccgugccuggccccuuucugccauuucuugggugcaaucuccgggccuuugcaccugcuguucucucugccuggaaugcucuuccucuucucucucuuccaucaggucuuugugaaagugucccuuauucuuuauuuuauuuuuauuuuuauauuuaguagaaauggacuuucaccauauuggccaggcuggucucaaacuccuaggcucaagcaauccuccugccuuggccucccaaagugcugaaauuacaggcaugaggcacuguuccagucaagugucacuucuucugugaggccuuuccugacuccucuauuuuauuuuuuuuugagacagagucucgcucuauugcccaggcuggagugcaguggugcaaucauggcucacugcaaccucugccuuccggguucaagugauucuugugucucagccuccugaguagcugagacuacaggcgcgugccacuacgccuggcuaauuuuuguauuuucaguagagacaggguuucgccacguuagccaagcuggucucaaacuccuggccucaagugauccucccaccucagccucccaaagugcugggauuacaggcaccucggccucccaaagugcugggauuacaggcaccucggccucccaaagugcugggauuacaggcgugagucagcacacccaguccugacuccucuauuaaaugucccccaccuccgggacugucacccccuugccuguuccauuuuucuccuaagcacgauuacccucugaccuaccuagcggcuguuugacuuauuucucuguucucccaacuugaaugucagcucugcaagggcaggaauuuugucuguuuggguuaaggcuguguccucauugccuaaaacagcaucccuggcacacaauaggcacucaaggugucugugguugaaugcaugaaugaggcaaugugugugugagauggagacccucgggauaugugcuugugcaggcaucaggaagcauagguuuagggccagugugguugcucacaucuguaauuucagcacuuugggaguccaaggugggaggaucacuugagccugggaguuugagacuagccugggcaacacagugagacccccucccuacaaaaaaguagcugggcaugguggugcgcaccuguaguuccaaccacucaggaggcugaggcaggaggaccacuugugugcaggaauuggaggcuacagugagcuaugauugcuccacugcacuccagccugggcaacagagcacgacucucucuuuuuuuucuuuuuuuuugagauggagucucacccagguugccuaggcuagaaggcaguggugcggucucagcucacugcaaccucugccagguucaagccguucuucugccucagccucccgaguagcugggauuacaggcaugcgccaccacgcccagcuaauuuuuuguacuuuuaguagagacgggauuucaccuguugaucaggcacccugucucuacuaaaaauacaaaaauuagcugggugugguggcgcaugccuguaaucccagcuucuugggaggcugaggcacaagaaucacuugaacccgggagguggagguugcagugagcugagauugcagagcgagacuccgucuaaaaaaaaaaaaaagagggcgugggggagagagagagagagagagagagaaagagagaaagagagagagagagagggagagacagagagagagagagcuuguauauggagguacaacccuaaaucugcuguucaaggagcgcugcugagacuugaauaaggauaggaagggaaugauguuaaguugugaacaauguuccaggcugcaaaaacagcagguacaaaggaccugaggcuggaacuugcuucgugugaggaagggccugggaggagggcagaaggggauauggcagauagcacaaguuuuuuuuuuuuuuuuuuuuuuuuugagauggagucuugcucuguugcccaggcuagagugcaguggcacagucucggcucacugcaagcucugccucccggguucaagccauucuccugccucagccucccgaguagcugggacuacaggcagccgccaccacgccuggcuacuuuuuuuguauuuucaguagagacgggguuucacuguguuagccaggauggucucgaucuccugaccucgugauccgcccgccuccgccucccaaagugcugggauuacaggcgugagucaccaagauagcgcaacuuuuuauggaucauggguggauuugggcuuuuccucuaaaggaggugggagccaagaaggauucagggcagaggagggagggagggacgugaacugacucagauguucacaggcgcccucuggcugcugucagagagacuagaccugggguugaggauggaaauccagagagcagggaggcagcugcugucauccagauggugucuugagcugggaauucagggagggucugggggcaguggggaguagcggagacguggaggaauucaggaucuaagcagaagagcagacgggucuggcugauggauuagaucugcugagauggguuggaucugcugggguuuuggucugaggacguggaagaugggguuuccaauauccgacggaugggaaggcaguuagugagacguuucccucaccccaccucaccuccuugcacccugcucccuuugcuauuuuuuuuuuuugagacaguguuuugcuuuuguuguccaggcuggagugcgguggugcgaucucggcucacugcaaccuccaccucccagguucaagugauucuccugccucagccucccaaguagcugagauuucaggccuguaccaccacacccggcuaauuuugcacuuucaguagagaugggguuucacuauguuggucaugcuagucucgaauuccugaccucaggugauccacccaccuuggccucccaaacugcugggauuacagacaugagccacagcacccagccucccuucgcuuuugcuuuaaccucucccagguugcuuuaauacaucaggcaggguccagucucagagcuuuugcacuuagaucugcuccuccaccaggccuucccuuuaggcaacccccucucaagcugccccugcacagaccugcguauucuuuaccuaguuugcuguuuuuuguuauuguuuuguuuuaagagacaggguuugcucucguccccaggcuggagugcaaugcugcgaucauagcucacugcagcuucaaacuccuggccucaaucgauccucccgccucugccucccaaagagcugggauuacaggugugagccacugagcccagauuuacaaaauaguuuaaaaauuagcagggcauggugggucacaccuguaaucucagcauuuugggaggcagagguggaucacuugaggccaggggagaccagccuaggcaacauagcaagacccugacuauacagaaaauuuaaacauuagccagaugugguucugugcacuugcaguuccuuuuuuuuuuuuuuuuuuugguagagacagggucuggauacguugcccagucuggagucuggucuugaauuccuggccucaagcagucuucccgccuuaacacaggccugagccgccucaccaguccuacuguuauuuuuauauuuauuauuuuauuuuauuuuauuuuuuugagauggagucucgcucagucacccaggcugggcugcaguggcacaaucucggcucaccgcaagcucugccucccagguucacgccauucuccugccucagccucccaaguagcugggacuacaagugcccgccaccacgcccagcuaacuuuuuguauuuuuaguagagaugggguuucaccguguuagccaggauggucucgaucucuugaccucgugauccaccugccucagccucccaaagugcugggauuacaggagugagccaccgcgccuggcccuacuguuauuuuuagcauuuaacauugucuaauaugcucuauuuauucauccuauacaguacauauuuauuuuuuugcccacuaggggagggauuuuugucuguuuuguuccuaaauguauucccagugccuagaaagggggcuggcacacauuugugccuagugacugcuuuuuuuuuuuuuucuuuugagacagagucuugcucugucgcccaggcuugagugcaguggcgugaucgcagcucacugcagccuggaacugcugggcucaggcgaucuugggaugacaagcccuugccaccaugcccagcuaauuuuuguauuuuuuguauagacagggucucucuguguugucuaggcuggucuccaacuccuaggcucaagugaucagcccaccucggccucccaaagugcuggaauuaccggccugaacggccccauaagccuuguuuuuauuuauuuauuuauuuuugagaugggcuaucacuuuguugcccgggcuggagugcaggggagcgaucauggcucacugaagccuugaacuccugggcucaagugauccuccugccucagccucccgaauagcugggaccagaggugugcaccaccacgucugucuaauuuuuuuuuuuuuuuuuuguagagacaggggucuccccauguugcccaggcuggucucgaacuccuggucucaagcgauccucucgccucggccucccaaagugcugagcuugcaggcgugagcuacggcgcccggccucgcuugucgaaugaaugaaugcuugagaugcguuauccggccuggcgccaagagcucgguguugaagccagagugggaucacccuggggcccuccagccguggggggaaugagauggggacugaaauuaugggcccgggacaucgcggguguagacgcgcgcauccccgcguggaagcggaggggucucgcugggccccagcaccccgucuuccuuccguuccuccucugccugcagguccgccgcgauggggaagcccuggcugcgugcgcuacagcugcugcuccugcugggcgcgucgugggcgcgggcgggcgccccgcgcugcaccuacaccuucgugcugcccccgcagaaguucacgggcgcugugugcuggagcggccccgcauccacgcgggcgacgcccgaggccgccaacgccagcgagcuggcggcgcugcgcaugcgcgucggccgccacgaggagcuguuacgcgagcugcagaggcuggcggcggccgacggcgccguggccggcgaggugcgcgcgcugcgcaaggagagccgcggccugagcgcgcgccugggccaguugcgcgcgcagcugcagcacgaggcggggcccggggcgggcccgggggcggaucugggggcggagccugccgcggcgcuggcgcugcucggggagcgcgugcucaacgcguccgccgaggcucagcgcgcagccgcccgguuccaccagcuggacgucaaguuccgcgagcuggcgcagcucgucacccagcagagcagucucaucgcccgccuggagcgccugugcccgggaggcgcgggcgggcagcagcagguaaccucgcagccuccccggagagcagcaucgucugugaaauggggguuuugcaaccccacgaucucuuauccacaguucugaaauccgcaaaacccugaaaaccggauuccuacucgccccuucugguaacuuauuugggucaaaaagugacugguggcuauuuauagccuucacuuaaccacuuaaugugaauagucauaggauccuauaauuaaacauaucauuaucacguaaagaccaaaaaccccuuuaggaguguuauguauauucuauacacacaugcauauacauaacccucccugugucacugugucuaaauccagccguguuauucugaauucuggaacguguccuggucuggguuugggauaagagaauguugcucugugacagucccuacguuacaggguuggugagaggagucaguaaguuagauacuguuggauguguuguuauuaucccuacucuacagaggaggcuggggcacagaucaauuaaaccaugagcaccaagagccgguauuuaagcccagcucugucugcacuuuauuuuuuuaauuuuauuuuugagauggagucucgcucugucucccaggcuggagugcaguggugcaaucuuggcucacugcaaccuccaccucccagguucaagcgauccuccuaccucaaccuuccgaguagcuggcauuacaggcgugagccaacacacucaguuaauuuuuuuuguauuuuuaguagagacggagguuucaccauguuggucaggcuggucucgaacuccugaccucaggugauccgcccgccucggccucccaaagugcugggauuacaggcacgggccauagcgcccagccugucugcacuuuaaagccaaguuguuuagcuuuuggggaggaucauuccuagggcugggacacccccacugccagauguccaggucauuugggagcugggagauuuauccaccauuucugccccugagaccaggccuccuggccugaggguuagugcaauuacaccugacuuucuccgucaccccagguccugccgccacccccacuggugccugugguuccgguccgucuuguggguagcaccagugacaccaguaggaugcuggacccagccccagagccccagagagaccagacccagagacagcaggagcccauggcuucucccaugccugcaggucacccugcgguccccaccaagccuguggguaagucgacauuagggcugaggaauuguggguagaggaaaauugaggagucaggauuuuaguggcagauuucucucauugugagaagaccagaagaaaugauacuccuauucugauuaaaaauaagaccaaacuucuaaggugugaaaauaggagaaacaagaaauagaagaggagggacucuuacuuuagugaggcgauguuugggacugcuacuuugguaagaguuugaacugguucagaguaucauauucaggacuuauauuauggugaggagaccauaaaaaaccaggguuuaagaaccccagaguuggccgggcgcgauggcucaugccuguaaucccagcacuuugggaggccgaggcggguggaucacgaggucaggagaucaagaccauccuggcuaacacggugaaaccccauuucuacuaaaaauacaaaaaauuagcugggcgugguggcgggcgccuguagucccagcugcucgggaggcugaggcaggagaaaggcgugaaccugggaggaugagguugcagugagccgagaucgcaccacugcacuccagccugagugacagagcgagacuccaucucaaaaaaaaaaagaaccccagacuugacauuuccuuugauuagagacaagggacccagauucuuagguaaagaaauggcuauuggagcucggauucuggugaggaaaugggagaggcaggccucuuauucuggugaggaaaugggagaggcaggacucuuugguagaaaagugggagaggcagaacucuuauucuggugagaggaccugugagaaucuugacucuugcuccaguaagggauuggucagcccaggcugugccuccccccuaucccugugcccacaggcccguggcaggauugugcagaggcccgccaggcaggccaugaacagaguggaguguaugaacugcgagugggccgucacguagugucaguauggugugagcagcaacuggaggguggaggcuggacugugauccagcggaggcaagaugguucagucaacuucuucacuaccuggcagcacuauaaggugggcacaggugggcagaggcagggaaggggagggagccuguucuggcuuccugacuuuccugcccugccaggcgggcuuugggcggccagacggagaauacuggcugggccuugaacccguguaucagcugaccagccguggggaccaugagcugcugguucuccuggaggacugggggggccguggagcacgugcccacuaugauggcuucucccuggaacccgagagcgaccacuaccgccugcggcuuggccaguaccauggugaugcuggagacucucuuuccuggcacaaugacaagcccuucagcaccguggauagggaccgagacuccuauucugguaaggagaacuccuauucuggugagaggauaggggaggcgggacuccuguucuggugagggaaugaaaggagguaggguagguaagacgccccucugguaaguauaaggauaagcaagcuuuuauuccgucaagagaacaaaggucaggacuuuuauccugguggggggauggggaguccagauuccuucucugaugaggcaaaaaaagaaucaagacuccuguucaaguaaagggcagagggugagagcuaguacucuuauucuagaaaggaaguagauacuuuucuuugauaaaggaaugaacgguagacuccuaguuugcagaaaaggugggaaagaugugacuuguacuuugguaaggagauagggaaggaauuaaggcuauuacucugaagaaaguuggggggccagggcuccuauuuuuuugcugaggagauggaagaucagggcuuguauucaauaagaaugggaggggccaggggaugccuggcaaaagccuugcacugugaggugcagguagaggcuuuuauucuggugagaggacauggacucucucucuccccucagguaacugugcccuguaccagcggggaggcuggugguaccaugccugugcccacuccaaccucaacgguguguggcaccacggcggccacuaccgaagccgcuaccaggauggugucuacugggcugaguuucgugguggggcauauucucucaggaaggccgccaugcucauucggccccugaagcugugacucuguguuccucuguccccuaggcccuagaggacauuggucagcaggagcccaaguuguucuggccacaccuucuuuguggcucagugccaaugugucccacagaacuucccacuguggaucugugacccugggcgcugaaaaugggacccaggaaucccccccgucaauaucuuggccucagauggcuccccaaggucauucauaucucgguuugagcucauaucuuauaauaacacaaaguagccacagaccgu

SEQ ID NO: 15883 - RNA, 4951 nt, Homo sapiens
cggaagugagcugcgcagcgccggaagcggcggacgcaggaggccucguggaggacacagcagcaugggacagucagggaggguaaggcccggcagcuugggaggcagguggcgcagguggggucccggccgaggucgcggcgcugacccuuugucucucgucgccgcagucccggcaccagaagcgcgcccgcgcccaggcgcagcuccgcaaccucgaggccuaugccgcgaacccgcacucguucguguucacgcgaggcugcacgggucgcaacauccggcagcucagccuggacgugcggcgggucauggagccgcucacugccagccgucugcagguuuguaccccacccccagcccgccuccacccacccucggccuagucuucguagcugcaguaauggcucccgcuguaaaacugugggaggacuuaagucuccccagcuggaaaaaaagacccucauggggagcaucauuucugccuuucagggcuuuugcugggcuggagugagggcgcgcagcuugggagauagauagucgccuaagccugacaguuaagacuggaaucuggagccgggcgugguggcucaugccuguauucccagcauuuggggaugcugaugcgggaggaucacuugagcccaggaauucgagaccagccugagcagcauggugaaaccccgucuuuacaaaaaauagaaaaauuagucggauaugguguugcgugccuguagucccggcuacucgggaggcugaggugggaggauuccuugagcccaggaaauuaaggcuguagugaaucgggaucgugccacuucacuccagucugggcgaccggaggagaccguguuagaaaaaaaaagacuagaaucuggaggcagcaaagcaggguuggaaacugacuucuccccaguaucugaugcaaguuacuuaaccucucugggccugaguucgcucauuugucaaugggaagaugcgcugugagcaagagacagaguuagaacucaaaucugcguccgacugacucuaaaggcuaagauccuuuugcuccucugggcuuguugaaagggucagaugcaagacagaccauaacaggaucugcaccgucagcuuauaguugucacaacaagggauaagcuauguuuucuuuuuuucuuuuugucauuuccagguucguaagaagaacucgcugaaggacugcguggcaguggcugggccccucggggucacacacuuucugauccugagcaaaacagagaccaaugucuacuuugugaguagacgcccucacccuucaucucccccagacccccccuuccccuaucucucaugaugaacacauaugccucugagcugcugugauuucuggcuucaaaguaaacgcucugaagaagagauggggcaaaggugccuacuccgggcaccucugcuagaccccuccagagucacugaucuuuucuucuccugcagaagcugaugcgccucccaggaggccccaccuugaccuuccaggucaagaaggugagagggguggaggugguacaaagccauguggggugggagcuggacuugggguuguccgcagccaugugugguugguggucacccccuccucucuccuguccuacaguacucgcuggugcgugauguggucuccucacugcgccggcaccgcaugcacgagcagcaguuugcccacccaccccuccugguacucaacagcuuuggcccccaugguaugcaugugaagcucauggccaccauguuccagaaccuguuccccuccaucaacgugcacaaggugggucuggccuggcgagguggcagguaugggggggugcagcggauagaggugccacaggcccucagauggauugcucacuccucccagcgcugagacugggagcuccugggucugcugaguccugaggucaaaucccacuccugugucugaugaugcugggcaaaaguguccagagauucccccagcgguccacaccccgugagcugcaccuuuuccagccgguggaaagaaauacugauggagcucuguuucccacguguguugagugcugggcugagcaggaucguagcaucucuucuuagggcccuguuuuacagagggaagcugcgggcccagugcuauggcuucggccuguaaucccaguacuuugggagggcgaggugggaggaucgcuugaagccaagacuuugagaucagccugugcaacauagcgagaccccaugucuacaaaaaguagauuuuuaaaaagcccgguguggcggugcaugccuguaguaccagcuacuggggaggcugaggugggaggaucaccugagcccaggaggucaaggcugcagugaguuguguucacgccacucuacuccauccugggugacaaagcgagacacugucucaaaaaaaaaaaaaaaagcaaaucugaggcuggcagagaugcuaaguuuagauuccagggggcaggacuggauuuuuaauuucaucuggcuccugaguccuagcuccuaauccuugucacuagugacucucagaugggacuuauaaauuauauauaagauaucagucaucagggaggcuaauacggcucugggaccagaauuucuuguuuaccuuuuuuuuuuuuuuuugagacggagucuugcucugucucccaggcuggagugcgguggcacaaucucaucucauugcaagcuccgccucccagguucacgccauucuccugccucagccucccgaguagcugggacuacaggugcccgccaccacaccccggcuaauuuuuuguauuuuuaguagagacaggauuucaccguguuagccaggguggucuugaucugaccucgugagcugcccgccucggccucccaaagugcugggauuacaggcgugagccaccgugcccggccuucuuuacuuuuuuuuuaagagacggggucuccguacguuggucuugaacuccugggcacaagcaauccugcagccuccgcuucccgaguagcugagacuacaggcgugcaccaccacauccaacucauuuuuccaucuacuuuuuguagacauggagacucgccguguugcccaggcugguuuugaacuccugggcucaggcagucccaccacuucagccucuggaguagcuaaaacugcaggugcgagcuggaagcagcauuucuagccagugccacaguccacgaacaguguguguaucccccaaagcccccacuuccccaaacuuugccaugagucuacuggacuaugcucucuuccuccccuuccaggugaaccugaacaccaucaagcgcugccuccucaucgacuacaaccccgacucccaggagcuggacuuccgccacuagugagugucccagcaggaugggagacgagggggugccgggugggggccuccacaugcggcugaugacagcacuucugcugagacgcugugauugcucuguccaaaguaaacgcccugacgcacugugggaagggugagaugggcaccgccagccccaucacgugcccccugaccacccccuugccguccacucauguuccugcaguagcaucaaaguuguuccugugggcgcgagucgcgggaugaagaagcugcuccaggagaaguuccccaacaugagccgccugcaggacaucagcgagcugcuggccacgugaggagggcauagggcgggaggccacugcggcccggggaccccagaacaggaccgggagccugagcucccccacugagcccuguuauguccuacacacaggggcgcggggcugucggagagcgaggcagagccugacggcgaccacaacaucacagagcugccucaggcugucgcuggccguggcaacaugcgggcccagcagagugcagugcggcucaccgaggugaggcccagggcagggggacccccgggcuccaccagucccaacggugggcugacgcuucuuccucguccccucagaucggcccgcggaugacacugcagcucaucaagguccaggagggcgucggggagggcaaagugauguuccacaguuuuggugaggccggggccgccggggguggggggucauggguguggagcugcacccggaucuuggugacccgcgucucuuggcucagugagcaagacggaggaggagcugcaggccauccuggaagccaaggagaagaagcugcggcugaaggcgcagaggcaggcccagcaggcccagaaugugcagcgcaagcaggagcagcgggaggcccacagguccaggcagagcugggaagggcagggccaagggggggucccugggaugggcggcuauguugacccccacgcccuccuccagaaagaagagccuggagggcaugaagaaggcacgggucggggguagugaugaagaggccucugggaucccuucaaggacggcgagccuggaguugggugaggacgaugaugaacaggaagaugaugacaucgaguauuucugccaggcggugggcgaggcgcccagugaggguauggaguggggucugcagcagggcacccagagccuguccuugucucugggggcccugacacugucucuccccacagaccuguuccccgaggccaagcagaaacggcuugccaagucuccagggcggaagcggaagcggugggaaauggaucgaggcaggggucgccuuugugaccagaaguuucccaagaccaaggacaagucccagggagcccaggccaggcgggggcccagaggggcuucccgggauggugggcgaggccggggccggggccgcccagggaagagaguggccugagcccaagccgcaccggagcagcggcuggauugaacgccccagauuggggcccgagauguggcccucgguuuccuuucauaaaggaguuguguccccagcccuuccacuccaguaaa

SEQ ID NO: 15884 - RNA, 4951 nt, Homo sapiens
uuuacuggaguggaagggcuggggacacaacuccuuuaugaaaggaaaccgagggccacaucucgggccccaaucuggggcguucaauccagccgcugcuccggugcggcuugggcucaggccacucucuucccugggcggccccggccccggccucgcccaccaucccgggaagccccucugggcccccgccuggccugggcucccugggacuuguccuuggucuugggaaacuucuggucacaaaggcgaccccugccucgauccauuucccaccgcuuccgcuuccgcccuggagacuuggcaagccguuucugcuuggccucggggaacaggucuguggggagagacagugucagggcccccagagacaaggacaggcucugggugcccugcugcagaccccacuccauacccucacugggcgccucgcccaccgccuggcagaaauacucgaugucaucaucuuccuguucaucaucguccucacccaacuccaggcucgccguccuugaagggaucccagaggccucuucaucacuacccccgacccgugccuucuucaugcccuccaggcucuucuuucuggaggagggcgugggggucaacauagccgcccaucccagggacccccccuuggcccugcccuucccagcucugccuggaccugugggccucccgcugcuccugcuugcgcugcacauucugggccugcugggccugccucugcgccuucagccgcagcuucuucuccuuggcuuccaggauggccugcagcuccuccuccgucuugcucacugagccaagagacgcgggucaccaagauccgggugcagcuccacacccaugaccccccacccccggcggccccggccucaccaaaacuguggaacaucacuuugcccuccccgacgcccuccuggaccuugaugagcugcagugucauccgcgggccgaucugaggggacgaggaagaagcgucagcccaccguugggacugguggagcccgggggucccccugcccugggccucaccucggugagccgcacugcacucugcugggcccgcauguugccacggccagcgacagccugaggcagcucugugauguuguggucgccgucaggcucugccucgcucuccgacagccccgcgccccuguguguaggacauaacagggcucagugggggagcucaggcucccgguccuguucugggguccccgggccgcaguggccucccgcccuaugcccuccucacguggccagcagcucgcugauguccugcaggcggcucauguuggggaacuucuccuggagcagcuucuucaucccgcgacucgcgcccacaggaacaacuuugaugcuacugcaggaacaugaguggacggcaaggggguggucagggggcacgugauggggcuggcggugcccaucucacccuucccacagugcgucagggcguuuacuuuggacagagcaaucacagcgucucagcagaagugcugucaucagccgcauguggaggcccccacccggcacccccucgucucccauccugcugggacacucacuaguggcggaaguccagcuccugggagucgggguuguagucgaugaggaggcagcgcuugaugguguucagguucaccuggaaggggaggaagagagcauaguccaguagacucauggcaaaguuuggggaagugggggcuuugggggauacacacacuguucguggacuguggcacuggcuagaaaugcugcuuccagcucgcaccugcaguuuuagcuacuccagaggcugaaguggugggacugccugagcccaggaguucaaaaccagccugggcaacacggcgagucuccaugucuacaaaaaguagauggaaaaaugaguuggaugugguggugcacgccuguagucucagcuacucgggaagcggaggcugcaggauugcuugugcccaggaguucaagaccaacguacggagaccccgucucuuaaaaaaaaaguaaagaaggccgggcacgguggcucacgccuguaaucccagcacuuugggaggccgaggcgggcagcucacgaggucagaucaagaccacccuggcuaacacggugaaauccugucucuacuaaaaauacaaaaaauuagccggggugugguggcgggcaccuguagucccagcuacucgggaggcugaggcaggagaauggcgugaaccugggaggcggagcuugcaaugagaugagauugugccaccgcacuccagccugggagacagagcaagacuccgucucaaaaaaaaaaaaaaaagguaaacaagaaauucuggucccagagccguauuagccucccugaugacugauaucuuauauauaauuuauaagucccaucugagagucacuagugacaaggauuaggagcuaggacucaggagccagaugaaauuaaaaauccaguccugcccccuggaaucuaaacuuagcaucucugccagccucagauuugcuuuuuuuuuuuuuuuugagacagugucucgcuuugucacccaggauggaguagaguggcgugaacacaacucacugcagccuugaccuccugggcucaggugauccucccaccucagccuccccaguagcugguacuacaggcaugcaccgccacaccgggcuuuuuaaaaaucuacuuuuuguagacauggggucucgcuauguugcacaggcugaucucaaagucuuggcuucaagcgauccucccaccucgcccucccaaaguacugggauuacaggccgaagccauagcacugggcccgcagcuucccucuguaaaacagggcccuaagaagagaugcuacgauccugcucagcccagcacucaacacacgugggaaacagagcuccaucaguauuucuuuccaccggcuggaaaaggugcagcucacgggguguggaccgcugggggaaucucuggacacuuuugcccagcaucaucagacacaggagugggauuugaccucaggacucagcagacccaggagcucccagucucagcgcugggaggagugagcaauccaucugagggccuguggcaccucuauccgcugcacccccccauaccugccaccucgccaggccagacccaccuugugcacguugauggaggggaacagguucuggaacaugguggccaugagcuucacaugcauaccaugggggccaaagcuguugaguaccaggaggggugggugggcaaacugcugcucgugcaugcggugccggcgcagugaggagaccacaucacgcaccagcgaguacuguaggacaggagagaggagggggugaccaccaaccacacauggcugcggacaaccccaaguccagcucccaccccacauggcuuuguaccaccuccaccccucucaccuucuugaccuggaaggucaagguggggccuccugggaggcgcaucagcuucugcaggagaagaaaagaucagugacucuggaggggucuagcagaggugcccggaguaggcaccuuugccccaucucuucuucagagcguuuacuuugaagccagaaaucacagcagcucagaggcauauguguucaucaugagagauaggggaagggggggucugggggagaugaagggugagggcgucuacucacaaaguagacauuggucucuguuuugcucaggaucagaaagugugugaccccgaggggcccagccacugccacgcaguccuucagcgaguucuucuuacgaaccuggaaaugacaaaaagaaaaaaagaaaacauagcuuaucccuuguugugacaacuauaagcugacggugcagauccuguuauggucugucuugcaucugacccuuucaacaagcccagaggagcaaaaggaucuuagccuuuagagucagucggacgcagauuugaguucuaacucugucucuugcucacagcgcaucuucccauugacaaaugagcgaacucaggcccagagagguuaaguaacuugcaucagauacuggggagaagucaguuuccaacccugcuuugcugccuccagauucuagucuuuuuuuuucuaacacggucuccuccggucgcccagacuggagugaaguggcacgaucccgauucacuacagccuuaauuuccugggcucaaggaauccucccaccucagccucccgaguagccgggacuacaggcacgcaacaccauauccgacuaauuuuucuauuuuuuguaaagacgggguuucaccaugcugcucaggcuggucucgaauuccugggcucaagugauccucccgcaucagcauccccaaaugcugggaauacaggcaugagccaccacgcccggcuccagauuccagucuuaacugucaggcuuaggcgacuaucuaucucccaagcugcgcgcccucacuccagcccagcaaaagcccugaaaggcagaaaugaugcuccccaugagggucuuuuuuuccagcuggggagacuuaaguccucccacaguuuuacagcgggagccauuacugcagcuacgaagacuaggccgaggguggguggaggcgggcugggggugggguacaaaccugcagacggcuggcagugagcggcuccaugacccgccgcacguccaggcugagcugccggauguugcgacccgugcagccucgcgugaacacgaacgagugcggguucgcggcauaggccucgagguugcggagcugcgccugggcgcgggcgcgcuucuggugccgggacugcggcgacgagagacaaagggucagcgccgcgaccucggccgggaccccaccugcgccaccugccucccaagcugccgggccuuacccucccugacugucccaugcugcuguguccuccacgaggccuccugcguccgccgcuuccggcgcugcgcagcucacuuccg

SEQ ID NO: 15885 - RNA, 5152 nt, Homo sapiens
gccccccgguaugagauugucaucaucacugugguagcagccgcagucauaaugggcacugcaggccucagcacguaccucuauaaccgccagcggaagaucaagaaauacagacuacaacaggcccaaaaagggacccccaugaaaccgaacacacaagccacgccucccugaaccuaucccgggacagggccucuuccucggccuucccauauugguggcaguggugccacacugaacagaguggaagacauaugccaugcagcuacaccuaccggcccugggacgccggaggacagggcauuguccucagucagauacaacagcauuuggggccaugguaccugcacaccuaaaacacuaggccacgcaucugaucuguagucacaugacuaagccaagaggaaggagcaagacucaagacaugauugauggauguuaaagucuagccugaugagaggggaaguggugggggagacauagccccaccaugaggacauacaacugggaaauacugaaacuugcugccuauuggguaugcugaggccccacagacuuacagaagaaguggcccuccauagacauguguagcaucaaaacacaaaggcccacacuuccugacggaugccagcuugggcacugcugucuacugaccccaacccuugaugauauguauuuauucauuuguuauuuuaccagcuauuuauugagugucuuuuauguaggcuaaaugaacauaggucucuggccucacggagcucccaguccuaaucacauucaaggucaccagguacaguuguacagguuguacacugcaggagagugccuggcaaaaagaucaaauggggcugggacuucucauuggccaaccugccuuuccccagaaggagugauuuuucuaucggcacaaaagcacuauauggacugguaaugguuacagguucagagauuacccagugaggccuuauuccucccuuccccccaaaacugacaccuuuguuagccaccuccccacccacauacauuucugccaguguucacaaugacacucagcggucaugucuggacaugagugcccagggaauaugcccaagcuaugccuuguccucuuguccuguuugcauuucacugggagcuugcacuaugcagcuccaguuuccugcagugaucaggguccugcaagcaguggggaagggggccaagguauuggaggacucccucccagcuuuggaagccucauccgcguguguguguguguguauguguagacaagcucucgcucugucacccaggcuggagugcaguggugcaaucaugguucacugcagucuugaccuuuugggcucaagugauccucccaccucagccuccugaguagcugggaccauaggcucacaacaccacaccuggcaaauuugauuuuuuuuuuuuuuccagagacggggucucgcaacauugcccagacuuccuuuguguuaguuaauaaagcuuucucaacugccucagccuugugugaguugaggggaggugucacauccagcuggaguccuuucuaagcagccacagccugauccucccacuuccucccccaagaaaacauuguggguugauggccauacccugagguucugguccaaaucggacuuucuaugaccuucugggucucuagugaaaacuaaagacuccucuccagaaaaaaacauuugguuucuaaugaggccuggaaucuuauucuugaccuggggagcggaaucccuuuuugcaguacucccgggcccucuguuggggccuccccuuccucuccaggguggagucgaggaggcggggcugcgggccuccuuaucucuagagccggcccuggcucucuggcgcggggccccuuaguccgggcuuuuugccauggggucucuguucccucugucgcugcuguuuuuuuuggcggccgccuacccgggaguugggagcgcgcugggacgccggacuaagcgggcgcaaagccccaaggguagcccucucgcgcccuccgggaccucagugcccuucugggugcgcaugagcccggaguucguggcugugcagccggggaagucagugcagcucaauugcagcaacagcuguccccagccgcagaauuccagccuccgcaccccgcugcggcaaggcaagacgcucagagggccggguugggugucuuaccagcugcucgacgugagggccuggagcucccucgcgcacugccucgugaccugcgcaggaaaaacacgcugggccaccuccaggaucaccgccuacagugagggacaggggcucggucccggcuggggugaggggagggggcuggaagaggugggggaaggguaguugacagucgcucuauagggagcgcccgcggaccucacucagaggcucccccuugccuuagaaccgccccacagcgugauuuuggagccuccggucuuaaagggcaggaaauacacuuugcgcugccacgugacgcagguguucccggugggcuacuugguggugacccugaggcauggaagccgggucaucuauuccgaaagccuggagcgcuucaccggccuggaucuggccaacgugaccuugaccuacgaguuugcugcuggaccccgcgacuucuggcagcccgugaucugccacgcgcgccucaaucucgacggccuggugguccgcaacagcucggcacccauuacacugaugcucggugaggcaccccuguaacccuggggacuaggaggaagggggcagagagaguuaugaccccgagagggcgcacagaccaagcgugagcuccacgcgggucgacagaccucccuguguuccguuccuaauucucgccuucugcucccagcuuggagccccgcgcccacagcuuuggccuccgguuccaucgcugcccuuguagggauccuccucacugugggcgcugcguaccuaugcaagugccuagcuaugaagucccaggcguaaagggggauguucuaugccggcugagcgagaaaaagaggaauaugaaacaaucuggggaaauggccauacaugguggcugacgccuguaaucccagcacuuugggaggccgaggcaggagaaucgcuugagcccaggaguucgagaccagccuggacaacauagugagaccccgucuaugcaaaaaauacacaaauuagccuggugugguggcccgcaccuguggucccagcuacccgggaggcugaguugggaggauccuuugagcccugaaagucgagguugcagugagccuugaucgugccacugcacuccagccugggggacagagcacgacccugucuccaaaaauaaaauaaaaauaaaaauaaauauuggcgggggaacccucuggaaucaauaaaggcuuccuuaaccagccucuguccugugaccuaaggguccgcauuacugcccuucuucggaggaacugguuuguuuuuguuguuguuguuguuuuugcgaucacuuucuccaaguuccuugucucccugagggcaccugagguuuccucacucagggcccaccuggggucccgaagccccagacucuguguauccccagcgggugucacagaaaccucuccuucugcuggccuuaucgagugggaucagcgcgggccggggagagccacgggcaggggcggggugggguucaugguauggcuuuccugauuggcgccgccgccaccacgcggcagcucugauuggauguuaaguuuccuaucccagccccaccuucagacccugugcuuuccuggaggccaaacaacuguggagcgagaacucaucuccaaaauaacuuaccacgcuggagugagaccacgaaugguggggaggggagggucccacggacauauugagggacguggauacgcagaagagguauccaugugguggcagccgggaaggggugaucagaugguccacagggaauaucacaaacucgaauucugacgauguucugguagucacccagccagaugagcgcauggaguuggggguggggggugucaaagcuuggggcccggaagcggagucaaaagcaucacccucggucccuuguucucgcguggaugucagggcccccacccaccgagcagaaggcggacucaggggcgcuccaggguggcucgagcucacacacgcugaguagacacgugcccgcugcacccuggguaaauacagacccggagccgagcggauucuaauuuagacgcccgcgaacgcugcgcgcacgcacacguguccucggcucgcuggcacuuucgucccgcccccuccgucgcgugcgggagcugacccggaggggugcuuagagguauggcuccgcggggucaaaaggagaaggaucagugagagaggcauccccacacccuccccuagaacuguccuuuccccauccagugccucccaaaucucucuuaguccccaaauguauccccgcccuaaggggcgcuggugggaggagcuaaaugugggggcggggcucggaguccagcuuauuaucauggcaucucagccagggcugggguagggguuugggaagggcaacccagcaucccccgaucccagagucgcggccggggaugacgcgagagagcguggucgcccccagaaggcccugggccaucaugccggccuccacguagaccccaggggucgcucacuccugccagcucgccuucaccaaggccaggagcuuagcgcacgcucgccucccgcccccccgccgccucugccgccgcccccuccuuggaaaccaaguuaccaacguuaaaccaauccccaagcgcaacucugccucccccacaccccacccgccgcgccgcgcggagccguccucuagcccagcuccucggcucgcgcucuccucgccuccugugcuuuccccgccgcggcgaugccagggccuucgccagggcugcgccgggcgcuacucggccucugggcugcucugggccuggggcucuucggccucucagguaagagccccgcucugguucgggguggacagggcgggggcggagucccuggaccugagaaacggccuccugucccucccagcucugcccucgccucgcucccacgccucugcccccaccucgagccugagucuucuccc

SEQ ID NO: 15886 - RNA, 1592 nt, Homo sapiens
acagaggcugguuaaggaagccuuuauugauuccagaggguucccccgccaauauuuauuuuuauuuuuauuuuauuuuuggagacagggucgugcucugucccccaggcuggagugcaguggcacgaucaaggcucacugcaaccucgacuuucagggcucaaaggauccucccaacucagccucccggguagcugggaccacaggugcgggccaccacaccaggcuaauuuguguauuuuuugcauagacggggucucacuauguuguccaggcuggucucgaacuccugggcucaagcgauucuccugccucggccucccaaagugcugggauuacaggcgucagccaccauguauggccauuuccccagauuguuucauauuccucuuuuucucgcucagccggcauagaacaucccccuuuacgccugggacuucauagcuaggcacuugcauagguacgcagcgcccacagugaggaggaucccuacaagggcagcgauggaaccggaggccaaagcugugggcgcggggcuccaagcugggagcagaaggcgagaauuaggaacggaacacagggaggucugucgacccgcguggagcucacgcuuggucugugcgcccucucggggucauaacucucucugcccccuuccuccuaguccccaggguuacaggggugccucaccgagcaucaguguaaugggugccgagcuguugcggaccaccaggccgucgagauugaggcgcgcguggcagaucacgggcugccagaagucgcgggguccagcagcaaacucguaggucaaggucacguuggccagauccaggccggugaagcgcuccaggcuuucggaauagaugacccggcuuccaugccucagggucaccaccaaguagcccaccgggaacaccugcgucacguggcagcgcaaaguguauuuccugcccuuuaagaccggaggcuccaaaaucacgcuguggggcgguucuaaggcaagggggagccucugagugagguccgcgggcgcucccuauagagcgacugucaacuacccuucccccaccucuuccagcccccuccccucaccccagccgggaccgagccccugucccucacuguaggcggugauccuggagguggcccagcguguuuuuccugcgcaggucacgaggcagugcgcgagggagcuccaggcccucacgucgagcagcugguaagacacccaacccggcccucugagcgucuugccuugccgcagcggggugcggaggcuggaauucugcggcuggggacagcuguugcugcaauugagcugcacugacuuccccggcugcacagccacgaacuccgggcucaugcgcacccagaagggcacugaggucccggagggcgcgagagggcuacccuuggggcuuugcgcccgcuuaguccggcgucccagcgcgcucccaacucccggguaggcggccgccaaaaaaaacagcagcgacagagggaacagagaccccauggcaaaaagcccggacuaaggggccccgcgccagagagccagggccggcucuagagauaaggaggcccgcagcccc

SEQ ID NO: 15887 - RNA, 1645 nt, Homo sapiens
gacacgcagaggcaaagagacacgcagagacaaagagacacgcaggcgagagacucugagauccuccugagagagauacagaggaagugagggagacacucauucauuaucugggcaugguugcaagcgacuggagucccagcagcuacguucagccggcugagaugggaggauggcuugagccgcggaggucgagacugcagugacuuaugauguugccacugcacuccacucugggccacagagcaagaucuugucucaaaaaaaaaaaaaaaaaagaaauucuuacauugcugggguuuacugucugcuaaggacacagcccagaaacaccauuaaugaguaaaucacuuugucgucagcgauaagggugggagagaaucggucgggggaacacggaauccagggggugggacaggagagacccuccuuaucugaggagcggcaaguucccaucacaauccugcccgggcccgccccacccccacucgcccugagccgggggcgggagcgggaaauugggaggggccugugcccgggagcagcgggaaccuaucugcuggugggagaggacucaggcuaagguggcccccacugaagacuccugcuaagcaacccacugaagaccccuccgaaucaucgacggggcguccuuggggugcagcccaggaagcucaguucacaggugggugggcaaugggagggcgcagugcccggacacccaggacagaggagaccccuccgcuggggagaagaggcucaggcugcgaccgcccugcugcagaacccucccuuucccgccucuccgaguccucccaccgcgauggagcgucccugggaggacagcccaggcccggagggggcagcugagggcucgccugugccagucgccgccggggcgcgcuccggugccgcggcgaguggcacaggcuggcagccaugggcugagugcccgggacccaaggggagggggcaacugcuggcgaccgccggcccuuugcgucgcuggcccgcccccucgccugccagcuccagccccgcccccggagcggcguccgcucacucgguucaaggcagcgcgacugcggguggcgcacgaccagggcgcagagugaguggacugcacuggaccuuugggggcgcugggcugggccugacccggagggggucgcccuggcggccacuuucccggucuaaaaaggcgcaccacuccuugcagggaguucuccgaacuuuuccuggaggccucuggggagggggaagcugggggcuccccagcugggugcaggaccugggauacggggugaagguggcuggaauccccuggccacccccuccuggccgggccacugcaaguuuccauacuucaguccugcugccgggcaagcugggcggaugggguuggccucccccucagagcauguguaacccugucucccuguauuugggcuccccaccuccagcaugggugagccagcgacuuccugucuauguuugccugccuugauucucugugugugacugaagcucucugggauguccgcaucccugccuugugcaaaagagauccauuccccuccccaggccuuggcuuucucaucuggacuugcauggggacuauuugugcauggauguuuguguggga

SEQ ID NO: 15888 - RNA, 2165 nt, Homo sapiens
ucugaacuaaagaauauuccagacaacacuggggccugcagacuccauucacaaaucccagggaccaagagccacccacauaagcaaggggccccagcaccacggaacagggagaggagcaccugccaauguccugcggccuccuccugcuuuccagcugugaaugaggcccugguucccacacuucauucacagucugggcggcuacuguaacuacaucccacgagaccacacacaaagcaucacgcacaagggacaguggcagcacucugagcaauccauggagauucccauccacaaauaccugaggaaaagagagcuuaaaguccuaaauuugaauccuaacuucggauggcaccucgcgauuccauguggaccacaaauaugccaucacaccacucauuuuaaagagagcaaaaucuugaaaaagauucagcagcagugaauuaccggaguccagaaaaagaaaccacugaaaccgacgcuucguugcugauccaugucaccuaagcagcaacuggcaaacaauguuggaaauguggagaagagaucccucauucuccucaaauuuggccacugaacugggggaggagcaugcagaccgccguacaccccaaauaauucauccaggcggugaauuaacuggggcagaaccucaugaguaaccucgagaaucucaaucguucaacuacuugagaaaauaaagguagaaauggguuuuaagcauccacguuucggggcccaggcuugcacccaaguagauugccggucuagagaaggcaaauacuaacaaucuggaaaaacauucaacaaugaaaacaaacuaacuaaagaaaaagcugaaacccucucaaguuuugacccugaucugagagaggccuggcugaccagagauuuggaaacccgacgaacccacaaaggcuuccucagcaauccgcgugggaaggggcuuccaaggaggggguccgccucuccgcgaccugugaggacaaaggaggcgacuuuucccgccucgggaaccugggacucuccuggaaucgggggcgggaccgggacaaagaggaggaggggguagggaaggagugaggaaggggggucgccccgccgcggaacucgggacccgagggggugugugcuccaagcacgugcgcgcguccccaggacccccgcaacagacaaaagcccagccgcggggaggcggcagccgggggcccggugcgcgcgcacccccccgcgcguggcgccgccgccggccgaggggccgcgugcgggggggagcggcugcgcgcgcaccgaguccucgccgccgccgcagccgccauuuuguuuccuccgcacaauggaagagaguuaacggccgagcgcgggagcgaggccggcaagggaggaacgggccaggcgccgggaugagggaaccgggcggaggcggcgagcgugggaucccuccagccuugucaccgcgaacccucaguggggaucucacugagggcgggcggggggaggggcagaggcgggagcgggcccggccgccgccacauugacgcuuaccuugucggcguccccuucuucgaccgcagccgccgccgccgcccuccugccacagcccgccggggucugcccccaaaagccacgcggugcgcgccgggcugcuggguccaacugcaauggcgagaagaggaggaggaggaguccggaccgggggcgagcgggcgggcgggcaggcgcgcgccggggaggugcgggaacacgugaccggcugaagccccgcccccuuugacgccgcguugcgccucgacgcaggcccaacccaaaugggagggaggggcgaaaagagauaaggggggggcugagggggugggcgugaguugcacguggugcaagcgggaguguuugcgugcguagucacgugacuucggcaccuuucccuccgcuuucgauagguugcuccaucaugugacaauggcgaauuucgcgguuuccuucgccaucugacaacuuuuggcgccuucccuuugccguacugggaguccuccaucacgugacgagggcacgcucugguuuucgcuaaggcguuuuuugagcggccauuaccacgugaugcaaggcaagcgucagaggcggagccucccuacggcugcgacauuuugcgccugcgcggccgccau

SEQ ID NO: 15889 - RNA, 4073 nt, Homo sapiens
cggggcagggcuagcgcuuaaaggagccgcgaccccuuugcagaccagagggugacccggaugauggcggccggcgcggcccuagcccuggccuuguggcuacuaaugccaccaguggaggugggaggggcggggcccccgccaauccaggacggugaguucacguuccuguugccggcggggaggaagcaguguuucuaccaguccgcgccggccaacgcaagccucgagaccgaauaccagguagagggucgcgggcugggcggccagcagagucagggagagggggcguggccaagcggucgaggcgaggcgcgcuuuaggaggaagggggaggaauccgugcuugggagcgcgggggcggagcuagaaagagauggacagauggggcggggacggugugugggagcggaaggggagggaguaaugaagcaggcggggcuagaguaagagauccagagggggcggggccaucgauaaguauagggagccucugagaggacaggacucuggcuggugggcguggcgauagugcugauaggucaacugcgggggcguugcccacacaggccuuucucggggguuagacuaaggaaaaaggcugggccuauccucuuucggaggcggagccaaccaggggcguggucagguaaacguccauuaaguacuuuugguaggugcguggucagcugaaaguauggaccccaagcugucauaucaaugaggguggaggcaaggggcgcagccacugggacagguuggggcgggugugggugugccgccguucagguaagcccuugguggucuguauugaucaguguugguucagccguagcccucuucggcaggcgcccuuggccuaccgcuagcccuccacccgcucuuaccugccccccaggugaucggaggugcuggacuggacguggacuucacgcuggagagcccucagggcgugcuguuggucagcgagucccgcaaggcugaugggguacacacgugaguucagucuugaugccugccuggguucaguuacagcccugcccuucccaggcggccucagguuaccgcccugacugccccgcugagucggcuggcuggccacccugggucaugucugugugucugucugcccaggguggagccaacggaggccggggacuacaagcugugcuuugacaacuccuucagcaccaucuccgagaagcugguguucuuugaacugaucuuugacagccuccaggaugacgaggaggucgaaggaugggcagaggcuguggagcccgaggagaugcuggauguuaaaauggaggacaucaagguguguccaggcugcgcuggggccacuccuuccagaucucuaggauucaccuggggugccccccuugggcugacccagccuccccuccguaguugugcccuccaacugaauuauaguaagaguagcagcucuuaaaauaaguaguucauuucaggccgggcacgguggcucacgccuguaaucccagcacuuugggaggcugaggcggguggaucaccugaggucaggaguuuugagaccagccuggccaacauggugaaaccccgucucuacuaaaaauacaaaaauuagccgggugugguggcgggcgucuguaaucccagcuacucaggaggcugaggccagagaaugacuugaacccaggagguggaaguugaaccugggaggcagagguugcagugagccgagaucgcaccauugcacuccagccugggcaauaagagcaaaacuccgucucaaaaaaaaaaaaaaaaaaaaaaguaguucauuucuagguauaaacccugguguaaagguuuaaggaacucauaucauaaauaacucauaccguaaaucuccaaaccaccuugugaagcagacccugugcucaagucauccccauuuuacagguggagaaagugagauacaagauggcugagcaacucacggccacacagaccaacuagcagaguugguauugaacccaugcugguuucagcaacuaugcucuuaaccacaagcaaauauguucuguacauuuauuaguauuuuaauuaacuacuuauuuauuuauuuucuaacagaucucucuuggucacccaggcuggauugcaguggcacgaucucagcucacugcaaccucugccucccagguucagccaauucuccugccucagccuccugaauagcugugccaccacgccugacugacuaauuuuuguauuuuuaguagagacaggguuucaccauguuggccaggcuggucucgaacuccugaccucaggggaucugucugccuuggcuucccaaagcucugggauuacaggugugagcuacggcgaggcaaggucuugcugugucacucaggcuggagugcaguggugugaucauagcccauugcagccucaaacuccugggcucaagcaauccugccaccucagugggacuacgggugugcaccaccaugccuaauuuuuuguuuucuguagagacgagguuucaccauguuggcuaggguggucuugaacuccuggguuuaagugauccuccuguguuuggauuacagguguaaucuugcuucagccuccugaguagcugggauugcaguugcacaucaccaccccuggcuaauuuuuuguagagaugggguuuugccauguagcccaggcuggucucaaacuccugggcucaagcgauccucccaccucagccuuccaaagugcuaggauuauaggcaugagccaccaugcucauccuuguacauuuauuuaggcauuaaauguucacagcaauuuggaagcuuauagaagaggaaacaggcucagauagguuaauuaaguugcucauggucacagccagugaguggcagggugaggauuugaacuuagccugaacaagucuguguuugcagcuguaccucccaggguuaauacagccucccuccguaucccccgguuuuuuuggucucugcucccugauggguggagggaggccugacccuuccccucccgcugcccuguaggaguccauugagaccaugcggacccggcuggagcgcagcauccagaugcucacgcuacugcgggccuucgaggcacgugaccgcaaccugcaagagggcaacuuggagcgggucaacuucuggucagcugucaacguggcggugcugcugcugguggcugugcugcaggucugcacgcucaagcgcuucuuccaggacaagcgcccggugcccacguagccccugccauggaaggaagaacgggacaaaggaggggcagcagggugugugcauaugagacuugggggucccuccccaauuuuaguuuccugccaaaacgggagugugcagucagggccugcggucuggccccaugagucuccuuccguccucagcgggcagggaacaccucuggcuuguagaagggacggcucaguggcugcaccgacgguccuggaaaucucacauggugggcacugcagcguuggaacgugagccucggauuuccuggccccucuacuguaaaugugccuuagccuaagccucccauccuguguuagcguugccuggugcggggcagggccuaacaaggaaaccugggcccuccaagccagguugaggucugguaacagaaugccaggaagggggccuggaagaccaccugccccggccccucuccugcaggggccccacacaggcaugagggauggcccggccaaagucuaggcagaagccuccuauaacaaagggugguguggccugggcauuggagucaauaaauuauggucagaaaaucacaagagccugcugauuggggcucagggacaccagccaggacagaccggcccccgagggggcagccagacaggugggaggggccucccacgaagcucagaagaaaggucgugcgggagccgauggagguggucgccuggcacaagagaaaaaucagaaagcaaaguuuaacugagccccaguugggccacgaggcuugggcuuccccacgaggugagagaagcagggccugaggguaggaaggggguggagcgcuggggu

SEQ ID NO: 15890 - RNA, 2493 nt, Homo sapiens
caggaagcgugaucccggcguggccuagccggacauucgccugaugcaacuaucgcaccacugccaggcccuugugcaaugcggggcaccaggucggccaguuaacgauugacuggggaucaguggggguaugaggcauaaaaggcuucagugacagugcuguggcuauaccuuagacccucagucaugccagugccugcucugugccugcucugggcccuggcaauggugacccggccugccucagcggcccccaugggcggcccagaacuggcacagcaugaggagcugacccugcucuuccaugggacccugcagcugggccaggcccucaacgguguguacaggaccacggagggacggcugacaaaggccaggaacagccugggucucuauggccgcacaauagaacuccuggggcaggaggucagccggggccgggaugcagcccaggaacuucgggcaagccuguuggagacucaggugggcaccguagcugcgacacugugggguggccaggaguccaaagaggaguucgugucuaggguaaccaaccauccugguuugcccaggacugaagggauuccugggauacaagauuuucagcgauaaacucaggcaaguccuuagguacacaaagaugaguuggacauccuacuagugacccacuguuuauuaagcagauggaggaggauauucugcagcugcaggcagaggccacagcugaggugcugggggagguggcccaggcacagaaggugcuacgggacagcgugcagcggcuagaaguccagcugaggagcgccuggcugggcccugccuaccgagaauuugaggucuuaaagguaaggagcucccccaacccuagugggcugagacccugauuuccggccagaacucgcuucugcaccuugagucccaaagaccucccagaucagccucccagcucuguggccucuacccugcauguccccagacaaaacucaaguccuuuugugugccucaguuucccuuuugugugccucaguugcaaauaagggcaacaccugauaucucacaguagggccagguacucaaugcagguaaaauauucagcauggggcgggcacacaguuggugcucaauaaauucuuuuuuuuuuuuuuuuugagacagagucucacuguugcccaggcuggagugcaguggugugaucuuggcucacugcaaccuccaccuccuagguucaagugauucuccugccucagccuccugaguagcuggaauuacaggugcaccagcuaauuuuuguauuuuuuaguagagaugggauuucaccauguuggccaggcuggucucgaacuccugaccucaagggaucugccugccucgguuucccaaagugcugggauuacaggugugagccacuacaccuggccaauaaauucuuacuacuagagaaacugguaacauuuugugagcacccaguaaguacccagcacuguucuaugcccuuuaauaauccauaugauggccgggcaugguggcucaugccuguaaucccagcacuuuggguagcuaagguggguggaacacuuaaggucaggaguucgagaccacccuggccaacauggugaaaccccgucucuacuaaaaauacaaaaaauuagcugggcgugguggcacaugccuguagucccagcuacucaggaggcuuagguaggagaaucgcuugaaccugggagguggagguugcagugagcugagaucgugucauugcacucagccugggugacagagagagacucaaaaaaaaaaaaaaauccauaggauguucaucaccuccccaugaagugaguccuauuuuauccccauuuuacagauggggaaacugaggccaaagagcauuguugacuugcugggucacacagauacaaugaggggcuggggcagagggucaggggaugggaggugagguggcugucggcugagguuuccauucugacccccacaggcucacgcugacaagcagagccacauccuaugggcccucacaggccacgugcagcggcagaggcgggagaugguggcacagcagcaucggcugcgacagauccaggagaggugagccuggcagggguuuggcaggcagggcaguuggauggggggcgcacagggcagcuggaaaggggcccccucaccugggcugagccacaucucccuccccagacuccacacagcggcgcucccagccugaaucugccuggauggaacugaggaccaaucaugcugcaaggaacacuuccacgccccgugaggccccugugcagggaggagcugccuguucacugggaucagccagggcgccgggccccacuucugagcacagagcagagacagacgcaggcggggacaaaggcagaggauguagccccauuggggagggguggaggaaggacauguacccuuucaugccuacacaccccucauuaaagcagagucguggcaucucac

SEQ ID NO: 15891 - RNA, 2493 nt, Homo sapiens
gugagaugccacgacucugcuuuaaugagggguguguaggcaugaaaggguacauguccuuccuccaccccuccccaauggggcuacauccucugccuuuguccccgccugcgucugucucugcucugugcucagaaguggggcccggcgcccuggcugaucccagugaacaggcagcuccucccugcacaggggccucacggggcguggaaguguuccuugcagcaugauugguccucaguuccauccaggcagauucaggcugggagcgccgcuguguggagucuggggagggagauguggcucagcccaggugagggggccccuuuccagcugcccugugcgccccccauccaacugcccugccugccaaaccccugccaggcucaccucuccuggaucugucgcagccgaugcugcugugccaccaucucccgccucugccgcugcacguggccugugagggcccauaggauguggcucugcuugucagcgugagccugugggggucagaauggaaaccucagccgacagccaccucaccucccauccccugacccucugccccagccccucauuguaucugugugacccagcaagucaacaaugcucuuuggccucaguuuccccaucuguaaaauggggauaaaauaggacucacuucauggggaggugaugaacauccuauggauuuuuuuuuuuuuuugagucucucucugucacccaggcugagugcaaugacacgaucucagcucacugcaaccuccaccucccagguucaagcgauucuccuaccuaagccuccugaguagcugggacuacaggcaugugccaccacgcccagcuaauuuuuuguauuuuuaguagagacgggguuucaccauguuggccaggguggucucgaacuccugaccuuaaguguuccacccaccuuagcuacccaaagugcugggauuacaggcaugagccaccaugcccggccaucauauggauuauuaaagggcauagaacagugcuggguacuuacugggugcucacaaaauguuaccaguuucucuaguaguaagaauuuauuggccagguguaguggcucacaccuguaaucccagcacuuugggaaaccgaggcaggcagaucccuugaggucaggaguucgagaccagccuggccaacauggugaaaucccaucucuacuaaaaaauacaaaaauuagcuggugcaccuguaauuccagcuacucaggaggcugaggcaggagaaucacuugaaccuaggagguggagguugcagugagccaagaucacaccacugcacuccagccugggcaacagugagacucugucucaaaaaaaaaaaaaaaaagaauuuauugagcaccaacugugugcccgccccaugcugaauauuuuaccugcauugaguaccuggcccuacugugagauaucagguguugcccuuauuugcaacugaggcacacaaaagggaaacugaggcacacaaaaggacuugaguuuugucuggggacaugcaggguagaggccacagagcugggaggcugaucugggaggucuuugggacucaaggugcagaagcgaguucuggccggaaaucagggucucagcccacuaggguugggggagcuccuuaccuuuaagaccucaaauucucgguaggcagggcccagccaggcgcuccucagcuggacuucuagccgcugcacgcugucccguagcaccuucugugccugggccaccucccccagcaccucagcuguggccucugccugcagcugcagaauauccuccuccaucugcuuaauaaacagugggucacuaguaggauguccaacucaucuuuguguaccuaaggacuugccugaguuuaucgcugaaaaucuuguaucccaggaaucccuucaguccugggcaaaccaggaugguugguuacccuagacacgaacuccucuuuggacuccuggccaccccacagugucgcagcuacggugcccaccugagucuccaacaggcuugcccgaaguuccugggcugcaucccggccccggcugaccuccugccccaggaguucuauugugcggccauagagacccaggcuguuccuggccuuugucagccgucccuccgugguccuguacacaccguugagggccuggcccagcugcagggucccauggaagagcagggucagcuccucaugcugugccaguucugggccgcccaugggggccgcugaggcaggccgggucaccauugccagggcccagagcaggcacagagcaggcacuggcaugacugagggucuaagguauagccacagcacugucacugaagccuuuuaugccucauacccccacugauccccagucaaucguuaacuggccgaccuggugccccgcauugcacaagggccuggcaguggugcgauaguugcaucaggcgaauguccggcuaggccacgccgggaucacgcuuccug

SEQ ID NO: 15892 - RNA, 10335 nt, Homo sapiens
gaggccccgccccacggggcuaugcaaaugagacgcccggaggccccgccccucccuccaccucggagucugcgcggcgcggccaggcccggccgaccgcgucucggucuucgcgucugccagccuggcuggcaguccgucuguccaucccgccgcgccggggcagucuaggcggagcgggggcucaggcggcggcggccucgacgcggugagaggagggggugggggcgccccucauccccucccgugggcuucccacccccggugucggucuccgguuccugaggguugggucccucuggguccagcgcggggaggggcgggggaggggaggcggcgagcugggggaggggaccgggcugggggaggggaccccgggccgaggagccagcaccgguggugagggcggcuguggguaacugugauugugugguugucauugugugucugugugugguuguguaacugucaucguguggcugcaugacugggauugugugguuucgggagguccgcgggugugugugugugugugucacugucauugugcggcugucguugugggugucacucugaugguuugugugugugugucuggcuaugcugugacugccauuggccccccguguggcugcugucucugugugugacugucuugguguucgugugguugugugcauaggacugucauuguguggcuccuguuguguguucauucugaugguguguauguguguguggcuguggucgugcgcugugcaccuuucuuguguggcauugugagucugugucaugguccauggauguggccaugugguuguagauggcaccuugucucuccccugugacuguuggugugaauaagagacuguuaguguguguguggcugucgcugagugccuuguaauugggggugugacgcugugaugaguucugugacccccauugugugcggugacucuuuucugugacucuuaaguguguugcaggccugacugugugucccugacuguagcggugugggggcuugugugggacugugauguguguagggucuccugacaugucucucucuguuuggccugggguggggguggggacuuguuugaucuguuuggugucucugacaggcuaugagcccacugugugugaguaugcagugacauguguuguguguguuggacaccugucugaacaagggggccccucuuguuuacugcaaaguggcgcccagcacagcgccuggaagucggcaggugcucggucuucacugugggaugggugaacgcuaugccaugguuguguguguguguguguguguguguguguggugccaggauggaggcugcggcuggguugugcuuccuaagggugacagcaugggugacucuggguaucuaggaccucuggcaaccaucaccccauaucacacugcagagugagugucgugguuggggugcuggacccagagugccuacccucgccugccugggccucaguuuccacaucugcacaaugggggugaccaucccugcccugcuggcugccaggagcggcugugagucuucaggcguggaugcagccugggggaagccauagggcgcuuucacaggugagauggggcugggagaauggaugcaagcaggugugacuguguugagcccuaaagcgcuggggacuggggguagccuugggggagggaagaggagaacugggaggcagaccggcugggaagagggggaaggagggagaggcaguuggcagagaaggagggcuuggcuaucagcccaaccagacaccaacaccacagcccauggggacagagagaggggccccugcagaggccauggaggaagcgacucaggggaagggucugguagggaugggggccccuugggaaagaggaugguguccccuaaaaacuaguggggacccuucuaagugccaugggggagggguucccaugaggcuggggagucucuucuaaaggcccaccuccuaaagggcauugggucagagccucccauguaggcuguaaaggaagggacccccguagacucuuggggaguggugucagaggaggcagguguccccaguagggucaggaccaacagggcaggaccuggauugcagaggcauggccagaagguucaagggacagagucagggccuccccgggucuucagggccagggguguggccaaaggacucaggggaugaagccagggucccggugaccugagccuuccccuaggcacacccccugggacucccacucccuccccaccucugcaggccuggccuucaccauggcgggagggagaccgcaucugaagaggaguuucuccaucauccccugcuuugucuucguggaggugaggacccccguaccucucccagagacggcgugccuaucucugucucuguccaaccucagucuccuuaucuguacccacuuuuccaucucugggaucucccuugcuguccccuuucucuugagaaaugguuaugagcuuagauucagaagugccacuccccgggguccaaucccucucugccccauccacacugcagggugcuggacaccacagguacccuccugagccacaguuuccucauucauaaaauggacaucaccagagucccaacucauagggcuguucucuguguguguguguguguguguguguguguguguacguguguuugagauagggucucacucugucacccaggcuggagugcaguggcauaaucucgguuuacugccaccuccaccuccugggcucaagcaauucuccuaccucagcgucccgaguagcugagacuacaggugugugccaucaugcccagcuaauuuuuguacuuuuugguagaggugggauuucaacauguuggccaggauggucuggaacuccugaccucaagcaauccuccugccucagccucccaaagugcugggauuacaggcgugagccaccacgcccggccuccuagggcuguucuaaagguaaaauauauuaauucauggacaaagcuugguacgacccccugcccacagugaggguuacaccugugguagcugcuagcaccccuacuucucugauuucuuuccaugugggagagucucuccaccucccccugucugucugucucucauuugagccuuggcccuaaucucacucuccccaugcccaucucuucucucccucucucuacaacucccuucccuuuuccuuucccuucucuuuccucuugcuuucuccucuucuccccuccuuuccuggcuuuccucucucucuguuuuuuuuuuuucacuucuuccuuuucuuucuuucccucccucccucucucucuuucuuucuuuugugauggagucuugcuccgcugcccaggcuggagugcaguggcacgaucuuggcucacugcaaacuccgccucccggguucaagugauucuccugccucagccucccgaguaguugggaguacaggcgucugccaccauacccagcuaauuuuuguauuuuuaguagagacaggguuuugucauguuguccaggcuggucucaaacuccugaucucagguaauccaccugccucagccucccaaagugcugggauuacaagcaugagccacguuuuaauuuuuuuucuuucuuuuugucuuucagccauuccuuuuccuuucuuuuuuuucugagacagggucucccucugucacccaggcuggagugcaguggugccaucauggcucacugcagccuuaauccucugggugaagcaaucuuccuuccucagccucccaaguagcugggacuauaguuguacagagauaaggucaugcgaucucaaacuccugagcucaagggauccucuugccuaugccucccaaagugcuggaauuacaggcacgagccgcugcacacggccccucuguuucugucuccuucuccuucuguuucuccuaagcccugacccuucucucaccuccuuuccccauuucucucagucucucucccccuugucucugucucucuccaucuucuaguuucugucucuaacccauguuucuccaucucuguaucucugccucuguggccucagcuggaguccugaccucucucuucucucuccgccaccucuccccgcccuggcuugguggcagucggugcugcugggcauugugauccugcuugcuuaccgccuggaguucacggacaccuucccugugcacacccagggauucuucugcuaugacaguaccuacgccaagcccuacccagggccugaggcugccagccgagugccuccugcucuugucuacgcacuggucacugccgggcccacccucacggugagacaaugaagaccuccuaggaggcaggugggccgguaagggugggugaggggaugggcuggaaggccagaagacuccaucuuggucuugcccacagauccugcugggagagcuggcgcgugccuuuuucccugcaccaccuucagccgucccagucaucggggagagcaccaucgugucuggggccugcugccgcuucagccccccagugcggaggcugguccgcuuccugggugagagacauggccuggggucagccccaugguaaugguggggagguggguauagaagaaaagagucaugggccugacagucauaauaauuccaggcugggugugguggcucacgccuguaaucucagcacugugggaggccaagugggcgaucaccugaggucaggaguucaggaccagccuggccaacauggcgaaacccugucuguacuaaaaacaaaaaauuagcugggcguguggcaggugccuguaauccuugaacccgggaggcagagguugcagugagccaagauugugccagccugggcaacaagagcaaaacuccgucucaaaaaaaaaaaaaaaaagaagaauuccagggaaaagcugggcauggugguacaugccuguagccccagcuacuugggaggcugaggcagagacucagcuacuugggauuacuagcuacuugggagacugaacaagaucccaccucuuuaaaaaaaagggaauuccaggggggaaggaagaggaccuggaauugccaugauggggauguuaggaagcaacaagggacuuaggcucagaccagauguaauggagguucuagggacauggguggggccuaacccaaccaugauggcaacugucggaagagggucccagaaugccauaaggagagucucaggcacaaaagagagacacaggcacaggacaaacacccuggggccccugggugagacucuggcugugcuuuaaauggggucccagccucaaguaguggcugugggaaagggggaggggcagaccuuaccuauaaugauggucccagggcagagggcgggagacccagcucuaacuuauuaguggccccaggaggagaguguugaacucaguaguagccaguuuaggggcaggcaggaagagccccagguaugccauuaggguuuucccuagccguccuaggcaugggguggauccugauguaaugguguuggggcggggguccaagcccagcuauaauggggcuccaagggaggauccgccccugacauagugguaauccuagaaagacaggggccagauaaugagggucccugggggcaggaggccucagaguaccuucaugguggucuuaaaggaagggggauguuggcacaacuacagggucccaagugugcuuuaaugacagucacaggaaaagggagcuaagaggcccaauggaaucagugggagcaucagggccuggcgcaugaaccccuuccacuaucccaccccuaggggucuacuccuucggccucuucaccacgaccaucuucgccaacgcggggcagguggugaccggcaaucccacgccacacuuccuguccgugugccgccccaacuacacggcccugggcugccugccaccuucuccggaucggccaggucccgaccgcuuugucacugaccagggugccugcgcuggcagucccagccucguggccgccgcgcgccgcgccuuccccugcaaggaugcggcccucugcgccuacgcggucaccuacacagcggugagcuucgggagcuucggggucggaaaugggugugcaggcuggacagcgaccagcagcuaggaagccgccaggguuggagccucugcucuuccacgccccgggugcuguuggaagcucucgcuccacgccccgaccuguuggaagcucucccuccuccucccagauccuagccacgcccccagucagaggcuaucgcuguccauugacuccgccccuugcccucuggccacgccuccugagccaguaaugcgagggaaacuguuggcucuacccuauggcaucaggacagucccugaugugcaagacucggaaccccuauagccuagccaggcccccaggaugcuacaggcgcuagauauuagcuggcagacugggcagaugggacggcccccuggaguccuugccccucuucuggagcccuugccccucuccugggggccuuguucccuccuguuguagcccuggccacgccccuugcucuuaacugcucugggauuucuaacucuguccccugcuuuuuccuggucacauccccuguugcuucaacucuuuuuucuggcauccggguuuaugcucccacccugucagugguccccuaggggucaggggcuccaccuccuacagcuccuacagcuccuacagcucccuucgcccugacuccacccucugguucuguggccacgcccuaauccaguaagugucuguccccaucugcgacuccggaccagggacaccugggccccagaccuuguccucugcucuugggagcucuggccacaccuagcccugcagguggugcccacgagacuccaagaccucaaucccugaccccccccccuuugccuuuuuggucacgcucccuggaaaagcccacugggagcccaugacuccaacccuggagccccuggccacucccuccagccccaacgcucuggccaugcgcucuagcccagaaaggagcguccacuuggguucggcgacuugccuccgcuaucccccugaccaguccggcuccccgcagauguacgugacucucguguuccgcgugaagggcucccgccuggucaaacccucgcucugccuggccuugcugugcccggccuuccuggugggcgugguccgcguggccgaguaccgaaaccacuggucggacgugcuggcuggcuuccugacaggggcggccaucgccaccuuuuuggugaguugccuccucaaccuucccagcauggaagacccucaccagcucucugacccaagaggcaggaccacaugauggagaaggguguggacucugugugaccuugggccaaucccuuaacauuacccuuccuggauauucucaucugugaaaugagauaccaggaucagggugaggcaaggccuugaaugcaaauuuuaagagggugcccaacacucaguaaucaagauuaauauuuuaacaaaacauuuuuaaaaaucaaaguuaauacaaaacuaucauaauguacagaauauaaaaauucuaaauaaagaugaaucaaggcugggugcgguggcucacgccuguaaucccagcacuuugggaagcugaggcaggcggaucacuugaggccaagaguucgagaccagccuggucaacauggccaaacccugucccugcuaaaaauacaaaaauuagccaggcauaguagucccagcuacuugggaggcugaggcagaagaaucgcuugaacccgggggacggagguugcagugaacugagaucgugccaccucacuccagccugggugaaagagcgaaagucugucucaaaaaaaaaaaaaaaaaaaauuagcugggaaugguggugcacaccuguggucccagcuacucaggaggcugaggcaagagaguugcuugaauccaggagguggaguuugcagugagcugagauugcaccacugcacuccagccugggugacagagugagacugucucaaaaaaauaaaaaauuaaaaaaauuaaauccugccacuguacaacuuggucuuacuuacuuuagccuaguguggggucugugggauaaauaauaauugcaccuaccucaguaaaauggaaccaacagugccuggcacauacuaugcauuagcuguuuuugaaaaccggagccucacuuuccuuaucugaaaaauggggaugguauuuacauggcuccuaugugacuugccccaggccucaacacucuccucucccucuauuccaggucaccugcguugugcauaacuuucagagccggccacccucuggccgaaggcucucucccugggaggaccugggccaagcccccaccauggauagcccccucgaaaaguuaaguguggcgcagguaaggggggccgggggcugcucccggcuggagagggugguggguggagggggccaaggagacaggaaggaagucaggcaagaggugggggucucagaaccauggggaaguggagggaucacccaucucuguggacauagguccugggcggacagccccaaagaaugaaagggagcacccccgucuucuucccagggggacacgguuaaucaugagaacugugguugucuuuuccauggggcucuucaccugaugagcuccuuguggcuguggccgguagggcccagggggccacuagccccuuccgucugucucuuugucucaggaacccgaggucugcaggccgcauucgacaccggcacggcucaccccauccagugaguguugggggaguggggggcuaaacagggggacuuccaggugggcagccacugccccagaggucucaccuaggccuuuaugcugccucccgaguuuucugauccccugauaucuggcuucugaccaccagagucgcagaacugcgcccgccguggccaccugauccccagcugugucuccuccagggccccagccauguguucgucgccccgugugccccguccucgauugaggucugagccgacgcccuugccccugccccuaccccugccagcgcccacccccagccagggccccucgccuuccuccccuggaccuggggggccaggcgggggugguggacguggccggaagcugcugcugcccacgccccugcugcgggaccuguacacccugaguggacucuaucccucccccuuccaccgggacaacuucagcccuuaccuguuugccagccgugaccaccugcugugaggcccgaccacccacccagaaucugcccaguccccacuucuucccugccacgcgugugugugcgugugccacgugagugccaaaguccccugccccccaagccagccagacccagacauuagaagauggcuagaaggacauuuaggagacaucugccucucuggcccucugagauaucccgaugggcacaaauggaaggugcgcacuugccccuacuauugcccuuuuaagggccaaagcuugaccccauuggccauugccuggcuaaugagaaccccugguucucagaauuuuaaccaaaaggaguuggcuccaaccaaugggagccuuccccucacuucuuagaauccuccugcaagagggcaacuccagccaguguucagcgacugaacagccaauaggagcccuugguuuccagaauuucuagagugggugggcaugauuccagucaaugggggaccgcccgugucuaagcaugugcaaaggagaggagggagaugaggucauuguuugucauugagucuucucucagaaucagcgagcccagcuguaggguggggggcaggcucccccauggcaggguccuugggguaccccuuuuccucucagccccucccugugugcggccucuccaccucucacccacucucuccuaauccccuacuuaaguagggcuugccccacuucagagguuuugggguucagggugcugugucuccccuugccugugcccaggucaucccaaacccuucuguuauuuauuagggcugugggaaggguuuuucuucuuuuucuuggaaccugccccuguucuucacacugccccccaugccucagccucauacagaugugccaucauggggggcauggguggagcagaggggcucccucaccccgggcaggcaaaggcaguggguagaggaggcacugccccccuuuccugcccccuccucaucuuuaauaaagaccuggcuucucaucuuuaauaaagaccuguuuguaacagaag

SEQ ID NO: 15893 - RNA, 10335 nt, Homo sapiens
cuucuguuacaaacaggucuuuauuaaagaugagaagccaggucuuuauuaaagaugaggagggggcaggaaaggggggcagugccuccucuacccacugccuuugccugcccggggugagggagccccucugcuccacccaugccccccaugauggcacaucuguaugaggcugaggcauggggggcagugugaagaacaggggcagguuccaagaaaaagaagaaaaacccuucccacagcccuaauaaauaacagaaggguuugggaugaccugggcacaggcaaggggagacacagcacccugaaccccaaaaccucugaaguggggcaagcccuacuuaaguaggggauuaggagagagugggugagagguggagaggccgcacacagggaggggcugagaggaaaagggguaccccaaggacccugccaugggggagccugccccccacccuacagcugggcucgcugauucugagagaagacucaaugacaaacaaugaccucaucucccuccucuccuuugcacaugcuuagacacgggcggucccccauugacuggaaucaugcccacccacucuagaaauucuggaaaccaagggcuccuauuggcuguucagucgcugaacacuggcuggaguugcccucuugcaggaggauucuaagaagugaggggaaggcucccauugguuggagccaacuccuuuugguuaaaauucugagaaccagggguucucauuagccaggcaauggccaauggggucaagcuuuggcccuuaaaagggcaauaguaggggcaagugcgcaccuuccauuugugcccaucgggauaucucagagggccagagaggcagaugucuccuaaauguccuucuagccaucuucuaaugucugggucuggcuggcuuggggggcaggggacuuuggcacucacguggcacacgcacacacacgcguggcagggaagaaguggggacugggcagauucuggguggguggucgggccucacagcagguggucacggcuggcaaacagguaagggcugaaguugucccgguggaagggggagggauagaguccacucaggguguacaggucccgcagcaggggcgugggcagcagcagcuuccggccacguccaccacccccgccuggccccccagguccaggggaggaaggcgaggggcccuggcugggggugggcgcuggcagggguaggggcaggggcaagggcgucggcucagaccucaaucgaggacggggcacacggggcgacgaacacauggcuggggcccuggaggagacacagcuggggaucagguggccacggcgggcgcaguucugcgacucugguggucagaagccagauaucaggggaucagaaaacucgggaggcagcauaaaggccuaggugagaccucuggggcaguggcugcccaccuggaagucccccuguuuagccccccacucccccaacacucacuggauggggugagccgugccggugucgaaugcggccugcagaccucggguuccugagacaaagagacagacggaaggggcuaguggcccccugggcccuaccggccacagccacaaggagcucaucaggugaagagccccauggaaaagacaaccacaguucucaugauuaaccgugucccccugggaagaagacgggggugcucccuuucauucuuuggggcuguccgcccaggaccuauguccacagagaugggugaucccuccacuuccccaugguucugagacccccaccucuugccugacuuccuuccugucuccuuggcccccuccacccaccacccucuccagccgggagcagcccccggccccccuuaccugcgccacacuuaacuuuucgagggggcuauccauggugggggcuuggcccagguccucccagggagagagccuucggccagaggguggccggcucugaaaguuaugcacaacgcaggugaccuggaauagagggagaggagaguguugaggccuggggcaagucacauaggagccauguaaauaccauccccauuuuucagauaaggaaagugaggcuccgguuuucaaaaacagcuaaugcauaguaugugccaggcacuguugguuccauuuuacugagguaggugcaauuauuauuuaucccacagaccccacacuaggcuaaaguaaguaagaccaaguuguacaguggcaggauuuaauuuuuuuaauuuuuuauuuuuuugagacagucucacucugucacccaggcuggagugcaguggugcaaucucagcucacugcaaacuccaccuccuggauucaagcaacucucuugccucagccuccugaguagcugggaccacaggugugcaccaccauucccagcuaauuuuuuuuuuuuuuuuuuuugagacagacuuucgcucuuucacccaggcuggagugagguggcacgaucucaguucacugcaaccuccgucccccggguucaagcgauucuucugccucagccucccaaguagcugggacuacuaugccuggcuaauuuuuguauuuuuagcagggacaggguuuggccauguugaccaggcuggucucgaacucuuggccucaagugauccgccugccucagcuucccaaagugcugggauuacaggcgugagccaccgcacccagccuugauucaucuuuauuuagaauuuuuauauucuguacauuaugauaguuuuguauuaacuuugauuuuuaaaaauguuuuguuaaaauauuaaucuugauuacugaguguugggcacccucuuaaaauuugcauucaaggccuugccucacccugauccugguaucucauuucacagaugagaauauccaggaaggguaauguuaagggauuggcccaaggucacacagaguccacacccuucuccaucaugugguccugccucuugggucagagagcuggugagggucuuccaugcugggaagguugaggaggcaacucaccaaaaagguggcgauggccgccccugucaggaagccagccagcacguccgaccagugguuucgguacucggccacgcggaccacgcccaccaggaaggccgggcacagcaaggccaggcagagcgaggguuugaccaggcgggagcccuucacgcggaacacgagagucacguacaucugcggggagccggacuggucagggggauagcggaggcaagucgccgaacccaaguggacgcuccuuucugggcuagagcgcauggccagagcguuggggcuggagggaguggccaggggcuccaggguuggagucaugggcucccagugggcuuuuccagggagcgugaccaaaaaggcaaaggggggggggucagggauugaggucuuggagucucgugggcaccaccugcagggcuagguguggccagagcucccaagagcagaggacaaggucuggggcccaggugucccugguccggagucgcagauggggacagacacuuacuggauuagggcguggccacagaaccagaggguggagucagggcgaagggagcuguaggagcuguaggagcuguaggagguggagccccugaccccuaggggaccacugacagggugggagcauaaacccggaugccagaaaaaagaguugaagcaacaggggaugugaccaggaaaaagcaggggacagaguuagaaaucccagagcaguuaagagcaaggggcguggccagggcuacaacaggagggaacaaggcccccaggagaggggcaagggcuccagaagaggggcaaggacuccagggggccgucccaucugcccagucugccagcuaauaucuagcgccuguagcauccugggggccuggcuaggcuauagggguuccgagucuugcacaucagggacuguccugaugccauaggguagagccaacaguuucccucgcauuacuggcucaggaggcguggccagagggcaaggggcggagucaauggacagcgauagccucugacugggggcguggcuaggaucugggaggaggagggagagcuuccaacaggucggggcguggagcgagagcuuccaacagcacccggggcguggaagagcagaggcuccaacccuggcggcuuccuagcugcuggucgcuguccagccugcacacccauuuccgaccccgaagcucccgaagcucaccgcuguguaggugaccgcguaggcgcagagggccgcauccuugcaggggaaggcgcggcgcgcggcggccacgaggcugggacugccagcgcaggcacccuggucagugacaaagcggucgggaccuggccgauccggagaagguggcaggcagcccagggccguguaguuggggcggcacacggacaggaaguguggcgugggauugccggucaccaccugccccgcguuggcgaagauggucguggugaagaggccgaaggaguagaccccuaggggugggauaguggaagggguucaugcgccaggcccugaugcucccacugauuccauugggccucuuagcucccuuuuccugugacugucauuaaagcacacuugggacccuguaguugugccaacaucccccuuccuuuaagaccaccaugaagguacucugaggccuccugcccccagggacccucauuaucuggccccugucuuucuaggauuaccacuaugucaggggcggauccucccuuggagccccauuauagcugggcuuggacccccgccccaacaccauuacaucaggauccaccccaugccuaggacggcuagggaaaacccuaauggcauaccuggggcucuuccugccugccccuaaacuggcuacuacugaguucaacacucuccuccuggggccacuaauaaguuagagcugggucucccgcccucugcccugggaccaucauuauagguaaggucugccccucccccuuucccacagccacuacuugaggcugggaccccauuuaaagcacagccagagucucacccaggggccccaggguguuuguccugugccugugucucucuuuugugccugagacucuccuuauggcauucugggacccucuuccgacaguugccaucaugguuggguuaggccccacccaugucccuagaaccuccauuacaucuggucugagccuaagucccuuguugcuuccuaacauccccaucauggcaauuccagguccucuuccuuccccccuggaauucccuuuuuuuuaaagaggugggaucuuguucagucucccaaguagcuaguaaucccaaguagcugagucucugccucagccucccaaguagcuggggcuacaggcauguaccaccaugcccagcuuuucccuggaauucuucuuuuuuuuuuuuuuuuugagacggaguuuugcucuuguugcccaggcuggcacaaucuuggcucacugcaaccucugccucccggguucaaggauuacaggcaccugccacacgcccagcuaauuuuuuguuuuuaguacagacaggguuucgccauguuggccaggcugguccugaacuccugaccucaggugaucgcccacuuggccucccacagugcugagauuacaggcgugagccaccacacccagccuggaauuauuaugacugucaggcccaugacucuuuucuucuauacccaccuccccaccauuaccauggggcugaccccaggccaugucucucacccaggaagcggaccagccuccgcacuggggggcugaagcggcagcaggccccagacacgauggugcucuccccgaugacugggacggcugaagguggugcagggaaaaaggcacgcgccagcucucccagcaggaucugugggcaagaccaagauggagucuucuggccuuccagcccauccccucacccacccuuaccggcccaccugccuccuaggaggucuucauugucucaccgugagggugggcccggcagugaccagugcguagacaagagcaggaggcacucggcuggcagccucaggcccuggguagggcuuggcguagguacugucauagcagaagaaucccugggugugcacagggaagguguccgugaacuccaggcgguaagcaagcaggaucacaaugcccagcagcaccgacugccaccaagccagggcggggagagguggcggagagagaagagagaggucaggacuccagcugaggccacagaggcagagauacagagauggagaaacauggguuagagacagaaacuagaagauggagagagacagagacaagggggagagagacugagagaaauggggaaaggaggugagagaagggucagggcuuaggagaaacagaaggagaaggagacagaaacagaggggccgugugcagcggcucgugccuguaauuccagcacuuugggaggcauaggcaagaggaucccuugagcucaggaguuugagaucgcaugaccuuaucucuguacaacuauagucccagcuacuugggaggcugaggaaggaagauugcuucacccagaggauuaaggcugcagugagccaugauggcaccacugcacuccagccugggugacagagggagacccugucucagaaaaaaaagaaaggaaaaggaauggcugaaagacaaaaagaaagaaaaaaaauuaaaacguggcucaugcuuguaaucccagcacuuugggaggcugaggcagguggauuaccugagaucaggaguuugagaccagccuggacaacaugacaaaacccugucucuacuaaaaauacaaaaauuagcuggguaugguggcagacgccuguacucccaacuacucgggaggcugaggcaggagaaucacuugaacccgggaggcggaguuugcagugagccaagaucgugccacugcacuccagccugggcagcggagcaagacuccaucacaaaagaaagaaagagagagagggagggagggaaagaaagaaaaggaagaagugaaaaaaaaaaaacagagagagaggaaagccaggaaaggaggggagaagaggagaaagcaagaggaaagagaagggaaaggaaaagggaagggaguuguagagagagggagagaagagaugggcauggggagagugagauuagggccaaggcucaaaugagagacagacagacagggggagguggagagacucucccacauggaaagaaaucagagaaguaggggugcuagcagcuaccacagguguaacccucacugugggcagggggucguaccaagcuuuguccaugaauuaauauauuuuaccuuuagaacagcccuaggaggccgggcgugguggcucacgccuguaaucccagcacuuugggaggcugaggcaggaggauugcuugaggucaggaguuccagaccauccuggccaacauguugaaaucccaccucuaccaaaaaguacaaaaauuagcugggcaugauggcacacaccuguagucucagcuacucgggacgcugagguaggagaauugcuugagcccaggagguggagguggcaguaaaccgagauuaugccacugcacuccagccugggugacagagugagacccuaucucaaacacacguacacacacacacacacacacacacacacacacagagaacagcccuaugaguugggacucuggugauguccauuuuaugaaugaggaaacuguggcucaggaggguaccugugguguccagcacccugcaguguggauggggcagagagggauuggaccccggggaguggcacuucugaaucuaagcucauaaccauuucucaagagaaaggggacagcaagggagaucccagagauggaaaaguggguacagauaaggagacugagguuggacagagacagagauaggcacgccgucucugggagagguacggggguccucaccuccacgaagacaaagcaggggaugauggagaaacuccucuucagaugcggucucccucccgccauggugaaggccaggccugcagagguggggagggagugggagucccagggggugugccuaggggaaggcucaggucaccgggacccuggcuucauccccugaguccuuuggccacaccccuggcccugaagacccggggaggcccugacucugucccuugaaccuucuggccaugccucugcaauccagguccugcccuguugguccugacccuacuggggacaccugccuccucugacaccacuccccaagagucuacgggggucccuuccuuuacagccuacaugggaggcucugacccaaugcccuuuaggaggugggccuuuagaagagacuccccagccucaugggaaccccucccccauggcacuuagaaggguccccacuaguuuuuaggggacaccauccucuuucccaaggggcccccaucccuaccagacccuuccccugagucgcuuccuccauggccucugcaggggccccucucucuguccccaugggcugugguguuggugucugguugggcugauagccaagcccuccuucucugccaacugccucucccuccuucccccucuucccagccggucugccucccaguucuccucuucccucccccaaggcuacccccaguccccagcgcuuuagggcucaacacagucacaccugcuugcauccauucucccagccccaucucaccugugaaagcgcccuauggcuucccccaggcugcauccacgccugaagacucacagccgcuccuggcagccagcagggcagggauggucacccccauugugcagauguggaaacugaggcccaggcaggcgaggguaggcacucuggguccagcaccccaaccacgacacucacucugcagugugauauggggugaugguugccagagguccuagauacccagagucacccaugcugucacccuuaggaagcacaacccagccgcagccuccauccuggcaccacacacacacacacacacacacacacacaaccauggcauagcguucacccaucccacagugaagaccgagcaccugccgacuuccaggcgcugugcugggcgccacuuugcaguaaacaagaggggcccccuuguucagacagguguccaacacacacaacacaugucacugcauacucacacacagugggcucauagccugucagagacaccaaacagaucaaacaaguccccacccccaccccaggccaaacagagagagacaugucaggagacccuacacacaucacagucccacacaagcccccacaccgcuacagucagggacacacagucaggccugcaacacacuuaagagucacagaaaagagucaccgcacacaaugggggucacagaacucaucacagcgucacacccccaauuacaaggcacucagcgacagccacacacacacuaacagucucuuauucacaccaacagucacaggggagagacaaggugccaucuacaaccacauggccacauccauggaccaugacacagacucacaaugccacacaagaaaggugcacagcgcacgaccacagccacacacacauacacaccaucagaaugaacacacaacaggagccacacaaugacaguccuaugcacacaaccacacgaacaccaagacagucacacacagagacagcagccacacggggggccaauggcagucacagcauagccagacacacacacacaaaccaucagagugacacccacaacgacagccgcacaaugacagugacacacacacacacacacccgcggaccucccgaaaccacacaaucccagucaugcagccacacgaugacaguuacacaaccacacacagacacacaaugacaaccacacaaucacaguuacccacagccgcccucaccaccggugcuggcuccucggcccgggguccccucccccagcccgguccccucccccagcucgccgccuccccucccccgccccuccccgcgcuggacccagagggacccaacccucaggaaccggagaccgacaccgggggugggaagcccacgggaggggaugaggggcgcccccacccccuccucucaccgcgucgaggccgccgccgccugagcccccgcuccgccuagacugccccggcgcggcgggauggacagacggacugccagccaggcuggcagacgcgaagaccgagacgcggucggccgggccuggccgcgccgcgcagacuccgagguggagggaggggcggggccuccgggcgucucauuugcauagccccguggggcggggccuc

SEQ ID NO: 15894 - RNA, 446 nt, Homo sapiens
uaccuggagucgcauugggucuagagucguuccggucccgcggggcaugcuuugaagaggccuucgugucaggaagaggacugggccuuggcccucccccgccgccucuagggccgcagcaaauagcagcgcuguuuuuccagauccugguguaccgagcagcagcaaaggcgguccggcggcaggcauguucuccuccccggaccaggccgcaccgccccugguuagcacccgccucagcgucuccgccauucgccgcguagcucugaccaaucgguggcucguucccagccuuagucccgcccaagccguggccgcaucgguacaguucacuuaguuucucuauuggucuaggaaucuguccaucaaaacucgauuccucaggugaaugggcaaaugguuagaaccuaugcggaggaaugggugcauucgagggaaauaagacc

SEQ ID NO: 15895 - RNA, 6596 nt, Homo sapiens
cuuagaggcgccuggucgggaagggccuggucagcugcguccggcggaggcagcugcugacccagcuguggacugugccgggggcgggggacggaggggcaggagcccugggcuccccguggcgggggcuguaucauggaccaccucggggcgucccucuggccccaggucggcucccuuugucuccugcucgcuggggccgccugggcgcccccgccuaaccucccggaccccaaguucgagagcaaagguaaggaugagcugcguguggaccccuacgcuggagccugcaggaccaugcuggggccugaacucccagccuagguccugggggccaugccuguuucuggacuuccugaccggguccugggggccaagcuggcaucugaacccuuagacuggguccuggauggguggggggcggggugggguauguuaggauccaagacuccugaucgcgucccgggcaagagcuagagugggcuuaacauucccguuuuaccuuuucagggagucugggacaugcuaaauccuaagggggcugacuuggugcuaaggucccugggggguggggaccaagccgacccucccuaggggagggaggguaaagcccggguccgaguuagaggggccaagccacaggcuacuguaaacacgguuugugugagggcgccagaucacuugcccggcccgguggagggagggaggcggggggcacgguuggcgcuaucgguuggcggggagccugccggggccgauagggggcccgccucuccgcacacacccccagccgcgcgcguguccuaggcuggggcggggcuggcagucccgagcucgaggucuugaacgccgcgcccagcucagcuggccgcugggugggcaggugugcgccaguggugacggcgggggacaguaaggcgagaaacuugccccugggaauuaggggggcaccaccucugcggaccccuccaagggacccgcuugggaagauggcagggcggggcuuuuuucuuaucggguccgcccaggcugcgggagggaagaggagggggcugucucccgaggauagagcucagacccccaugcccuuccuuugucgccccuccccagcggccuugcuggcggcccgggggcccgaagagcuucugugcuucaccgagcgguuggaggacuugguguguuucugggaggaagcggcgagcgcuggggugggcccgggcaacuacagcuucuccuaccagcucgagugaguccgauccggcgggugccuccaagggcggagggaggggguggggcagagcucccuggaggucguagccucguauguccccugcuguuugaggcccgacggcgccuccagucguggucacuggagggaaaccugcggguccagggcuggcacgcccucuaugggccggggcgcgaacacucccgcgaucaccgcuggaacgcgaccccaaacaucaggcugggauaacaacgccuccaaaucgaggguaaggcguuacuacgucggggcugggacgccuucucgagguaguauccaaaaggaggccagcaguggcucaugccuguaaucccaacucuuuggaaggucgaggcggaagaaccgcuugagcccaggaguucaagaccagccugggcaacacagcgagauccccgucucuuaaaaaaaaauuagacugggcgcgguggcucacgccuguaaucccagcacuuugggaggcugaggcgggcggaucaccugaggucgggaguuugagaccagccuggccaacauggagaaacucuaucucuacuaaaaauacaaaauuagccgggcgugguggcgcaugccugugaucccagcuacucgggaggcugaggcaggagaaucgcuugaacccgggaggcggagguugcggugagccgagguagcgccauugcacuccagccugggcaacaagagcgaaacuccgucucaaaaaaaaaaaaaaaaaaagccaggcguggcgcgugccuguggucucaacuacuugggaagcugaggugggaggaucccuuaagccccagaauuugaggcugcagugagccaugaucgcgccacugcacuccagccugggcgacgaaggaacaccuugucacacacacacacaaggcuagaccuugugucacacauacacacugccccccacaggccgggcaaugccaacuccccgguccccccucccaaccugcucccuucccugggcgcauagggaugagccauggaagcugugucgccugcaccaggcucccacggcucguggugcggugcgcuucugguguucgcugccuacagccgacacgucgagcuucgugccccuagaguugcgcgucacagcagccuccggcgcuccgcgauaucaccgugucauccacaucaaugaaguagguaagugcucugggaauggaggaguggucggaggagagggucucaguccucgcccaccugaccaacccccaugccugcagugcuccuagacgcccccguggggcugguggcgcgguuggcugacgagagcggccacguaguguugcgcuggcucccgccgccugagacacccaugacgucucacauccgcuacgagguggacgucucggccggcaacggcgcagggagcguacagagggugaggccagccccuacggcccagcccccaaagcuccacugacuacggcccagccacgccucucgaggucgcgcccggugccgcuuucagggccgguccguaacaucccacaucccauuacccuggugcugaagaccguuccacgcccacagacacacccccuuuccuaauguccucgcaagccuguugaaccccaacuucuucucccuccggcccguaacccuagaccccuuuagcgcccgggucccucuacgagugcuagcccagauauuaaauugcccgggucccgcccuuucguaccagagacucucucucugauuggcccugagcuuucuugggcuccucccccuacucuuauuggucccauugcaauucuagggcaccguuuuccuuuccccugauuggcucaguuccaccagggcccgcccccacgucaucuauuuuugucugcuacgcgucccucgcccugauuccgcccccagguggagauccuggagggccgcaccgagugugugcugagcaaccugcggggccggacgcgcuacaccuucgccguccgcgcgcguauggcugagccgagcuucggcggcuucuggagcgccuggucggagccugugucgcugcugacgccuagcggugaggccccaggcggggguguaggaggagccagggcgaaucacggggcaagcccaccgcccugaccuccuccccgccucuuagaccuggacccccucauccugacgcucucccucauccucguggucauccuggugcugcugaccgugcucgcgcugcucucccaccgccggugagcuccccauuugggcgcugggcccagacuccuccccgccaacgguccucuuucacuauggaaaccuaggcucagagagagacacgcacuugcccaaggucacgcaguaaggauucacaucaguggcagggcugggaugcaugccagacuagacccagacucuucguuaacauuuucugcucuuggggacuuucaccugauuuuccuucuacaucaggggcugccauuucuugggucccuuuguuaguuccuuuccccagugucaucaccuuuguaaaaucaacuagauggauuuagugaaagaauuuaagacccugaaugccuccgcaccccugcggucaagcuucucagacacuaugaucagacuagccguucugagguauuuguaauuccaagcacacacuaggugguuucacacccccaagcuuuugcccaugcuguucccucugccuggaaugcccuuccugccuugucugcuaagcaaucuucuagucgucuuucauggcccuguucauuuacuugguuggaaaauacaaacagagugccaaacaugugccaggcacuggagagagaauggagaacaagcuagacccugaccacaagucccugaccuuguggaucucaagucaacaaacaagggacccaagaaauauuugaugacaaauuguaaugagugauaucacagaaacaaacagaauguggugacaugacaggauggucagggaaggccuccaggaggaggugacaucagaguggaaaccugaagauuggaaggaagcagccgcuugaaaaguggggagaagaaacagcaagugcaaaggcccugaggugggaaugagauuggaacguucagccagcuucaagaauugccacauggcauggccuggcaugguggcucacgccuguaaucccagcacuuugggaugccgaggcaggcagaucaccugagguugggaguucgcgaccagccugaccaacauggagaaaccccaccucuacuaaaaauacaaaacuagccaagcgugguggcacaugccuguaauccccgcuacucgggaggcugaggcaggagaaucacuugaaccugggagguggagguugcgggugagccgagaucgugccaucgcauuccagccugggcaauaagagugaaacuccgucucaaaaaaaaaaaaaaaauugccacauggcuagagugguauguaaggggguguggcagauauugagaugagggaggugacaggggucauauaacgcagggccuucugcagggugguggggaggaguuuggaauuuuuuuuuuuuuugagacagagucacucuugucgcccaagcuguagugcagugcagcagucuuggcucacugcaaucucugccucccagguucaagugauucuccugccucaaccgccugaguagcugagauuacaggcgugcaugcccggcuaauuuuguaguuuuaguagagacgggguuccaccauguuggccaggcuggucucaaacuccugaccucaggugaucugcucacaucagccucucaaagugcugggauuauaggcaugagccaccgugccuggcuuggauuuuauccuaaaugccuucucucauuaccccagaagguaacauaauauuuaucuaugaagugacaucauggaccuccuggaaaaaucugggccaggguuuuggguuuuuuaauuuauuuuauuuuauuuuuuuuagagaugggggucucacuauguuuccuaggcuggucuugaacuccuggguucaaaugauccucccaccucagccucccaaaguacugggauuauagugcugguguaaaccacugcaccuggccauggccaggauuaaagggagaaugaccaagguauauugaacuccuaugcacccuucaauacccuguuccauuuacccuuuuguagggccuugcugaugcuucagccaaaaccccuguccccuggcccugauguacuccucugccuccauugugaucacagggaccaaguguaucugugccucuaugacugggaguggagggggaauuggugaguauucaaugagucauaucuauguaacuauuuauauuggcuucaacagggcucugaagcagaagaucuggccuggcaucccgagcccagagagcgaguuugaaggccucuucaccacccacaaggguaacuuccagguagguggccugguuguccccucagugccugggcuucccugcuucuugcagccaaacugcaggccucucugagcagguuggugcuauuucuucagcuguggcuguaccagaaugauggcugccugugguggagccccugcacccccuucacggaggacccaccugcuucccuggaaguccucucagagcgcugcugggggacgaugcaggcaguggagccggggacagaugaugagggcccccugcuggagccagugggcagugagcaugcccaggauaccuaucuggugcuggacaaaugguugcugccccggaacccgcccagugaggaccucccagggccugguggcaguguggacauaguggccauggaugaaggcucagaagcauccuccugcucaucugcuuuggccucgaagcccagcccagagggagccucugcugccagcuuugaguacacuauccuggaccccagcucccagcucuugcguccauggacacugugcccugagcugcccccuaccccaccccaccuaaaguaccuguaccuugugguaucugacucuggcaucucaacugacuacagcucaggggacucccagggagcccaagggggcuuauccgauggccccuacuccaacccuuaugagaacagccuuaucccagccgcugagccucugccccccagcuauguggcuugcucuuaggacaccaggcugcagaugaucagggauccaauaugacucagagaaccagugcagacucaagacuuauggaacagggauggcgaggccucucucaggagcaggggcauugcugauuuugucugcccaauccauccugcucaggaaaccacaaccuugcaguauuuuuaaauauguauaguuuuuuuuuguaucuauauauauauauacacauauguauguaaguuuuucuaccaugau

SEQ ID NO: 15896 - RNA, 2062 nt, Homo sapiens
gcgagguuugacgagccaggggugagcccgagccacgagggaagaaaccagaagaggugcaggcggguccugugaggcuagaggacgcggcugggguauccggauggggagaggccuaguggcagggccccagagaccaggggcggaccugagugaugagggggugaagcuggguaucaaggugccugcuuaaggagggaugggagugggcaguggucuccaguuggaacuagggcauaucucggaaugggguagggaggagggggaacgugacuucucgguggccccuggccccgcccaccuuccucucucgcuucccauccccgcuuaguuccucgccagcuuagagggaaggcugcccgaauacaacacccgcaucgcccugccccuugccacuuccaaggacaaguuuuuuggucaguauggguggggggaugaaggggugcgguuggggccccaagcuggguagcaggagguugucagauacccuguucagggccaagguggggguggaguggggugguaaagggaaggggagccagggauggggaccuggaucccacaucgcucccugcucauccccccaccccccuuagacgaagagagugaggaggaggacaacgagguagugacccgcgcaucacucaagauccguucccagaaauuaaucgaaagucacaagaagcaccgucgcucucggagguccuagacucguccugacacccaccaggcggcccccuucggagcccccgaucccuccgggucuagcgcaggccccacggggccccuucaggggcugaacgcggcccggaccgggaacggaggcggccagcggcgcccggaggggaggaaggggccgggccagacguucccacaguaaaucuccccagcuggguccgccccggccucagaguugcgcaauaaauguuaccgaccaugacccuggguauucaucuguuuuugacccugcaccacccaagagacggcugucccugaaaacccagggccacagacugccuccuccaaccugggucaugaugacucccaucagcuagugacgcagauggagcuuaaaaaugggagauggcccgauguagugguuuuaugccuguaaucccaguauuuugggaggcugaguugggaggaucacuugaguccaggagcuccaggcugcagugagcuaugaucgugcuacugcacuccagccugggccacagagccagacccugucucaauaaauaaaauaagggcggggugcaguggcucauucauaccuauauucccagcacuuugggaggcugagcugggugugucgcuugagcccagggguuccagacuagccugggcaacauggugaaaaccaguuuuuaccaaaaaaaaaaaaaaaaaaaaaaaaaaaagcugagcaugguggcauaugccuguagucccagcuacuugggagacugaggcaggagaauggauugaacccaggaggcggagauugcagugagccaagaucaagccacuacacugcagccuuggcaacaggagugagacccugucucuaaaaaauaauaaggcugggcgccgugguucaugccuguaaucccagcauuuugggaggcugaggugggcgaaucucuugaggccaggaguuugagaccagccuggcaaguauggcaaaaccccgccucuacaaaaaauacaaaaauuagcugagcaugguggcggcaccuguaauccuagcuacuugggaggcugaggcacaagaauccuuugaaucugggaggcggagguugcagugaguuaagaucaagccacuguacuccagcaugggugacagaacgagacuccaucucaaaauaauagcaauaauaauaaaaaguggaagaugcccccacacuugaucaagcuagccccuuccacuggaggacagaggacucuggucuggggacacacacaugcccccacacaggagcucccccacaucuggggauacaaaaaagaccccuuggggacagauauguccuuucuucuggggacagauugauaggcacccagcggaagagccaggaccucu

SEQ ID NO: 15897 - RNA, 448 nt, Homo sapiens
acucuaagauagcgucaguuguaccagugaaggacaagaaacuucuggaggucaaacugggggagcugccaagcuggaucuugaugggggacuucagcccuaguggcauuuucggagcguuucaaagagguuacuacugguacuacaaguacaucaaugugaagaaggggagcaucucggggguuaccauggugcuggcaugcuacgugcucuucagcuacuccuuuuccuacaagcaucucaagcacgaguggcuccgcaaauaccacugaagaggacacgcucugcacccccccaccccacgaccuuggcccgagccccucugugaggaacacaaucucgaucguugcugaauucuuucauauccuaauggcaauuaaccuccaaauaaaagaugacugguaaaaaaaaaaaaaaaaaaagaaagaaagaaaacagaagaacauuu

SEQ ID NO: 15898 - RNA, 722 nt, Homo sapiens
gcuuuccuuuccgucuggcggcagccaucagguaagccaagaugggugcauacaaguacauccaggagcuauggagaaagaagcagucugaugucaugcgcuuucuucugaggguccgcugcuggcaguaccgccagcucucugcucuccacagggcuccccgccccacccggccugauaaagcgcgccgacugggcuacaaggccaagcaagguuacguuauauauaggauucguguucgccgugguggccgaaaacgcccaguuccuaagggugcaacuuacggcaagccuguccaucaugguguuaaccagcuaaaguuugcucgaagccuucaguccguugcagaggagcgaguuggacgccacuguggggcucugaggguccugaauucuuacuggguuggugaagauuccacauacaaauuuuuugagguuauccucauugauccauuccauaaagcuaucagaagaaauccugacacccaguggaucaccaaaccaguccacaagcacagggagaugcgugggcugacaucugcaggccgaaagagccguggccuuggaaagggccauaaguuccaccacacuauugguggcucucgccgggcagcuuggagaaggcgcaauacucuccagcuccaccguuaccgcuaauauaaguaaagucuguaaaauucauacuuaauaaacaauuuaggacagucaaaaaaaaaaaaaaaa

SEQ ID NO: 15899 - RNA, 665 nt, Homo sapiens
cgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaag

SEQ ID NO: 15900 - RNA, 4914 nt, Homo sapiens
cgcuccauuucgagcaugacuucauuggcgucagcaacguuuugcuguucggguuuagccgccauguuuaaguuggccggguuucgcaccacugaggucauggauacucaggccucuuugcguguuucuucaacacugcuucuaagguuaaccgcguuacauuuguuggagaaaauccugggaacgcugaaaaggacuaguggguggggugcgaggguggggucuugcccgaauuaaagauggccgcagucagcucugccccgcgcaauuucacgucaaguuuuggagcugcgggagccggccaguuggccucagcgccuccuuacggaauuggcguaaggcaaagaggcgcggcuggaagaaccagacugagaaagugccacagggcgggggccgcauccgccccucggcuucugguuacugacccgacggcuuugugagugaaagugaagagacacuucgaggcaggugucugugcuccccauucaucccuguuuccguggcuaucuugacuuucggggugaaaagugagguuaggcccuguuuccccgacccuucccucgcgccaucacacucuaguggccuggcacagccccagaggucggccgcuguagcccccauugcggacucgccacauucauauuggcucaccuugucggugcccgguucgguccucuuggagcucacacuccaguugaggaaaugaauggacacaggaacuacuggguaacaaaauacuaauaaagggcugcgauugugugaguuucuacuguagcgaugaaugucgcugucauuggaacguuccccaagugccuucuagugaaagccuuacuucacucggaauaaccuguggucuuuucuugaacgugauggcucucuugguuguauucuucaugcacauguguuacuuuuccuguuuaacuacauguuaaagaaauguguauguuccuguuuaacugcauguuuuaaaaaaguauguguauuuuuaaguuauaggcacgugcaagaaaguucagagcaaaauagcuuauauuagugaaacaauaaaugucuacuaauaggagaauggaugaauaagugucauuguugaacaaauugacauacaacacgaaccaaaaaaucagugaacuaaagcuaccauuuuucauauggauagagucauuaaccuaauauugaggaagaaaugaaaagacagguugcggaaagauauauaugacauaccauaaauaaaaguuuaauaauuacaaaaaaguaagaucaaacuaaaaauuguauaaggaaaugauagauaccaaauucagaauacugguugcuuccagagaugaacagaagggaauguaacaagaaggguucauuuguaucuauaacguuuguuuucuaccagaaauaucuugaaaauguggcaaaacauuaagcuaaguagagggcacauggguguucacuuguaauuauuuccuuuacuguucuauauacuugaaauauuuccaaguaauuuuuuuuaagaaaagaaacuuauagaagcaacuuauuuuguaucuugauauaugccauuucguaagucuacauuuuuacugaacugcuuaugaagucuguugcaacuuaucuguucaaucauuguuuuaaguuucugaaacuucaaaugaacuuuuacuuugggaaauuuuguugaauuucuauuuuugaaaaaaagcaguguaccaaggaggguaaauguauauagccuccggagucagacugccugaguucaaaucccagcucuccauuuauuaggcuugcaaccaagaacaaguuacuuaaacuuuccugugauccaguuuccucaucuauaaacggagauaauacuuaucuaacaggauuuugauaagaguuaaauagacuaauacaugaacacggugcuuagucaaugcuuaguaaauauuaccuaaauauagauuauuuuaaaauauaaaauuaaagcaaauacuuauauuaauauaaccuaauagucuaaaggaaguaaaucuuugccucccaucucuauugauaauauuucuuugaggaagaucucuuaauggguaugaaagaggugaauuguguuauuuugugcuaugaaaauggauaaauucuuaauagaaacuauauuaaauuccuugucugaaguuuguucauguucaccccacacuaugauagcuucacuacuuuucauugaaaaucacacagaguggccgggcgcgguggcucacgccuguaaucccagcacuuugggaggccgaggcaggcagaucgccugaggucaggaguucgagaccagccuggcuaacauggugaaaccccgcaucuacuaaaaauacaaaaaauuagccgggugugguggcgguaccuguaauuccugcuacucgggagacugaggcaggagaaucacuugaacccaggaggcggagguuacagugagcccagauagcaccacugcacuccagccugggcaacaagagcgaaauuccgucucaaaaaaaaaaaagaaaaaauuauacggaguguuacaggcaaugaaauaaugauauucugaggaacuuucuuuguagggagguuucauagccaauguucuauaauguauauacauguguuaugcaaauuauacguggugcacgaggaaagagaauuguauugaucuuaugaucucuuuauugcacuuauuugcaauauuuaugaucucuuuauugcauuuauuuguuaauaaaauauagccuagacuuuacugacucagaaacagauuuaaaaaaacugaucugaaauucuggacagaccauauagaugguuuccaccacauauuuacagcguccaaacucacgugggccuucaacuuuaccaagcaaugcuuguuucccuaguuggcucucucuuaauuuccacaacagccacuucugauuuucuccuuauuuuucaaaccacuccccucacuuauucucaaauaagagaauagaaaaaaauagaaaccaucaaagaggaacucaggcugagcgugauggcucaugccuguaaacccagaacuuuggaaggccgaggcaggcacaucaccugaggucaggaguucgagaccagucuggccaacauggugaaacccuguuucuacuaaaaauacaaaaauuagccggaugucuuggcgggugccuguaaucccagcuacuagggaggcugaggcaagauaauugcuugaacccaggaggcagagguugcagugagccaagaucgugccacugccagcccuggugacagagcgaggcuccgucucagaaaaaaaaaacaggaacuccaacaauuuuaugucuccauacucauucuuucaagcuucacgguagauuaggugccccccugucugaggcacauaucucugccaguucccuguauuccaucucuuugugcucguucucuagauucucacuccuccugccuuuccaggaacugcagucaauggguucuuuauucaacaagcuucuggguucugcaacuaccacuccacugaaauucucaacgaggucaccaagaaccucuuguguucaauccaguagacccuuugucuuauuuuccuugaccucucugcagcauuugauacuagaacccuuggccuucugcauucauaugccuugauuugugaaaccacacuuuccuaguuuuucuccuagaucucugugucucuauuuuaccuuucaggacccccuucuggcugucaaauauccaugaaccccaaaguugugugcaauuuguuucuaucucacuuuuuacauuauccuuuauguggucucauucaccuucauggcuucagccgccguauauacacuaguaacuccuaaugcaaguuucuaguccaguucucucuucugacuacaaaccuauaugucuuacugccuucaaaauaucuguccuggauguuccaagauaucucaaaaaucccaaacuaaacucuuuauuuuaccagcuuuuauguuucuaaucucuaaaaguggguaucaucaacccgcuuuuguaaaccagaaauauggguauuuacucagcccgucucucucugucagccauuagaaagcccuaucaguuuuuccuucucaacucuaauuuuccauuucucuccgcuucauuacuauucuacuuaagccauaauuaucuccugccucaacuccuugcaguagcuuuucuggccgguaauacugcaacucauccuuuacaucguacccagagugaccuuucuaaacuuuaacuaugucaguccccuguuuaaagucuuaaaauuuuccuugaagaaacuugcaugacacauucccucauuucuggcuaaucugcuauaccuugcucacccuaaauccuaguaagcccugcugcucccacuucacucuccuuuuuacauuugcauuccuuaccugguuuuuccuuuaagucucagcuuaaccacuauuuucucuaaaagucuuccuugaucaccaaaaacuaggcuagguacccucucaccucccauaguaucuuguguuuucuccuaugguaguucuaguagcagaguuuuguaaauacuugucuccuauuuaagagagacaaauuuaagucuaaacuccuuaaagucaagaucucuugucuuguccaccucuguagccucagcaccuggcccaggauaugguauucauuacuuuauuugacaauuacuucuugagugauaauuggauacuaggcacuagcacauugguugaaguguggaauggggaaaccucaagagggaaucucuugagaugugccaagacgucaaugucuuaauuacaauaauaagacguauuuuuuaccuuuuuuguucccauuauuuaaugagcacacagugucauuuuccagagauugugugaagugugauauugcaacagcuugaaugcaaaaacaaaauaauccggcuaucuucuauua

SEQ ID NO: 15901 - RNA, 2460 nt, Homo sapiens
caugccuaaucaaggagaagacugcuauuuuuuuuucuauucuacauguaccaaaggugacagcugcccauuccgucacugugaagcugcacuaggcaaugaaacuguuugcacauuauggcaagaagggcgcuguuuucgacgggugugcagguuucggcacauggagauugauaaaaaacgcagugaaauuccuuguuauugggaaaaucagccaacaggaugucaaaaauuaaacugcgcuuuccaucacaauagaggacgauauguugauggccuuuuccuaccuccgagcaaaaguguguugcccacugugccugagucaccagaagaggaagugaaggcuagccaacuuucaguucagcagaacaaauugucuguccaguccaauccuuccccucagcugcggagcguuaugaaaguagaaaguuccgaaaauguuccuagccccaagcauccaccaguuguaauuaaugcugcagaugaugaugaagaugaugaugaucaguuuucugaggaaggugaugaaaccaaaacaccuacccugcaaccaacuccugaaguucacaauggauuacgagugacuucuguccggaaaccugcagucaauauaaagcaaggugaauguuugcauuuuggaauaaaaacucuugaggaaauuaagucaaagaaaaugaaggaaaaaucugaggagcaaggugaggguucuucaggaguuuccagucuuuuacuccacccugagccuguuccagguccugaaaaagaaaaugucaggacuguggugaggacaguaacucucuccaccaaacaaggagaagaacccuugguuagauugggccuuacugagacacuggggaaacgaaaauuuucgacaggcggugacagugauccuccauuaaagcgcagccuggcacagaggcuagggaagaaaguugaagcuccagaaacuaacacugacgaaacaccaaagaaagcucaaguuuccaagucucuuaaggagcgauuaggcaugucagcugauccaaauaaugaggacgcaacagauaaaguuaauaaaguuggugagauccaugugaagacauuagaagaaaugcuucuugaaagagccagucagaaacauggggaaucgcaaacuaaacucaagacagaaggaccuucaaaaacugaugauucuacuucaggagcaagaagcuccuccacuauccguaucaaaaccuucucugagguccuggcugaagaagaacauaggcagcaggaagcagagagacaaaaaagcaaaaaggauacaacuugcaucaagcuaaagacugauagugaaauuaaaaaaacaguaguuuugccacccauuguugccagcaaaggacaaucagaggagccugcagguaaaacaaaguccaugcaggaggugcacaugaagacgguggaagaaauuaaacuggagaaggcacugagggugcagcagagcucugagagcagcaccagcuccccgucucaacaugaggccacuccaggggcaagguugcuacugcgaaucaccaaaagaacauggaggaaagaagagaagaaacuucaggaaggaaaugaaguugauuuucugagccguguuagaauggaagcuacagaggcuucaguugagaccacaggaguugacaucacuaaaauucaagucaagagaugugagaucaugagagagacgcgcaugcagaaacagcaggagagggaaaaaucagucuugacaccucuucagggagauguagccucuugcaauacccaaguggcagagaaaccagugcucacugcugugccaggaaucacauggcaccugaccaagcagcuucccacaaagucaucccagaagguggagguagaaaccucagggauugcagacucauuauugaaugugaaauggucagcacagaccuuggaaaaaaggggugaagcuaaacccacagugaacgugaagcaaucugugguuaaaguugugucaucccccaaauuggccccaaaacguaaggcaguggagaugcacccugcugucacugccgcugugaagccacucagcuccagcagcguccuacaggaacccccagccaaaaaggcagcuguggaugcuguuguccugcuugucucugaggacaaaucagucacugugccugaaacagaaaauccuagagacagucuugugcugccucuaacccaguccucuucagauuccucacccccggaggugucuggcccuuccucaucccaaaugagcaugaaaacucgccgacucagcucugccucaacaggaaagcccccacucucuguggaggaugauuuugagaaacuaacaugggagauuucaggaggcaaauuggaagcugagauugaccuggauccugggaaagaugaagaugaccuuccgcuugagcuaugagaaaugauugauagcugaaggugguagugaggacacuuuaa

SEQ ID NO: 15902 - RNA, 26661 nt, Homo sapiens
gagccagggccugaguuaaacccuaacagcguuuuucccgccucguuuuucuucaaugggggaaaaucuaaaggguaucugagauaggguacuuccgguaguaacugucaccuuugcccucgucaggcgacauuucgcgugcgugucaaagggcugccuuucccgucagcacucgaacagcguaauauccgaaugugaaaggcagcccaacguguaucgagcuaaaguaauaagggaaaaguagccgaaagcacuccgagaagacaagacaacugcaguucuguagggacugcgcggcacgcgugggcccagagccugucccagcgagguagcagcugccaugccgaccgcuggagcgccggccgcgcucucccugcgcaugcgcagcgagcucuccuccgggcugccgggagucccaggagcguuagggggugcgccugcgcgccgcugcuccagcgcauccgggcuggagcucgcccgcccccucccccgcccggagccgccgaagcgccucggugcguugcaccgccggaggcugggcagcucgcagcgcugcucggcgcuggaccccacccggcaggcgcaggccacccacacccggcucugugcggcugccccccgcagcauugcacggccgacccucgcccgcccacugccaccggccgcgggacuggcugggacuggcucggccgagggcacugcuccucggugcauugcugcucgggcgccgcagcccgcagccgccagccucccccggccgugccccucccccguggagccggcuguccgucggcgcccacugcccggcggcagcggcggagccaggcagccccgcggcggccgagcgcgcucgcgcaucgggcccucuggccuucuuuaccuagggcagcccgcgccccggugcgagggagcgguccuuaccgagacccgcccggcccggcggugcgaugagcuucuucggcuucgggcagagcguggagguggaaauccuucugaacgaugcagagaguaggaagcgggccgagcacaagacggaggacgggaagaaggagaaauauuuccucuucuacgacggggagacggucuccgggaaggugagccuugcccucaagaaccccaacaagcggcuggagcaccagggcaucaagaucgaguucaucgggcagaucggugagucgacccccgggacccccucccccagcgccgacagccggccggggagcagggugauucagggcccagcuccuccggcgaggccugucacagucgcuugucaacugcagucugaggccugggguucagcuacaagucccgcccgugggcgacucccccugcguuacuguccucccugccaaaagugacagcgcgcugccagggagauggggacggcgagggcgggaggaagcgcccugcugugccucgugggaugggcaccuugccuauggguucuccccauugucuccggcaugcacucggcuuugcuucuuguccccaggauuucugggugaggugcucuggccauagccugcagguggguuuguuagggggagaccgcucugccaauacuggcuuucccaucgcccggccaucugcaacugccagacgcaaagugaggcucguccaccgagccccacuucccagagcccgcaccaacccguuuuucucuuuagauguggugugagagagcuaaccaguucucucuuaccucaccucagcccugaacuaccuaugcuuguacauguuuccagaaagaagacccauaaucuucagucuaaaucugacuaccuaggcugcguuucuuagacuucuuuauuagaaugcaaguuuucaguuaccacauuuucuguuuaaagacaaagaaaugguguuucuaaaaaccacaauuaagugaucagaguuucucaaugcuuuaaacaugauuauuaaucauuggaacuagacagcgccaggcacaguggcugaugccuacaaucccagcacuuugagaggcugaagugggaggauugcuugaggccaggaguuggagaccagccugggcaauauagcaagaccugccucuacccccaaaaauuuuuuuguaauuagcuggucgugguggugcuugccgguaguccuagcuccucggggggcuaagaugggaggauuguuugaacccaggaguuccaggcagcagugagcugugauaacaccacagcacuccagccugggugacaaccagcaagacccugucucaaaaaaauaaacaaauaaacaaauaagaacuagacaguaaaaggcaguaaugguaaagugauuuggggagcucccagucaagacugggucgucuccaauucuaagccuuauuuagacucuuguguauuauuaaaaugcuuggguacuuuuaaaauaaguuguuuuugucguuagguuaggaguagaaucacaguaaauacccugugagcuacacaccucugguagagaauccauaccgauaccacacacugcauacauaacucuguuuuuagagacuuccuuggggaaucuuuguuaaacucucuuauccugagaguuuagcaaagaauuugccgucuuuuuuucacagaggcaggaaacacggagacacagguaggagaaacccugggaaaaggaggccuuguggccuggcucuuggguucacugcucagccucaagcauuuugccucugguauuuaagaacaugaaaucagguugaagacuggcugaucuuacaggaagcucuuuguuguuauuuuaaagccagaauaugaaaggucuuaguguaccagaaaaggggccgaagagugaguuccaugccuucugcuuuccugcuucuggguucaauggugggguagauggcaagguuccucaguagcagcacugugaugucuggcaucguuuggcauguugucaugggauguuuagcagcauucccagccucuacugaccagacaacaguagcaucccccacuugcgaccacaaaaaugucuucagauauugcuguauauccucuggaggguaaaaucaucucuagcaaagaaccccaggauaaacaggaugaguccaaagcauauuaugcuacgcauaguaaauagucgagaaauccuugccuauugagcaagguauuuuuuaguagcaguuuuaaaguuauugcauugauucuuuggcuccauaauaauaauuaguguuggcaggcauguuuagucugugucuauaccaucacucccagauggugguaccuuaccaguaugugaaagauaacccagaaugucuucugccccagacagugugaaauuagcuguucuaggaaccgugucaaggccuuccucuggucuaaaugaaagggaguugaagaaacugcuugcuguuccugccccaccugauuucuugucuaucuccuuacuccugagacauccaucaucccugcugaauuuucucagaaccuuuuguugcuuccacuaguaacucuucccgggcccuuggccacccugcacugaguugaccaugagacugggggaauuuagccacucucugggccucggcuuucucagcuaccaagcaaggaaaauaacaucacuuggugagaauguugggcaugccaggggaucaugcaugacccuuauagaggguuccuuuauaaaauuaugguaguuguaguaaaauguuuccauuucacaaauugaguuaucacccacuggcuugcugcucuuccuccuguaccuguuuuaccugaagaagaucgcccugucuacugauaaggagugcauguuucaacccuuugccuuaaauuucuuacuuuggccacaugggccagucucaguugguguuguagauggagccagucccagcuuugugcugaaguauauuguucacgcucaauuauccaugguuacgugaggacauggaaguagaauaacacagaaugauggacaauauguuucugauuauuuggcuuugggauguauuucuugaucaagaacaaggcauuagaauaaccuuuguaguucuauuugauguaaaagggaguuuguguuccugaaauacacacauggacagggaguaaagauguacuauuuggaagucuauuuggaggcacagagugacuuuucuuagacaacauguuucuuauuauuuggcuuugggauguauuucuugaucaagaacaaggcauuagaauaaccuuuguaguucuauucgauguaaaagggaguuuguguuccugaaauacacacauggacagggaguaaagauguacuauuuggaagucuauuuggaggcacagagugacuuuucuuagacaauauguuucuuauuauuuggcuuugggauguauuucuugaucaagaacaaggcauuagaauaaccuuuguaguucuauucgauguaaaagggaguuuguguuccugaaauacacacauugacagggagugaagauguacuauuuggaagucuauuuggaggcacagagugacuuuucuuaaacucuuauauuccuccuauuuuaucuuccugguuccccgaaagaagcauguugugaaguauuugugucauacaccugugucagucauuguaaacugagcuuggggcaccagagcgaggcuagugagugaguuugcugaagcugcggucgugugguuuucuccuucauugcauucuuugacuaugugugagauggguggaacuucagucuguucugaggucuggcugacgggguggcauauggcaguaaucaaguugauagcacugagcucugucccucuuccuuguuaauuuggaggcaggcaggcagaggugucacuuuuauccugucacuugcuguggcaaucucaucugcaccgaugacuuauuuucuuuguuuuuuauuuaaaaaauuuuuugagacauggucucacuccgucacccaggcuagagugcagugccacgaucacagcucacugcagccucaacccccugggcucaagcaauccucccaucucugccucccaaguagcugagacuacaggugcaugccaccauacccagcuaauuuuuuaaauuuuauguagagacagggucugucuuuauugcccaggcuggucuggaacucaagcgauccuccugccuuggccucccagagugcugggauuacauacaugagucacugugcugagccccaugaauuauauucugaugacucccagacuguuucuuuguucugacccgaccucucuucugaguuucacacgucuuugaagcugucugcuagacauguccaccgggauacccuacaggugccucaguaaugcaugcaaacacaaaccccucucucugucucugcuucagccacagccccacugcgucuccuuuuuuccccauuucggccuaugucagcugggaucauuuagccucagaaaucuagaagucauuuugaagucuuggcuccuccucccacacaugcaguuggcugcuaaguuuuggccuucucugcugguucugcaguauaucucaaaccagugucuccucucucuucucaaugccacugccuuuuauuuucuguuuguagcagcuuccuaaguggucuuccugccuuugucuuccuccccuuucaggucauuuucugugaggaugaaguuucuuaaaggcaguucuaucauugucaguccuuucuuaaaauucucgccucccuauugguuaaugggggaaaguauauccaaaucccuccugcucuggcccucccucucuuuccagccucgucuccccuaacccuucacucucaccgcuuguggguuccacaaacuauccuuuucuucuggaaucuugguauuuucccuuuguauaguaacaucuuucugcaagauauaaccuuccacccaagcucuuacuccuucaaagccuagcuaacaucacauccaucagaaagucuucucugacuuccccaggcugacuuaagugcuuccuccacuguucuuccagaggccucauuaauaccucuuuucaagccggguaugacaagcuugugacuuuuuuaaaaaacuugucugucuuucuuacuaauuucugagcaccugagauccagggacugccuucagcccaucauuagugcaguggcuagcacauagaaggugccuaguaaauauuuguugaauggauauauuggucaaaucuaagaauuuacagaaacuauucuuuguuguuguuuuguuucauuuuguuuucuuuccuuuucccacaucuccucccagauaagcaagaguuguuuuaaugaaagaaagacagaaaucagguuuguuuuggugguugagcagcugagcuuccugccuuuguuguggaggaggcauugaugagcaacaugugguuguccaucaaggccacugacaacucggugacucuccagcuggugugcccccacuggggcugcguccucacugggggaacugggauaaggaaguauuaaagcugaugucaguuuaccugccuuuacaucuuucuuuccucacacucuucugugccaaguugaaacugauauccccuuguguguaagaacguaagaguugucaaaccucuggcccguuugguccugcaccacugcucagauguggcaguuugaacguugccuccugagacuauaauaucuuauuuauucacuuaugugguggacguuuuucuguuauccucugcaaguuuucgagccacacugggauccuuccuguaccuaggauacuuuuccaguggcuuggucuguguucuaacaaugccaacacauguggugagggcaucucuugggucaggcccaugggacagaaaggucuaagaccuagucauccuacuggcccacgucuuuaggaagaugcaguagucuguaaggagcacugcaaggaaaaacuguaacugugagaagaagagaccguuguugagcuggaauccuuuggggaacaccagugaaguuuagaaagcagaccugggccgccuuggagacuaauggguuaaauaaaccaaacguaauuagaaggucagacaugcggaggagggcagacaggaacaucccugcacuccaaagccaacagacauuaucuggauuuuuuuuuuuuuuuagguuuuaauaagcccauuaauaccaaucaagcccauacuuuuaaaaacuccaggggcuuucuguauuuuaauucauuagcccuugaaacacuaaguaaaaggcacauuaagaugagguggauugauucuggccuacuuaacaagcugcuggugggacuggagcagagcugcgccuggugaggcgugggccgcucagaggugccagugcuucuggguuucacaggguuggcagacaggaguagggugugguaagcacgaauccugacaguggccagccagcagacaguggcugggagggucagaugaagaggaggcucuuuggagggcuuuuuuuuuuuuuugagacggagucuugcucugucgcccaggauagagugcaauggcacaaucucagcucacugcaaccucugccucccggauucaagcaauucuccugccucagccucccgaguagcugggauuacagaugcccaccaccucgucuggcuaaucuguguauuuuuaguagugacaggguuucaccgucuuggccaggcuggucucaaacuccugaccucgugauccacccgccuuggccucccaaagugcugggauuacaggcaugaaccacuacgccuggccuuuggaggucuuuuuaugcuuugcugacuuagguuucuuccaaaacugcacgaggccuagacuaaacauggccuuagccaagcagcaaagcucagggcggcugucaugggugaccugugaugcaaagcuggcucaguuuccuuccagaauggcaaauucacuucucaacuguugguggcaaguuucaccaugaaaacauccugaguacaaaaguuauuuccuccuguuggacugagaaggaaaccaaagacaggauaguuaccuuaaccaaaaacuuacucaguuccuacuucuagccugacacgucuggucccugaggacuggugauugggaagaaugaaagaugacgcgugguugcuucuuugggacggaauagaggcuauuuacaaucucuuuagggcccagaccucucgugagaacagccuuggauuuuuguuuuaauuuaugcaagaggaaaccaaacuuucuggcaaauaggaagcaucgcugugucugccccuuugccccacaguguuugcagaaguauugcagauggcuuauaaaggauagauuaaaaaggccaggccagcccugcugugacugcacacuggccacucuuccaugacauuugaugucagagcugauauuaacaugugugcaggaggaaaggcacuagggagaacgugaugcuaugcagggaaugacuucuccugcuccaggugcccugcuggggcaggccgaaccuucugcacuguugcuaggcuccacaaugcuggcagccugagcgcucucugugccuucucuguuuuguuuauuccugauguugccuuugggcugugugaucgcauuucuguauuuuuccauccuuuucuucuccucuuccucuugacucuggaccauugauucuggacacuggggccuugcucugccugcuucuguccccugaaacuauggccagaaucuagugcuuagaaacugagguaccagguucccaagucaagguuucggcuuccacacgaaagccaacaccaucgaccaggacucaugcaacaagaguaagccgaggagucccuguccccggggcuggccgcggcuccgcuucugccugucauauacuucugacuuuuauugggggggcacaauuacuggauugcucacuuuccacccauaauuuggagcugccaccucccacucugaggcuuuguggauuaucacucacuaaccagaaugcugccuacuauugaaaccacugaguguuuggaaaggaaggucauuguuuguaauaaaagauuguggcugauuguaguuacacgggaaaucagccacaagccacagccacacaauacacugugaauucauacagaaguggcaucacuagugugggaucccagagacuccagucuguggacucgccucuuccuccccaagcagcaaacaacagaggcaaugagugugcuccgccugcucuguguucccaauucaucugccccgcugcaaguugcagucuagcacgggacuugaacacagaauccuugaggggugguggcuugaacuguaauguggccaugcauagccacagucaguauuaagagcuuaccucggccgggcacgguggcucgcgccuguaaucccagcacuuugggaggccaaggcgguuagaucacgaggucaggagaucgagaccauccuggcuaacauggugaaaccccaucucuacuaaaaauacaaaaacaauuagcugggcgugguggcagaugccuguagucucagcuucuugggaggcugaggcagaagaauugcuugaacccaggaggcggagguugcagugagucgagaucacacuacugcacuccagccugggcgacagagcgagacucugucucaaaaaacaaacaaaaaaagcucacuugugcagggccagguucuaggaagcaccagggagcuggggaugugggccuuaucuuuaaagggccugcaguccacagugggagcgggggagaccagguauguagcaaaacuuauacuuaaauagaauauaagcaaacauaaaauaauauaggacaaauggguggcaugaacuuaucaucaaaaaauaccagaacuauuuccugaagaggauaaauuuagagcaaugcuucuuaaagcguggaagugugguagcagccguccuggggagcuuaucagaagggccaguucucaggccccaucccagacuccugaaucagaaacacuaggguggaguccagccaucuguguguuaaccagcucucucagugacucuggugcacacuaaaguucgacacccccugauuucaguggagggaauaacaugaaaauguccauguucgauuggccacaugccuuccuuuuggaguaauaacagcagcuacuaacgauguuuuugaguauuugcuguguacuagauacuguucuaagucuuuuaccuacaucaccccugcuacuucacacagagccuugugaaguagguugugucaugaccugcauuauaccagcugauagaaauagacgcagucuagaaggagaccugcucuagucucagcucugcagccagcucugcgacuccaggccagucaguuaagcaugcugugccuggguuuccaucgucuuuuaaacggggugauaagaccugucuuagcugugucagaagauuauuauuauaaggaugauaugauuaaauagcuauauccuuucggaaguuggaaguguuaaaugcuguuuaaagaaguguggcauuucuuauauuggcucccaugacuuacccuuauuaaaagaugguguccgagugucuuggagcaggauuauuuuggguuccuuuucugccacgggauuucacuauauaagacagaaaagccuuuggagaagaaggagggagugaaagagcagaggucaagaaaacaaggcuagaaggggucuguucugcagggagguccuuccagaaagcagucccuccagccuacagccuccagcccccuacucggcccgguguagcucagggucugauaaaggagggcgucgcaucgcugucucucaccagaacucuacuacgaucgcgggaaccaccaugaguuugugucccuggugaaggaccuggcccggccuggagagaucacccagucgcaggccuucgacuuugaguuuacccacguggagaagccguaugaguccuacacagggcagaaugugaagcuacgguaagugaugucugcugguuccccacuguacccuagaaccugccccauguggacaaggaccugaggccguccccacuuugagaaucuucacagggaucccgagaaggaagagugucgcgagcuguggcgugcugguaaaccauuaaccgugggccuucuaggaggaaaguggcccuagguuguagcaugugucaauuucuguaguguacauagccccaccauggccaauuucaagcuaccuaauguuccuaaauguagaggugggagagaugugcuauuaccaucauauggagacacauucccucaagagcagagagcauuguaaagggccggaaaauaggaagugaugagauuuucgcaugucuuaccuuuguuuuuaacaugauucauuuaauugugaguuuauauaauuuaacuuuaaauaauugcuguguuuaacagccaggucauaaaauuccugaaaguucaacgucagccacccccagcacacuccugcuggcugggugucaggagauccugaccugcuguccggcucugccacacagcugcagugugaccuugagcucuguaacucagcuuucucacuucaaaguggguaauggacuuggauucuaauucuagauguccucuucuuuugggggugauaagaaaauaaaguucuuaaaaugugaacacauagguacauggauuguuuuuacuguuauaguguuggaaacucugagaauagagacugaugccaaggucuuuugggugaaaaaaaaucuacagcagauauagacuguuagguguaaacuugagguuaugugaugcuacugggauaaagcagucuccccugugacucugaacaccugauuccaggucuugauaccaucucauaagaucgguuuaucuccucaccugaggaccugaguuuaggaugguacacaccacaagaccuuuaacuucuuuucuuucucuguccucccuucuuccaucagaagagugaaggcucuuuuuaaaucuuugcagagguggugguucacgccugugauccuggcaccuuggccaggaauucgacaccagccugggcaacauauugagacccuaucucuacgaaaaaaaaaaauuuuuuuaauuuuuuuaaaagaaaaaaaacaaaucuuugcagagaggucuaagacugacauuacacccaguaaagacagugucucauaaucgcacccagagaaugcagcaaccgcgaggaucaucuagucaucacuucaguuugaccgagggauuuauuauuuaauuuuuuuuucuuuugcaguggauuugucuuaagcguuuguacggcagaaagaaagguguugaaaccaguauagcagugccucaaaaaauuaaacagaauuaccauaugaucuagcaauuccucuuuuggauccagaagcggauccaaaagaauggaaaacaggaucucgaacggauaucuguacacccauauucacagcagcauuauucgcaauaaccaaaagguagaagcaacccaaguguccaucaguggguaaauggacacaggaaauguguuuuguccguacaguggacuguuauacagccuucaaaaggaaggacauucuguccuaugcuacaacaugggugaaccuaaaggacauugugcuacgugaaagaagccugucacaaaaggacaaauacugucugauuccauauauaugagguacccagagcagucaaauucauagagacagaaaauagaaugguagaggcccagggcugagggaaggaggaaauggggguugguguuuaaugaguagaguuucaguggcggaagguggaaaaguucuggagacugauggugauguuugcacaauacgaauaucauuaaugccacugaacuguauaauuaaaaauuguuaaagugguaaauuuuauguuauacguauuuugccacaauaaaagaaaaguguuaauguccaaaucacaugaagacuuuaggauucauguugcgaaagagaggagguagagauaggaaaauuaguugaggacaguuuaaagauguaacuuccagauuaaaagcuuuuucuuauuacacaggcagagggaaaacaugaaaagauuauuguggacuuuucuuuugucuuuaggcagagaaaagguuauuuuggaagauuggaguccauauguagcauuugguggaugggaagaguguagagacaaaacuaucagaaggcuauugugagguccuccgaguaugauuuugguggcuguaaugggaacaaagagaaagugaggaauguaacagacaccagcagagauuaccagugagugcaggcaugcagccguggagauggagacagagggcuaucaggaggaagaaaugaucuggagauaaggugauucauccagcucuagagggcaggcugaaauacuggcaaaauagagaaagcauaaaaguuuagcagacaauuggaagcgcagaccuggcacuaaggacagaggggacacuuagaaaugugcagucaggacugaucugcucagaggucauaacugauacguuuuugaagaaagggagcacaaggagaggagagccaggacccaccagggcauggcaggaggaggagaggggggugaaucagggcagcgccucuguggaaccgcgggaagaguguuucaaggaagaaguguuucacgggacgcagaaucaagggcugcuggauuuggcagcugggaggccauggguuacugaccucgaggcgagcgguuucuguugggugguggagacagaagcaagggguugggaggagugguucguggagaagccucagcuguuggugcagaacccgccuugugacaguugucucugaagaaaggaaaagaaaguaugguaggucaagaggguaaggccuggagaggguucuugggauuggugacuuuggaaaccaauuuuuuaauaagcucagaggaaaaggccuuuagcuagagggagauugaugaucuuggggaaaucagaauauguagaaggauccagaugccggaccaaggcuuccacauuagaaucaugugggaagcuuuuuaaaaugcgaaugccugugucccuuuccagacaaucacauaucaggugugcccaggcagcaggauucuuaagggcucuccucuccuggugauuucauugugcauccauauggagaguucuugggccggaguggggaggagaggucuugagagggagaggugcuguuggagacaggaugggugaaaaugcagagacauguuuaggccuuaaguaaggaacaaagcagaggaaggagcacauuguaagucuugacugggaaggccuucaucuucuuaguggaguaaaagucagugucuucccagacagcgggguggggagacuugggaggcugagcaguuagaagagggcuagggacaggugucuugggcagugugaugguuacugaggugaaccgaaaggauccccaagaagcagccagugccacacagaggauaguagccgaaauguguaguugguauggcuagcauaucuuuauguauuuauuuauuuauuuuuauuugauuuuauuuuuuagacggagucucgcucuguugcccaggcuggagugcaguggcuugaucucggcucaccgcaagcuccgccuccuggguucacgccauucuccugccucagccucccgaguagcugggacuacaggcgcccgccaccacgcccggcuaauuuuuuguauuuuuaguagagacgggguuucacuguguuagccaggauggucucgaucuccugaccucgugauccgcccgccucugccucccaaagugcugggauuacaggcgugaaccaccgcgccuggccauaucuuuauaacuucaucugguaaugcuugacagaugguggggauuaucuaaguuuuauuuaaaagaaaauacaauuuauuauauuacauuagauuauauuaaaauaauguuuuauggagaaggaaauacaauuaaagagcuccuccucauugaguguuagcacagugcuaagugccggggaugacagugcugcacuggcgggccacagagggcagcuuguuaaacccuucagggcugugucucugucuucucucucauccccuccacagcagcguccuccccagggauccuagguucagccagagacuuguuauucaacagaccagguccugucugccccuguggcauauaagguuugcucuccuggaaugcccuuuucucccuccacacagcacuggaucgcagcaucucaauuagcccuuuccguguguucccauuucucuauuugcccaucucccccggugaacugugagcuucccaugagacuguaucuuauucauccugugcuuagcccagugcuuagcucaguaaauguuuguggaaugaauagcugacuuaauuucucucuuuccuaguccccucuuuuaacuuaagaaagguuuauugggacacuuuaaaaagguuuauugauugaauauuguucggugaacaaacaugcaaagauaaaacuacgagacggacuccuuugccccaaaagccaggaguuagcugaugaaauaaaaccuguacacaaauacauggucaguagugguaagggccgugaaaggcccaagaauaacaugugauugggguacaaggcagagaaaucacuuucccuuacagcaggauucuugacccgggggcaugggcucccuagagggauuugggggaagggucuuugaacucccuagaauugugguugaaaaggucucuguauagguacauaugugcaucuuucccuggaagagggucuguaacuucuuaaaaggauacaaagcccucaaggguuaagaaccuuuguacaggcuucucucaagugggccaauuugguaccuauaucuagguagcaucuggagacugggaguguuuauucaugacaguuccgucuccuacagcuauuuccuucgugcuaccaucagccgccgccucaaugauguugucaaagagauggacauuguaguucacacacucagcacauacccagagcugaacucuuccaucaagauggagguugggauugaggacugucugcacauugaauuugaguacaauaaauccaaguaagugucucagugccaagguugugaaaugauuauuuaaggagguuaagaugggacuugaugcagaugcaaacugaugacccucugugacucgacugcuuugugguggcaugcggugggggaagaccgugggagcaauccagugagugucuauggcaggccagcugcagcuggaccgaccacgacguaaacacuucauuuaccuaaacuaaaccauauucaacuaagguggugucuuuaaguuaaacauccuaugaugccucucagucaagcuaaacuaacuugagguuauuuguuuuggaauuccagcuucagcuguuucccgcuacugcuaagaacaaucucagaauaccauuccauuaucaugugcucccuccaucugugucuucagaaaucaaagcgacgaaaccaaauauuggccaugauuugcugcuuccucccugaacuaaaaugaauuauagcaaagaauauuggauuuuuuuuucaagaugggguacaguggcccagucauggcuuacuacagccuugaccuccuagacucaagcauuucucucaccuccgccccuacaaguagcuaggagcacaggcaugcaccgccacacccagcuaauuuguguccguguguguguguguguguccguguguguguguguguguguguguguguguguguagccaagguuucauaauguugcccaggcuggucuugaacuacugagcucgugaucugccugccuuggcuucccacagcgcugggacuacaggcaugagccaccaugcccagcccugauguauuuuuuauaaaagucuuaaaaugacuuuauuuuaacuggcaaguugggaagauguauaucuuuuaaacuguguuuacuguuagaacaucaaaauaauuagccaguuauaaauaaaucacaaaacuuucugacaggguauuucaaaagcaucuuucuuuugaauaugauauuccugagaauguuuggaacucaaauauccaaaaguagaaaggguauucuauucacagagagcuauacaaagaagccacaaagucucuaaguaggauuuucauuguggcacccccuggaccacugucauccagaggcugggagcagugggagcugcaccagauggcucaccuuugaagggucaggaacagaacuuuuuaaaacuaggaacauauaugguucuuggaacaggguuggaggaaugguguguuuuuuccccuggcaggccuggaaccuagagggccccaggaaaaugaccagugugacccagaauuggcucugccucgccuaagcccaccagugaacagagagugaggcaaggugggagggaggcugaucugggccuggcaugggaacagguucucccccuuucuccuuauagccucagggcucugcgguccugcccagaaaggagccauccagagugccuacccacuacuguccugaccaucuggugaaggcagaggccagcagcugugccacccguaggagcucaaagcagccacuggucaucagugcaugccagaccaaagcuaguguggaaaaggugcucuagagaggcagggacgggacacuuucagaccacaccucuccuugcacagcgagcugcucugugugagugccugauuuauaugccagagaacuccagacuuggaaccagguccugcucuuacacuaagaaguugggcggucagcagauacuaacauuuuguaucucggcuucucaucuguaaaacgaggagcuuggaccagaucaguggguuucaaacacacagaaagugugagguggcagcggagcugagauccuuagacccucuggccuuccgcuuuucuuccauccacaagcaacguuuuuguuggguuuuuguuuuuuguuuuuuaacucuccccgcuuacaccuagagcagcuuuugcuucuguauaacauuuagaauacaggaaugugugauuuguaggaguuugaaaacaucucgaauccauggucucuaagcauccccuguaagauggcgcagguggucuccugcugcuuuugcaaauuugcugaggcuguuugcucaggugucugcagucuuccuguagccugugcacagaaggguggugugaaacaguggggaacacuccagccuggggacuaggauccuggguuuaccaccuuucucuacccccuacucacauccugguuauccaagagaacauuaucucuuuucuuccaacugccuuuucuucaccuguaauauaaggaggcugaauucugauguccaugccagcauucuuauccugugagcugagcaucagguuuuaagauuuuacucguucucucaugccugauacgggcugugcacauguagacuauugacugacccagagaaaaaacccugagggucaggaaguguuacccaauguggcucacuucguaacaacucacaaggccaggccagcggagcccagaaagcaggcgcugaugccgagagugauuugcucuucucacucuacugcugcugccuggccugucggccuagagcggacagaacugugugcuuugagccauccagguccaguucucuaaagacauuguguggagaucagaggaagggagagacuggucccugcgcuugugggacuagccucucauacauuaggauaucuuucaaaaacacaaauauaaaagguacuaaagcagcugcaugcuggggagauagagcagaugaacaaacaugaauggguaccaugcaggagagacguccuuugcgugggauguggaagggacagaagcuacuuuaauccaaguaaagaccgcacugggaaacaguucagccacagccaugugggcagugaugggugaguguguccugcaacuggacguuuaaccagcacgcuuggccguggcgugugcgcucuacugaaacagaaaggucuggccacaguaccaacaucuuacuuucuguacuuucuguuccccagauaccacuugaaagaugucauuguagggaagauauacuuccugcuggugagaaucaaaaucaagcacauggagauagacaucaucaagcgagaaacgacggguacaggccccaacguguaccaugagaaugacacgauagccaaguacgagaucauggacggggcaccagugcgaggugagacuccaggcccaggccucggcuaccacagcuuuucucccauguccugcacagaauucuggaggggcuugagggauuacacugucaaaauaagauguccucuuaaccuguaacuucuuaaucucucaguuuacaccguggguggccauaaggaagaaaaggaaggcugaguguguagaacuugaggcuacuaucccaucuucacccugaaaaguugcacuuagacuuggauuauauaucgggcuuguacugaagauugaaccucaagcgucacuuuggaagguccagguuuagcagaugugguuugaaaacguuucugcuucuuccuguugacauucuggcauucucugcugcucaggagcaagggaugcaugcacagcagccugucugugacuuggcucuagcuccgauuuauuuucugaauucacuugucagguagaaagagcacuacuagauacuucagccaacaccaccagguacccagauagcccuggaauuugcuggaagcauccucucccagccccagggagcuaacauuacaucuggguuaguagagcuggaagcccuuugucauuuggggaccgugauuaucuggaagaagcaaucauuuacauucuucauuggcucuuuagccaucccucaggaauggcgaagacucuucauuuugaagugcauggugcuuccaggguuuuauuggcuuauuccuuuuacucccacaggcuguuccauguggaaggaggagcgccacagauuuagcugccugcagcucuggggacacgcggguguuaccaugccaggcccuuggaggguugggaccaagcucuccugacacucucugaugucccauuuugucacuggcugugcaaauagagccagcugucauuuuuccuguacaaaugaaaugggucacugagaaugcauguaaaagagcagauaaugauaagauggcuuauauuuagcuuuagaccacauuauagguuuggccuuucuugguagaauuacugcccuaauuuuguuccacugauacuagaaacggucugauguuagagcuggaagggaucuguaguaucacgcaguccgauucucuaauuuuccacaugagaaaaugaagguccagaggaagcagagacuuaacucacaaaucagaaaagcgguucuugcagaacugaggccauagugaggacuuucugcuuuccaccauaccaccuugccaguccacacaagagggaggauguauuuuggggggcauacacugaggauggagaaagauggcaucagaacugcugggugaagugguggcuuaacuggacuuugacagcugccuuuugaaaaccccaaaacuaaacacacugcauguaaucaaaagaugcuuauacuaauaaugaccugugcuguucccacucaguugcucucuguuuucgagaagacaugagaagcugcaacaugaccuggaguggaacuggagagucacauuuuuguuucagccaccugcugggcagcagagcgacugcaccuucccagaaggcugaagugcucgugugcugcacuccaguggcaucucugcaguggucagagugaccugguauaagggagagggcaucaccuugcccccugugcugacuccugcccucccccuacaggagaguccaucccgauccggcucuuccuggccggguaugagcucacgcccaccaugcgggacaucaacaagaaguucucugugcgcuauuaccucaaccuggugcugauagacgaggaggagcggcgcuacuucaagcagcaggugagggccaggcuccuccaggccccgaugcccuugggacagaacaggaggcucucuuuccuauggaaggucagacuccauuuuugccaagaggugggaacauuaggucgcccacaauugcacaacaagaaugaggauucucaccuggccuuagagucugcuuccucgggccuucuccugcaaccaccugcccuuuuggcccacaccagggacagggaggugcuggcagcugcugccuuuggugagagagaagcagaggagguccuugcccgagauuccccacgucaaaguugggagccucuaggaaaccuguccccaugccucccucuaaggugucacauugccccccuuucaauucugcaggaagugguguuguggcggaagggugacaucguacggaagagcaugucccaccaggcggccaucgccucacagcgcuuugagggcaccaccucccugggugaggugcggacccccagccagcugucugacaacaacugcaggcaguaggcccccagggccgagaagaugcugggcacccacccagcacccccaucuaccaacaccagcggcugggggcgggggcggaccuugugaggcucaguugacccguuacuugcaaccugaaaacaaaucauguuuuugacuuaaauucuuuucucuggagaacccaaggggcuuggggugggaagcagucucuccuugggauucugcggccgaugugggauagaagagguagcauccuggaagccagccucucuggggaacaugagcccccuuccucggggggcugccuugcgucuuagaggagggagagcagagagcacgcauccuuggcuccuggcucucugagcuuccugauacaggaucugagcaugucccugggauucugagcugccaacagggcccuggguagucacaucuuguacuccccuuugcugucccggagguaguggcaggaguugggccagcccccacuaaguggcaggggaagacucacgauugggaagcuaccucuuugggaaucuuggauguggugaucucaaguucccacaggccaccuccuucuggccacucacugcugggacccaggcaccucccuucuccauccucucuggauugucaguaauguccuggaacagaagccugugggauggccuugggcacggagaagcccuggggucagugucgugcacggauggcggcaguguugaacccaggaggcugaacccggcccaccacggaagaugagugcauggcaaccgccugccuucacgucgcuccacuugguaaccccaaggucugggcuguucuagguauugcuucacgugccccagcaagcccuuaacaagagggccugguucccugaagaaccaaucccaggaaggggccuugaucccuccgccuugcugagagugaacccucgucucuccucacccuccauuucauuucugggaauuggggcuuaguuucgaaccuuuggcaaggcuguucuuacuaaugcccaagccccuuuaccccucucccuauagguuacacaggggagaccagggccucggcagaagacugcugccacacuuccgaaucauucugcuugccaaauaggucaucuucaccaguugacugacccaaguuuaggaccauugguaucguguguuuaaaaaacacauauaaaaaaacucuugugaauauucuuguuaugcuagagaggaagguacuucucccucuacggcucugcgcuggggccuaugguaguaaaguuguuuacuguccuuuuucugcuuccccuggaaaugacaggcauuacucucccauuggccucccuucccuuuauagaaagaccaagcaggccccacuggccaagagguacgguauuuggcagucugaguucucaguaauuuggaaaguuaaggaguugguuccugugucaccuuucaguuagugugggaaaggaagacuucuguuuuccugagaucagugcagucucaggccuuuggcagggcucauggaucagagcugagacuggagggagaggcauuuuggguagccuaggagggcgacuggcggcagcagaaccgaggaaggcaagguuguuucccccacgcuguguccuguguucaggugcgacacacaauccucaugggaacaggaucacccaugcgcugcccuugaugaucaagguuggggcuuaaguggauaagggaggcaaguucuggguuccuugccuuuucagagcaugaggucaggcucuguaucccuccuuuuccuagcugauauucuaacuagaagcauuugucaauuccuuugccucccaacugacaacacacguucauuuuccaaccuuccuaacaucuuaaaccuuucuucugggagaacuagaagacagaauuugcuuugauucucucaggcgcugugcacaagccaggucuucuguuuucucuuucuuacucuacccacauucuugccuucucuauccaacugugaaagugaggggaggcuccugucccccucucuuaagguccccaaaccugggagugcauagguacuaaaucaagcagugcaacuuguaauuaagcagcugcaguguuuacauguuucuuaaugugucaucuuuucaauggcuguauuaaaagaagaacguuuguuuuaauggucuuucugauuaaagaaagccccuguggcuuuggaggcauugugcccacgguccaccaaguucuguggucucuuccgucuuacauggucccaacuccgacacucagggaaagacagaucccugcccugauuucccuacauagugccugugcucucacuguauagccccgggugaaaaaugaugaauacuuuauuagccaccuguuugagacaagcacauggcugagaaaugaauucaguucuuaucccuaucuggcaguuuauccagaacugcucaugggaugguuuaaaccucugugggacccagaagaugaaaggggcaggugagcaaggcugguguagaaagaagaguucauuccaguggguguuaccagacugaggaucucagcccuacgucaugcaauuugcuacagaacuacuagugaucguaaagaaagaagguggaggcagcucugcaucugggagcggccaaaggagcccgccuggagguaagaggucugcaguggggaguaucccacugcacucagugugguuuuagaagaaaaguucuucaacuuugauauuuuauugaaaaaaguacacaaaaaccacugagguacacaagcccagguaagcauaccaagcaagcccccucacaccuuuugucugaaaaaagcuugacuucuuugcagcaaugucucgcccauuccagcagcaguaucucaguuaacuugguuccuuuuccuccaggcucaaaacaaaaucaaacucuucuacaaaaaaaaaagggaaaaaggaaggauuaguuuuuaauguccccucuugaacaggaaaguugugccaggcacagguacaucuuacaugguacuaaggcgagcagucauucguucaaaacuauuuaccaggugccaagcacuauagaguacuggguaauaguaacagguaacucuggccacauucccucccucauggguguuacaggugaggaugcugacugagaaaggugaaguaccaugcccaaguuuaaucagcuaguaagugggaauucaugaggucauucugguauauggacaauaaaggagagggcccacucuuacccugggucaggggcuggauugauaaucucuggcgagugaagagaaccauauuuuuuaaggggccaccaguagcuuugugagcuugaugauaggauuugagcucagccaggggaaugaaacguuucaucauccgaacaaacuguacauccaccuaugugacaacaguguacaugacagaaagacgugucuaggcugacugugcccacuguauuuuuaaccgcccacaggaagcuccuaucucaguaucaccucaucugaguaagugcugggccguguaccuugaccuacagucaccccaaccgucuucuuccccugguucauccuuccccugucaugaaauagaaagcauagucuuuaccauggaccacuuaggguuguccucuuugcuagaugggucauaauggggauuguuuuucucaaacuguguguggucuggguaagccucuuucacgaucugaaaccaaaacaaaagcuuugaaucaucugccugcagucagcuccacagccaaucuuuuaauccauauccaacuuucauuucuucccugcacauucuuaacccaucugccuugcuguacagccaaugggggcucagauauuuggaaacaauauauagucuaauauauagacuaggaaaucaacucuguuuuuacaaaagucuuaaaaacaugcucuaaaaacaaauggcaaagguuauuacugguaccacuguuuuuuuccccucugcacaguuaauaauuuuauccugauaagcuuggaggagcuaucaucaggccuguuuucgagugagaucaagacuuagagguggagugaagucugugcuagucggaccugaaugaaggccugcuuugaguuaucagauaggaaggggccagggcaguuuuucccuauuccuguaaaagggggauggggugggggggaguguacuuuuuuguugccuaauuaagguauaucccuuuauaucuacuuaaguuagucucccuggaggaaaagggauucacaccaaaaccugcccaacuaaccuucaugaguccugcgaugccuggcucuuugcaguugcuaugguagaagaaggcuucuucucccagcuucauggcucuaaggaaguuccgagccugucccgggagaagaaagaguaacuauccucccaccagcuggaaaguacuagcuuuuagcagaaaucaagucugcuuuuaauagaugggugauucuugucugcaacuccucaauucauuagaaaguccuuccccuuugccaggacacccagacuuuuaccaggacauuggccagaacacaggccaauugaaaauuucaugcagaguacuuaaggcauuuuuuaauacauuaucagguuugcuucugagaaaaagcaaccuuggccaagagguucugcuacugaguacgucaugaggaggaggcaggcauucaucccaccugggucucaggcgaccuccuccuuacccucuuaccugguaguuacgaacaccaucccagcauguugucuguuugggcugugcuuugagauccucaaugcugaacuaggcaagaggaaauaaauucaaucauuaaacaauccuuggccaguuaguaagcacauauggaagcagacaguuccuuccccuaaaaugagaggggccacuggcuauagaggaaguauguaguucaccgggaaguggcuccacagagacacuuuugcugggugaauguaaguaagccuuguguuaccuuguuauccuugcuaauuaugaggauuagcugaaugaauaaucuaggugauaaaguaaucugcuaguuacuugcauuuuacuuuauauuuauaauaguucugcuuauauuuuucccaggcuauauuaaauucccugaaauauacaucaacuguuggcagggagacaccuaggagcauggcagguguucagagaaagguaaccuaagauugagguuggcagacuauagccuucaggacaaaucuaaccccaugcuggauuuugugaauaaaguugaacuugaacacagccacagcuguuuacuuau

SEQ ID NO: 15903 - RNA, 7122 nt, Homo sapiens
caacugcugagucuuacaguaguugcauguuuaguuguuuaaaaaaccgacagaguguuuuucaaagcugcuuuacgauuuuacacuccuaccagcaguguauuuucccacauccuuaccaacacuuguuauugucugacuuguuaaguucuagccaucuuaguggguuggaagcggcgucuuguggauuugauuugcauuuccuggugacuaaugauguugagggucuuauuuguguauuuucuuuggagaaaugucuguucaaauuuuauguccauuuaaaaauauuuuuuuuucuagaaacaggaucucacuguguugcacaggcuggacaugaauucccaggcucaaauaauccucccaccucagccuucugaguagcugagacuauaugugugcaccacugcacccacccuuauguccaguuuuuaaauuagguugucuauuucuuacugaagugugaauucuuuauucuggaugcuagguuggauguacgauuugcagguauuucucccauuguguggauuguuuucaccugccuuuguccuuugaauuuugaugaaguccgguguaacuguuuuuagugugugcuugugcuuuuggugucauaucuaagaaaccauugcccaauccaaggucaugagggauuuaugcuuaugcauuuuucuaagaguuuuauaguuuuaacuccuauguuaggucuuuguuguauauggagugagagagagguucaacuucauguguuugcaaguggauaucaaguuaucucagcaucauuuaugaaacauugguuguuuuucuagugguguuuuuuucuauucaugggcgguccuuccuggaaaugaggaggaggaggugaaguuccugguuuuaaugacggagacacaugguaaugagugugucuugcacaccaggaacuauuuuugguguuuagguuacagauaggaauaggucaugguuccuguccucaagagaguucacuucuguacucgggaauagaaauaaauauugaucugcaggcuuccuugcuguggcaucuagugcuagccccagaaaccacccucuucaaguggcaaagauuucuuuaaagaaguuuuuuagugccucgugucuuuucuguaggagacuuggcgggucgugcagaaauacuggggaagacaucccugaagaucuggaaugugacacggagagacucagcccuuuaucgcugugaggucguugcucgaaaugaccgcaaggaaauugaugagauugugaucgaguuaacugugcaagguaggagcucaugcgaaggugagacauugccaccauaggaugcaagagaucaguuagugucuugguuucuuuccuucuagaacuguaucccugagggcuucacauggcuuagggaggggagaacuguugagagcugagacugccugaguugggguagaaggugagaagggaagugaaguuccugucacuuccuuccaccagcuagaggaggcgcuuuaacauaugggagggcaggaugcagcgguggcuugucagucugcaguugugauccugggaacagcaguggcgugggaaccccucgacuggcugucuugucuuuggagcugauuucuucugggcuuuaauaagaauagagcccugucacugagaucuuaaacaccaccccuuuuuccccacagugaagccagugaccccugucuguagagugccgaaggcuguaccaguaggcaagauggcaacacugcacugccaggagagugagggccacccccggccucacuacagcugguaucgcaaugauguaccacugcccacggauuccagagccaaucccagauuucgcaauucuucuuuccacuuaaacucugaaacaggcacuuugguaagaucucuucuaagaggugaggauggagaugucuuuguuggggcaagagaugcuuauugugaaaagaagauuaggagagauacugaaacuucuugauaagacaggagucaaaaaucuagaauguuagggauucuacaggaaaaaugacccuucuuccuuuuauaaacaaguacauucuuaggggguaaaauaaggaagagaaagaaaccauagauugagaccgaagagggauauuaagcaaauguuacuagggcccugaucggauaaucaacuguaaaagucauuagacaaucggggaaauuggauuacuaggugguauuugaugaucuauuaagcaacuguucauugcuuuaggcaugaugaagguauugugguuacgauuuuuuacagucuuguagagauacugaaguauuuauggauaaaagguguuuggaauuuguuucaaaauaacccaguggugguggugggaggugggggaggagaggaaacagauuggucaugcacuagaggacaaagugaccuggccagcaaaccacaccaggcuuuuacugcaugugguucucuccugggagguaccuucugaucuguggaccauccaguuccacguagucaucagacagauuuuaacaggguccucuguguucauuuugccaaaauguugccccaggagcagucaucauugaagagcccuuuuaccagaauaaaagcaagguuccaccucccauuucggauguugccaggcuuuggugucuccagucccaaggggauugguuguuggggagcugucaggcagguaucagggagugggucagggaggaacaugcacagugcuggggaagcugaaagcaagcgagcaggugucgaccuaguucuggacccagcuggcugugcucucagaaaucggccccaugauggguccgauuauuuacuugucauucccugaaacagguguucacugcuguucacaaggacgacucugggcaguacuacugcauugcuuccaaugacgcaggcucagccaggugugaggagcaggagauggaagucugugaguuucuuuuuugaagagguuucaucgcaagacugggaagugaauagaacauuuuaauuuaauauuauaccaucagcuuagagaacucuuccgccauggguuagcuuucuucuggagcugccuagguccaccagaacccacugcacagugaagggaaggcugagaaaaccgaguccagauaagcagguccucaaaacaaaaccuucugggaucugcugguguugggaacguggccagccuugcaacuuucacugcaaguuuaguaaacuccauucuuugguaauugauagaauuaucaaaauguaagguggugucaggucuccagaaauuuauccaguuauaacccucuuguagaaaacugacaguuuuagcccgaguaauuuuaccugcagacaaagcuuagccccuagaguaauguuaucucagggcucugguuccccuaauggaggggcguugagaggagggugggggcagagaggauguguccaaaucacuuggggagcuuuuuuuuuucuuaaaaaacaaaaaacaaaaaacaccacagggucuugcuuuguugcccaggcuggagugcagugagugcagucacaggucacugcauccucaaacccagccuucaagccauucucccaccucagucuccugaguagcuggaacaacaggcacacaccaccaugcucagcuaauuuuauuuuuuguagauacggggucucacuguguugcccaggcuggucucaaacuccuggccucaagcaauccuccugccucggccucccccaggugcugggauuaacaggcaugagccacugugcccagccaggagcauuuuuugaauccuucccuccucccuauuuggagcucuccucagagcagcauuuuccaaaacugccuggugauacccauuugggaccacuguuucacauacagauucgagcccaccucagacauaugcuagaaaugucugugugugagacaagcguuccgaaggauucuucucaugugucacguuugagaaacucugcucuaggguuguuuucuccugcaguuuugccccagaccuacuuuagccuauugacuuuuuagugaugaaacuugggaauugacauuuuaacaucaaaauugcaugccaggcgugguggcucacacuauaauccuagcacucugggaggcugaggcggguggaucaccugaggucaggaguucaagaccagccuggccaacaugccaaaacucugugucuacuaaaaauacaaaaauuagccuggugugguggcaggcgccuguagucccaguaacuugggaggcugaggcagaaggaucccuugaacccgggaggcggagcuugcagugagccgagauugcaccacagaacuccagccugggugacggugacggagcaagacucugucucaaaaaaaaaaaaaaaaaaacgauugcaaguuuacuuuuuguuuuugagauggagucucgcucugucacccaggcuggagugcaguggcacaaucucggcucacugcaagcuccgccucccggguucacaccuuucuccugccucagccuccugaguagcugggacuacaggcaccugccaacacgcucagccaauuuuuuguguuucuaguagagacgggguuucaccaccuuagccaggauggucucgaaucucugaccucgugaucugcccaccucggccucccaaagugcugggauuacaggcgugagccaccgcgcccggccugcaaguugauuuuuaaguguacauucaucuuugagaaccaauacacuaggauaaaggagauuuuuuuaaaacuuccaaguuacuuggcucuuguugauaaauucccugcauaguuuuccaugugucgcuugcuugaaggaacggcugccagagccccauaugaaagugacccagugccuuugcccaguguauagacaugagaaaaggguuccaggggguuuccucucagagggcuuauagaucggaggucaggcagccggcagagacaaagcucuaguucuuaccuaggauucuuuacuuguuuguuuuuugagacagauucuuuaaggcuugaagcuaccuuucuuccccgcagcaaucugcaacaaagggaggcccuggaaauuagggauucuuuucuucuugggauccuggcuccuaaucuuguccucauaaccauuuccuccauaaguaaucucaggcauucagccagaggauuuuuaagccuacagugccaagcccacuuuaauacacuuuucagugcgacugcauuucaacuguagaagucucaguacuuuucacgugugaaguuaggaguuaugguguccuauauguucuaggcuagaaggauuguaaguguucucucuucuagcugggguaggccugagggggcagggggcaaguggguuuggggugaaggaaggaggcacagcagggccagggccuuuuuaaauaacagauaguguguaucauggcuuccaccaaaccuccuuuucuucagaugaccugaacauuggcggaauuauuggggggguucugguuguccuugcuguacuggcccugaucacguugggcaucugcugugcauacagacguggcuacuucaucaacaauaaacaggauggagaaaggugagccugccuuaugugaaaaaagggaaguucaagcuggcaauaauauaacaacccuguugcuaaacugcucucuucuccucauaguuacaagaacccagggaaaccagauggaguuaacuacauccgcacugacgaggagguaaucauuuaguaaaccuggaaaccuagguguacccagcagggaaaacaacauucccccuuggaaaccacacgggucuccugggaagauuucugagugauugugcagcuccugagcuccucagccccuucacaguaacacacacacacacacacacacacacacacacacacacacuaaugggauuugugcuuugcaagcgcuagugaugguacuuuuuaagaaugauuauuccaucuguauuuagcccauguuagacuuacuccguguuuuucccugcuugccaccaggccccuugauggcucuaacuguguguuggcuuugcagggcgacuucagacacaagucaucguuugugaucugagacccgcgguguggcugagagcgcacagagcgcacgugcacauaccucugcuagaaacuccugucaaggcagcgagagcugaugcacucggacagagcuagacacucauucagaagcuuuucguuuuggccaaaguugaccacuacucuucuuacucuaacaagccacaugaauagaagaauuuuccucaagauggacccgguaaauauaaccacaaggaagcgaaacugggugcguucacugaguuggguuccuaaucuguuucuggccugauucccgcaugaguauuagggugaucuuaaagaguuugcucacguaaacgcccgugcugggcccugugaagccagcauguucaccacuggucguucagcagccacgacagcaccaugugagauggcgagguggcuggacagcaccagcagcgcaucccggcgggaacccagaaaaggcuucuuacacagcagccuuacuucaucggcccacagacaccaccgcaguuucuucuuaaaggcucugcugaucgguguugcaguguccauuguggagaagcuuuuuggaucagcauuuuguaaaaacaaccaaaaucaggaagguaaauugguugcuggaagagggaucuugccugaggaacccugcuuguccaacagggugucaggauuuaaggaaaaccuucgucuuaggcuaagucugaaaugguacugaaauaugcuuuucuaugggucuuguuuauuuuauaaaauuuuacaucuaaauuuuugcuaaggauguauuuugauuauugaaaagaaaauuucuauuuaaacuguaaauauauugucauacaauguuaaauaaccuauuuuuuuaaaaaaguucaacuuaagguagaaguuccaagcuacuaguguuaaauuggaaaauaucaauaauuaagaguauuuuacccaaggaauccucucauggaaguuuacugugauguuccuuuucucacacaaguuuuagccuuuuucacaagggaacucauacugucuacacaucagaccauaguugcuuaggaaaccuuuaaaaauuccaguuaag

SEQ ID NO: 15904 - RNA, 1602 nt, Homo sapiens
aaaaaaaaaaaagcagcugucuuuggauuuguugcauugucucuaagcuuccaggcagcugcacuucauucuaaagacauuaaauauuuuccuuagagaaagacauccaacagggaaguccauguugggcaggaagaagugauggggcacaucagcugacagagugcuucgggaaacaucuuucagagucuaguuucaacagaagucaauuucacccuguauuuuuaucacucaagaggaagaaaacagagaucuuccaggggcugccacagaguaggugcucaauaaauuuuggcucgcuuugaacaggugaacaaaggccauuacucagaucguuuugucaguguguucaaaaagaaggggggaggccgguaaucucggcagcucucaguuuuccagcuaaccauuugcugaggacaccacagcugacucccccacccaaaagucaguggcaacuaaucucucaaaugagucacaaacaauacauuaucaagcaacugaacuuccagucagccacuccuucauccaauguggcugauauuaagaagcuagaaaaaggcacaauccacaugcuaucacauuaaacaaacaaauuauauuuucccauuacuagugccaaauuuaaaauuccacuauuguaucuacuggaagccaaaccaagaugcaacuuuuuucauuacacaaaaaauauccucaucaaagaacauuuggaaaacagacaaaggaauacaagaaucaaccaggaaaacaaaaacaaagaaaagcagaaaacaauuugcuguaacacuuccacucauaaacagccccuaucaacagucugguucauucucauccuguuuuuuccccuaagcauagauguuuuguguaaucguaaucauacaguauauacuaguauaccugcagcuugugucacuuaaaugauaucauaagcauuucuccaucuuuuucuccuucuuaaccuuguaacugcacaaaagcagauggcagaaagauucugaaauuaaaccaagucaauaaauuauuaccauucucuuucuuccagaauaacuacuguaguacaaacugacacuuuuccagaaguuccuagggccacuagaaauaagacauuuuuuuaaaaaugccucgacacaaagagaguguuuaagaaauguuaacucacuuucaagugacaaagugagauaaacugaauauuuacuagaaucaccucuggaaagauacaaaaaaauuaaauucagccucuguuaccaacaaaauguuuauuaucauugagaaaauacaaugcacugacaccuaacaacuaaagcccaauguaaaucggagucaauuacccuggcucuuuaaggacuggcgauguuuuacccauuuugcaacccuagcacacagaacagugccugacacgucauagauacucaauaaauggguguuguacuaaacugaacuagagacuaugaucuaagcuuauuuagagauaggaaggaucacugugggcugagguugucaaacauagcagauagcaugacuauggcagaauuugauuuuggcaauaauuuucaggaagaaggcugaaccauagaaaccuugggaaacugcaaaugaaagaua

SEQ ID NO: 15905 - RNA, 2292 nt, Homo sapiens
gccuuggggagaaagccaggucucauuuucuuccuguaucauaucacagggccaugacauugggcugcuggagagucugugacaaagaaacugcccaucagagucuucagauccuucucuccugggccuuaguucccacuaccuucuacggucccuuuuccagauggaggaaguagaacucagacaaagagaaugacccacaccuuugggcugcuggggccagagcuggauggugcaguggagcccugauucuagcugucuuccagacuucuggaugccaagaguuugagugagguucgcucugcucaucugucacugcgccuugcagcuggggccuguggccaugggcagacaagggcauacucaggugggccaggguagccccaggaggccugagaacaacauuuuuaaugaugcagacauuggcgaggugaggaguugcugaacagugugggugaaauguuccuggggggcaguucacaagcagggcuaucuauauagggcuccugaguucuaugggacaaauuucaugcagaguaaugaacuuccuuucuguaguccuaccuuaagucacacaacaaugaaauauguuuucucugagauuguucagagcuggccuggaacaccuagaagaaagaggagagggauuaguaaggcugagggugcuguccaccuaguuuucaaauaaacuuauccuaaauuauaggucuacuuucgaccuugggcaaggacuccucccuucucagccaggcaagaaaugaauacaguucagcuaaaauucuaguuucuuuaucauuaauuucuacuacauugccacaaacaaaucuuuaagaacuuggacuucaggcucagcaugagagaauucugcucuguagagaugcauguuuauaccugugcacacacaaaugaccaggacagguucugagagagugucaucugcugcccacuugcauaugugggcagcaguuagcauacauguuaccucugccguaugcgcgggauggugagagcacagggaagcaacauuaggcugcacccugcaauggaugggauuuggguagauccucuuccugggcuguggacucaucuggaugaaauauaaaaugauccuaugguggucggaacggguaucuuaagcuaggaagggcuggaucagucucugggucuguuaccaccaccuaaccaagcuguggccuucagaggagauugcaccucaauagaacucuggacauuguagcaauuuuuuuaaaauggggucuuguucuaucaccuggccuggaguacaguagugcaaucauagcucacuguagcccagaacuccugggcucaagggauccucacaccucagccucccaaguagcugggacgacaggagcaugccaccgugcugcuaauuuaaaauuuuuuuuuuuuuuguagagauggggucuugcuuuguuacccaggcuggucucaacuuccugacuucaagcgguccucuugccucagccacccaaagugcugggauuauaggggugagucaccaugcccaaccugguaaauuugacucauaaugaaguuugcguuugaauaagacaaaguauucaggaauuuauauuuggagagggcaagauggaugguuagaauaucuacuuggguccagaaaaacaacuuaagaccagaggccacccacccaagagacaagcggggagccaggagagacgaacgccaugugaggugcuugcaacguugugggaggauuuugagccuagaugaacaauucuuacggugagagggcuugagacccuugcaaagcuuuucuccacuucugcgucagaucuuaagauuauauauuuauguuucagaaaugcaauuuuauuuauuuuccucucuccuccaaguucuuuuaaaauaugcugacuggucucugguguauuaagagaaagcaaggugaaaggaucugcuucacaaacaggcuagucuucuguaaggaucaagcguacaucccugacaccugggacugguagugguagcuugacucaaagggagaaaacucugagaucggauacuauaugccaagcccuuuuguguuggucaauuuuagaugucgacuaggguaagggcugcccagauaccucacaaaacuuucuuucugggugugucugugagggugcuucuggaagagguuggcgacagaauugggaggcugagugaggauggucuguccucacuagcgugggcagccaucauccuacccuccaucaaagcuccauauagagcaacaaaggcugagggugggcaaauugcucucuu

SEQ ID NO: 15906 - RNA, 4524 nt, Homo sapiens
aguauuuagguuuauuucaaauucaucuuagggaugccuagaugcauaauuuuuaccaggacauauugaaaauauugcaaagagauagccaguuauauuaucccauucauuagaaauuaccaguguaacuaaacauaaauauuccaguuuagagugcuuaaacguagcuaucuuucuuaaggccaggaggguaacuuugugguaucuaaagggcuuaaauuucagaaugcagaauaaauugccuuuuuaaaaccaagcauuuuguacaagcuuuuauuuucaguuuuuuaacuaccaaauaggugugauguacuuuagaaguaaacaaagauguucacccaugauaauggauguuaaagcuccugcaguuguucuuuucguguuuaaaggguauauucuaauaguggaagcaucaaacaugucagugauuucaucucauucagaaauaaagagauuaauauuggucuuuauuuuuuggcauuuuaaguuuuauauaaauggaugcagauggagauuaucacccacaaauauauuuaaauggauuuuucuuaauuugaauuucaaguaaucuuuuuauuucaaguaauuaguuacgcauuuaguuacauugccaguuuuuuuuuuuuaucaauuucaguaagacaaaauauacuaaaauguuuaaauagccucauucaaucuuacauuuugacauuucagcaaucauucuggcuuacaguaauuagauccccuguuacgacacaugcccuuuguucuuaauaacuagcaaaaaaaaaaaaaaaaaaaaacuuucaucuuguuaaaauacuuugccaaaugaaauagacuagucaauacaucugauguccauaauuauugguaacucaguuaccuucuaacuaauaggcugguucaggagacucucccaguuuauaaaugguucucuugggagccuuuggaagcuguauuaaaucuuucagucuuuuauuucuaauuuuuucucuuaaucuaaauagaggccaguuaucuauuuuaucagcuuuuauucuugaagauucucagauuauguuuuagucccuuuuagcuuuaauaguccuugaaaaauacauuacuguauaauguggcaauucuguaacagagacuuauuacuugaaugaauaauccuaaaauuuuaauauuuuagcugaaguuugagauuuguggaaugaacaaaagaauuagaaacuuucauauguuacuuuguuucagucaucugcaaaguaugaagcuguaauucugaaauacacauccaagugaaugagaauuaaaaauuuucuaaauauuaauacuaacugggaaaaaaaaacuagugugaaguuuacaguuagaagaaacagacccaaaguugccagaagguaauaaauaaauguaguuuucacuguaaguaaguuauugacguaagaugcuuuauuuguaauauauuuagauuuugaaaguuauugagagaugaauguauaaaagcuaaauuuucuuuucugaagcagugaaacaaaauugggguaacaaggaagcucuguuguggcaaacaugucuaugaggaauauuaaaacuaagcauacucccacaggcuuuaaacucaaacuaugaacauuuaaauuaaguuguuccuuauuuugccuauacccauuuuuaucuuucauugucguuuuugcuugacaguauggugacagaguauuuuuauuuggaaaguccucagcaagaugaauuagccaaaagcaauaaugguucagauuaaacaauaaaguggaauugauucaaucccaggcucaacuaagaacagucgcucucuggauguuucauuuuagacgauagauaaguugagauguuguaauauuuaugggggguuaagccugugucaguuaugggaugaagacuuguaguaccaguaccaucaguggucauacuuuuuuuuaacuuuuuacuaaacuaauacaguuagacauuuccacucuaucgugauuauauuuuuaugaugggaaaauaaaaacacuuccauguuuuuauaaauagucucugcaaagauuucagauguuauugguaucucgguuuggcaguaucugaaaaauugagauugucuuugaaauguuugugcuacuuuuacuuaaguaaacccccacugugcaagacccaggccggcuucagcuaauaccaagguuucugugugcauaauaguuuacagagaacuuaagaguaaggacugcggauuaaaaacaaaacuuuuuuuaacuuuaaaauuuuuaguuuuuguucaaaguaccugguuuauaaagucaaauucuuuuauuaguuccuuucucguuuaaauugacugauguugcugaugaagcuuaaagucccaggcacgguuguggcgauauacugauaaaauuggugccuaguggugggaggagcuccagugucaggacuuuuauuaaaaggcccuuguuuucccaaaugccaaucuagccacauuuagauuucauuauucaauaaaacagaugaaaaaucaucccauaaaugaauguugagguuaccaaaguacaucaccugcugaggaaggauaaaucuuccugcuuuaagggagcccugucaucucuccucuuaaugcacguuucccuugguauuaguggaagcuguguucaagaugggaagccuuuccugcaguucuuagaaacaccugcuuucuaaggagagccuuuucuaggauuagcuuauguguguuuucucuaggcgauuuuuuauuucaguuaccaauuuaauuuucaaguugacagaugcuguguaaagucucucauaaugagaguaguccauuaaauuguugaaaguugcacugcuuuucaucuuucagguaccugaaaugagugacaucagguauuuggaaggaguaagaucauaaacuguauucauuuucuuccuuguacaaagugaugacuucuaaugcuuauaucucaagguauuuuuuaaaaaagcaacggucccuaauagaguaaaauuugguuuugguccaaguucccaauaauguauuuaauguuucuguuguuuacuggugccucccguugcaucagguagagauugccugccucuuuguagggcagccuuguggcaccuuauguccaacuuggaggauaguauauggcuucuuugugccucuacuaucuuuucaaaagccauuuuauaaaaauccuagguagccuauuuuaauauuuaaauauauauauuugugaaagaacuuuuagaacagaccuuuucuuuuuacuuuaaaauuccuguauuuccauuuuuaagaguaaauuuaaucuccaggauuuagaagugucuuuccagagaagcauaaugagaaagucagacugagguaauaagaccagaauuaagugauagaagaaacuguuguuugguuaaaggacacagauuugaaggaaaaaaauuuugauguaacaauuuuuuaaauaaaauuuuguuuuucuguaaugucauauuugcugcuacaguagcucaauauuuuacagggcuaacauaaagcuggcuccauuuaaaaacuggaguacuuccuagugcagccagccuaggcggaaacuguacaccauggucuuccagaugggugacugauggcuuuggguagcugaugcaugcuuuaauauuugccuauagcccggcagcaaggaagucggggcggggggacuuuuuuacccugccaguuauagcauugugauucuuucugggcacuggcauuuugugaaacucucaagggaaggugaugcaggggagaaaaugugaauuaaauuacauagauggguguuuuuaugucuucuaccccuuuccuagaauuaguacaacucuuaacugugccaguccccaguucaccagcuuuguauccagucgucaucucauucaaguauggcuuuacuuggugacacuggccauagcuaaguuaacuuggcauguuugacuuuugacaauaacaaaaaugguuuuggauuuuguuuuauuuccaaaaaauguauacaauaucagaacuucacauuuuauauacuaguaucuggcuauuaguauuuuacaggaaccauaguucuuggugacuacauauauauauauauuuuugugaccuuuuuuguaaacuaagugccguuucaacguuacaaucauuuuuaggguuauuguaaucaaugugaauaucauguuuuuucaaaucuguucugagccuauaguguuugcuuugugaacauguguauuguauauauucuguauaguuauauuguacugaaauuagcuuguuugauauaaggaaaauauguauugaguaccuuuuugcuagccugauuguuuaaucuuuuuaaaaaagguuuaaacuuuuuuuaaaaaaaaaaucuuuaaacuggccuuuauuacauggucacacauaaaguugcaguuaggaaagggaugggcagggaaaaacuaguuuugagugucuuuagauagaaacaugagacuaagguuugauuuuguuuucguuuucucauuaaaauaucuuaugcuuuauggaauaaa

SEQ ID NO: 15907 - RNA, 1298 nt, Homo sapiens
ugugccuugagcuuugugcacuuugcaacugugugaccauguugucaaacuccuccuggagaaguguaugguaucuaaacucacccaccaagauggcagguguggcccuguagcaggaugcuaauuaagugggaaaauagaaaccuuuugcacaugggucggauuuuccccugguucaccagagcauauucauauuaauguuggggaccaacucuccuagagcauuuccauucccugugccacuuaacacgaugucugucaccagcugcuauaguauuggcaguacucuaguuuagggaugggcgguacuuuagcacggaagcuucccuuaguauuauugagagcuacuuccugcgaugcucuaggaagcagauacaguuauuaaguccaaauacacaguggugugggguuccugaucacuucauuuuaaaugaaugagauaauuacuuaaaaaaagucugucauuugaacauuauauuugagugugauagggaagaaguagcacugcuguccuaaggcucccuuccagcuguggcaaagcuauauuucuguuucuccacauccacagugcuuuuuaguccaucauaaaaguuucugaagcuuauucuagcuguuguugaaagcccaagaaaaauagauguggcaagagaaaaauacuuuucuucucaauuuugcuugaaucuuaauugagcauaggcuucucuacuaggcaacaucagacuaauaguauuuaccucuucagagaacuugaggggaaaagaaacaucccagggaugcugucgcaugucugcucugcagguucuucauacagcugccucugccaauucaguuuauuuuuuggggggaguggugugggugggagaguuagaagugggauauugggagcaaguaagucacccaauaauugaaguccuugauuuguaaaacuguuauacagagaaguaaagauaaagguugucagauuuauuuuuuaaaguacuuaaccagaguucguggauuuuguggacuuuaauuggacucaauucacucugugagcauccuggauugcaucgaugaacacugaauuacuguaagaacauagacaggcucucacuaugaccuggacaguuuaaguugcuacacugguaacauucuaguaucaaggagaauuccauucaucaugacauucacauuuuacuuuucucaauggaaugcuugcuucaggcuuaccaaucacaccuagaacugaagucugagugagugguauuaauaauuuuucugaaaggaauaaaauuggaauguuucuaaauguggagaaa

SEQ ID NO: 15908 - RNA, 1000 nt, Homo sapiens
ugucaucauuucuucuugaauaaaagaugcauauuagaaagauaauucaaaaggaaguguagaaaauggccuggauagaggagcuauggauggaggaugacuacugggagacggauaacaauaguccacgcaagauauaggaagaagguugauguuacacaacgucaugcuaugcacugcagggaauacgaagcugaacaagacacagccccugcugucaaggauggaugaaugaaaaugccaacuucaugcuuguuaacccuaacauagucccccuggagacagugauauagaaagauauggauaagagaagauaggcuuauauuaaaauccugcugaagauaaagauuauagaaagcggccagggacaguggcucacgccuguaaucccagcacuuugggaggccgaggcgggcggauuaccugaggucaggaguucgagaucagccugggcaacacagugaaaccccgucucuacuaaaaauacaaaauuagccagguguggugacacaugccuguaaucccagcuacucaggaggcugaggcaggagaaucgcuugaaccugggaggcggaggaugcggugagccgagaucgcaccauugcacuccagccugagcaagaguaaaucuccgucucaccaaaaaaaaaaaaauuauagaaagcaguaauuuuugcuugauauuuucaauuugacuaugucauuucccaugucuuuauauaaucaauuuauacacccugcuguuuguguuuuggccagccauacaaaacaaggcaacaggaacaaugcagucagcaguugccuggacuuguuagcggaugugauuucaguaacuaacuacuugcugacucagagacagaggaaagcaaaaaucuccucucccuguucuguggccagccaagugauuaugaggcugucaaaguccacagugauggggacuccuuauagugcucagcuuguuccuuugcugugucacugguuaaccuggacugaaguuuca

SEQ ID NO: 15909 - RNA, 2416 nt, Homo sapiens
aucuuuaucaaauugacucuucaaacccucgguuuuugccacagaacagagaucuuucaggggaaaguagauuucgagguggagagaauuugccuugcucuugagcuggucuuuuaacauacugacgagccuuacuuuuccuuuguggaaauauuaaguggcauauuguguucauaccaaagguggagacaggaugugccaaguucaugguuacuggacuucuuauuccaagccauggcaccaaaggagaaggggcauuuugugggugugcauuaggucugaacugcuuuaucuuguuuuaguuuucaguaauuuaacaaagggagccugcugaauaacaaaauuaaaaugaugaaacaaaaguuugacagugauauucugaagcaaaaacugucaucuaaauuuuucuugcugauuuuuuuuaacuucccuauuuuagaaaacuauuguugggcuguugguagugcuuuccacagaugcugguccucaguggauuaggucagaagcucauguucugauaguucuucauuauuucacaaagguggacaaccugaaagagaaaaggcugcuugaugucagcagaaucuaaaccccuacauuaaagcuuugccucccauucugugguugugguggugguaagaaggagauauugguaccaagaaaaauuuccaaaacuauugagagagagagagagaaaguauugaaauuuuguucugccuugcaggauccauuuaucauucauugguaaaggauauauuccuuguucuuaccaaguguacauuuaacucuugcugacauguucaguguauuuuauuacuuuuaaugcugucuuaaaaugaacauucuuuaaaguuggacaggaagguggcauuucuuauuuauuaacauuuuuaacuuuaaacauauugugacucaucuagaccuuuuaauaagacggucaacuucacacuuagggaaaaaauuaaaaugugauggccacuucuaauaauucagguaguuauaagggaucuggaagaaauccagucuuuaugaauauacuauuaguugggcauuaaaaaaucaguauauauuuuaacuuuuugugacaugcuaacacauuuucagaauaauuauugcauaguagaauuuauuacuccagaacagaaagaccuuacuucauuucaaaugaaguuaauuaauuuacauuucuggguaaaaacugguucuauaaauuaaguagaguagcuucuuuaugauaaagacaauuuucugaaaagugaacaauucuguuaaaagaacuuuauugauguguagauuucgcacuuuauuucugagacugcguucauguaguuguuccccaauguuugaguacuaagagaacuugagaaaauuacuucauaaacauauggaaacugaaaauggacucucuuugugacaaagauauucaacagaaaauauugacccugcauugcaaaacacagguucggguucccuaagucccacaguguaaugauuacaaauauccuaguguccggucuagaaagacuuucuaggagaagacuaguggaauuuucuaaagguucaguuuuagcuuuuauaacuuaaauuuggcccuguuacguucuuuuuaauuugaaccauaagguaucuccccucccuucaggaauaacuuauuggaaaacugaaaagaaucacugaauggaauguucauuuuauggcaguuguuuuaaguuuuaaaauacacagaggaaaauauuguggaaggaccucuuuguugcuuucccuucuaaguugucuucuucuucuucuucuucuucuucuucuuugguccuuaagugaaauaaagacucuaaaacuaauuuguauauuaucagccagagaugcggauggcagucgagccaaaucgcauggcuuucagaucagguauucugcacauucauuccaaggucauagauuuuuaaaaggaccuggauuugaagagauggcaaaugaugagccaucagaaaacuuaauuuggaaaacauguauguagccaguguggauauuguggccucucucaagacacauugacacuguagacuucauucaguccagugugaguauuuuggaguagguuggauguagauuuuguuuuuaucauugauuuguaccgacagaaauagacauuucaucauguaaaauuccuguuauucuggaaaaaccuauuguuuugaucuucuuguuuucugacuuggaaguauccuuucaaaaaaacucuuaagauaucuaggucuaaaaagcacuucaugagaugcuaaagcugacccacugguugaaaauguugacccuauccuguuauuuaaaugugaacauuuauuguacauucagugaguuauaguguuaauagucuugugcuaugcagcagguguaaaaauuaauaaauauauuuuuuaauaaa

SEQ ID NO: 15910 - RNA, 2416 nt, Homo sapiens
uuuauuaaaaaauauauuuauuaauuuuuacaccugcugcauagcacaagacuauuaacacuauaacucacugaauguacaauaaauguucacauuuaaauaacaggauagggucaacauuuucaaccagugggucagcuuuagcaucucaugaagugcuuuuuagaccuagauaucuuaagaguuuuuuugaaaggauacuuccaagucagaaaacaagaagaucaaaacaauagguuuuuccagaauaacaggaauuuuacaugaugaaaugucuauuucugucgguacaaaucaaugauaaaaacaaaaucuacauccaaccuacuccaaaauacucacacuggacugaaugaagucuacagugucaaugugucuugagagaggccacaauauccacacuggcuacauacauguuuuccaaauuaaguuuucugauggcucaucauuugccaucucuucaaauccagguccuuuuaaaaaucuaugaccuuggaaugaaugugcagaauaccugaucugaaagccaugcgauuuggcucgacugccauccgcaucucuggcugauaauauacaaauuaguuuuagagucuuuauuucacuuaaggaccaaagaagaagaagaagaagaagaagaagaagacaacuuagaagggaaagcaacaaagagguccuuccacaauauuuuccucuguguauuuuaaaacuuaaaacaacugccauaaaaugaacauuccauucagugauucuuuucaguuuuccaauaaguuauuccugaagggaggggagauaccuuaugguucaaauuaaaaagaacguaacagggccaaauuuaaguuauaaaagcuaaaacugaaccuuuagaaaauuccacuagucuucuccuagaaagucuuucuagaccggacacuaggauauuuguaaucauuacacugugggacuuagggaacccgaaccuguguuuugcaaugcagggucaauauuuucuguugaauaucuuugucacaaagagaguccauuuucaguuuccauauguuuaugaaguaauuuucucaaguucucuuaguacucaaacauuggggaacaacuacaugaacgcagucucagaaauaaagugcgaaaucuacacaucaauaaaguucuuuuaacagaauuguucacuuuucagaaaauugucuuuaucauaaagaagcuacucuacuuaauuuauagaaccaguuuuuacccagaaauguaaauuaauuaacuucauuugaaaugaaguaaggucuuucuguucuggaguaauaaauucuacuaugcaauaauuauucugaaaauguguuagcaugucacaaaaaguuaaaauauauacugauuuuuuaaugcccaacuaauaguauauucauaaagacuggauuucuuccagaucccuuauaacuaccugaauuauuagaaguggccaucacauuuuaauuuuuucccuaagugugaaguugaccgucuuauuaaaaggucuagaugagucacaauauguuuaaaguuaaaaauguuaauaaauaagaaaugccaccuuccuguccaacuuuaaagaauguucauuuuaagacagcauuaaaaguaauaaaauacacugaacaugucagcaagaguuaaauguacacuugguaagaacaaggaauauauccuuuaccaaugaaugauaaauggauccugcaaggcagaacaaaauuucaauacuuucucucucucucucucaauaguuuuggaaauuuuucuugguaccaauaucuccuucuuaccaccaccacaaccacagaaugggaggcaaagcuuuaauguagggguuuagauucugcugacaucaagcagccuuuucucuuucagguuguccaccuuugugaaauaaugaagaacuaucagaacaugagcuucugaccuaauccacugaggaccagcaucuguggaaagcacuaccaacagcccaacaauaguuuucuaaaauagggaaguuaaaaaaaaucagcaagaaaaauuuagaugacaguuuuugcuucagaauaucacugucaaacuuuuguuucaucauuuuaauuuuguuauucagcaggcucccuuuguuaaauuacugaaaacuaaaacaagauaaagcaguucagaccuaaugcacacccacaaaaugccccuucuccuuuggugccauggcuuggaauaagaaguccaguaaccaugaacuuggcacauccugucuccaccuuugguaugaacacaauaugccacuuaauauuuccacaaaggaaaaguaaggcucgucaguauguuaaaagaccagcucaagagcaaggcaaauucucuccaccucgaaaucuacuuuccccugaaagaucucuguucuguggcaaaaaccgaggguuugaagagucaauuugauaaagau

SEQ ID NO: 15911 - RNA, 103027 nt, Homo sapiens
uauuuaugaccgaagauuuucccagcucucagaacuuccccguucugacacccugaaggacaguccagagguaagcauuuaguacauuuaguacagagguaaucacuauauaugaguuugcagaaguuuuugucuguauacuaaacaaaagcuuauacugaacacgcagggugauuccugggacuacuugccuguuucauaacugaaaaguuaguaauguuaaauauaauguuuagaaugaaaguagguucaguguguaauuuuauaagggaaaacaacucauaacaauauaucaacaagcaauauauaugagcaaaacauucuccagagagcacauaaaaguggaagcaaaaauauggaaaaacauugccuuucaugaucaaagggauccauauuaacaguguugaguaguuuaugacagcaugcuguguguaugcaccuaccuucaccccuacaaaaaaauaaauaguaaaaacguaaaagauuucuaaacagagauucuuuauagcaucauuaaaccaaaaguaccauugggaaucaaaaauuguaaggaaucuuaaaaaguagaugggauaagguuuauggggaaaaguaaauauagccuaaacauguaagugcaacaagaccgcaaaacacaaggaaacuagaaaguuuacacauagaaacugaauaaauaaaauaacugagagguacaaacaaggcuuuucgaaggaugauuacuauccucugagagaaagugaagcugucacauucaugaaauggauuuaaauaaacuaaaaucagagauguuguaaacgaauauaggaucauuuaaauuaauuuaguaagagcaaaccugaguaacuggacuccauacagaauguacccagcugaagagaaagucagggaguugaaugaucaagccaagucauuuauaagaauacaaccccuggaagggacggaaaguuaaaaaguugugagagaacaguugggagucauggagaauagguccagagagguuucuacugaugggaguuacaggaggagagaguggaugcaaggaaauaauuaaaaauugguguaagccacucccccuaccagaucuaaauaaagugauguucugagauucaguggguucauuaagugcuaaaauauaacggacacugcagcagggucucaggagugucuuaaaacacggaucucuuuguaccauagaaaaccugaaagucccuuuaucugcauuucccauuucugcuucauuucauuuuuuuucuguuucauuuuuuucucucagauuauccuaaaacauggccacuaccaagaggucccagguuuuuauccccuuuuaagagagcagccagacugagcuagaaucugugucacaauuccuaauuccuggguuagcucuugauugguccaacuaauacuggggcauauuccuggaccaaucggcugaaccaugguauaggaucacguaugaacauggcugcuccugccacaggccaugugcauggaagauuacagugggucuuggggaaaaggguuucugaguaguagggggaaauuuaggcagaaaagccaaauauguaucugcuauaguuaucuuuuugcauauucaguacaaaaauagaaagugucaaaauuagaaaccauggaauaguaugaucgcugaugauaaggggcuagaaauugaagcucugcaugagacaggggcugacuugcuauguaagugcccauagugcuacugguaaguuucugugaagaguccucuguaacuauuaaaaugccuaaagaucuauagauuuuuuucuuccagaaaccauccaguuuucccugccagagagcauaguaucuuuacucagaguuacacugaucuuuuucuuuucagucggucacucagaugcuuauggcuuaccugucacgccuuucagcuaucgcuggcaacaagaucaacugugggcccgcccuuaccuggauggagguauuuccuaauucacuuuucaugaaaaauguauauuuaaauuaucuacuuaagaaauuugauauuaacauaauuuugaugucuauugagcuucaggaaucaaagaaaugaaguauauucucagcaucugggaggauagauacgugauacacgaaauauuuuuucaucucaaaucuuucuuugauaaucuuggaaacuaaucuuaauauauuuuaugaaucucgaugauaccuguuauuuugguguuuaguauacuaauguauauauucagcaagguguacauuuuuuuaguugacuuaguaauugaaaauauuuuucaguuauuagcaagggacaacuuuuuaaaggguccuuuuuaagaguaaguauugagugaaacauuauucaguaaauagauuacauauuuauucuuaaugugcauauguagaguuauauuguuuucuccucccacuggaaauugggaaugcaagauggaaaguggaaagaauauagaacuaugggccaaccugcguugagaucuuggaaaaaguauugaaucucuuguaaauuacauagccucuuucaucuuuagcaucucaccuuuaaaugaugauaaguauuuuuuuuuggaguuaugaggauuaaauuaaacuguauauguuauaggcacagcacaaugacuagcauauuuuuacuacccaguaaaugguaguuuuuuuuuuuaagacucuuuggguuauuguaucucuaaauuaaaaugaauuucuuuuauagauagucaaagaagcauuugcaaguccagugucuuuaucucauaguacauuuucuuugugauagauugauaauaagggaaaucaccuuuugguucaugaggagucauccaucaacacuccugcugucggugcugcccauguuaucaagagguacacugcucgggccccugacgaacugaccuuagagguaaauaguuaaagugguuguuuguuauuugguucuugcuaacuuucuggccucaucuuugacuguucuuaaccauuuccuuaauuuuuaaaaaaaugaaaagcaccagguuuuuccauagucuuuuauauuucagccuguaauaucuucuauuuuuguuuaagugacaguacucauccuugaaaacugagguuaagugucuccuguuuugucugggaagucauucuugaucucccuccccucacuccaugcaaauacauaccccccaaaaccugaauugaaugucauucugaacugugcucauggcuuauugcugauauaucacuuauuauauuuaaucaugauuguucuccucuuugucucauugagcuucuggaaagcaaggucugucuuuuuguguuuuuguaccuaaaaacaauacccaaugauacauuuuuuuucacauauuguugaaagauugaguuaaagaacagauaaaaggugaaaugaacacaucuugcuaccacauauaaaaggaggggaauuaaauuuuuuccucuaaagauauauauuggcuaaugagagaaaaaaaaugcugacaguuacuaaauuuaagaaauaacaguauaacuuuuuacugcauagaaucugaacuguuuucaaacuuuuagguucuguacagaaagaaauguaggucuuggaaugaugauguuagcauauauggcuuuacaaaauggcuuauacaugauauguaagaucaguugugaauauacaaaagaaaaauuccuaaagcucuauaguauauguuaguaacauugcucugaaguucuuaacuauguuuuaucauagauaucagcauuucuuuugauugaagaauauaacuuccauugaauauauuauuaaaaacuauuguaauuuuuauauuuaugauuuuauaugaguuuaaacucaguaguuuuucuuuuacagugaagaaaguuagcucuuuaguggauauaauuauauuuuacuaucuauugaaagaaguguaguugucaucaaauuuuauacuuacuaagaauaacccauccuaggcccuuuucuguaugauuaaauaagauaugucaagagcucaguacagugccuggcacaugguaagcacucacuaaauguaauauuaagggaaucuguuacuguuucuaaacaugaauauuuaaaauuaucuuuuauaagugaaucugaucacucucagugacagcaguaacaguauuuuaacagaagugaugauaauggugugaugccuagcauuaaaaaucuuaugcuaugaaucuggcuuucugaaguuacugcaccuguguuaguugaaucacagucuuugugcugcuuaacuuuuuguagaccucucuuuaacaaaucauaagauaauuaaaugauuuuuaaaaagaaaugguacuuuuuuuggaaauuacuggccagagcaugaauaguacuuuaccuuuucauacaguucggauuuaaauucuagguauaacaauugguuuaaaauuuaacuaaaaccauuuugcuuaaaauuuugauucuccuaggugggagacauuguuucuguuauugacaugcccccgaaaguguuaagcacaugguggagaggcaagcacggauuccagguaggcagcagcaaauuaggugugggaaaauucaaaggaaaguuuuuuuaugauucaguaauacuuuuguuuacaugugcugguaauggacuuugucaucagaaauuuugucugcaacgauagaaaaugcagauaguaaugauaauagauuuagauuuccuuuucuaauuacuauuuugguuguuucuuaucuccuuuuucaucuuuaaaugguggugaagccaaaaugugaauagcaucucagaccucauggccacuuuuagguuacaaggccuguggagugaccuugcuuuuaauacagguuguuaaucgggauucacauauauuuccucucuggaauuaagucaguuugauuaauauuucucuauaaaaaggcauuguaacuguuauguaaacuuacuuuuaauuacagaacaacagaaucuaaagcaaucucauuucuuuuucuauauucaguagucccuuaucuacgguuucccuuuccaugguuucaguuaccugagguuaaccaagguucgaaaacauuaaauggauaauuccaaaaauaaauaauucauaaauuuuaaacugcaugcuguucugaguagugugauaaaaucucucucugucccaccccggacgugaaucaucccuuuguccagcauauccacacuguagaugcugccugccccauuagucauucaguagcccucucaguuaucagguugacuguugagguauuaaggugcuguguucaaguaauccuuauuugacuuaauuguuuuagucgauuauuaguuauuguaaugaaucucuuacugugccuaauugauaaauuaaacuuuaucauacguaugcauguauaggaaaaaguauccuaggguuugguacuaucugugauuucaggcauucccugaguggucuuggaacauauuucuugcagauaaggagggacuacuuuauggcuaaacaguuuugagaccugauaauaacaucuauuagacugacuuagcaacuacuuuuuaugaggagucucugaaaaugccuuaaaguuguauccuuaacauauagccugugguuuuuuguggucuacuuauacaaguguuacuaaauacuacauaaauaaaaugcuccugcuauauuguuagaaauuugauaagcauuguauaaauacuuugaguucuaacuacauauuaaauaaaaaugaauuauuagcuuuuuauaaaauauauuuuuuauuaaaacauaauaauacaauuuaaaacauuauaagaugguggauaagagugggcucuggcuccagauugucuggguuuuaauccuguguugucucgggcaaauuguuuaauucucugugucucaguuuccucauuuguaaaauggggauuaugggacuauuguuuaccucacaugauuaucuugaagauuaaauaugugagaauaaaaauagaacaugcuuauuagaccaggucugauguauaauuuuuuuuuaaucaauaaguguugauuuuuaaauuuaaagaauucugguuuuuauuuuacaaguuuaauuuuaucuaucccuuucccuauuaugaaagcaucuauaguaauuuaauuugguuguuaagaccagaaaaacccuaucacauuaccccagaacucuucuuguuugugcuauugggaucccccuccaucugugcucugauuucuuaccagcuaugaauaagugcuuuugauuaaauauaaaacuaaauagaagacuacaguuaucuuuuuccuauuaaggagucaguucuucauguuaguggaaaugaacaauagacuuaagggucucaaagaugaucaaaagauuaauuuggcuuuaaaauaauaguuauguuguggucuugauguuacuacuaacuuucuucugucugucugucugucugucuaucuuaucuaucuaucuaucuaucuaucuaucuaucuaucuaucuaucuauguguaacaccuuagggaagucauuugcuuuuuuuggauuugaguuucuucuuaaaaucagaggguuucacuuaaaaucucucuauuccuucucaacauuuaaauucuaugauugucuucccuuuguuuauguaacagauauuuauucaguacugauugugugcuaaguguauagcuuuauaccccaaaguuuuguugagacgcacacaauuaguucauugccuaaacaaacuaauucuuuucaaagugaguauaaauuaacuagucuaaaacuaguuaaacaucaguuuauugccaaaacaaauuauugaaaacaaaaacgaaauuucuaacuucaaagauugauuuguaaccgauaaugaaaaaucuuuccuauaggaaugcuauuuuucaucuugauuggucuuagaaaggcaaucguaucuccauggaucauguuggagugugccugugagaagagguauugauguggggggugcccguguaaccaggaacaagucuuuaaauguuacugucaaacuuuuuuuaaaaagaaauucaggcuaggggcaguggcuuacaccuguaaucccagcacuuugggaggccgagguggguggaucaugaggucaggaguucaagacaagccuggccaacaugaugaaaccccaucucuacuaaaaauacaaaaauuagcugggcuugguggcgcauguuuguaaucccagcugcuugggaggcugaggcaggagaaucucuugaacccgggagguagagguuacagugagcugagaucaugccacugcacuccagcuugggugacagagcaagacuccaccucaaaaaaaaaaaaaaaaaaaaauugcaaaucaguauuuuaaggcaggaauccacaguucagcauuccuugcuguuucuacacauuaguccauuucuaagagcacucaugguuaauugcagggaaaggugugaaagaggagacauguugagcaucuguuaccugcaaaguauagcucaguacuuuacaugcaguguuuucuuuaauuucacaaagcuucuagguaguuacuguccuccauuuuuauggagagaaaacaguuuuugagagguuuaauaaguagucaggaugcuaagucaguuaagugaagggaguagggacugagaucuaagucugcuccaucucauugccugaagagcacuaagcaugauuuuuacauucacucucagauuauuaacguucuucaugucaguuuucuaccauauggaaaggaacaucuuuccugcucaaccagcaagaaauauaguguaaagauuagccaacuguggacugcaaagcauacauguuuacuggugggaacauugcuguuacugcguguuauguuuuugugugaugauuaaucaauuguaugcuggagaaaaacucuucagacuguucaugauguccccuaccuuuguuagguauuuuuaaauuguaagcgugugcuccuccugggagacacucuguugagagaggaagacaaucaugguaacuguacaucagacaucuuuccacauccugauuuucaaguuuaacugaaauaauagcuuaguucggugguuuuuauacuuuuucuuuuaauccaguggaauuacuaaucaaacagaaucaugcgcagaaccucagugcaagaaaaaguaaccauggagcugcccugauugguuuaagugggaaacgcugggccuuauccccaugcagcccaccuggcuggccuccuucaggccuucugcagcagcccugaggggccucaguaggggugaaaaccaugaguuuagcuuacuaguggaccucacuuuguguaguagauacaucaaaagcuauuuuaaaauuuuaauuuugaaaagccagccaacagucuaaaguuaauagggaaacauguucuuuauaagaagauuuuucaugacuccuguuagaaggauaauaucuagaguuauaaaauuucucuaauguaaauuaugucugaauuccugguacuucauauauucugauauggaugggggauaucauauauucauauauucugauauggaugggggcaaauaaucacauauauaugauuguauaugagauauauauauauauagagagagagagagagaguguguguguguguguguguguguguguguguguauauuuuuuuuucuguuauugggcauaacagaugacccacugauacuucugccagugggagcuguuucuaggauuuauucaucccuuaauuggucuguuagguacuguguucauuugcuagggcuacuguaguaaaauaccacaaacuggguggcuuaaaaauuaauagcaaauauauuuuccuacaguucuggaagcuagaaguuaagguaccagaagguuuaguuuuuuucaaaaggcuucucuccuuggcucacagauggucacuuucuugcguguccuuacauggccuuuccucucuguguuugucuguguccuaaucccuucuucuuguaaggacaucagucagauuagguuaggggccaccucauuuaaccuaauuaccucuuuaaaaguucccaucucuaaauacgcaguuaauccaugaacaacguguguuugaccuuugcgaguccacuaauacacagauuuuuuuuuuuuuuuuuuuaucaaacgcuauugaaaauacaguauuugugggaugugaaacccucauauauggagggcaggcuuuuggaauaugacgugggauuugaguauguguggauuuggcuauaugaggggguucuggaaccaaucccccagcuauguugagaaaugacuguagucgcauccugaguuucuggggguuaggaauucaacauuaugaauuuugggggagaggggcacaauuuuuagcccauaauagaugucaaccaguccugaauggagaagcugguugagccaccuuuagggcuggccugaaggcaccugagggacucucuuacauagacuugguggggaacaggucccuaccugagccaggcugguuucaggcucaaggcaggcaggacauggaggacuagcagaccucaguacucuccuuggggucucucugaugaguagggaguagggcucaccaggauucccuggaaggugcaggagggcuuccuagaggagguuacacuggagcacaguguugcauaugucuucugccgagaggauguccgaugacccacugaugcuucugucagcaggugcacaggccaggcggggaacagcaugcaccucggucagccagcucgccuggcucugguuacaugugaacccugucaacugggcuccggcugcagaacacggaggaggcugugcgucacagagguggcagugucuucccuagcaguguaaaggaaacgagggccucgucuugguguuggcugucaccggugguuuuccuagggauugagaugacuuagugcaggccucucucaggagagaagggaagaggagcaaggaugugggcuacugcuucccaugauggaggcugagugagcugaggugucacccucuugagcgcugcugcaacacuuucugaagcucguuguugacacccaggcccgauaugucugcauuugcagcucugcucagcucgauguguucauggcaugugaucuggacuccaguuuucuuuugucaaggucacacuaugugugugugaucuccuuucuggccagcugucagggcaugagaaggcacaagucucugugcagugguccuuccuuaauauugcugugaacucaugcuauauaguggugguauugugauuuuaauauuuuaaaaauagagcuggaugugguuccucauaccuguaauccuagcacuuugggaggccaaagugggaagauugcuuggaccccggaauuugagaccagccuggccaacauggugaaaccucaucucuacuaaaauuauaaaacugacccaggcgaagugguacaugucuauagucuaagcugcuugggaggcugaggcaggaggaccacgugagccuggcagguggagguugcagugagccaagagccagaccuugucaaaaauaaaaauaauaaucaauagacuugauuuuuguauaguuacagauuuacagaauaauugagcagauaguucagaguuucauguaauaccccugcccacuccccucaccuauaccuucccgucauucacauuugcuuuacaguacauugaauagaaucagcaaaaugcugaucuuuaccaaccaucagcugauuagcugaguuuaccuacagcacugacugagcacuguuucuagaagaguggucuaaggagcaccagggccagaaucacacagaaaaaaauacagucucaaaucauaccuugcaacuguugaaacaauuuuggggcuuacuuuuuguuauaauuaaugaaucaauauugauauacuauuauuaacuaaaguccauuguuuauguuagaguucccucuuggugugcauucucuggguuuugacaaauguguaauagcauguauccaccauuauaguuuucauacugaauaguuuuauugcccuaaaaaucuccugugcuucuccuauuuuuccuuuccugcugaacccuucacaaccugugaucuuucacugucaugucuuuuccaaaauauccguauuguuggaaucguauaguauguggccuuuucagacuggcuucuuuuacuuaguaauaugcauuuaagguuccucugugucuuucucuggcuugauagcuucuuuuugaaucacuaucuaauauucagugucauggauaugccacaguuuauauauucaaguauugaaggaccuugugguugcuuucauguuuuuagcaauuaugaaugaaacugcuauaaacaucuaugugcagguuauuguguggacauaaguuuucaagucuuuugaguaaauaccaaggaauaucauugcuggaucauaugguaagaguauguugaauuuggugagaagccacaacacugucugccaaagugccuguaucauuuugcauuguuacuagcagugaaugagaguuucugcuguuccacauccucaccaacauuugauaauugccaguuuaaaaaaaauagccauucuaauagguccaacacauaaaguuaguuugaggaauaguguuuaccaaauguauugaagggugcuguucugcucucuucauuuuguuaccaguaauucuuuuuauucucccuuugccacugacucuuaaacuugaauguuuaaaggaggcuauguuuaaauaucaaaucccagggccuaagcccuacaguucguuucagucguugugggguaggaucuaagacuauuuugguccaugugugcugcaggucaauucugcuacucaccugcauuuugccaaguucuauucuaaguauugcacuagcccagaccauaauuuagccgugggaacagaaggauaaguucauccauguguuuaaauuauacugugacucucuuucuuuucuuaaacuucugggaguaggaagugugaaauuauauuaacuacaguaauuugaaauuuugaaaucuguguuuuuuauuugucaccuaaggaguauauugaaucucucaucuuuguugucugagguauuucaucauauaauauacuucagaaaguaaaaguaaaaacucuucccuuuuuuuuauuuuuaaacuaacuggcauuauuaauagauuuguguucuugucuguaaaugauuguuagaaauaugaggugauaccucagaaaacccuuuuuucuagguaaaggcauuacacaaauacaacauguuaauauauuuuaggauuguuuguuaugugcagugucucucagaguuuuagcuaggagccauugguaucugaaugagagaaacgugauaaaaauggguauugaucaucagaaucucaggggauggggucaggagucugaauuuuaacagguuuuucagaugauuauuaugcacagaacaugagaacugcugauguaggcucgcacuguuuaucuugugugcagguaaagggagcaaucagacacaguuuagaaauuguguuuuguuucucccuccccucagaaaaucuuccguaaagcacaucugggacacaguuaaucuaauggcuagaaucucacuuagagagugacagaauuuuauauaccccauguucucuugguuuuccaugagaugaucaaggaucaccuauuucguuuuucauaguuauccccaaauauugugaguuuucgugcacaaguaucagagaagcgauucuuggacagcacaguuuuuuuuuuuuaccucaagaguauaauguggcuccagguaacuuaguuuuagagaaaucaucuuuauuucaaggggcagauauucagaaaccuuaucuuguauaguagcuuaauggauuugcuuauuucucugcuuauuuauguaaaaacuaucauauucauguaauauccuagaauccaaagcugcaucuuuucauuauucaaaaucaaauagagcaaaauguuuacucuccaguuaaguaaugggaaaucauauuauacugugaguuuucaucugugacauaauuucaagagaaggggaauuaugugauaaugcaaaugaaauaaauugcuaacauuucuugaguacuuaggugugcuuuucgaagugcuuaccacuaaccuuuuaauuccacaacuccaugaagguacuauaaugaucucauuuuagaugaagaaacuaaagcauaaaggguuaaacaacuagcccuuugucauuacacuguauauugcagaguuucuguugaagccuaugcauuuuaggcauauaacagagcaugguaauaauuuaaugaauaauaguggcucugcuuguuuacuugugugaaucauagauuuuucuauaguggaugaugauaguggaccaucugguucuaaacuaucauuuuaaaaugguagaaaucuggagacaaauuuagauaaauuuuucuguuucacaaagacaguaaguacgugguauagccaggaccagaauacaagcgugaugacuuuuaauuuuguauuucuuuuccuuuugggacauagaaauaaauacauuuucuuaauuuauguuuuauuuguugcuacuuuuucuuauuagugccauuagauauauugauguuggagauaaauuuccuacuugauagcuuuuuguuaauuuauaacaucagaauaugucuuaccaaccgaggcuuaaacacucaauuuuuuaaaucagcauuaaagaacacuuuauuuguuuuuaguuuuuuucuuuuuuuuauuauacuuuaaguucuaggguacaugugcacaaugugcagguuuguuacauauguauacauguaaaaacucaauuuuauagaaauuauugacaaaauggcuguggcaguaguucuuaaucuuauuaaacccuaauacccccucuuuaugacaaguauuuucuaaaauccuuuuuugucauucuaaaauggaauuuacaaauuauuuaacuacuuccauuaauauacacuuucaaaaaagucagcauaaauuuucagauauaaaggagaaauaaaaggaaaguaauuuauguauuuaaaauacacaguauguuuuuaaauauaaauacuugggacaacuaugugaagaccuuguuauccuaaauguaguccacagacuugcagcauucacuucagucagaaaauguauaaaacccauguauaauaguacuaaaaauaggaaauacuuaggacuguaucugaaaaaaaaaaagaugugaaagagcuauauacugaaaacuacagaacauugcuaagagacauuaaagaagauccaaauaaauggagagauauacuguuuuuauggguuggaagacuguauauuuuuuaagaugacguuucuucccauauugaucuaagucaaaaucccaggcaggcucuuguguagaaauauacaagcaaguuaaacaauucaaauggaaaugcaaaggaccuggaauauaauagccaaaacaaauuugaaaaagaacaaaguuggagaacuaacacuaacugaagauuuacuacaaagcuacaguuuucaagagagugugguauugguggaaagauagauaaguagaucagugggaaagaauagacaguccugaaauacauacauacaguuguacacauggacaacugauuuucagcaaaguucaaaagucaguucagugaagagauguaauggcaguggaacacuuggauauccagacgucuccaaaguaaacuuuauuuauuuuaccaucuacaaaaauuaaaauagauaauauaccuaaauguuuauaaaguauaaacuauaaaacuucaagaagaaaacuuaggagaaaacuuuuguggcuuuggauuaggugaagaugucucuuuuuuuuuuuuuuuuuuuuuuuuuuugagacagaaucuugcugugucaccaggcuggagugcaguggcccaaucucggcucacugcaaccuccgccuccuggguucaagcgauucucccacuucagcuucccgaguaguugggacuacaggcgcaggccaccacgcccagcuaauuuuuguauuuuuaguagagacaggguuucaccauguuggccaggauggucucgaucuccugaccuugugaucugccugccucagccucccaaagugcugggauuacaggcgugagccaccacgcccagccaauauaccuaaauguuuauaaaguauaaacuguaaaacuucaagaagaaaacauaggagaaaacuuuuguggcuuuggauuaggcaaagauuucuuuaaugugacgucagaagaacaauucauaaaaauaauuuaauuucaucaaaauuuaaaacuucugcucuuaaacaaauuuacaagaaaacaaacccaucaaaaagugggcaaaggauauaaacagacacuucucaaaagaagacauuuaugugaccaacaaacauaagagaaaaagcucaucaucacuggucauuagagaaaugcaaaucaaaaccacagugagauaccaucccacaccaguuagaauggcgauuauuaaaaagucaggaaacaacagaugcuggagaggauguggagaaauaggaacgcuuuuacacuguuggcgggaguguaaauuaguucaaccauuauggaagacaguguggcaguuccucaaggaucuagaaccagaaauaccauuugacucagcaaucucauuacuggauauauacccaaaggauuauaaauuauucuacuauaaagacacaugcacauguauguuuauugcagcauuguucacaauagcaaagacuuggaaccaacccaaaugcccaucaaugauagacugaauaaagaaaauguggcacauauauaccauggaauacuaugcagccauaaaaaaaggauggguucauguccuuugcagggacauggaugacgcuggaaaccaucauucucagcaaacuaacacaggaacagaaaaccaaacaccacguguucucacucauaagcaggaguugaacagugagaacacauggacacagggaugggagcaucacacaugggccuguuguggggugggggacuagggaacggauagcauuaggagaaauaccuaauguagaugacaaguugaugggugcagcagaccaccauggcacauguauaccuauguaacaaaccugccuguucugcacauguaucccagaacuuaaaguauaauaaagaaauaauuaauuuuuuuaaaaaaacuuucggcucuuuggaagucauauuuacuaguacagaaagacaaaccacagacugggagaaaauauuugcagugauuauaucugauaaaggauuuguaucagaacauacaaagaacucucacugggcaagcucaguagcaugugccuguagucccggcuacuugggaggcugaggcaggaggauugcuugagcccaugaauuugaggccagccugggcaacauacugagaugcuauuuuuuaaaaaacaaaaacucucaaaauuaaagaagaaagcaauucaauuuaaaaaauaggcaaagauuggaagagauaucaucaaaaggauaugugaauggcaaauuaauacauagauauccaacaucaauagucauucgagaaauguagguuaaaacaacaaugagguauugauucauacuuauuaaaauugcaaggauguggaagaauuggaauucucauacagugcuggugggaauuuaagaugucacaacucauuugaaaacaguuuagcaguuucucaaguuaaacacucaguaagucaucacuuaauguuguugguugguucuuggaaacugcaacuuuaagcaaaaugacauacugucuaaugaaaccaauuuuaucauuggcuaguugauauaaauaagaauuaaguucccacagcacagaguaagucaguucacaguuuccaaugugaacaucaaugacguuaagggaggaauuacuguacacuuaccacacgaucuaacuguuuacagaaaaagcauguguccauauagaaacucauacaugaauguucauagcaucuuuauauguaauaguuuaaaacuggaaacgacccuaauaucugucaacagcagauuaauagacaaauggugguguccauacaauagaauauuacuuagcaaugaaaggaauacacaguugauaaauacagcaacaugagugauccucaaagauaugcugcaugaaagaaggcagacaaaaaagaguauauuacauaagacuucauuuauguaaaauuauagaaaauggaaaguaauauaucgugauaaaaaguagaugaguaauugcccgaggagcagugaugggaggauagggggaaggaaggauuacaaagagauauaaggaaacuuuugggguugauggauauauuauaaucuugauugugguaauaguuucauggguguuuuaucaaaauguacauuuuaaauaugugcaguuuacuuuggguuaacuauaccucaguuaagguggaagcaaaaacugcaggagcauucuugacuucauguuguucaugcauccaauccaguugaucauaucugucucuucuaccucugugucguuuacauucauauacuguccuuccuuuuucaugcuguugucauacacuguagguuuuauucucuuuccuagccuauuuugcaaauuccugaagugguguacugcuucuuaucuuccucccuuccuuccagcuugaaagguauacaggcgaaugcuuuuccuuuuagaacaugccuguuccugugcugcuucugcucagaaugugucacuuuuauuuccuacagaaggaacuuaaaacuccuugugacgguauacaagaucauccaggaucuccgacuuuauucucacuuaccagucuuacuuugcacugcucuguuuuagaaacuggauguucugccagauguaacuauuauuuccccucuuaguacacaaguugcuuuuuucuacucuugugucuuuuuuuucuaugugucuuuccacuuacaaugccuacucuauccuuuucuuacuccuuccaaggcugaaagguauuacaaauuaauuaaaacuuuaaagcaaccguaaucuaguuugucuuauuugauauuguauuauggcaacugggaaaagaaauuuaauccccucagcuacuugcuguacaauaaacaauuauguucaauauucaguauuaugcuuaguauuaucauuccacuguuccucccaguuuuugcccaucaauuacuucuugccuuuacuauccuucuuuuccaguguagauucuagagccuugauuacauucaccugucacaaauauauucuuaaacccuucacccuuugguucuucucuuuuaucacuaguggucucuguuuggcuuaaugaaaaaaaaaaauagauacuuuacuacuccuuacuuaaacuaucauuaguaucugauuuucuuuuuccagagacuuuuuucucuuaacugacuugacacagucuccuuugccaggacacccuccucuacuagaccucugacguuugguguuggacugccuucuuauucuacacucuuugucccuugcuaucuuacucacuuucucaacuuuaaaaaccauauuuaugcccaacucucagauuuauguccugaucuuuagcuuuguuuuugacucucaaaccugcauauccggcugcaagaguaauuuuuuauuuaaauggaaauuagggaguugacauucaaggggacaguauaaauaaggcaaagaaaccagaagcaauguugugcuuuugggggacauacaaggagaguggggggugggggaauugguaggaauaucucaaagagcccaauacaagaauuacuaggcuauaaguaaauggaaccagagcuaaaaaguaaggaccugaggaacuuauuucugguuuuugcuuccuuugguguguagcaacuguuguuucuuugucucuucucuucuuuguuuggaaaaauauuuccuaauucuaacaauucaauggagaucauugaagauuuggaacuaguuccaaaaucauagcagacaaacuaauugacucauugacuuaccgucuauuugaucaacugugcugggaugguguuggcaggccaugguagucagacugggcagagacucuaaagaagauuagguucuuuaagcauguuucgggaguggggagaaaauaauuggcauuucuggacaauagccugugaauuuguauugguucaaaucuccuuagugaugugauuuuuuuuuuucuccagcaguacacagacaugcaaguaugguagugaauugauuuaguuguggugguuugcuggauugguuuggcaggaaguuaauauugcaaggaaauuaaaggguacugauuuaaaacaaaugcucaaucacaggguccauauuggguagcaaacaaaacaaaaaaaaccuggaauuguggggauaaguaccuuggggggaaaugugaaggggaugggaugucucuguuuguacuuuuguuguuauagaauaucaacacuagagaccugagaggauaggaaguuguagucagaaaaugaaaaacuggaguuuuaacacucugaggccaaauaauuccaauugaaaaaucugugauauauuuugaggagugagcagugcuucuacuaaguuuaauuugaaaaauguuuggcuacgccaacagugcuaaagauucgcuagccauaaauuaaauaaauaaaccaauagaagagaauuuuuuuuuuuuuuuugagacggagucuuucacucugucacccaggcuggagugcaguggcucgauaucugcucacugcaagcucugucuccuggguucacaccauucuccugccucagccucccaaguagcugggacuacaggcaccugccaccaugcccggcuaauuuuuuguauuuuuuuuuaguagagacgggguuucaccauuuuagccaggauggucuugaucuccugaccucaugauccgcccgccucggccucccaaagugcugggauuacaggcgugagccaccgcgcccggccaagaauuuuuuuuuuuaagucagcgauaagcacaugaucguuaugcugaauuccuuuuuagguuuuuguugauugccucaaagagacuauaguuaggauuagguucuguuguuaacucuacuguuuccaaagcuccaggcuuauuuuauugcaguaguuucuucucuaauauuccuuuuaaguuacaccaaaguauuuuucagcacauacacucacuuuagaagccaaaccggguuuucuuuuuagucugaguauuccccaagguagaagaagaucagaagaaccagauuacagucuguucccuuuacaucucuccugguucuccuagagucagagggugagccauaugcuugcuaagcuacuagaaacugauuaucagaagcuguuagagguggauaggcgcaggacgaaguguaugaauauacaucaguggucagcuggagccaacugugaaauuuuguaggacaguuguuaaaaacagccauuauuaaaaauuaagguauauauauuuacaaugaaaugaauuguauuaaaaacaaagguaauaaucaaauauauuuuguaauuauuuuaccacauuuuaccauuuaugcucuugaaguuauuuccagcuacucuaucuguaugcuuucaauacuguauaacugagugcccuucugcuucucuuuccaauuuuguguucaguuguaucaaguugguagcuugaaaccagccaugaugggaguguguauacggugggcgcuggaaaacacuggaaaugaaggccuuucccccguggagagcuaguuguuaaacauuuaccagcacaccaugguauagauuagcaugucugguggcuuuuugcuuuauuucaaagacuugagugaaaacagucaacagggaggucuccucuuuucaagaccauuccuaaccuguuccagcccugucucuacauuguucuuuuccuucuauuacuguguuuuuauuaccuacuucuuuaccgucaugggcccuagaugcuggcuuuuucuccaucuuccauucucuuccuggaguugaaucucauuuugaccccugccaauauacccaauucugcucucccuuuccagccauguaaauugaagcuuuagaaauugccacagcugcagaaagaauaagauacagaacaagaugacauagcuaauagaucauauuuucagaguuccagucacuuuuuaccauuugacauuuuaucaaaauuguuacuauuuggugaaaucuuaggugaaguauucauuagaaaaguauaaguguucauuaacuguacuuuuaaaguuaguuccauucucguguguaauauuuucaagagaacacaauuuuuuaucaugaaaauuuugugaugguaaaauggaaucuguuugccuuucacaaauucauagaacugacucuuuuaaaagacuccuugauguuuaggagugauuuuggcuucaagaaacaaaaaacugagcggaaaagaugauggauuucuagugcugagucagcagcuuaaugaugccaggcaggagucucuaagguucucucagcuuuucacuuauggucaagugaugaccacgacagaucuagucaugacaccugugcucacggcacagaggaggagacaggauaguagcagagcuguguuuacauguguugcggcuuugccugaauauagggagucugggaaacugucuaguuuagcuaguaguuagugauauuacacuuaugauaaaguaaaacaagagggcagggauuggaguuagguauuaggugagccuacuguagaucuaccucuguauaguaugcaguggcauuuccccauauaccuaaaccuaauucauugugaugaauuuaaaaggugaaaauguaacuaauguaugugauauaguucccugagaagugcauuaagcucucuuuguucagucuuugugggaagugauggaaaacuuuuuuuuuuuuuugccaaaagauacucgaacuuagaaacuaggcaguuacuuucacauaaacucuuugagguauagguaguguuaucccuaacguuacaaauuaggaaacuaagacagagauguuaagcaguuugccauagaucacagaaccuaguaaaugggugagccaaguuuagaaucuggacuuuucucucaggcaguugcagauuuuauauauugaaaugaauuagaauguuuuagaaagaaugauauuugagagucaggaaacuucagcagauauauccaaaagguggcauuuuguguaauauccauuugauggaggagcuagagcccucuagcaguucugguagccaaauacugggauaauaauagcauuuacuuaugcauuaacccauuuaugcuuaguguuccauuauuggaacgcuaagcuugugggaguuauuuauaucuuacugcucaaggucaucgccaaguucugauuuuucacaaaaaaauuuugcaaccucugccauaaauggguuaaagcuuuagaaauugccacggcugcagaaagaauaauguacgaaacaggcugccguaguuaauagaucauguuguuacuagaccauuuaguuaacaaaucaaugcauuuuacucuaugcauuuuauuuauacuagcccauuuaauucucauaacaucccuuaugagauaggcauuauuauuaccauguuuagacgaagaaacuaaaacacaaagaggcuaaguuacaaaccuaaucuagugaguggcagacuuaagauugaacccagauacuucuuuuuuguagccauguguuagcuuuauauauaaaacaugaugaaaacuuguuuaauauaaaacacuuuaauauaaaacaugaugaaaacucaauuacaagaguucgaaagggcaagaaaaaccaaugaguuuccacuuuauugcaaguuuuaaaaucugagacuaguuaaaaaaacugauauguuaauuucagaugaggguuaauuuuuuucaccaacuaaaaauuacuauaugggaagaucagugcaacaaacaguacaguuugcaaacccaagccacaaacuuauuguuaauaaucaugguaagaaacagccaaagagcaacugaugccucaguuaaguuugaaagaaacucugccuucugugaaggcagagaagaaauaugcaagcaauucuccuucaagaaauuugcauagagucaggauguggugacucacgccuguaaucccagcacuuugggaggccaaggugaguagaucaccugagguugggaguucacgaccagccugaccaacauggagaaaacccaucucuacuaaaaaugcaaaaaauuagccgggcaugguggcgcacgcguauaaucccaguuacuugggaggcugaggcaggagaaucguuugaaccugggaggcggagguuacagugagccgaggucgcgucguugcacuucagacugggcaacaagaacgaaccuccguugcgcaaaaaaaaaaaaaaaaaaaagaaaaaaagaaauuugcauagaaagagaaaauguuagagccuuuaccacaagugaaauugcaaagcuugaacauaauucaacucaauccagagagcaccaaacaucaaauuggggccaagguagaacuugaacauuuaauuuccagcuaugugacuuggagagcacuauaauuucagauguggaaaccagcugcagguaggcucuuuuagaaacaugaauuguauacuccauaaauucugaaacaaggcagauauuuguacauuguuacuugaauuucagaaggguaccucaaggcaucaggaucuuuuucagagucacucuugaaauaguuguaucuucccagccuugguaaccaccuuuuuacaguucucuagccuuugcauugaaacacaccacuuuguggaaugacuuuuaacauucuauccgucauggcuuaagauccugaagcagcuauuuccagggcaccucccaucuccucggcaugagcaguuucccagucacuucuucauccccccaaguccucuucaugagagucuccagagcucauagcaucaaggucuccauugcugggacucacaccggagacuacaucuggaagcuccacuccuccagcucucucugcuggagaccaaacugacaguuuauugcaaagacuuguaaaaacaaagauuauuuacaaaugcauuuuuguauacauuuguuuaauuuacgaccugagacuuuuauaaucgcuuuccaaacccuuuuauggaggguggaacacuuacuugaggcuacgcuguuaaccaugucccauauccccucucauaacugacuuguguaagaaaaaaaaaugaagauuuuuuuaaguugacucuuaccugguucuaaucagucuuggaagcauuucuacuuguuccguaaaauaggaaguugaguagaauauauuaaagaauuucaccaguaaaacaaauaccuaaagcaucauuuuggaaggcagugcauaggaaucccaaauucacaucuugugaacaaaacugauagucugauaaugauaccucaucucuacacaaaauaaacaaaauuagccaggugagguggugcaugcccagagucgcagcuacucaggaggcugaggugcgagaauuguuugagccugggggaucgaggcugcagugagccuagauugugccacugcacuccagccugggugacagaaugagacccugucucaaaaacaaaaaacaaaaaaacugauaaucuguuaauaccccuuuucagcucaugauaacugguuuauaucuucacaauuuuaacaacuaccauagaauauggaucuagaaauugaaauaagaauguagcaaaugaguaugugaaaauaauuucacacagauggaaauuauacagcucagaacuuggugaugaaucauacccuuggaaaacuauuccauucuuccccagagucugucaacagagggauacacaaagugauggagcuuucauauuucagcuuuaacaucugcugcauggcagcccauuuauauuuuuaucuaaggaaacaucuauaaauauugauaaagauuuccucuuugcuuuuguuuccaggcuguuuaucucgguauuuauccuuuuggcuauacaguaucucuggaugaucuggaacucagcauuuuccuaauacggcuuguuacaaugccaaaagcaaugccugcgguucugcuacuaggucacugugguguguuccucaaagccagagucuguugacacugcugagauuggcuguuuucuucucucuuacuuucccucuuuuccaugcgcuacuaguuuuuaaaagcagugaauaccaggauuuuaaaugagagauuauuuuacacauuuauuuuagucaugucuuuuuuuuuuuuuuuuuaugaaaccugggagagagugaagagaaaauucacaaaaaguuugaguuguggcuuaguguugauuuaaaaaacccauagagaagucaauaaacauaaguuggcaacagagguaucaacauaacuggauugagauuucaguaaagcgcauuauuaaauuauaaaauuuuaccuacuugcaugcauagcucauugucagacuaaauauuuuaauucauguaaaaaaagauugggaaauuaaaaacuaaaaggaaaaaagcagacuuagauauuuggacaaauaaaacagauaacuuuauguacucauagcaacagauuguuuuauuauuuguuuguguaauuggcaucaucuguuauuuagagucuuggaauaauagaaucauuugggagggacuguagaauacauuacuggaauucaguuggcaguguucacauaauuggucuguuugcugguuuagaauccuuucuuuguugcuuuucaucaggugggacucuucccuggacacuguguugaguuaauuaaccaaaaaguuccccagucagugaccaacucagugccaaaaccaggugaguacacuuuuuucacuaguguaguuauuuuaucaacugcuugaagacacagauuuucugucagucaaguauuuagcuuguuuugcuaguuuugcauuuauaggcauaauaauuaacauucuuaauuuuauaugguuuugauuuuuaaauguauucuuauaucucuguugaucauuuugaaaagguuuacaugcacucaaauuuuuaggcaauugcuccauuaagcuuugucauuauuuacuuuuauaguugcauaauagcauuguaacuuaaugaauaaaaugauuuaaaaaauagguuuaaagaacuaacauagaaauuguaggauuaacugaaaauuaauaaaugaaaaguaaguauauuuuaacagggcauaugaacaucaaaacuauuuuaaacagcauuucuuauuacuuauacaguauacuuacagugcugcauaaauaucuagaauauauuacaaauaaagcauuguugaaggggauaaaaaucaagaaaaugugaauuucgguguuuauugaggugauuuaguuuugggaagauucaacagaaugccucaucugaaacuuuuugaugaugucgauuaaaaaaaaauucaaacaaagucuaaaaagcuuuggagagaagagggagucauccaacuuauuuuuccuagcuauauuacauuucuucuguccuuucccaccucccaauaaaaggagaagaaaaaauuucugggccucagaauuaauuugaacuguuuaccuuaugauaguauuuucuaguuuuaggaccuguauguaagaguuaagaaaaaaaaaacaguuauucuuuacucuuuugguauuuucccacuucugcucccaaagcuuacauccaacaaucuuugcuaauaguauuuaaguaaagguuaauaauaccuuucaaagcuuauuucuucacaggagacuagggaaucauuguucccauuucucucauuggaauuuguuuauuuuagacuaacuuuauuguucaguagagaaaaugcuucaaaacaguguuuucugcaguucuacuugagucaggauucucaguucuuuuugaagcaauuuuauccuucuuggguaaacuuuuuuaaaaagcuccuaaguggguacuuguuugguaaaucuucauucguaacuguagauuucauucuuuuuaaaaauacggcguuauuuuaaacuuaacuuuuugaaaacucagcuuuauuaagauaaaauucgcauaucgugcaauuuacccuuuaaauuguguaacaggguugugcagccaucaccacaguuaauuuuagaacaccuucaucacuucaugaagaaaucccauauccauuagcggacacugcuccccucauacugcucccagcccuaaacaaccacuugucuacuuucugucuuuauugauuucccuauucuggacauuuuguauaaauggaaucauauaauguguggucuuuugugaugggcuucuuuuacuuagcauaguguuuucaagauucaccugugcaguagcauguaucaguacuucuguuuuaauuccuucuuuuuaaauagcuggauaacauuucauuguaugcauaugccacauuuuauuuguuuauucauuuggaguuguuuccauuuuuggcuucucugaauauucauguacaauauuacauguggauauguuuuaauuucccuuggguauauguccaggugugggauugcugggucauaugguaacuauauuuaaucuuugaagaacugccagcugcaccauugguguaacuguaccauuuugcaguuccaccagcaguguaugagacuuccaguugcuccauauccuugucaacacuuguuuuuauuuggauuuuuuugauuauugccuucuuaauugugaaguaguaucucacuguggauuugacuugcauuuuguuuuuggcuaaucauguuuagucauuuuauaugugcuuauugguuauguguucaucuucuuuggaggguaucuauucauauccuuugcuuauucuuuuuucuuuuucuuuuuuuuuuuuuuuuuuucgagacagggucuuucuuugucaccacaggcugcagugcaguguugugaucauagcucacugcagcccucaacuccaggccucaaaugauccuucugacucagccugcugaaugacugacauuacacgugcaugccgcugugcccagcuaauuuuuaaauuuuuuguagagaugaggucuugcuuuguugcccagauuggucucaaacuccugguuucaagugauccuuccaccucaaccucccacuuuugcccaguuuuuaauuggguuauuuguguuuuuuuuagugaguuguaaauguugcucauauauucuagauacaaauucuuuaccagauaauaaugauuuacaaauauuuucaccuguuuugugguuugucuuugacuuucuuugguaguauccauugaugcauacaaguuuuuacuuuugauguuucuuuagucauuuaugcuuuugauuccuuauuuaagaaggcuuuggcuaacccacagucaugauuuacuccuguguuuucuucugagagguuuacaguuuuagauguuacauauuagucuaugacccauuuuuuaaaguuaauuuguguguauggugaugaggcagggguccaacuucaugagguuauccaauuguucuagcacuguuuguugaaaagauuauuucuuuccuguugaauuaccuugauacccuuggaaaaaucaauugacccuagacacaguugacccuagauuuauuccugaauuuccaguuuucuuccauugauuuauaugucuuuuuuuguucguuuuuuugaggcagagucuugcucugucacccagguuggagugcaguggugcgaucucggcucacugcaaccuccgccuccugaguucaagcaauucucuugccucagccuccggaguagcugggauuacaggugugugccaccacaccuggcugauuuuuauauuuuugauagagaugggguuucaucauguuggccaggcuggucuuaaacuccugacaucgugauccgcccaccucggccucccaaagugcugggauuacaggcaugagccaccgugcccagucucuauauguguuuucuuaugccaauaguacccuguuuucauuacuguuguuuuguaguaaguuuugcaguggggaaguguaagucauccuacuuuuuucuucuuuuuaaggguugauuuggcuuuucugggccccuuguaauuccuuauggcuuuagaaucagcuugucaguuucuacagaguaggaugggauucugauagagaguauauugaaccuguagaucaacucgggaaauauuauuaacaguauuaagucuucuaaucccugaacaagggauguuuuucauuuauuuagauauucuuuuguauuuuuaauuuuuuuucuuuggagacagugucuugcuuuguugcccaggcuggagugcgauggugugaucauaguucacaaguccucaaacuccugggcucaaggcaucuuuccaccucagccuccugaguagcuaguacuacaggcaugugccacugugccaggauaauuuguuaguuuuuuguagcaaugucucacuguguugcauaggcugguccugaacuccuggccuuaagugauccucccgcaugagccuccaaaagugcugggauuauaggcaugagccacuaggcccagucagucuagacauucuuuaauuuauuucaauauuuuguaguuuucagaguauaaguuuuauauaucuuuuguugaauuucuuuauaaauauauucaauucuuuuuaaugcuauuguaccgggaauuuuaacauuucauuuucuuauuguucauggcaaguccauaggaauauaauuuuuguauguugauguuauaucuugaagccuugcugaacuguuuauuaguucuaauaguuucauaguggauuccuugggauuuucuauauacaagauuaugguaucuacaguagccacuuuuuacuucuucccuuccaaucuggaugucuuuuuauuguucuugcccagugguccuugugagaaccucuaauacaauauugaauauaaaucucaaguacaagcauccgugucuuguuccugauuuuaggggaaaucaucuagucuuuuaccauuaaguagcuguggggguuucauagauguccuuuaucaggguugagaaaguucccuucuguuucuugugugucaaguguuuaaaagagugcaggaauuuuuccaaaggcuuuuauucaucuguugagauuauaauggguuuuuauggucauuauuuugaaguuacuaaaauucaacaucaaacauuuaauuuccugcacauauuuuuauccaucuuucugugguguaagcuuaacuuauauuaguuauuaugucucaucuuugauaguauugacucagauguacuauaaauuggguuuuuaaaacuuagccuaauauuggcauuaaaauaaacuguguuaguaucaaucaagugcuuucucucuuuuuuuuuuuuuuuuuuuuuuuuuugagacggaguuucgcucuuguugcccaggcuggagugcaauggcgcgaucucagcucacugcaaccuccgccuccuagguucaagcgauucuccugccuuagccucccgaguagcugggauuacaggcauaugccaccaugcccggcuaacuuuuuguauuuuucauagaaacggguuuucuccauguuggucaggcuggucucaaacuccugaccucaggugauccgcccaccucagccucccaaagugcugggauuacaggugugagccaccgugccuggcccauucucauguuuugaauggagaaaugacacuucaaguagggauaaccuccagaaccauuuagcauugggaaaguuaaucaguuauugauaguucuggaaaacagguuuguauuuguagaccugcauagcauuguuauuucuaaauuaagaaugaccaagaaaaaccuagcguaccuucaaaagcuaguauuuugucuucugugagcagcauugcagaguuggcauaaggaaaugugcuuuuuuuuucuuuuuuugauggagucuugcucugucacccaggcuggagugcgguggcgugaucucggcucacugcaaccuccgccuuccagguucaagcaauucuccugccucugccuccugaguagcugggauuacagacacaugccgccacgaccugcuaauuuuuauauuuuuaguagaggugagguuucauguugaccaccuggucucgaacuccugaccucaagugauccgccugccuuggcuucccaaagugcugggauuacaggcaugagccacuguacccagccaaaauguacauucuuaauacauuuugaaaaggaugaugugaauucugucagccuugggcuuguuucacacuuuaaaacugucuuugccuacgguauaaacaacuugaauguucuauuuauuuuuaacauugccaucugucacuguuagaugccaaaucugaaagauacagcuauaguuugagacugaaaauuucaaguuccuauacuauuacacaacaaggguaacauaggaaaaauauucucuuugaaucuguucuuaaauguuauuaauauguucaauuauuuguguguacagaaaauuaaucaccauauccugaccaagauagaaaguacccaugguaccuuaggaaaaagaagguaagaguuugauagagagagagagagagagagaggagaggaaacaaaagagggggaagcuugucuauaagaaauugucauuuuauucagucacccuagggcaugauauaguggaagaugaggucuagguggggaaagguggaaggggaagcacauguuuuucuuuguguuuguuuugcuugcaagucacugaggagcuauuuacugacacuuuucuugaaggcuuuauguucauagcuauucucuuuucagauauuucuuuuuccgaauucucuuucuccucuccuuuacauaucaguuacauuauuugauauugucucacagaucucagacucuguuuuuucuuuuuuuuuuuuuacucuguuuucuuuuucuucuuuuucuuuuuuuugagacaguuucgcucugucucccaggccagagugcaguggcacgaucuccuguuuucuuuuuuucucucucucuuuuuuuuuuuuuuuuguuuucaguuuggauacuuucuguuguccuaucaucaaguucagugauuccucacucugcuauguguggucagucuucucuuaaggccaccuaacacauucuucaauucucguauuuuucuuuucucgcauaaagcuaaauggucuuuuuacaauaauugcuaugcuggaauuccccaucuuuuugcaucauccaccuuuuccaccagaaagaaagaaagaggaggggugggggauagaagagagaagagggaaagagugggagaaauggagaacagagaagaaaagcaagcagagcuuauuuugaggcauuaacuucuggaaauaaaagacuagugauuuaggcaaccuucccucugaggacaguuaaaaaauuuugacagaaguauaaaaacauaucuuugaagcauuagagaguuaauaaaacuguaagcaauuauugugauaaggugaugaaacagaaggaaaucugaagagugaccccugcauauggagacauuauuccccuaggauaucugcugauggaguagaggaggucaucauagugcuaggggaacaaaaauuggaggucagaacccaucaagacagaguugcugaaaaaugccccaagcuuugaguuggaaucuauguagaaauugaugacugauucuaaaauguauauggaaauacagagccaagaauaccaaagacgauuuagaagaacaaaaaagugggaaacuuacuguaauagaugucaagauauauugugaaagcuucacuaauuacgacguugguauagauguguacagauagaccaauagaucaauggaacagaauagaguccagaaacaaaccugugucuauauagauacuugauuuaugacaaagguggcauuggagggcaguuucaaaagaacagucauuucaauaaagaguacugagucagcuggacaucugaauauaaaaaaagagaagccugauccuuauuuaaccccauacacaaaaauccauuccaggagaauuacaaaucuguaugugaaagacgaaacaauaaaacuuuuagaagauaauacuauagaauaucuuuaugaccuuggcuuuagacauaguauuaauuauaacugaaaagcuuaauaauuaaacaauuaaaaggaagaacuuuaucauaauaugcccuuaagacagugaaagggcagauuacagugugggaagauauuugcagaaugcguaucugacaaaggaguuguaaagagucuuuaggaaaaugcagaucgaagccuuauugacucuuuaguacauacuuaaccagaauaauuaaaauuuaaggauaaugauaucuaagguuggcaagaauauacauuaauaggaauucucauaugcugaugaugggaguauuaauuugggacaaucauuggcauuaucuauugaaguugauacacaacuguaacccagcaguuccacuuuuagauguauauagagauucauguacacagacuaagacacaugcauagaaauguugauaacagcuuuauuuccauuuguuaaaaacuggcaaaacuuauggguguauacaugguggaaugaauaaaugaagauauauacaguaaauuccccuacaccaguaaaaaugaaugaguuaaaacuguuugcaacaacaugauugaaucucacaaaaaauaguauugaauguccugauauacacacuuacacuguaaaguuucauguauacauguagagaguucaaaauccuaagaguucaagacugcucugugguauuagaacuuaggauagcaguuaccuuuggagaggaaagagaaggucagugauugggaugggcaggagagaggauucuggaguacugguaauguucuguugauccaggugggaauuauacggaaaugucaugauauugagcaucuuuuugugugcuuauugcccauuguauauuuucuuuggauuaaugccuauuuaagucucuuucuauuuuugaauuggucacuuugcauuuuuaaaaaauauuuuuuccauccagaugaauauucuuugcaguauugcuuuaauacacaaauguuggaaaucauauuuucaaaaaauacuuuugguacuuuuauacuguaaauuacuuugcauccaccacaaaguaaguagaagccuauguacuaaaccagagaacuuuuucucugauauauuguuaaaugaaaaggcaaaucacagaacaguaaaaucccauuauaaauucauagaaagaggaucuagaaggcuauguacguaacugcaaaggggaaugggauuauggagacaguaagaaacauuucauuuuuucuccauuugguuguguauuauuuaauuuuuuuauaauugaaauggaauaguucccuuggccccuuugcaggauucaaagcucaggggcagcacgcaggugagugggugcagaggcaaggaugagcaccucugggcaacugguaggagcagaacucugugcaggcccauggcagcaucuagaaguuacccacgacccuuggcgccccagagggcauguguuacagugugcucuuuuaccguugccauccauggguggcucaaauguuaacucaguggagggucagugugacagccucuugcacuuguauccaaguccuugucugggguccaggaagaaucaggaugcgcaaaugaauugaaggguggugaauguggaggauuuuauugagcgguagaaguggcucucagagggauggggagcuggaaaggggauggaguggaaaggugguccuccccuggaguuugaccaugcccagcugaacucuccucugaaguccugccgucgagcccucccucugaagucagucugcuucucucaaacguccggcugcuucucuuauucucugcugcucuacggcucuacugcucugcuggcagggccugggguuuuuaugggcacaggauaaggagcgggucaggccaaggugguuuuggaaaaggcaacaauuguaggggugggaaacaggaaugcauguucucacuuugggucauagguccaggcuugagaguguggcccuugccagggaccacccucuucuacccaguguuucccuuucuccuguccguaucacaaugagcauguauuauuuugcagaauaugaagaaauagauuguaaucuccuguuaacucuacccugcccaaacagguaauuucuaagauccuucuuaaugcaucuaccccauaaaauggacacuagugacacuagauuuaaugcagguguuaaauuuauauaccugugugaaaagcagcaggguuaaagggacaaaagcucaggcaaccuuggguucaaucccuaugccacauuuuauugucuggguauacacauuuggccucucugauuuucaauuuccauaacugaaaagugaggcaagauuauuauuucaaagauuauggauaagguacuuaagaccccuggauacuuagugaaugucaacuguuauuuauugauuuguguuuauuuacuauguuauuuaaauucaugaguaucagaaacuauauuuaauuuauauagauacuuauuuaagauacuauuuauugauauaaaucuacaugccaagauaucacaguuguguuagucuauucuagcguugcuguaaagaaauaccugagauuggguaauuuauaaagaaaagagguuuaauuggcucacaguucugcaggcuguccaggaagcauggcacuggcaucugcucggcuucuagaaaggccucagggagcauuuacuuaugguugaaagcgaagugggagcaggcaccucauguggcaggaguaggagcaagagagaguggcagagaguaccacauacuuauacaaccagaucucacgaguauucacuaugcaaguacagcuccaagccaugagggaucugccccugugaccaaaacaccuccugcuaggccccaccuccagcacuggggauuacaauugaacaugagauuugaguggggacaaauaucuaaacuauaucacaguacaugaaggaaacauucauuacaguaguuuucacagaaccauggugggggaaggagcuucuuugaauggucuaagaauuugcaucacaaauuucuguuuuauuugaagauaacuuuuuuuuuguuaacagauauacauuaaagcugagaccuuuuuuuuuucuuuaagacuaguuaagugcaugugugagaagacagaaaagaguagaacagggaaauagaucuguaacugacauggguacaaucuauugagauaacucaguaacuuuggaccagccgggcuuuuauuuguaguguuguuucaggaaaccaguccucuaguaucuugcuuuuuauguuauuuuacauucaguauuaccuaauuccaguuguuuuguucuaaauuuucacuugcuugcuccuggauuguuucuauuuucuuucuuuuuucaguuuccaacacuuuuugcucuuuuguagccauguuucuuugcaugucacuuuaguaagaagugaccacacauuuauaugucaacuaaaagagguccagguuuuuacuuacucuauuuggaguguugcaccgaauaugaauaugcuucccauugaacaaaugcuuaaguguguuaagaaucagauuguuaaaaucccuaccuucagaggcacugaugaaagagucaaaggaguacuaaaaugcuaaagugccuugggaagcuuucuccccaaauacauugcaaaggauagaucaagauaauauuuucucacucuguaucaggggaaaacagaaaauuuauaauaccauguauuuauaaagugcuuuaggguuuaugaauacuuacauuuccauuguuuaaacuggacaugaaucuggucacaacccugugagcuugcuagggauagggaauguauuuccauccccuccccuuccuacccguuuuuuuuuuuuuuuuuuuuuuuuugagacggagucucccucugucccccaggcugcagugcaguggugcgaucucggcucacugcaagcuccgccucccggguucacgccauucuccugccucagccucccgaguagcugggacuacaggcgccugcaccacgcccggcuaauuuuuuguauuuuuaguagagacgggguuucaccguguuagccaggauggucucgaucuccugaccucaugauccacacgucucggccucccaaagugcugggauuacaggcgugagccaccgugcccggccccuacccuuuuuuaacaaauggagcaacuggaagcuuaagacaccugccugaggcuucacaaguaggauuugcugaaaucuccugacaccugaugguaaucacagccagcgcuuacauaucccugacugcgcaccaagcccugugccaugcaccugacauggguuaacuagcuugugugcagguaguuaaugcaaaacccagaauucugcccacuauagaaccuugaauagacauaaagauuuuuguucucucugucaaaacaaaaauuuaauuccuuuugcuuuuacuacaauaggaguaaauaaaauguguuuacauuuuuauaaggccuauauaaacagaacagaaauuagggcaaaagaugggcugaauugagguuaaagagaauugcuuauaggaaccuacuuaauuugcuaauuuuguuuucagucaucgucccuuccuaaugccacuuuaauuuaaaaaaaucuuuuaauuuuucuucacuaugcauaaaaaauauccccaaacucucuuacauuguagcauuuccagucauucuuuuccauuuucuuaguauaguauuucucccuguguacuugacuggaaucuccuuguguuuucugaacauggcauguggcuucauagcuuucacuuugcuccugcuguuccuacacccugaaaugccuuccccauuuuggccaguugaaauccugcuuauauuucaagacucaggccagaauccacuucuuccaugaaagcuucccugacccaccucucccuaaucccaucuccucuccaccacuaguccacuagugcaaauuuaauagcaguuauuucacauauucacuaaauuguacuuucuucauaagugacaaacaugucauucaucuucaucuccuccccaggcuguguguguagugguuacacaacgaaugccuguugaauuaauccauccuaguauuuacuaucaaauuaaaauuuuggaguacagcuuucaucauguaacucuuaucuucagaauauuugggugaauccucccucuaugccagaauuagauacaaaauuuucaguguagaauugaagguguuucacaaauaguggaacuaacuuaucuuugcagccauuuuuuccccccauuucuuaccuauauucagcuucacuaacguguuuccuuacucucuucccaagguacucugggcuucccccuucccucgcuugugacugacuuaccauuuuuuugugugaagguucccuaggccacucuuugacaaacuugaauuugcauucagcccaccugaguucacauucauuucucucaaaaaaauuuugaguuugauacuucacuuucuauaugucuuuuuuccccaccugcgugguuuuguuuguuggcagauguuguauuuuauaguaauuugcgucuuuuauauggaugcuccaaaacaguucuugauugguaauuauaagcaugaacaguuuucauuauaguuaccaaaaauguuuccuaaacccauaugcccuuuagucagugcugggaguagcccccuaaucagucuuuuucuugcccugaguaaagaggcuuuuccgcuuuuggccauuuccgauauucauucauuaauugaucaagaauuuaucgagugcauacuaagugcuauggcuaaaacagugaacacaccagacagaaauuccaccauuuugguguuuguauucacgugugacuagaaggagagcaguaaauaaauaaauaaacaauauaguaugauagauaagggcaaugaagagaaauaaaccugagagacggaugccaagacuaggaaaugcugagaaguggcuuaugugggguuauaauuuucaagggaggguagggugguccgggaauggcucauuagaaaccuacuuuugaacaaagaccugaaggagaugaggaggggagaucugcauguaaucuggaggaagagcuuuccaaagacggaacagcagguguaaugauaccgaguugaaugugugucagacuugguaaagggucaggaggaaggccagguuggcuagagcagugggugaagacauaagaugaggucaagaggggagagggaucagaucuucucuggggccugggugucaccauagggguuuuggcuuuuauucagaauuaguuggguaggcaguggaagacuuugagcaguuuuuguuugguucuuguuaagaggaucacuuugcuugcuguguuaagaggaaaggcagagauagguagaagaagaggggcuggcaguggcuguugaaaugagccaggugagagaugauggugacuuagaccaguaugguagcuguguaagugaugagaagugaucugcuucuggauauauuuuggccauggagcuggcagaauuugcagacaugcugugaagggauugaaucauccagguaauuuuuuuuuuuuuuuuuugagacagagucuugcgcuguugcccaggcuggagugcaguggcgugaucucggcucacugcaagcuccgccucccggguucaagagauucuccugccucagccucccgaguagcugggacuacaggcacccgccacuaugcccagcuaauuuuuuguauuuuuaguagagaugggguuucacuguguuagccaggauggucucgaucuccugacuuugugaucugcccuccucagccucccaaagugcugguguuacaggugugagccacugcaccuggccuuuuuuuuuuuuuuuuccaagauggagucucacucuguugcccaggcuggagugcaauggcgcuacuuggcucacugcaaccucugccucccggguucaagcaauucuccugcucuccugccucagccuccugaguagcugagauuacaggcaugcgccaccaugcccggcuaauuuuuuauuuuuaguagagacaggguuucaccauauuggccaggcuggucucaaacuccugaccuugugauccuccugccucggccucccaaagugcugggauuacaaaugugagccacugugcccagccccacucaaguaguuuuuaugauagaaugauuagaauaaagccauuccuuuuccagugaauucuccuuuugccucucccacccaugcaaagauacauccuaguccaaaauagggggauagucaccaaacauuuuguuaaauaugagagaaaaacaagugaccucuccuacacagucacuagauggcacagcaucuuuucagucaauuauauuuuuugacuuuuuauuuugaaauaauugaucucagaggaaguugcaaaaauaguacagagagauccccuggauucaucacucaauuucuccuaguuggaacauaacuauauaguaguacauuaucaaaaccaggaaacaacauggucacaauacaguuaacuagaugcagaccuuacuccaaauucaccagcuuuggcagcacucuuuuucuuaccauguauuuuuauauggcauuaggguacagcuuuuuggguuucagaugagaauuaucaucauuaaucucccacacacaggccaaugauuguggaauacaguuauuccuaucaauguuuauauguuaaguaauauauaacauauauuacuuaaauauauaugucaaguaauaacauguauuacuuaaauauauaugucaaguaauauaacauauauuacuuaaauaauauguuauauauaauaugauaaaauaauauauauuaacauauauauuacauaacauaaacauggauguuuauaaguuaaguaauauauggggcuuacagauuguucuaaguauucccaaauggcuuuucuacaguaaaaauauguacuuucuuuuuucucacucucuucccucaucccuccuucucuucuuucucuuuuuucuuccucucucucuuuuguuuuucccuugcccucccuugcugucuuuaguacuaaggaagagguugggagggagagauguuauucauuuaaaauuaaagaaaagaagaguggcuuugccuucuccaauaggaguaaauuuuaagagccuuguuuccuauucagcuaaauucaauaaucugcagaugucccauugguaaagaucaaaauguuuuguuccugccacauacuggaauucucuaugaucuuucuuauuuuaaaaucacauaaauuuauuguuuuuuauuguggacuaccauuuaucaacaauucuauguucagagcuauguucaaagaggaaggaaagaauaaauucaaucaacagcagaagauuuuggaauggugcaugaugaauccucccuggauaucucaucucuugccaguuacuguuaugggaccuuggcaaauugcuucaucucucugccuuagucuccucaucuauaagaugagauaauaauagaacugccuucauuagauuaggauaaauaauguuuuuaaauaccuagaauugugucuggcacauaguaagugcuauaacauuauuuuguaaauuaaaaaauaccugaggguagaauuuacauuaauauuaguaaaaagucauuggaauggaaaauauguaaauauuuuccaauucauuuguuucuucaauaaauacauaauuggguuaacacaguucaguauuauuauuuaguagaaguauugaaucucaguauuuauauuguauuuaugcaaauaacuaauaagaaucuuuaaagcuuuaaaaagucacgaauugagauugauugucaguuugauaauaguugccaaagauuuucacuuuugcuaaugaaugucucugguagaggaaaagaaguaccuugggacuccaugggugaaggagaguuacauauuuaacaucuguguaguguaugaaggagaagguuguacuugggaaaacuuguuuaauucuggauuucccauucugaagaaaccuuuuuuauuuuuuucccuaauaauugcauaagagauugucuuagaauuuuucacacagagacuguguaaguugauacuuaaaaaaauguguuaguagaauaacaaucuuagcucaguaucagcaaagauauuaaaagauuuguuuucucagccuauccuguuguuuuagugauucagccuuuuacuggcaguacuuccuacuugaucaauuacuuuucuuauuuuaaaggagccuaaagugcuaucauuuuuauuggauacacugucucccaccuacuuagcaaacaacugaaaagcaauuaacuuuuaaaaagagaaaagacauaauuuaauaucaauuucauacugguguuuucugagcaggaagugcucaccugugugggguugauggguggagcucuucuggugaagccuguucugcaagugugaguuuaggcuggggcguuucugugguguugcaaagcaguaugugcugagagaggaggauuaagcuccuggaggcagagcucucccacacacuugcuggcuugcugggcuccacugacuggacugaaaacagggccaagaaaacugcugcugcaggggguccugaaaacagcuggaacccggcagugaugugggaccuaacuugaaguuaaccugugguggugagguuggaaccaguuggauuaugauuuauuuucuacacucuuguacggaaugcagagcuguuguauccugaugaaucuacugcuaaauauagucauuuggaauaauuuuaaguauugaucuuaaaacuuguaccacaacaagagguaaggagaucucaaucagucauuuaaauauuugacucaagcaacauucagaauuuuucacugaaacuauguuuagauuauauuugggcacauguuaccuugguugcucucuuagguaaaugguuaauuauuuaauuaucuagaaauucagcacuugaacauuaguauuugucauguuugucaaaaaguuuauacuuuuugaaguaggcuuugcugauuguacaacacagauguucccagucgguuucaagaaauaucuuuuuuucuccuauuuccaaucagcuuauuucuuguuuucuauacauuaguuuaauauaauaaaaguuuuuaugauuaaaagaaccugccuuuauuucuuaagcagccagcuuauaucaucuuuuuaauuuuuuuccugguggguuaauaauauuucaauuauugauuaauggaaaugggcagugcuaaugcacuuaaaauaauuugguagacuguguaaagaggcuccucaaguuugcacgaagaaguaaccuuucuggccuuuucccuucaaguaugguucuuccccgccucuuugguauuggcauugguaaggauaaccaucuccauccauaaaauauuuuguauuaaaucucagagauuuuaccacuaaggugguguuccguauguauaugguguuucuuuagaccucgguaauaaaugccuuucauuaaaauaacauggagaccagaauuuucucugaaucacaaaucagcccuuaauagggcugauuaguauguucaacuucuuaacagagguugaacauuuuucuuuccaggauuguugcacuagugcuuaaaugacagcaauauuuuaauuuuuaaaaccauaaaugggggaauuucagaauuuagagcucauuuucauagucagcuuuuuaaaaaagcaucuacugcucauauaauaaugguuugaacuaugauuucuuuuuuuaaaaaagaaugcuauauggcauuuaguggaagauagaaaucuaaaaugucuuagguuaaguuuauauuuaagaaaauuagagcaggaaggacuagaaagugaugccauguucucagugcugauuccaggauagauagccagauuccagguucuggaaagcugagucaguuuucugguuagcccuguaccucagggauucucaaaguuuucagaugaaauguaacaagaaauuguaguaguaauaauagcuccuauugauugacacagaauuuaauguuuggcacauacacuucauguaagcaucauaguaaccuuagugagagcuguuguuagggucauuuccauugugagugaaagaauugagacuuaaauagguaauuugcucaagaucuugcaacuggaaagugauuagggacugaauuauaacccuuuggucugauuccaaagccuauuucuuuaacaagaacucauugucaguuccauacucaccaaauauagaaacuuuccccucuacuuccugcaaaacaaaacaaaacccacaaaaucaaaaaccaccucugauaguaucaaaguuccacaccaaacuucauagcuuaauaaagugcagaggacugugacauuaaaguacaugugauuacaauuuaaucugacaaaaauuuaucucaaaagagaguuuuuacaccauuaaaauuaagguucuaaguuuuccaauuucuagaacuaauguauauuuugguaguccuguuaccuuugauguaccugaauuccuaagaauuuguguguguuauauuuaauuuuuguaagaauacacaagcaugucuuccugagauaguacuagcuuuuaagcuucuuaucaaguaguacuaguucauccuggaaaaauaagagcccagacaauuuaaaauuucuuagcagguuuuaaaaucuauauucuguauauaauaucccauuccaauuuuaaaauacuuuaagugucaggaauuuauaucuacuucauguuuuuuccuccugcuucugguaaaaugcaaaucuuccuuuucuguuuuuagaaaugaaauuagucauagucucuuauauaauaaccgaggugguaaagucagcaaguuaaaaauacuucuuacuuugauuuuguaccaagucgagaaacagaaccaaucguauuuauuauuuuaaauuuguaauuuaaauuucgaaauaaaaauuaguaucacuuuuagcaggaaaaagguguaacuuauuuauaucaaccuaaaauaacauaaucuaaauuugaaccuucuuugauauuuauaacugaaaucuguagcuucuagaaaaguaaguguguaauguagauaauaauagucuuaucuuaaccguaugaccauuuucccaagggaacuaugauuuuuaaaggucuagcaugagcagguucuguguuguaacaguuuguguacuccucuaggaagggcagcagcauagugauguugcuuugguuucaucuuuaacccuggagaagagauacaguuuuauucaaauaucccaauauuuuaguuaaccauugguaugccauucaacaugaguugugcuggauauucugaagaagcaguuuguggcccauuuucugcucucuuucucucagugaauuguuguuaccucuucugugucuaaaagauucuuuucuaaaaucuacuacagauuuauuuucuagaucccuuaauguuauucauuugcauuccagucaguaaugccuuuugaaaugucuacucuucucucauaauuagauagaacccuguuugaauuauauaacuguuaguagcuuucccauuuuucagucaagagccauuacuaguggugcuauuuuaaauguggccuugcauguauaugaauuucugagauacuugguuuuauuccuuugagguuggaauagcaaacuguuucauuuaauuccugauccggucccagauagcuuuucugagacagcccuugcagcuguuauauacaucaguuaaagaacuguguuuuuuuccucuuacuuccaaaguuguuugugauauauugaucaaaagugauucuguacuuuccuacucuacaauagcuuuguaguacauuaaaauucaagacucaauuuaucuaaaaaaaauuuuugacauauacuugggauaggaguggggaaugaagcccaaggcugaaaaacuguuauauuccugauuuuaaaaagugguuccuagagagacacugagaauuuugcuuugugagcgucaaccugauagauuauaaguuuucagaaguucagaacauacagaugauauuuaccuuauuuuucuuuuacugcaguaaacucuugaaaccuaugucaaaaaauaauuuuuauaaaguauguggcauuuucuaauacaaagaauauuauaagugaccauuguacuguugaccaaggacuugcaagcaaauaaagaaguaaacaacaguauaccauauggcaugaccagcaacugugaauguccuuagcaauuaaagguaguacaagcaucaaguccaagaaacaguuauaagcauguuauguaaauuaguuauguaaggacuccuuauuacuacuaagcauucauggaacuaaauaauuaaaauuaauuuaaaaaguguuaaaccuaauaugcuuaauaaccuuuaacagugauuuuuuuaucuuaaauuuuuauaccagccuuuuuccaagaugauuuagagaaccuaauuuuuuuugacaaaguucuccaaugacguuuuaaaugaugucuuuuuuucuccugauaaauuucccuaaacuaaagguauguuucuuagauuuuagagcuuuguaugcuauugacacuucauacauucucagaguacuuuaugauuucucagguauuuucauuaaaaucuagaaucguauugucugguuaaacuucucauuuuucauauuacuaaucugaggucuaaacugcuuaauuuccuuuucuaaaaucuuauagugaguuauuggcagaaucgggauuaaaacugucucuccacauucuuggucugguacuuuuucacuagcacauaccuuagccaaugaugucaugauuggauggaugaccuuaauuagacuauaugucuuauuauuggaaaacaauaaaagcuuucaaugacuaggucauugguucaaggauguauuuuuaaaucuucaaauaggauugcuaacauuuuaugcuuacuacauguuuuuaccacacacacaacuguguauuuagauauuauaggauauuaccgaauaaacuaaagaaaaugaauugaaauaugaauaauaaauuaucuugauaauuagaaauagauauauagaagagaggaaaggaauaaaguuuuguaauucugauaacuuauuacauuuaaguuauuacacagaaugugaugggagauaauuagaauuuauuuaacauaccuguucuuuugauaucaacuuuuaaggagguaauucggaugauuagagacuuguuuauauuuugaaugugaauuauuuugaaugugauguuaauacaaacagauuaaauuaguuaauacauguaaagcccuggcacacaguaaaauaguaagcacucaauaaucauuauguauacaauaauuaucguuaugguauuacuguagcaucuagauuuuccuucaauuuuuguugacuaucuggguuaggauuuaccuuuuccuucauacugccuuuguaggacugggagcaggucaguggguggugccagagagagggcagagcuaucacaaaacagaccagaagauucacagagauaggaauagucagugacagaauuucuucagcauguccuuauuccaucaaacaaaacuuggcuggguuuacuuugcaagaaaccccuuuacucugauuugaaugauauuuuuuguaaaacuggaaaaacacaucgccagaguuauucauguguauuuuuagucauuggcuuaaagaacuuuuauaucauuagucauaaugauaugaaagccuuauuuauguuaaagucuuuuuguguuauaaaaaggaaaaguuucaaaaggguauauuuuucuauagaauacuuguaauauuucuguauuauuggaaaaaguauuuguucaguuccuuuaauauuuacauugcauauugaaaucuugcccaacuaccuacaaauuuuuauuuaaaagauuuguagaguuauuacucuagugaaucacagauuaauuugaguccaguuauuuguaaauaaaagcuuuguugguuaagcuuacacuaauuuaacugauauaaucaaggcuauagacugaguaagauucauaucacauauuucccaagaugaaugcgaacuaaaguuuuucagaaacuuucucaguugccuaaagauccuuuugggucauauaacaaugcuugcuaaagauaaguuuaguuuuacaacucuuggcaauauuccuuuuaauaaauuugaaaauacuaaguacacaguucacuucaacuacuuacuuaagacucuaacuguaaaucgaugucauuuuucuuugcugcuauuuaagguauuugcugaugccuauuguuguuuuuccauucuuucuuggugcuuucacccaauacaguucuucuguguuugucuuccuuuacuagaaguucacaucuaauauguuuacaguauucuuacauuuauuacaguugcuaagacggaacuuugcccuggcuuaaggcuguuauuuuuuuaaauugccacuugccuuuucaagucuauugcacucauuuaugucacugcaaaggauacaaggaaaguaggaguauaaaaguauuuaaaaauauaaaagcauaaaagcaagccuucugcacguucugcacuuguaucccagaacuucaaguauaguaauaaauaaauaaauaaaaauaauaauaaaaaacaaagucagaagcaagaaaagaaaguaguuacaaauuuaguguaccucauucaaaacuuaaacaagacaaacuaaaauaucagcuuaauagauggagagaaaucauuugauaaaggucaacacuuguuccuuuuauauaucuuagcaauuggggauagguaauuucuguauauuuaagguuucuacccaacaaacccaagugaauuuuauucuuaauggugaaacauaagaaauaaucuauuuaaagucaggaacaagagaggcauuuauuggagguccagugaaguuagacaaaaagaauuaaaaggauuggaagggaagaaucaaauguguauuauuugcagauuuauaaauccagaugauucuacagucaaauuuuaagaaauaauaacagaguucagcaagguugcugaauaaaagauaaauaauacaaaaauaacaauagcacauuuauuaaguuuuucugucuagcacuaagugcuuuauaauuuuaacucauuuaauucucacaauaaugcuguucaguaguuauuauuuuaaacuuuuuuuuucuuuuucuuuuuuuuuuuuuuugagaccgggucuugcucuugucaccuaggcuggaaugcaauggcacgaucucagcucacugcagccuccgccuccagguucaaaugauucuccugccugcugaguagcugcgauuacaggugcccgccaccacacccggcuaauuuuuguauuuuuaguagagacagguuuucgccauguuggccaggcuggucucgaacuccugaccuugugaucugcccgccuuggccucccaaagugcugggauuacaggcaugagccaccaugccuggccuaaacuuuuucauagaugaggaaaaugaaauacugagaauuuaaauauuucuccauaaucauaccguuaggagcugcagaggcaagauuggaaccccagaggucugacuccugagucuacccuuugcaaccaugcuaauugcauuucuguacaccaauaauaaaugauuagaaaauguaauuuagaaaacaccauuuuauaacaucaagaaagucauaaaguuccuaagacuaucuacaacaaaaguucguaagacuuuuaugaaaggaaauuugaacaauuuauugaaggacauaagcaaauuguaaauaaguggagagaucuauuauguucauggaaaagaaagcucaguaucauaaagaagucuguccuccaaaauaaucuauaauucagugcagcuucaaugagauuccaaaaaguuuuuuuucuccuucuaauuugacaagcugauucuaaaauuuaugugaaaugggaaauggcuaaaaauaaggcaguuuuagaaaauaauagugaaugaagggacucaucuuuccaguuaagacuuacaaauuaagaaagugagguauugauagagagaaaugagacaacucagaaacagacgucuuacaugcuauaugcauuuuucacguaagauagaaucagucuuacaauucagugauaaaaagguuauucgauuaaagauggcagaauaguugauuauacauauggaaaaaaguauauaucucucccuaaaaaacaugaaaaagcaaaaguuuuuagaagaaauagggcaauauguuuaugacuuauaaggaaaaucucuugaaguacagaaugauuucuguaccuaaagacauuuaaaaauuugugcaauaaaagauaaaccauagacuuggagucagucuuuauaauacguaaaggauucauuucuguauuaugugaagaauucuuauucaucaguaagaaaaagacaacaaaauagaaaaaugggcaaggauaugaucaguuauuucacugaagaagaaaacugaauggccauaugaaacauaugaaaacaaugccuauucugauuagcagucacagaaaugcguauuaaagugaaauauaauuucagaaauuugacagagcuaaguagaacaaagauuugaagaaugaggacugaaaaauacaucuaauuagaguguauauugauaaaucauuuuagauaauauuuuagcaaaguugaaauaugguugaaaaguagcauauucuauaacccaacaauuuuccuccuaaacgugagugccagagaaguccugucacuugugcccagggagacacuuaccagauuauacaguguagucaggauuguaagaacaaacacuuguaaacucugacagcaggagaauggaaauauaaguugugguauauacuuaaaagagaauauuguaauguaguuuaagugauauacugaaccacaagugccguggauaaaucucagaauacacaguuuugcagaaaguuugauaucagaugauuccauuucugaauuugaaaaacaugcaaaauguuaguauuguuuauggcuacauacacaugucguuacaguaugucguuacauggauggaaaugauaaaugcuaaauucaggauacagguucucucuguaggagaauaggauugcggaaacaguggcuucagcucuaucuuuuauacuuaagggaaaauaaucugaggaaauaauguggcacaauguuaagauuugaaaaaccugcaugaugaggacauggauauuuaucauauuauucucuuaaauauuucuguauaaucaaaguauugagcaauuuuuaaaaauaaguacauugacauugggcucuaauacuuucuaucaguacguuagcuccugauuuuccagggcagucauaccccaggccugugucuucuggucguguuuuccaguuaguguauccuaaaacuggucucuagagacuuaugugaauacaaagcugauuaagcauuaagccaguaggcuuuuaaauaguagucagguuaaaacuagguauaauacaauaggaguuuuguuucagcacuuuuuuccaauucuuaacauuuguuauauuuucuuuugaagagcagaauuuucagaacauuuuuaguucauuaaauggauuugauaguugucuagagaaaaauucuuucuucauauucauuagcgugaauagauauauugucgugcuuuaaauaaaagcaauuuauggaauuuuaaauuaaaauucaaaucuuuuaauaucuguuuaacauaaaguacuuuaagguaugcaacagagacugagaaugauagaauuugugagauuauaagagaaccuuaaacauuauguaauccaguugccuguauuuguauucuccucacuuaaauuucuacccagugguuaucuaaucuguuugggaacuuugaauaaaagacaggauauuauauacaaucuguaaaaauccacuggacauguuaaacauuacagucauaccuuauuauaccuuugguuuaaucagaacaaucugcacagguauuaauauauucccacuacuacauucuaauuuugucuccuugacguugugaauuuuuuaccuuuccuaaaauuugauguauauaaucaaauaaacuuacugcugaggccauuaucuugggacagaccauuuuccuauacacccucagaaauuaauccaagcccagauuuaucuuaagucagucuagaacauuucugggaaccaauuccuagaacuuuagagaaaguauuaugagcaagcaagaauucguugggauugcuggggaaguauuacgcugguguaauuaaacagcacugcccugccucuccaugccaagguucacuauggcuuaacgaacugcauguuuuuuaguaucucucuauaaacugguuauugguaucauaaagauuuaccuuggagauacuaggucgugugucauacugcaaaggcuuuuaacuacuggaaagacuggccugguaggguuugucuuugguuuaaaaaaagauugcaaauauaaagugugucaugucuaaauaacauuguggcacauguuguauuuuagcucugaaguaggaaauuugaauacaaaguaguaugguuugcuuuugucuaaguauuguuugcauuuuauuuuuuauauauuuuaucuguggaaauaccauugguaucauuuuagugucucuaauccaggauguuugguggaccuuaauccucacagccuugcuugccaguguucuguagaaauggguuuguaagcacuuaaucaucuaaccccacauccugccuucgucaguagaaaucuucugauagaauuaacaguauuagauacuuuccuccucaaaagguaguaacuaguaauauugaacaggaaagcaacagguggggaucagugcuugugucccaaauaagcucuuuuugguuacuuuaaugucuaagaaaugggaagaaaguuuaaaaugaagaaaacuaauuuaagagauuuauauuuggaaguguuacuagauccucaaauuugaguauaauuaaauugaauaguuuuauuuaaaucuccaaggcagggaaauuaaucuaucuugauaaauaauugauuauuuaauuauguaugccagaacuucuuacugucuaccacaaugaagaggaguccaauuaaaauaacaucaccagcagcgcugaaacuaugcagaacauaguuuaaucuuccuuugaaggcuuuuggaaucacguaagacuuuaugacuagucaccauuaugaauauccauuauuucagugucucagauugggauguagaugggcaagaagagaccauauccaccccucccacucacacacccaguuuagaugugaaguucuaaucuacguagcaauguuuuguggaaaggugacaaugcaaaguggccauucagaguagaagccagagcugcacguaugucagcacaguuucccagagcccuggagugccaaaugggggcacagaguugccagugacacccuccauuaucuuaauuuuaugcucuguugcaacucuuacuuaauugcgccuugugucacuauuuaggaaaaauaaacaugaauacucuuuacccuaacaggaaaagauagccacguuuccuuguuccugaucuaaacuugccaaaccaagaagcagagucaguuaccuaauguccugggaaguccaguugugcacagacugcuuuugacuagugagguguuauuguguaguagaguuuguuuggaggaucauaacuauaaauauguuuccguugacuuaccacugaauugugaagauguauguuuauuggucaguauauaauuccaguuauaaaauugcuaaucgaugugaaggaaaugaauguguucuuuucucuacuguugagaagccuaguucaauauggcagacuacugcugcaguuuaaaaaauguucucccuucauuuguguugaaaauggucacuuuuucccuuucuuucuuuuggauacuauuacuacugacucaggauuuuuauuuauuugaucuuuuaugaucaguuauaaccauucuuuaugauguguggaucgucccagauguguccacaagagucugacucagggaucccucagcugugggcauccccuugcuuucugugacaagcuuuccauucucaucuucugcuuugccugcuucugacuugcauucuggguuuguuuugauaaggaauuuuauuuagcacccaagaucugagaccagaggucuucauugcaaccaauauaucauuauuucuaagccuuuuaaaguggauagagcuucaggaaagugugugaguguuuuaaucaugaguucauguugauguuuccaagucaaaguugacauuacagguuuuucuucuuaaccuuuuagaucuuauaauuguaucucauuuucucucacauggaaaaucuuuguuuugucccacaauauguauaaaguuguuaccaauauuauuaccaauaguaaaggaguuggaugaaguuaaauauuacuuugcaggaguuuuuugguccuuagaauauaucccacuaagcacgugguccuuuuuuaaauauuuuaaauuuaguuuugaacauguagaaagaacauuaacaugauucagaagucaagcuauauaaaaaagauacacucagggaaguuucacauccuauucuuacccuuuacccuuuccccaccuguuguuuuuaacccauuuuuauuagcuucuaguuuauccuucuaguauuucuuuuugcaaaaauaagcucacauguacaugcauauuugugugggugaauuugugugugauguguguauuccucauccuuucuuaugcuaaauaugcuguucucugcuuugcuuuuuugacuuaauguauccugaagauuacucccuaucaguagguagagauccuccuuaaaaauaaaaaaaaagccaaccaauaauccucugugcagauguaccauaauuuauucaaccaauucccuauuaaugcucuuuuggguuucugauaaacauauuugguuauuuuuaaaggaacccaguguuuuaaaauguuuugaaauguuuaaaauuguuuauuuguaaacucucuauucuggccuaugcucccagccuuuacauaccccuugagccucauuucauaccacugucccguggcucccuaccccucucauggcuuccagcucagauaugacuuccucagagaaacuguuccuuaacucucuguuuaaugcaguuucuuucaagucacuaauacgucacccuguuuauuuuuuuauuagccacuauaaauaaucugauauuacuuuguugccuucauuuaggcaguaucauuuaguggauaagaguuuggacucugugcuaaaugcccugauucggaauccugguuaugugacagugggcacauuaacuuagcauucucugccucaguuuauuccucuaaaaauggguauaaauauuuuccuaauagugggcugugagaaaugaaugauuaauaaauauaaacacuuagguaguuacuugcacauacuaaguguaaaguaaaugcuggcuauauccguauuacuauuuaaucauucauugucugccaucaguaagcucugugacagcaaggaccuugucucuccuguuccccaucguaaucucaugacuuagagcaguuccuagguuauggcagacacuuacucauuuguugcuaaaugauuaauaguuaauauucacuuuccauuccuuugaaacauucuuagaaauauguuacuuaaagaaugcuuucuuauauacaucauaugcaguuaccaaauuugacaauuauuuucaucagauucagcaucaaaauauaaaugccuacuguuaacauguauuuuggaaguuuuggacaaaaucugaaacagaaaucagaagcuuuuacuaucagacaaaagcuagaauggccauauuuacuuugacacaguuacauauccaugaaauucaaaagaaucaacuaauauccuucuaaaauuauugagaguuuaguaaaugaucagaugugagcuaugcauuaagaaauuguuuucccagaauagagaacucagaaauaagauugcacaccuacaaccaucugaucuucaacaaaccugacaaaaacaagcaacagggaagguauuccguauuuaauaaauggauugggagaacuggcuagccauacgcagaaaauugaaacuagaccccuuccuuacaccuuauacaaaaaucaauucaagauggauuaaaaacuuaaauguaaaacccgaaacuauauaaacccuagaagaaaaccugggcaauaccauucaggacauagguaugggcaaagauuucaugacgaaaacaccaaaaacaauugcaacaaaagcaaaaauugaccaaugggaucuaauuaaacuaaagagauucagcacagcaaaagaaacuaucaucacacugaagagacagccuacauaauggaagaaaauguuugcagucuauccauaugacaaaggucuaauauccagagucuacagggaacuuaaguuuacaagaaaaaaacaaccccauuaaaaagugggcaaaggauaugaacagacacuucucaaaagaagacacucauccugccaacaaacaacacuggucguuagagaaauagaaaucaaaaccacaaugagauaccaucucacgccagucagaauggcgauuauuaaaaagucaagaaacaacagaugcugacaagguugcagagaaaaaggagcacuuuuacaauguuggugggaauguaaauuaguucaaccauugcagaagacaguguggcaguuccucaaagaucuggaagcagaaauacuauuugacccagcaaucccaaacaaauguaaaucauucuguuuuaaagauacacgcacccguacguucacugcagcacuguucacaacagcaaagacacagaaucaacccaaaugcucaucagugauagacuagauuaaaaaaaagggauacauauacaucauggaauacuaugcagccauaaaaggaacaagauuauguccuuugcagggacauguuuggggcuagaagccauuauccucagcaaacaaaggcaggaacagaaaacuaaacacugcauguucucacuuauaagugggagcugaacaaugagaacacauggaugcauggggggaacaacacacaguggagcuugucgagauaguuacggggagggagagcaucaggaagaauaguuaauggauacugggcuuaauaccuaggugauuggaugaucugugcagcaaaccaucauggcacauguuuauauaauagacuugcacauccugcacauauacuccagaacauaaaauaaaaguugaagaaaaaaaauuguuuuccagcauacuaguaauuaccaguuaagggcauaauugaagcaagguguuauucuacuaaagcagaaaaaaaaauuaaguuaccuagcaauauuccuaauaagaaauauguggaauguguccuuuaugaggaaaauuagaaaaaucuuuugagagauaauaacagauuuagaaaaauuaugacauacucuuuccauguagaaauauugaauauuauagaaauuaaaauucuuccaaauuauuguauaauguuaaauuguugcaaaccaaacuuauuaguuuucugcggaucuugucaaaauuauuuuaaaguucauauggaagaugucuaaaaaugaacauaaaugguuugauggccacucuauaacaaagauucauaauacacaaucugcuagcaacuagaggagaauaauuacaccagccuguaacuuuuaauauagugauauuauaugugacaaacuucugaaguuaaccaacuauacuauaaaugucucauuaguagaaaagugagcauguaauuuaauuuuacugugaggaaucucagauacaacagagguuguaauuuacccagaguuucagagcauacaugucagagauagcaucaacauuauauugagauugcaaguaaguuuuaacaggugguauagaaaauaauaauuuuuuuucauuuaaucuguguuacggucuagaauaacugcuuuguuuuacuuuguccaagacuuuuacugguuuuagccuggaaaguuccaugucucaggaaacuugucagucauggacuaaccaggaugguuggucaccuuguguagucuauaaaaaagacacuaaugucuguaaauaauguuuuccauaaaaugaaaagaaauggauggcagaugucuaaucuuguguagaauagcccaucuaguguucuaucuaggccauaaguuacucuaggcacacaagguucccucaggagucuucaucuguucaggaauguuaagguuuggauucacucacuacuguauaauaggggaggggcaaaggaagauggccaaauaaaaggcuccacugauuguuuccccuugaggagcaccaaauuucacaacuauacgcauaaaaaaauacccucaaagaaaccaaaaaucaggugagcacucauaguaccugauuuuaccuuccuauugcugaaagaagcacuagagaggguaagaaaaacagucuuaaaucaccuuugccacccccucccccauccccugguaguggcccuguggcacagagagagaaucugugcucucucuugagggagaacuuaggaauuuugggacuuugccuugaauccagugcugcccugucacaguggaaagcaaaaccagcuugaacuuaggugaugccuacccauggaggggccauuuagacagcccuagacagaggggaaaucugucccagccgucagaacuuagcugcaacaagccucaccacugcaagcuaaagugcucuggggccuugaauaaauuugaaaagcagucuaggccgcaaggacugcaacuccuaggcaagucuuaaugcugaacugggcccagagccaauggacuugaggggcacaugaccuacugagacaccagccaggguggcuaagggagugcuugugccaccucuccccuuacccuaggcaggacgguuugugacuccaaaacagaucccuucuuucugcuugggaagagaagaaggaaaauuaaagaggacuuugucuugcaucuuggauaccagcucagccaugguaggaaagggcacuggugagaguugugaggcccccauucuagccuagcuccuggaccacauuucuagauacaccuggggccagaagggaacccacugccuucaagggaaggacucagucuuagcaggccucaucaccugcagacuaacaagcccucggacccugaauaaccagcagugauaccuggguaguaugccaugggccaugggugagacucugagauaugcuggcuucaagugaaagccagcuuauuccuagcugugguggcuauggugaaagacuccuucugcuugggaaaaguaaaggggacuuugucuugcaccuuagguaccagcuuggccacagugggauagggcaccaugcagacucuuggggacucugauucuaggccuuggcucuuggucagcauuucuagacccgcccugggccagaggggagcccacugccgugaaggauaaguuccaggccuggcagcauucgccacaagcugacaagagccuuugggccuuaagugaacaucaaugguaaccuggcaguacucccuguggcccugugguggugguggccaugggauggggcuccucugccuauggaaaggggagagaagaguaggaaagacugugucucaugguuugagugccagcucagcugcaauauaguagaacaacagguagauuucugaagcuuuugacugcagucccuggcuccuggacaacaucucuggacccaccuagggccugggggaacucacugccuugaaaggaacaacacagcuuggcuggcuuuaccaccugcugauuauacaguccuagguccuugaacaaacacaggcaguagccagguagcaguuacagugggcuuugggcaagacccagugcugugcuggcuuuggguuugacccagugccgucccaguggugguggccacaggggugcuuguuucaccccagcuccagguagcuuaucacagagacagagagagacuuuguuuauuugggagaaaguaagagaagaaaacaaaagucucugaccgguaauccagagaaugcuucuggaucuuaucgaagaccaccaaggcaguaccucuacaaaucugcaggaacuacagcauuauugaauugggguguccacuaaugcagauacagcuugcauugugaugcagaucacaacacccaacuucuuuugaauaccuggaaaacuuuccuaagaaggacagguacaaacaagcccagacugaagacuacaauaaauaccugacucuucaaugcucagacacugacaaacauccacaagcaucaagaccauccaggaaaacgugaccccaccaaaugaaguaaauaaggcaccagggaccaacccuagaggugugugaccuuucagacagagacuucgaaauagccauuuugaggaaacucaaagaaauucaagguaacacagaaaaggaagucagaauucuaucagauauguuuaagagauugaaauaauuaagaagacucuagcaaaaguucuggaguucagaaaugcaaucgaaauacugaagaauauaucagaauauauuaauagcagaauugaucaagcagaagaaagauuaguaagcuugaagacaggcugaaaauacacaaaggagacaaaaggaaaacgaauuaagcaugccuauaagaucuagaaaauagucucaauugggcauaucuaaguuacuggccuuaaagaggagacagagaaagagauagggguagaaaguuuauucaaagagauaguaacagagaauucccaaaaugaaagauaucgcuauccaaacacaagaaguuuacaaaacacuaaacagauuuaacccagaaaagacuaccucaagacauuuuaauaauaauacugccaaaggucaaggauaaagaaaggauacuaauagcagcaagaaaaaagaacauacaauggagcuccaguauaucuggcagcagacuuuucaguggaaaccuuacagauugagagagaaugaguggcaugacauauuuaaagugcuaaaggaaaaaaacuuugcccuagaguaguauaucuggugaaaauauccuucaaacaugaagaaguaguaaagacuuucccagacaaaugaaagcugaggaauuucagcuuguagaccuguccuauaagaaaugcuaaagggaauacuucagucagaaagaaaacgacauuaaugaacaauaagaaauuauaugaagauacaaaacucacugguaauaguaaguacacagacauggaauauuauaacacuaacugugguguguaaacugcucuuaaguagaagacuaaaugauaaaccaauaaaaaauaauaacuagaacuuuucaagauguagacaguauaagauauaaauagaaacaacaaaaaguuaaaaacagaggaugaaguuaaagcauacagucuguuaguuuucuuuuugcuuguuuaucuaugcaaacaguguuguuaccagcuuaaaaaugaguauaagguaguauuugcaagccucaugauaaacucaaauccaaaaauauacaaugcauacacaaaaaguagaaaguaagaaauuguaucauaccaccagagaaaaucaccuuuacuaaaaggaagacaggaaggaaggaaagaaggaaaagaagaccacaaaacuaccaguaaacagauaacaaaaugguuggaggaagucugaacuuaccgauaauaacaucaaauguaaauggacuaaacucuucaauaaaagacauagaguggcugaauggaugaaaaaacaagacccaguggccugucgccuauaggaaacacacuucaucuauaaagauacacagagacugaaaagaaagggauggaaaaagauauuccaugucaauggaaaccaaaaaagagcaggaguagcuauacuuacauaagacaaaauagauuucaagacaaaaacuauaagaagagacaaagaaugucacuauaugguaauaaaggggucaauuuagccaaaagauauaacaacuguaaauauauaugcacccaacacuagagcacccagaaauaucaagcaaauauuguuagagcuaaagagagagauagaucccaauacaauaauagcuggagacuucagcaucccacuuucagcauuguacagaucuuccagacagaaaaucaacauaggaccuaaucugcacuauagacuaaauagaccuaauaaauauuuacaggacacuucauccaacagcugcagaauacauauucuucuccucagcauguggauuauucucaaggauagaccacauguuaggucacacaaaucugaaaguauucaaaaaaaaaaaaaaaaaaaaggaaagcauugaagugauaucaggcaucucuggccacaacagacuaaaauuagaaaucaguaacaaggaauuuuggaaacuauacaaacacauggaaauuaaauaauauacuccugaaagacggugagucaaugaagagauuaagaaggaaauugaaaaaauuucuggaaacaaaugauuacagaaacaacauaccaaaaccuaugggauacaauaaaagcuguacuaagagggaaauuuauagcuauaaguaccuacaugagaaacaagaaaaacacccuagcaauguauuuuaaagaauuagaaaagcaagaauaaaccaaacccaaauuaguagaagaaaaagcaauaaugaaagaucagggcagauacaaguuaaacugaaaauaaaacaacaaagaucaacaaaagaaaaaguugauuuuuugaaaaguuaaacaaaauugacaaaccuuuagccagacuaaggaaaaaaaaagaagacccaaauaaagaaaaucagauaugaaaaaggagacauugcaacugacacugcagaaauucaagggaucauuaguggcuauuaugagcaacuauaugccaguaaauuggaaaaucuagaauaaguggauaaacuccuagacauguucagccuaccaagaucaaaccaugaagaaauccaaaaccugaacagaccaauaacaaauaaugagaucaaaauuauaauaaaaagucucccagcaaagaaaagcccaggacucaauggcuuaacugcugaauuuuaccaaacauuuaaucaaagaagaacaaguaccaauuguacucuaacuauucagaaaauagaggagagaguacuuccaaacgaauucuacaaagccaauauuacacugauaccaaaacaaaugacacaucaaaaaaagaaaacuacaggccaauaucacugaugaauauugaugcaaaaaauucucaaaauacuagcaaacugaauucaauaacacauuaacaaggucauucaucauggccaagugggauuuaucccagggaugcaaggauaguucaacauacauaaaucaauacaugcgauacaucauaucaacagaaugaaggacaauaccauaugaacauuucaauuaaugcugaaaaagcauuuaauaaaaauucaacaucccuuggccgggcacgguggcucacgccuguaaucccagcacuuugggaggccgaggcgggcagaucacgaggucaggagaucgagaccaaggugaaaccccgucucuacuaaaaauacaaaaaguuagccgggcguaguggcgggugccuguagucccagcuacucgggaggcugaggcaggagaauggcgugaacccgggaggcggagcuugcagugagccgagaucgcgccacugcacuccagccugggugacagagcgagacuccgucucaaaaaaaaaaaaaaaaaaaaaucaacaucccuucaugauaaaaccccucaaaaaauauauauagaaggaacaugugucagcauaauaaaagccauauacuacagacccauagcuagcaucuuacugaauggagaaaauuuggaagucuuuuaacaucaggaacaugacaaggaugcccacuuuuaccacucuucuuuaacauaguauuggaaguucuggcuagagcaaucagaaaagagaaagaaauaaagggcacucaaauugaagaagcagcagccaaauuauccuuguuugcagauaauaugaucuuauauuuggagauccuaaauacuccaccaaaaaacuauuugaacugauaaaacaaauucaguaaaguggcaaauacaaaauuaacaugaaaaaaucaguagcauuucuguaucccaacagugaacaaucugaaaaagaaaucaagaaagcaaucccauuuauaguagcuacaaauaaaauaaaauaccuaggaauuaaccaaagaaaugcaagaucuuuaugaugaaaacuauaaaacacugaugcaagaaauggaagagaacacaaauaaauggaaagguauuccacguucauggauucggagaguccauauuguuaaaaauguccauauuacccagaccaaacuacagauuuagugcaauuccuaucaaaauaccaaugacauacuucacaggaauagaaaaaaauauacuaaaauuuauauggaacuaaauaauagccauagcaauccuaagcuaaaagaacaaaacuggaggaaucacauuaccugacuucagauuauauuacagaguuacaauaaccaaaacagcaugacauaaaaacagacacauggaccaacggaacagaauagagaacccagaaacaaauccacacaccuacagugaacucauuuuuaucaaaggugccaagagcauacauuggggaaauaacagucucuucaauaaauagugcugggaaaacuggauauccaugugcagaagaaugaaacuagaccccucuuucucaccuuauauaaaaauuaaguccaaauggauugaagacuuaaaucuaagaccucaaacuauaaaacuacuaaaaaaaaaugggaaaaaucuccaggacaauuagagggggcaaagauuuguugaguaacaccagacgagcaugggcaaccaaggcaaaaauggacagugggaucacaucaaguuuaaaagcuucugcacagcaaaagaaacaaucaguaaagugaaaagacaacccacagaaugggagaaaauauuugcaaacuacccaucugacaaaggaugaauaacuggaauauauaaguagcucauacaacucaaaggaaaauaauaauuugauuaacaaaugggcaaaagauccaaauagccauuucuuaaaagaaggcauacaaauggcaaguagguguauaaaagauacugaacaucauugaucaucagagaaaugcaaauuaaaacuacaaugagauguuaccucacucuaguuaaaauggcuuuuauccaaaagacaggcaguaacaaauguggagaaaagggaacccuuuuacacuguuggugggaauguaaauuaguacagccacuauagagaauaguuugaggguccucaaaaaacuaaaaauagaacuacuauacaauacagcaguccuacugcuggguauauacccaaaagaaaggaaauucguauauagaagagauaucugcacucccauguuuguuguaucccugcucacaauagccaagauuuguaagcagccuaaguguucaucagcagaugaauggauaaagaaaaugugguacauauacacaaugggguaguauucagccauaaaaaaauaaugagauucagucauuugcaacaacauggauggaacuggacaccauuauauuaagugaaauaagccaagcacagaaagauaaacuuuguacauucucacuuauuugugggaucugaaaauccaaacaguugaaaucauggagacagagaguagaaggaugguuaccagaggccagaaaggguaauaagccaaugguggggggguggggaauagggaugguuaauggguacaaaaaauagaaagaaugaguaagaccuagcauuugauagcacaacaggcugacuacagucaaaaauaauuuaaacguacauuaaaaaauaacuaaaauacuauaauuggacuuuuugcaacacaaaggauaaaugcuugaugggauggauaccccauuuacccuggugugauuauuacacauugcaugcuuguaucaaaauacguacccauaaauauauauaccuacuguguacccaugaaaauuuuuuuaaauguauaguaggcuucaguaagacucucaguaaucaucugcaaacuuaguagggggauuuaggccaucuggcuuagucuucuaucuaacagcuaaucuuugagcucaugauauuguuguauguugacuuuuagcauaauuaucccuauaagcugcacuucucagcaaaagucauuuuuaagggauuuacuuucaguuuuuuuaguugucuuucuaauguaucagucgguggaauuauuuuuucaaauauuaauuuacucaccuuuuuccuugaucuauaaaggauuuaagaugauguacuuaguauauuauagacgaauguuaauggacuaucugaugcuuguguggguguguguuuuguauuuauauagccauuagguugacaaguguguucugugucauuaugggauuguccucuuugcaaaaugagaaagaguuuucuuuuuucaguuauauucaacagauuacaagugcuacgaaaauuucuaaccaucaaguaaaauaauuuaaaaauugacaagaaaugcaaaccgcuuuuacaccauuuuaagucuuacuuauuauaaagaucuccaaaguaauauauuacaguaaaacucagguuccucuuauaauccuguaacauccuuaaguaugcauugggaagaugacugguuuaccaagcuugauucaaacgucauggguuacaacauuuaaauuugcugacagucucauaagguaagguggugagaagauaucgggggaaccagcccccaguauuuuaauguagguucuuuucuauuuucccaaagugucggcuggucuaagaaauaaagguaaagaguacaaaagagacaaauuuuaaagcugggugucugggggagacaucacaugucggcagguuccgugaugcucccugagcugcaaaaccagcaaguuuuuauuagcaauuuucaaaggggaggguguuuacgaauagggugugggucacagagaucacaugcuucacaaggcaauaaaacaucacaaggcaaaugggggcagagcgagaucacaggaccagggcgaaauuagaauugcugauaaaauuucaugucccgcugugcaugcauugucauugauaaacauuuuaacaggaaacaggguucaagagcagggaaccggucugacuaaaauuuacuaggcaggaauuuccuaauccuaguaagccugggggcaccgcaggagaccagggcguauuucaucccuuaucuacaacugcauaagacagacacucccagagcggccauguuagagaccucccccugggaaugcauucucuuucccagggcuguuccuugcugagaaaaagaauucagcgauauuucuccuauucgcuuuugcaagaagagaaauaugacucuguucugcccggccccacaggcagucaggccuuaugguuaucucccuuguucccugaaaauugcaguuauccuguucuuuuuggaugcccagauuucauauuguucauacacacauguuuuacaaacaauuugugcaguuaacacaaucaucacaggguccugaggugacauacauccucaguuuacaaagaugaugggauuaagagauuaaagacaggcauaggaaaccacaagaguauugauuggggaagugauaaauguccacgaaaucuucacaauuuacguucagagauugcaguaaagacaggcauaagaaauuauaaaaguauuaauuuggggaacuaauaaaugcccaugaaaucuucacaauuuauguucuucugccauggcuucagccagucccuccauucaaggucccugacuuccugcaacaaaaagaaaguacaaaauuaugauguuauuuauaacacaacucuuagcuuaaacuuguacugacauuuuccuaaagauuauaaaguauauucauaauagauuauuuugcugucagccucuugagauauguuuguuuuuaugcuaaguaaaauguaaccucuugccacaacuaagaucuuuucucuuuauugauuuuuagugucuaaaaagcacggcaagcucauuacguucuuacgaacauucaugaagucucguccaacaaaacagaagcugaagcagcggggaaucuugaaagagaggguguuugguugugaccugggggaacaccuucuaaauucugguuuugaagguaaaaauaaaaugugcaagcuuauacucugaguuucugaccucuccauauugguuugcuauaaccaauuauggaguagauuuagucaaaugauaccuguuucauuucaguucaaugcauguacuaagcuuucucagguacucaguucuggauggagcugagaaugaaaagucuaagaaugcacuuuggcauuagagauguucguguucuauucgggaagaguaggacauucacacaaaauauauuacaaccacccuguuauuuugccugaguuucuauuucucccuagauagcuucuucagccaguuuugccacccacauuuuauccuaaaauauuuaucuaauucuucuuauggaaaaaaaacugucagaguuuugagacauaaaaugccaaaaucaaucuuccaauuuuuuuuguuuuuaaagagacagggccuugauuuguugcccacgcuggagugcaguggcgugaucauagccgacugcagccuugaauuccugggcucaggcaguccucccagaguacugggacuacaggcaugugccaccacaccuggcuaauuuuuauuuuucauuuuacuuuuguagagaaucuguauuuuauuuuuuauaggaaucuauauuccuuucuuuauaaauuaaauuaugaaucaagaauuuaguuguuggauggggggauggauaggagggaaagaaaaaaaggaguuuuccuuuuauauuuaaaaauagcacuuuccucuagcaucucuuucagaaaugccagaagaugaaggcaggaucuaccugugauguugcuaaguaccagaaauaggugauuaugaaauuccaaauuaguaugggaaauacccauugugccuuuugagaagaccauuagugaaaaacaaugguaaaguaauaauaauaauacugaguugauaguaucaaguucaaauuaaggucuugcucauuguuuaaagaauaucaguggacuuaggaauuuaaugcaaacuguaccauguuucuugagagaguagacaaaauguuauuucaaacagauguuauucccaaauuaauaccaacuuaaugcagaucccuaaaaaaacaaaaacaaaaaaaaccccugaggauuacuuuugcaacuaaaugcacauggaaaacucaaccagugagaaugucaaagaaaaaaaucaguaauaggaugggagacaucuaguuuuacuauauauuaaaacaauauucaaaacuagaaaagcagaguuuucacugggugcaguagcucacgucugcaaucccagcacuuugggagucugaggcaggcagauagcuugcgccuaggaguucgagaucagccuacacaacauggcaagaccuggucucuacgaaaaauacagaaauuagccagcauaguaguacgcaccuguaaucccaguuacuugagaggccaaggugggagaaucaucugagcuugggaggugggggucgguaagcugauuucacgccacugcacuccagccugggcgacggagcaagaccuugucuccaaaaaaaaaaaauuuucuuuuuaaaggcagaguuuugugcugagaaugaaaugugagugaaacagcuuacaguguucagaaauaguucuuacuguacauaagaauccauugugagaaaaaaguaugguuuuagaaccaugucacauggaagagcuauuuauaauacauacugagauaauuaaauagcaguuuugaaaaaaauucacacuucaucauacugaauauaaacuucaaauguauaaguuaaccauuuuaaacuuacaaaauugccaaugugaauugauuuuguuuugagauaaaauaaauaauagcuuucucagauuuaaacaaaaaacaugaagagaugacuuaaauauauauauacuuuucauauaaugaaaaauaacaguguagagggagagguaccauagacaaggaaauauaaucauuuuuuggauaugaugaaaugcugcuauuacaguguaugagaauaucauuucagacuuuuuagaaaauuaaaguaauuuuaauuacugaguaaaagaauggagaauagauacaaacauuaaacugucacagggcuauaaauaauaaacaaaauacagaaaaauguuuauccuuauuuguaaucauggaaauguaucuuuaggcgauuuugaaauaccauuuuacuuugguaaauauuaaaauaacaaagcuauuuuucuaaauuaugauauccagugccauaaauauaguagugauuuuuaccaauagguucagaaucguugguuucagaagguucugaguuagcacuaccuuuuuggaaaacauuugacauuucauagcaagacacuuuauaguguuccuuucaucuaaugaauccauccuuagggacuuaucuuaauguuauaauuaaauagaaauaaaaguguucaucauagcauaauguaugagaacaaagaaaacgaaauacccaacuuugggagaauguucuuuuuugagaugggguuucacucugucauccaggcuggagugcaguggcccaaucgcagcucacugcaaccucugccuccugggcucaagcuguccuccugccucagcuuccugaauagcugggacuauaggcaugcaccaccacacccagcuaauuuuuguauuuuuuguagaggugggauuuugccauguuggccaggcugaucucgaacuccuggacucaagcaauccacccaccuuggccucccaaagugcugggauuacaggcgugagccaccacacccauacaggggaauguucuauaaauguugaagcuguuaaaaauuuuaaguuugagcugugugagauggcuuaugcuuguaauccuaguauuuugggaggccaagguaggaggaucgcuggaggccaggaguuuacaccagccugggcagcauauagcaaaaccccauuuauacagaaaaaaauacaaaacgagcugggcaugguggcacacacccauacuucuagcuaguuuggaggcugaggucgggggauugcuggaccccaggaguuggagacuacaguaagcuaucaucuugccacugcauuccagccugggcaacaaggcaaaacccugucucuaaauaaauaaauaaaauaaguuugaauacaguguaggaaccugaaaaauauuaucuauaaaugguagauacaacuuuugaaagucuggauacuuaggugauaugagaaaugaauauaauuaaaguauuagagaauauuguugagauuuuuuuuucuuaguugucuugcuuuuucaauuaaaaaaauuagaggaauauuagaaaugaauuuaauaauccuggaagauuaaucccucuuugccaaguuaaacucaaaugacuagaaaaaaaauuaacuugugaccuuaaaguguaauugaaauucaguaaacuuuaggagcuagaaaccucaaagaccaaggccagauauauuauacuuggcauauuaaaauaauuuccuguuucaucaggguugguaagaaaugaauaaauauucauaagaaggauauucauuugaacauucaaaugaagccuaaauuagcaggagaagggaaaccuuugaaguuuauuaacuaaaaauuaggaaauaaaaugguuuuuuaauagcugagugauuuaguaguuugucuuugauuuaaugaauaugugaggaauuucaguuuuuucagauuuuaagacuucauagggggcugggugugguggcucaugccuguaaucuuagcucuuugggaagccuagaagggaagagcaccugagccuagggguuugagaccagccugggcaacauggcacguuuaacaccauguaacauguuaaaccuugcuuagaugugaucauuaauaugaaagagaggcccagcaggguggcucaugccuguaaucccagcacuuugggaggccgagacagguggaucaccugaggucaggaguucaagaccagccugcccaauauggugaaacccugucucuacuaaaaauacaaaaaguggccgggugugguggugcaugccuguaauccuagcuacucaggaggcugaggcaggagaauugcuugaaccugggagcuggagguugcagugagccaagaucaugcuauugcacuccagucugggcaacaagagcgagacuccaucucaaaaaaaaaagaaaaaaaaaugaaagagaguuuuccaauuuguccugccaugcucauuagcuuucaaauaucaauucaauuuuaguuguacuuagaaguuucaguuauguuuccauucuucauaaggaugauaggggaggacagaggcuauuauaucacuucuuucugaaaaauagcagguuaaacuacaguguucaucuguucccuaauuaugauaaaaucuauuugaguggaacagaguuuuuugguaucauugauuuuuugucauugauuuuuuuguagggacagugucucuacaaaaaauuuuaaaaaauuagcugggcaugguggcacgugcaugugguuccagcuccuugagagguugaggugggaggaucucaugagcccaggagguccaggauacagugagccaugaucacaccauagcacuccagccuaggcaacagaaugagacccuaucuccaaaaaaaaaaaagacuucauauguauuguccaugaccuauaaccacaguuauaucauauguguguauauauuuacacauacaaauauauauagagacuauuuuaaagucuaaauuaaaacaaugagaauugauuauauauuuuaaacucuaaaauaauuagaauaaaaugaagaaaaaaugauuauauauuauauacauaauugugaggagagaugagacacauacaguauauauaauauugauauauaucauauauaauuguucuuucucaaaguuuagacuuuaauauagugucuuuacccuaaauaaaauuaaccuugcacuagauuuuucugagaaggaagcucguaucaaaauuacguuuuaugugcuugcuucgacagcacauauacuaaaauuugaacaauacagagauaagugugaccccugcacaaaaaugacacacaaauucgugaagcauuccauauaaaauaaaaauuuuuuuuaaauuuuguuuugcuaaaugguuaauucucugaauauuuccuagugaaaaaucagcuuuauagggagauuaucuuauuauacuuucuaaacuucugaguaccucucuguuggagcaagugacaaacuugaccugugucuucuguacaaaguguuguaagaaaucacauaggagccugacaaggcaguugucuuuuuauucuuuuauguguggucccugcuguucaaucaggauuaucauagaguuuuagcuaucacaaaccgguguuuauaauugaguguauuaaacauuauaucacaguuauuuguagaacugauuguuuaaaaaucugcccacaaaagaaguaaauaaaaaucugcccacauaguacuuuuuuugagcauagauuauacugauuugucauuuacuuuggcauccuuuuguuuuguuuuguuuugauacggaguuuugcucuuguugcccaggcuggaguguaauggcacaaucucggcucacugcaaccuccaccucccagguucaagcaauucuccugccucagccuccugaguagcugggauuacaggcgcccaccaccaugccuggcuaauuuuuuuuuuuccuguauuuuuugguagagacaggguuucaccauauuggccaggcuggucuugaacuccugaccucaggugaucuaccugucucagccucccaaagugcugggauugcaggcaugagccacugcccgcagccuacuuuggcauccuuaucuauagcuuuaaaauguuguguuguuguuggugguggugguggugguggugaugugacguuaauuucuuuuucugguaucauugauuuuuuucauaagaguuaguauuuuuuuuugguguacauauuuaaaacugaauuucauuaaaaguuugaauugagaucacuaaaacaaaauagugagaguuuuauagaaaacuagguaaaauuauguuugguacaaaauauuacaaauauuuugaaacccucggagaggacucucuguugccugaacauauuucuguguuguaugauaugcacaaaacuuuaaaugagagcacaguaggaaaaagcaaggcccagauaacaccagaaauuaauccuuuugguagucauauuagguagaaucaugaugcacauucuaauaagucacacuguacucaugucccuuuagccuggaaaccaucucccugaaacuggaacucagcuuuuucgucuguaucuguaaugcuuucaugaugccuggaaaauagaagagacuuaauaaauacaugauugaugagugagugagcgagugaaugaaugaagagaaaagagcagaaacgaaaccaaaacugucaagaaaaaaaaaucaaagaucaauucuugucauacuuacuuccuacuucuuuuagccauauucuaaucuaaaggaucaucgauuuuaauuuaaauauguacuucuuauucuguugucguaugaugauauuuuaaaaacuaagaauguaaaaucaaaguaaaucagaaguguauuauguggagaaugugggaaugauucugaaagucauaccgucuuuuggaggaagcauuuuggagguuucuaauguuauauuuugacugggucauuauucgcugugcauuuggcugguuuguuagaugguuuggggguagcuaguaaauagccuuuuuuuaaaacuaggauuuuuuuuacaaaauauauuggauuucuuauauugcuuuccuacucuuucgugaaaaaauaaaacagaucuuuucuucuuuuuucuucugacauuguuuuucaguuuuugcuccuuuucuucaagauucaaguuuaugcuuuucuuucauuuugccaccuauuuguauuaaaugacucauuuguuucccuuaaacuuauaaguaauaguuauguaauuuuauuuauuaagcucauuaugugauuuuuguguagacauucaguccuucuacucagggaacacaaaauauaagaaaacgauucagaugcuugccaugaaguauuacguguguagagacuuggacauauuaucaggaaaagaccucuaauucuccauauuuucaauguuuuccuacuuauuuggaagaauaaacagauaugaaucuaauaacacacagauauacacauccaaugaaaauuaccgauacuuuuuuuuauaaaugguagcuuauuuuuaugaaaaauuuaugugugcucggagagccugauaauauggaaauaaaauacugugcucugaaggguuuuucuugaagacaaaccuuuuguguaccugggugaaucagcaugcucauuuggagcauauauaaugagaagcaucuucucagugcuuuacaggaaagaauuuuaacuauuuuccuaaguaaugauguuaauuaucccaguaaucucuaaauacauucccuuugaagcagaagacugaaauuuuguagccccaaauuuuauuauuccacuuccaguuuuuagaauugaaaccuaagacaccaaguuuaucauuggugggacaaugugagaaauagaacccaagcuuuuauaaagaugcuauguauuuugcauaucauuucgacacagagguugcuucuaauaucaauuaaauccacaagaaguacccagcaauucuaccugcccuucaucuuuacuacauaaccauaaccuuuucuuguuacugaaagucuugaauauuuuuagagguagaaagcauguaguugaaaauguauucauaugaaaacuaagguuccuucccugcuaacuugaccagauaaugaccauuucaggcucucagggcacugguaaauuaauucacuugcuaauuuuauacauugugucaggacgguguuccugaguuuuaaauauacaaagauggacgaugcaugguuuugcucuugaagagcccacagucagaaaaggguaauaguuguaugaacaaauaaaugauaauuuugaaauauuuuucuaugagcacauagaacacagugcucagccaccucuacuuguggguauucaaugaaggcucgcuaaagagugauaguuuaccuggauuuugaacaauagccaagaauuuuuucuauacgaagagcguuaugggagagaguccagcuagaggaaauuguuuugugaagaagucauagcaugguugguuuguauggcaaaagguaacacuucacuuggccuaggguuguggaauauggaaauacaauaauaauuaaauguaaauuaugaaaggccuucucugccaggcaguauauugcaguagucaaaagcauuggcucugacuggauaaagaaaaauguggcacauauauaccauggaauacuaugcagccauaaaaaaggaugaguucauguccuuugcagggacauggaugaaguuggaagccaucauucucagcaaacuaucacaagaacagaaaaccaaacaccacauguucucacucauaagugggaguugaacaaugagaacacauggaauagggaggggaacaucacacaccagggccucucgggggguuggggggcuaggggagggauaacauuaggagaaauacucaauguagaugauggguugaugggugcagcaaaccaccauggcauguguauacuuacguaacaaaacugcacauucugcacauguaccccagaacuuaaaguauaauaaaaaaagauauauguaugugugugugugugugugugugugugugugugugugugugaaauaaaaaacaaaacaaaagcauuggcucuguacuuggacugccugaguuggaaucucucacuucugccaguguuuccugccugcccuuggguaaaacuuacucucucuaagauacaauuucuucucuguaaaaauugggaauauauaguacuuuccuuguaggauaucucugaaaaucagagaguaugcauuguaaaguacuuagccuggcauauauuuaguacuuaauacuaucagcugcugguuuuuguuuuuugauuuuuuuaaucaaagaugagguuaaguuuuaaauguuguuauaggaucugacagaauuuaaagauggauugcaugaaggacaauaaaagucaggaaaaccaaggaaaaguugguuauaauaauaaaggaaugacaauauacuguuaaugaaauacauucacuaaaauuaucuuauuaaaaugccuuauuuguuucauuugccacucugaauguuucaucucuaguauaguagcucuuugcagaccaaauuuuccaagcauuucuuuucaaggauuuuaauuaacccuaucaaaugaucauacuaaagucuguaaacucaucaaucugcauugcaaaacaacuauuguuaaauucucagcugcuguaaauguuugaaugguuauaaaaugcuuuaucauauauuuugaaaauucuguuuuauacugcaugccccagcauagcuguccaguguauauucauagagcuaaccagagagagugcccuguauuacaagcugauaauauaaagucaaaaugucaauaaaguuaauguaaauauggccaggaaauuacaagauuccaucuguuugaaauugccuugggcuuugcauuauauugguguuuuguugauugaauaaagucagaauuugcauuaacuaugaaaauauagaagauccuuuucuagaagcaaaacuuuguagcacuuacaaguaauuauguuguugggacaagcauuuaacuuuauauauucauuugcuauauaugaaagucagcugaacagcuguauuucuuaaaaaucuggcaugguguuaggacuaaacaguucacuuugcuguaauguguaacuguaacaugaucuaaaugagucuacugcagaagaaagacuguccuaauaauguaugaacucucuuacucacuuaaauaucaugacauagaaccagucuugauuauucaggaauuaguuaucuaauuuaggugggcaauuaaauaaauauacccucaucauuuuuuguaguggauuaauuuuugcuccuuuuaacuuuaauuuacaaauuuuauuuuacuuuuguaaacuaagacaaucuuauuuuuuggcaacuuugguuccagugaauacuacaauuucaucuguuucuuuacaaauucucuuuagugccgcagguucuucaaagcugcacagcauucauugagagauauggcaucguggauggaaucuaucgccuuucugguguugccuccaauauccagagacuacgguaaaaucuuauauggcacuuuuucacuccuucuuaacuaauuaaaaugcaaauauuuuaaaacagauucacuuacuuugauaaccuauuuucauuaaagauaauuuagauaaaauaggaaauaauauacauguuauugucucuguauacuuuucuaaauggcauuuuuuucaucuguaguaucagagaaccaugcaccuuaaucucuucaguacuuguauuuugccucuuuauaguguuugaagauuuuaacaaauugaguuugaaccgaugacagccaugagagaggaaauuugcauuauaauaaaauuauucuuuagguguuaauuaaaauggaugggaauggaacauuuucuaaucuccuuugacccugauucuguguuuauguucaaguaugcaucucuacauauuucacauccuccccaaaucuucucugagacaaaaacagugacaaacucugugccugcaauauuuuauuuuugcuuaaucucuuggauucuagacuauucuugacaugccauuacccuuucuuuuuuacuguaguacaugauaacugccauuauucuguagagauuuuaauacuuuaacagaucauagagcccaucucaguuuugggaaauacaugcuugaaaaauacauaaauuaguccuuguacuaaagacaguuucagucuucaguuuaagacaaaguaaaucucauauuguacacacacauuaauccucuagguagaugauaaguggucucaugcccguggaugaauauuaauuaaccuccuggagagugagcuuacucugccuuacuauucugcguacaacuuuuauuuuacucauucuaaugauacagauuuuccugccuauuaaaauuuguuguuagcuaggaauugcuuuauguuguuucugacuuuuuuauccugcuucgggaaagcauuucuguguuguacaaucuguaucugaggaauuucugcucauaauuguucauagaucaauugccauucaacacuagucucuggaauugccaaaauauuggauauucaagucauuagcaauuaggaguccuguuuucagacuguuguacuauaagagcuguucauucauauguaucucagaggcuauuguccauuuuaauauuaaagcugugcccuuaauuuccacauagaaagacaucuaucuuguacuaagacauccaguuguugcugaaguccaaacacaacuuaaaugaaauauaauuaauggaagauaauagcaacucacugagauagagcugaacacuuuuggagcuuaugcuuucuguuuuuaagacacauauuugcucuccucaaucaaaugauuugcuuguccucuucugucuacgucagccaugaauuugacucugagcacguccccgaccugacgaaagaaccguauguucaggacauccauucuguggguucccuauguaagcuguacuuccgggaacucccaaacccucugcuuaccuaccagcuguaugagaaauuuucugugaguacaggcuacuuuugaaucuaauucuuuguggaacuuugcugugcuuuuguucaaaacacaugaacuuugguuuggucacauguaagaaauaguucugugacugaaaugacuccuuaaaaaaacaaauauugccagcuagucgguggucuuugcuguuuucacauugucauucuugugcuuucugacuuugagcugcuagucuugucacacuuaauacugaugaccaucaagccuuuuuaaaauuaguuucguagaucucaguguucacacuguguggaaacaguuuacuuccugaauacaauguuguguuuccucgccauuucacauccaagagcaaagcaaguugaucucagagugaaaacugaauuguaagugaacuuucauuuuuacuaacagagcucacuaguuuauuuuguacugugacucuucuaggaugcaguuucagcagcaacagaugaagaaaggcugauaaaaauccacgaugucauccagcagcuccccccaccacacuacaggucagccacaguggguaaauaccaggcagagguagaagucgguugaccuguaaacguuuuuuuuuccuuuggauuucuauuuaaacuuccuuggaguucuaauuaaacuuccauuucauauauauauauauauauauauauauacacacacacacacacacacacacacacgcacacacacacacacuauauguauguguaccuauauguauauguauauguuuauguauagauauucauuuguccuuagauccccagggccuggcacacuguuuagcauuccauagguacuuaaagguugaaugaaugaauggauggacaaagggauggcugacuaaacuuggggguuuuuuguuuguuuguuuuaguuucuucuuugguuuuauuguuguugcuacauuuuaaaaccuaauuugauuuguguguuaguuuggaguguuggaaauauuuaugguuaugucugagaaagccagaauaaaauugaaaguuacuuugccaguuagaaaaagacaacaguagaaacuagauuccaguaugcaaagaaacaaaagauacauuuuaaaauuccaauuacugacaagaaauuaaacucagcggauguucuaguaauaugcaaauuaaguaauuuaauuuuuuuuuucaaaaugacauugcuuauguauauauuucaaaaaucagcacuauaggccaggcgccauggcuuacaccuguaaucccagcacuuugggaggccgagguggguggaucaccugaggugaggaguuugagaccagccuggccaacauggcaaaaccccgucucuacuaaaacuacaaaauuagccgggcaugguagcacgcgccuauaaucccagcuacucgggggcugaggcaggagaaucacuugaacuugggagguggagguugcagugagccgagaucaugccacugcaccccagcuggacaacaaagcgagacuccauuuaaaaaaaaauucuaauugugguuucuguuuaauguuuaucaccuuugcaccaucauaaacgucaaaaaaucauaaauugaaccauuguaaguuggagacuaucuguauacaaucuuucuaaaacauaagguacuugaggucaugaauucugucuuguuuaucacuguauuuccagaauagagucuugcagauagauguucaauaauauacacugcauauauguuuuauaucuucugcacacuauuuuauagcuugacuauagauacuuauauguauauauauccuaauauuauccacuuugccugucuucuaauauauauuauauuacuuaccauguaugcccuaccuggauuucauaccuugccugcuauuaauauguacauguauaucuccugcuuuauaauguauacaauaucuuguguaacucuuuucuucacuauaacuuauauguguguguaucuccuacuuuguauaucuuuugauauagacuuuuuauccaaaauuuuaacauuaaccuuucugaauuccuuagauguucuugaaaagcguaauuuuccaucauguucucucauuuggauaugccauguuauuuaaccuuucauaauuugcauauuuaaucuacauauauggugguaugggguguuuucuauuuccuuuuuuuuuuugaggcagggucucacucuguuacccaggcuggagugcaguggcacaaucuuggcucccugcagccucugccucccaggcucaagugauucucccaccucagccccccaaguagcugagaccacuggcacacaccaccaugcccagcuaauuuuuuguauuuuugguagaguugggguuuugccauguugccuaggcuggucucaaacuccugagcucaggugauccacccaccucagcaucccaaagugcugggauuacaggugugagccacugugcccggccuuccuuuuccaauuuugaauauuacuaugagggccauccuuuuacaugguaucuagauuauguuuuuuauuacaggauaaugaccuggcagugaaauucuggaaaucuaaauuauuauucucaauauuagacaauaauauccaaauuacguuccagguugcgaaguuuuauacaauucacacucucaucugcugaauauaaaagugcucauuuuguggaauccugacuaaaauucuacauuaacuuuuaaagacauccuuauaaucagauaggcaaaccaaauagaugucuuugguuuuuuaaauuugcaauucucauaaaauacauuccugaaguccuuuaaucauucccuucauucaccuuccucaaguaauaaaauuuuacaugguuuucuuuuuuuuuuggcugaggagccuggcuuuauucuauuuuauuuauuuauuuuuuuauuauacuuuaaguuuuaggguacaugugcacaauaugcagguuuguuacauauguauacaugugccauguuggugugcugcacccauuaacucgucauuuacauuagguauaucuccuaaugcuaucccucccccuuccccccaccccacaacaggccccggugugugauguuccccuucuuguguccaugugaucucauuguucaauucccaccuaugagugagaacaugcgguguuugguuuuuuguccuugcgaucuaaauacguuucucaagcuucucaccucuaugucauacccaggccagccucacuucgguuugucuucucuuaauuauauacagcagagacagagaauuaccauuuuaacuguaaagcaacuacaaugcccuugaacgcgcaggcacuuuggagccacucugaccuugauuugaaaugcagcacugccacugcuagucuguggaaccccagcaaccuugacuuuguccucgguacaaggggaaugguaauucugugcuuguuagagcuauuaugagaauuaaaugagacugcugguaaaagccucuugaacaaugccuaaugccgagucuaacuaugauauuccuuuuccucucaaauucauguuaggcccaucugaaucuuuguggcucggauguagaccacauuuuaucuuucauuacuguuucauauaauacagccuuauauuucugucucccauucauuguccuuuuuuuuuuuuuuuuuuuuuuuuuuaaagacaaggucucacucugucacccaggcuggagugcaguggcaugaucacagcucacugcagccucaaccuuccugggcugaagcaauccuccugccucagccucccgaguagcuggcacuacaggcaugcaccaccacacccagcuaauuguuuuuacacuuuuuguagagaugggguuucacuguguugcccaggcuggucuugaacucucgaguucaagugaucugccugccucagccucccagacugcugagauuacaggcaauagccaucacacccagcccguugucuuuaguaguuuuacucugggcacuauuagguaggacgcuuugagacaugcuaggugauagauaauaccucugugugugcaugcgcacagacacacacacacacacacacacacacacacacacggcacuuaccugguuuaacuuacauuuaaggugaucaugucuuguuuucaaaaguacucuucccuauuguuuaaucacaauauauguggaauuguuuaaguaaagcaaauuuuaaguagucaagauaaaccagaauaugaggauuugaauuaggcucuuuauuucaaaagcauauccuuugcucaaauauucuccccuugaugccuauuggaauuuuucuuguaacuguuuuaaggcuuuugagacauuacuguuuucuuucauagaaguguugaaauccuuuccuguuaguaugucugcugcaaguagaauggcauaacuucaaaauauuauuuguuccagaaacuagcuuugguggaagauucacuucuaauaguaauauuucaaccuguuaagcaggaaaaaaaaguucucuuggguuuguauggucccuuucuucauuuugcuauugcaaacuuaggaauuaauuagcaggcuuuuauguucuauacugcugcaucauguuucuuucuguuaauauguuguauuuuauuuccagaacacuggaguuccugaugagacacuugucucuucuagcugacuauuguuccaucacaaauaugcaugcaaaaaaucuagcaauuguuugggcuccaaaccuguuaagguaauuugcauuucacuuauuaauuuuaguagaacuaauccuaaauaaaaggcugauucaucaguguucuuuaaggaaacuuuuaaaagauuaaacaaaucuguucuuuuuauuugcaucucccuaaaacaggcaacugggccuuagcuaagggacaguaaaaguaugauuucuuccucuguuugucugagauuuacacguuuaaaaaaagaggcccuugacgacugcuaucuuuacaacucugugaugaaaauguuuaccucacagaucaaaacagauagaaucugccugcuucaguggaacagcagcuuucauggaagugaggauucagucugugguuguugaguucauccugaaucacguugaugugcuguucagcggcagaaucagcauggccaugcaagagggggcagguacggcuccgauggcccuuccuaccaggagggugugucucagcuuccagaggaguagcaaaccaugcauuucuuauugcaacaacaaaaacgugucacugguauaaggcagcuaauaauguauggcugcuuaccaaaaugcacaauuugacaguuauuuuguguguauauagugaauacuacauaugagaccuauugugaucuaaguucaugacacauuaaaaaacuugucguucauuauugauguguauuaaaguauaaaguggaacagaagaagaaaaauugcuuccaaaacuaaaaauaucugagugauugaucaccuuuccucauaucuuuuaagaaaggaaaacaguuauuaaagaguuuuauauguguguaugugugccacugguguauccccuucaguuuuuuauuuaauauaaagcuuuucucauaucuuuuaagaaaggaaaacaguuauuaaaggguuuuauauguauguaugugugccacugguauguccccuucaguuuuucauuuaauauaaagcacuaugguuuuugcuauuuaacauacuugaagaaaauuugaaacaacagauagguagauagauggagagauagauacuaacaaauugaauacacucacguaguugacucucuucaucagcuuccuuuucuuuuugaagcuucucuaucaaggcccaagucccuccugguauccucuccauccaccaaacugcugacauuggaagaggcccaggcacgaacacaagcucaggucaauucuccaauugugacggaaaauaaauauaucgaaguaggagaaggaccugcugcacuucaggggaaauuucauaccauaauugaguucccacuugaaagguaaaauuuguuaaauccuauuuugggauaugauuuucauagcuauguccuauuauuuucuuuuaguuugcuuuuaauuuuguauuuuaguauuacucuauugaauucuaggcuagucccagagaaaccuguuuauucgaauauggaugauacuuaccgcuucauggggaaugaugcaaaugauucuugcuuuacaaugucauguaauuuuauaaaagaagaacaucagugguauagggaaaauuguuuggaaaaauaaggauauacugucacuauauggguugauuuugcucucugaacuauguuguuuauaaaguuguuuagaaauaagcuguguuggaagaguuuguucagaaagucaggaauggacagugacuuguuugacauugguuucacauuaagguuagaagagauuaauaguguggucucccagccaacagcaucagcaucaccuggugauaauugcuagaagugcacauugugcagucguccagucacaccccagacccgcugaaucagaaacccugggcgugggacccagcaacuggucauucaucuaacuuuccaggugauucugaugucugcuaggacuugagaaccacugcagcaguucacucuuucaaugucccuuccagcucugaaauucuauuacucuaaagaaaugauaauaacaugguuucuguaucuucuuuacuagguuauaguaggaagacuaauguauguaaaaguuauuuuugaugucucugcuacuccuuuggcuauuacacaugaauguaaggauuuugauucucuggauuggguaguacuaauauaacuuuagaauuuguucuucccguauuuuaguauacuccucuaacuuccuuucacuuccugugacuaaaaacauucuaucagcaaaaaguuggaacauacucuuacuuugucauccugaguuugucuuuagcaucuugauuuuauauucuaguuccauaauuuacucaaagauuuauuuauggaguaguaguuaagagaguagauacugggauguagauuggccuggguuccaauucugacuccaucauuuaauaguuuuauaauguuaaagaaguuauuugaacuucuuagugucauaauuuccuuggcugcaaaaugagaauaauaguacuuaccucaugugguuguaucugauuuaaaggagauauuacauauaaggcagguagcacagugccuggcauucaguauauguuuguuauuauucuuaauccuugucuucuuuguuugccuuuauucucuacucacaccuaaaaucauuuucuuuaacucuguguuauuuuuggacacuuaauauuuccuauucccagauacgucuuauuuucacuuauuuuucaguuugugagguuggauccaaauaugaagauauauauaaaaaugaucuuugugaaaauauuuacuaguacuaaaaucugcauguuuacuauccauuuucugcuuuggcugcacuguguagagugugcugucuggaagguggauguuugcuuacuguuucacuuaugcuucuccagccuguuugguucuuucugucauguguucauuucuuuucuguaagaaaagacagacccauggcuaucuuaauguugauuauuuuuucucuuucauagaaagaggccucaaaauaagaugaaaaagucuccuguggguagcuggcguuccuuuuucaacuuggggaaaucaucaucuguuucuaaacgaaagcugcagcggaaugagagugagccuucagagaugaaagccauggcucugaaaggugagugccugggagauucucacuucugcugcugucaugauggucuucgguuguucugggcacguucuucacauauuguuaugaucugcuuccauaacguguucacaguugugucacacauacagagugucuucucucaccgauucuuuauuccuaaauugaagaguaacauaaauuauauauaaauauguagaaguaugcaauuucuuuucuuaaggaaacuauauagauuauauauaguguaaaugugauuaaauucacauauaccuuguauauuguuguaaauaaauacugcuaugguaucuaaauuuauugaucuguauuuuuacagaucuaaaaaauuucaaaacuguuucaacauaacuuucaaguuuauaacucuuuuaacuaaagaagguauuuuuuauuagaugucucauuaauagaguaucuuauuagaucaaauaaaucuauuacugucgaaaaaguacucuuuuaaaaauaguuuaaaagccauauucuauugauauuaacaacuucugaaucuaggaaggauaguaguacuucuuagauaauguuagaaguauaauguucaauucauuuaauucgucauucaguuugcaaucauguagagcaugugcuagcuauuuugauagcaggcucugcagauagaaaauuaggguaguaccucugccuuccaagucaaauugggaagucauacgugugagaaaguaaauuuuagugcagaaucauaguuauugaaauagugguuuaggcuagguacaguggcuuacaccuguaaucccaacacuuugggaggccaagucaggaagaucgcuugaagccaggaguucaagaccagccugggcaacaaagugaggcccugcaucuacaaaauaauaauaauaauaauaauaauaauaauaauaauaauaauaaauugcaaauaagcgaggcuugguggcacauaccucuaggcuuagcuacuccggaggcugaagcaggaggauuacuugagcccaggagguugaggcugcagugagcuaugguugugccacugcacuccagccuggaugacaaagcaagacauagucucuuaaaaaauaaaagaaauaguuacaugagacaguugugguaggaauugucaacucuuguagaggagggacuagugguuaggaaauaacaaccuuugauauggguuuucaaggagaaguagggauucaccuaacugacaggagacuaagaaugguauuucaggagaugggagcagagugaaaagaagccagcugagggcugaaugcuggagagaagcaauguuuaaaggugggaaaggaagaauugucaugagaggagaguaagaagaaaugauuacaaagguaggcagagaaaaaaagagaugcaugcuauccucagcaggggaggaggggguuaaaaagaaaguguucguagugcugccaagggguuaaagaggaugaagauauuuagcgaauaagauucacauauguacguaaaguuaccuguguuaguaucccagaguucccauaacaaauuaccacaagucaagugguaaaaaacaacagaauuuuuuucccucaugguucuagaagcucaaagucugaagucaagguaccagcagggcugugcuugcuccagaggcuccagggaaaaauccuuccuugccuuuccaagcuccugguggcugcuggcauuccuugauguguggcagcaucccuccaaucuuugccuccaucuccacauggccaucucuguguuuucuuacgaggacaccagucauuggguguagggcccacucuaaauccaguaugaugucauucaagauaucauauuggucuuuaggaaauguaaaagaaagaagcaucuuaguuaaucucucugcucaaauucauaauccuuuagaaaagagauuuuucacacgggaaaccauuugagaacaguauaacacauuauauaauagaguacuaaauugcugucaaaaugugcaguauaacacauuauguaauagaguacuaaauugcugucaaaauguacagcuaaucacucucaaaaguuuaaauguaucaagaaaaacaccgaucccauuaaccacauauguaacaaauaagaaaucuucacacuauguguuuuuuauucuucagguggcagggcagaaggaacccuccguucagcuaaaagugaggagucucuuacaucucuccaugcaguugaugguaagacuaaaagcaucagucauuuuauucuauaauauauugcauaaaggaauacugcaauugaguauauuuuuauauaucugugcuuaauaaauaggcuauuaacucauuuccuaggaauacuagugucuauuuaguauuauucagauuaaaauucauugaugcuuucacauggaagcagucuuuaaucuuuucauuuuuggcaugacugcuauucaguuuacauaaaaguagccaaaauauuucaaguuaacuauuuauauuuauuaauaucuagugaaaacuuguguuauuacuguuuccuuuagauuuuacaaugggagcauaagaguuuuccaagauuuucaauuaaacuagucaagauaaccuacaaaacaaugcagcaagcuagguggauacuaguguuaagcagaagauauuuguaaggaauuaauuuuaugggugaucaauacauuugugaauauauauauauauauauauauauguuagacagagucucgcuuuguugcccaguuuggaguacaguggcgcaaucuuggaucacugcaaccucuaacucccgguuuaagugauuaucuugccucagccucccaaauagcugggacuacaggcaugcgccaccaugcccgggagcauaauuuuauaaaguguauaauuaagcaguuuuuauauuuuuaguagauacgggguuuugccacuuaggccaggcuagucucgaacuccugaccucaggugaucugcccaccucagcuucccaaagugcugggaucacaggcaugaaccgcugugaccggccaauauauuuauauuuauuaagauaguuucugccucuuuaaauuacuuuuuaacuauggcaauuaaaauaauccuaauagaauagagaguuucuuuuuuaccaguuggauauuuagcaacaucguaaaauuauguaauacucucugccacucuugaagacugcuugggaaacuuaaaaccuauucuuaaagaaaaaaaugaaguucuuguuuaguaucugaaaggaauuuuuuacuaaauauauguaaauacuuuaugggauuaugaagauuuuuuaauugagaaguucaauuuauuuagaaauuugaauauuguaaggauguuuccccacaaaaaaaacauccauuuugcuauuauagauucaaaaugccacucaaagugauuaauuccaccucauaagucauaugaggccagugauaaaauaagacacaaagaaaugaaaaacuugcccaaagucacaccaagaaucaguguuggauuaguaauagaauccaagcauucugaguucuuuuccucuccagaccaugaaauacugcauucgcccucugauucuaucacauguuugcuauuuagcauuugguuuuggaguucuguuaucucaaguguaaaugaucugugugcacugaaagaauuuucagaaagaaaaugagaaguaacacuuccuucaccuagauaguaaguuacugcugugcugaguaggugacuuaccacagcauucuguaucuacgauguucuuacuuugacacuguuauucauuuuuuccaggugauucuaagcucuuccgacccagaagacccagaucuuccagugaugcacugucugccucuuuuaauggagaaaugcuggggaaccgcuguaacuccuaugauaaucugccucaugacaaugagagugaggaggaaggagggcugcuucauaucccagcccuuaugucuccucauucagcugaggauguugacuugagcccaccagacauuggaguagccagccuggauuuugauccaaugucauuucaauguaguccuccuaaggccgaaucagaaugucuggagaguggugcuuccuuuuuagauucaccaggauacuccaaggauaaaccaagugccaauaaaaaggaugcagaaacagguaguagccaaugucagacuccaggaagcacagcaagcucugaaccugucucuccucuucaggagaaacugaguccauucuuuacccuggacuugagcccaacugaagauaaaucaucuaagccauccuccuuuacugaaaaggucgucuaugcuuucucuccgaagauaggacggaaauuaagcaaaucaccuucuaugagcauaucugagccaauuucagugacccuaccaccacgggugucagaagucauugguacagucucaaauaccacagcucagaaugcaucaucuucaaccugggacaaaugcguugaagaaagggaugccacaaauagaucccccacccagauaguaaagaugaaaacaaaugagacaguugcccaagaagcauaugaaucugaaguccagccccuggaccagguggcugcugaagaaguagaauugccagggaaagaggaucagucugucucaagcagucagaguaaggcuguagcuucuggacagacucagacagguaccguuuguuuuccuccauucuuucuuuaaguuaagagggaucuucaauccugugugccaucugugccuuuuaagagagaaauuuguccacagcuagccuuuaaucaaagagaaugcuuuucuggguggugcugauggcucagagcccuaaauuaaaagcaguccaacaaaacuccccaaaagggccaaugguccugcuucaaaucuucacaaaaguccccuuaucucuuuggacggugagaauucguggauaauuuuugcacaacugcguagcucuugauucuguuuuucucuucuaauaaaauaucuuuauuguagccuuccaaguuaacaagccagcuacaccaucaaauguaaaaacuguucauaauaacagucuacaagcacuugaagcuuguuuucuaagcaaucuuuucugagccaggugagggacaugcuuuuuuucccccccaucucuguaacaauucaagaagagauugcagucuuuauacacuguuuguuuuaguuuuccuucugaaccagauguguuuucaacagcauuugcaugugggauagaagaucauggauugccauuuugaaauauggaaggcaccuauuuuuuaaugaucacauggggaguguuuggcuuuccauuuaggauaacguaagcuaccuuuucacucucauuuuuuuucccaauuucccacuaggagcaguuacccaugaccccccucaggauuccguuccugucaguucagucucucuuaucccaccaccaccgccuccgaaaaauguugcccgaauguuggcgcuagcauuagcugaguccgcacagcaagccucaacucagucauugaagagaccagggaccucucaggcuggguauacaaauuauggagacauagcgguggcuacaacugaagauaaucuguccaguucuuacucugcaguugcucuagauaaggccuauuuccaaaccgaucgaccagcagagcaguuccaccuccagaauaaugcaccaggaaacugugaccauccucuaccagagacaacagcuacuggggauccuacccauuccaacacaacugaaucuggggagcaacaucaccaaguagacuuaacagggaaucagccacaucaagcauauuuaucuggggacccagaaaaggccagaauuacuucaguucccuuagacucagagaagucugaugaucauguaaguuucccugaagaccagucugggaagaacaguaugccaacugucuccuucuuggaucaggaccagucuccaccccguuucuacaguggagaucagccuccuucuuaucuuggugcaaguguggauaaacuccaucacccuuuagaauuugcagacaaaucucccacaccuccuaauuuaccuagcgauaaaaucuacccuccuucugggucccccgaagagaauaccagcacagccaccaugacuuacaugacaacuacuccagcaacagcccaaaugagcaccaaggaagccagcugggauguggcugaacaacccaccacugcugauuuugcugcugccacacuucagcgcacgcacagaacuaaucguccccuucccccuccgccuucccagagaucugcagagcagccaccaguuguggggcagguacaagcagcaaccaauauaggauuaaauaauucccacaagguaagaaggggaagauaucagugagaugaaauauacuauuaccaaagguaugucacuuuucagcaggguguguuguuaucuuugagucagacacaacaauuacuuuuaagcccuguggcugguuuccaugagauaguucccauuugagguuggagucugccauuaccuugaugcuggcuuuuccccaggaaaggaguagcuccuagaugacuauagcuuaacuguaccugcucccuuuucuuccuaaagugucucgguaguuuauuccaguaacacaaagagaucaggaucaaaugagacaaagugggcuuuacgguuguggguugcuuuuucuuauuuuuuuccaacuccaucacugacucauugugacuuugggcaagucauuuaccuacccucugccaauuauucacaguuacacaaugaaaauacuucauucucaaaacauucguaagacugucugccuugcagacuuuuuggaaguauaagagauuauagugccuugggauuuuuuguuacuuuccuagcauucaccagcaguuugucccauagucaggugccuguuucaaugagagaauguaguaugcagaaugcuaagguuucuuccugaauuuccucauauuuuaagaaagugccacagguuguuuuucuucuauauggucaccuugaacuauuaauaggacuuaagauuuuagaccuuaguggaggaugcuguguuuacugcuucucaaggauagcauguuuucaguaugaggauuaucuuuggccagacuaagguggaaucaaagguaggagagaggcaguagcuucugauuugaauauugccuuucccuauguuugaagcccuaaaacugcuaacuguguacaacugugaauuucaaaagucuccccagaugauagaauuaacucuuaauuuaacaagauguccuuuguguugagacugagcuagacuaauagaccggguauguauuuuuaagcucuacagcauuacuugacuaaaccucucuuuugguuuguauauuaaaauuaugccauaggcaaccucaucucgcauuuaaaaccucucauaaauuagaaaacuuugaaugguucuccaaagauaauacuggguguuguacaaaauagcagcacaagccuucuuuuccuagaaauggguacagauucauugcaaccacauggcuugggaaaguucaagcugcuacccaaccagccuuaauuugugaguuacaaauuuaauaguacuugauucauagagggaacaaaaaauagacccauaguauuaucaucuuucaauagguucaaggaguaguuccaguuccagagaggccaccugaaccucgagccauggaugacccugcgucugccuucaucagugacaguggugcugcugcugcucagugucccauggcuacagcuguccagccaggccugccugagaaagugcgggacggugcccgggucccgcugcugcaccugcgcgccgagucugucccugcgcaucccuguggcuuuccugcaccacugccccccaccaggaugauggagaguaagaugauugcugccauacacuccagcagugcagaugccaccagcaguucaaauuaucauuccuuugucacugcuucauccaccucuguggacgaugcauugccuuuaccacuuccugucccacaaccuaagcaugcuucucagaaaacaguuuacuccuccuuugcuaggcccgaugucaccacugaacccuuugguccagauaacuguuugcauuucaauaugacuccaaacugccaguaccguccccagaguguaccuccccaucacaauaaauuggagcagcaccaaguguauggugccaggucagagccaccagccuccaugggucuucguuauaacacauauguggccccaggaagaaacgcaucuggacaccacuccaagccaugcagccgggucgaguaugugucuucuuugagcuccucugucaggaauaccuguuaccccgaagacauuccaccguacccuaccauccggagagugcagucucuccaugcuccgccgucuuccaugauucgcucuguucccauuucacggacagaaguucccccagaugaugagccagccuacugcccaagaccucuguaccaauauaagccauaucaguccucccaggcccgcucagauuaucaugucacucagcuucagccuuacuuugagaauggccggguccacuacagguauagcccauauuccaguucuucuaguuccuauuacaguccagauggggcccugugugauguggaugccuauggcacaguccaguugagaccccuucaccgccuucccaaucgagacuuugcuuucuacaauccuaggcugcaaggaaagagcuuguacaguuaugcugguuuggcuccacguccccgggccaacgugacuggcuauuucucucccaacgaccauaauguagucagcaugccuccggcugcugaugugaagcacaccuacaccucaugggaucuugaggacauggaaaaauaccgcaugcaguccauccggagagagagccgugcucggcagaaggugaaagggccugucaugucccaauaugauaacaugaccccggcggugcaggacgacuugggugggaucuaugucauccaucugcguaguaaaucagauccugggaaaacuggacuucucucaguggcagaaggaaaggagagccgccaugcagccaaggccaucagucccgagggagaggaccgcuucuauaggaggcaucccgaggcagagauggacagagcccaccaucacggaggccaugguagcacgcagccggagaagccaucccugccucagaagcagagcagccugaggagcaggaagcuuccugacaugggcugcagucuuccugagcacagggcacaccaagaagcaagccauaggcaguucugugagucaaagaaugggcccccuuauccccagggagcuggccaguuagauuauggguccaaagggauuccagacacuucugagccagucagcuaccacaacucuggaguaaaauaugcugcauccgggcaagaaucuuuaagacugaaccacaaagagguaaggcucuccaaagagauggagcgacccuggguuaggcagccuucugccccagagaaacacuccagagacugcuacaaggaggaagaacaccucacucagucaaucgucccacccccuaaaccagagaggagucauagccucaaacuccaucauacccagaacguggagagggaccccagugugcuguaccaguaccaaccacacggcaagcgccagagcagugugacuguugugucccaguaugauaaccuggaagauuaccacucccugccucagcaccagcgaggagucuuuggagggggcggcauggggacguaugugcccccuggcuuuccccauccacagagcaggaccuaugcuacagcguugggucaaggggccuuccugcccgcagaguuguccuugcagcauccugaaacacagauccaugcagaaugagcccugcgagcaauagaguugaagcagccucugcuggacaguggacuguucuauuuuuuucaauaaccaaaaagauuaaacaaaaaauacuauaaaaccccugaccacauuuaaaaaaugauaauaaaaguaaacaaaucagcaucuuuuuccccuucccugcuucauuacccccucuuccaucuauagacuuugucauuuuugucuuuagaaaagaucugaaggaugguaaagccccgugcugaaacccaguagagaaaccugucucaggacacacuugccaucuagggcuagcuugaaagagccugaggacugccuuuaacugaauuugaauucagcauuguccuuucuucuuaguauuugcugcauaauugagagcaguucacaucgauuuccugguaggcgucugcauucccuguuguguuccugcuucuccuucaguagcugcacaacuugcgcagaucgacacacuguugucacuucauucuccccgucugagaaggaucuuguguucaguuagagucguggaaaaaucccugauccuucaaggucagucagacaguuggcaacauuauaauuaaaaauaagaaauuaagacuuuaaauuaaacauuugguagagucaucauaaaacaccagaccacuuagacucaggcugaaccauacucuuucuauucuuauuuuucauccuuguuccucacgguucagugaacaggcucauaucaugacagaauggacuuuuaaaaguuaguacuuaaggaaacuucuuuagguggaagaaaguaaaguucuuauugucagugaacuuuauuagcaccagaaaucucuauugaugcuuuuaaugcauugccugccuucagguuuucuucuuaccccaccccucaauaagauuuggugaauuguaauucuaguaaaacaugucauaccauugguuuuccuaaauuaucaacuuucuuucauuaaaaaaaaaaaaaaaaaaaaaagcccagcaugguuugacuggauagacacgcauaauuuauuaugaauauaaauuuccauguuuguuucuguuccuaaaccagaguacgaggucccugggaauuuaaguagcuacgcauuaucuauuauuagacugcaaguuccugcaauaacugcuuaguucacagccccguuucaccaguggaguucugggcaguuauugcuguccuaaggcauuacugucguuugcuuacucuauacuuguguggucacagucuucuuguaauuaccaucuacaccagcauuucagguauagcucuuuauaacucuggagacauguaaaacauguuuaacacccacgaguuuugaaaguugcauuccuuauuagaguaggaacucucuagcccaacuccauucuauguucucagcucccuccaccccccaaaauacaucagacuagcaaggcaguccuauguuuacaaaacgaguuuagauugucauuucauuccauaacucuuaauaauacucaaguuuuauacauucacguauuuuaaaugcucggucuguagaagacacuaggagaauugcauuccaauuacuggaugguugcugcucuggcuuuuuagaacuugaaauuaauuuuuauuuagagcaaaggaggaaaucuuuuaagaggcuaaaaucaugcugcuauuauugcugugaaauuguauaaagauuaggauucaugccaguuuuuauuuuaaaaaauaaugugcauuuuaaggguuuauauuuagaaaaaaauaaaauguuucaagaacaacacauugauauguggaaauauucuauaagguuuucuuuuguucccuuagaauucauuggagggaugcaguaaaaacuguaguagaaaccuugaaacacccauaugugaaaaggucuguggaaauugaggccucuacauuaaaagugcagaaccaacuguuuuacagucaaagugcuaggaaaccugauaggauacuucccuuuggcacaaaaacacccugggugcuacauacaggaguaugaccuuuggugaauauguggcacuaauuuuuuuuaccuuaaucauauucuugucaaguaggcaacccauugccccuuggagaccacaccagcccuguaaguucucaccagcagcauggagauuaggaagaggggcugcugugaccaggagauacacacggcuuuaaguaacugagagccuaaagaaaguaacccagggaguccgguccaguuuuaauauuuguggauuuguugucacacacauuguuuaguccugaaacuaaaaccuauuuuauaaauaguaggguuaauuccucgaaacaauuucuuuauuaauaaauguccuguggguuuagaaauaucagguaaauauuugaauacagaaugaugauugcaauuacuguuacaagcgugaaacacaaacuucagaucaaaucuagaguugcuucauuuaaugcaugcuagcaacagccuuaacuuuggauucaguuauuugaaacacuuuuccggcaucuuucccuuucuaauguugugggguggaaaccggauggcaaaucacugugagccggauaccucagcacaguccaccuugugugugacuucacaaaugggggacuucacaaaugggguaacugaauguuauuacuuucaaauuuugacauggagcauuaugaucaaggaaauggagcugccuuauacauuaaacccgugauuuaauccuauugacauuuucauagccaugccuccagauuuuaucuuuuuggcaaaauucugauuccacaguuuggucugauugaaauaaauauucccuggacgucuggcuaaaaauuuugcuaacaaucccagaggugccauuuucuuauuaauaaauuucauuggagccuuauuucuuacuauauucaauuucguuucaaaccugcaagucccugggauggucccacgacuagggccugcacauuucuuacaauggcaaagcauuuuuuaaaauuuagggucagguugaaaaauucuaggacuaauucuguagagaggagggacuguuaacuaacgugaguggggacggaggaguagguuaccacauuuggagcaguaauagaugcaaacgauguaaauuugaaauuugccccuuuaguuaaagaaggagccugcaaaguccauuucucuguuuucagcccugucagucacccauuuaggauguuggcaaaguacugcuugagcagaauguguaagaaaguaauaaugaaagcaaaaguaugucagacaguuacuucuuccacaugguuagaggcaugugauuuucagcacuguguguuacagaaaugucaggaaugguguauuauaacgugugcaagauaaugucagugugcacagagggucuuuuuuccuuaucugauuaguacuguuaauguucaaagaauaaaaaugguuuuacaguuuagauucugagauagcaaaaccugauuuuucaaccaugaccugcaugagagaagcauccuaggaagucuuagaucauacuuuugaguuuuuaauuuuaauuuauauaguguuuuuuuaugucuuaauauuuuugugaacugguguaaauuguuaaugcauauaagcuuguguauuuuuguaaauaguuuugugauuuauuucuugccccauauguaaauauuuagagucucauuucuugcaaacuuauuugaagcugaguuguggguuuggguuuuguuuguuucuuugguugcaggguggggugggggguggcaggggagggaggaagggauuuuuguaccuggagauggagauaucuugugguuuaaagcaaaugucccacugaaagugauucaaauaucaacagaauuauuucagguuaaaacagacugcuuuguguauguguuuccuuuuugaccuaauaugaauuauaaugagauagugggggugauugauuuggggaauuaggaccaaaggacacauguuuucaugacacauccuguuaugcccagggguacgcuauuugaggaaagggguuaagugucuccugucguuaucuauuuaccaccuuuugcugccuggccaaauuucccccaagucaaacacuguucccuguagagcgguggagaccucuugauccauccuggagagucugggcugacuugcugcuuccugcuccugaaggaguccacacuccgcucuuggagccugguucccgagugugcacuucucaggaaacugaaucagcuuaucucaggauccuucaaaggggauucugaauaaaaccauaucuuuacagauucccaggaaacaucuuggacauccuguuuucucucucuuaagggugaaaugaccauaaaagaaucaugccgcagaugaggccaccuguggugagcuggcucgcagcaagcccagaucaaguguuagugagacggugacucuaggugugaagcaaguacugcaaguggcccagcugcccagcagggcuccagaguuucuucugcugccacaguucucaaaauaaauacuucaguaucaaccaggacuuaaaggugaggcggggaggacccucaauauucagcuguugaauauugguuuuccuauugagagucaaguugcaaaucauucuucauuuugagguguuagggcccuauuuuuuuuucuugccagcaauaggaaaaguugccuguuuauuccagauggcccuaguaagccaaccgucuuuucugugccugcauaccacacuccagaccucagcaaagauacagcaucugcuuugguaagcguccucagaccugaauaaguguucccauggaaacugcucagaugggaugaaagaaaagauacagccgcagcuccacugggucuucucaguuuucaggacucugcuuuccaugccaacuauuucaucaccaaacuuauguuauacugacaaaaauaugguaccuaccucuuaaaauguguaucacugaggaaucaguaacacauacauucuuggugguugagauuuuagucauuugugguuguacaggaagaggcacauuuuaaaguaacacugacuccccauccaguaaaaccuugggcaucuggaaacaccagaaauaagacauuuuaguuggucauguuuuucauacaguugacaguguaccucugaaaaaguauaagguguaauuuu

SEQ ID NO: 15912 - RNA, 1414 nt, Homo sapiens
guuacagauaggaaaaauauugccugacuauuacaccuuucucgaaaaagcuaagcauacccuuccuggcccuguuuuugugggaaugcagcagcucauaugaauaucauuagaaaaagaauaaacucucucuacaucccuuucacucucauggcauuaagcaagaucaggccuugauuauaaggcacgugggcuuuuguccaaggagcaaauuaaauaagugaccuuuucaaggaaaaagaggaauacuguaguacucaaugauaucauaguuucugagagcagccugagaucaaaaguaaaggcggauuuugaggaaaaaaugaugcaaugaaugugugaauaaaaguagucagaaauuugaucuaagguuucagauaguaaaucaaaauaauuuauuugagucucuacaugaucucucucucucucuuucucuucuguuggaauuagauacuuggauuucauuaguuauuuuauuuucuuguuuacucuguggccuuucccuguagcaggaacacucaagcuauucaaaggagaagaagccaaauaaaucaaauucuuuaagucacagcuuagagauacuugcugguuccuguagaccuugaaucuccagaaagaucugggauaauuuaaaugugagaguaagagagauuuagaacuuugcaaccauaaaacuuauauuugacugaagauaugggccaguggauacaacuuccugaggaauauaaauaugccaaauaugcaaaagaauauuugaucacccaugacuggaggaaagcuacuaagugacucugccaggccauacuguugacuuauuuguaaaaggaggaggcugaaaauaugaaagacaccuuuagaaguaagugagagccaagaaaauacaacaagagaggaacguauucucauccacugacucccauagcacacagacuuuggagucaaaggguugagggcugugugaccuucucauaguuguuaacuguucugagccuucgcuaacaugauugagaaugaaaaucaucauagacugguuucaguguauuguuggugccccaaagcaacagaauucuggguguacacaggcugcuagaugugcccaagugugagcgugcuggaaguuagaaagcugaugaaacauuuuaaucugagcuuugugccuugaaugaacucuguguuccuccugguagccuacuuuacccuaggaaucaaaauagagcuuugaaccauuuucuuuauaaacuguccuccuaacccccauccccugcaguucccacacacacugaggccagcuuuggcccacuuugccuuucccaggcuucaggagcccaagagacacuaaaaccuggauuuguuggagucgucuauccugcaauuuccccaaacacauacugaauaaagaacucuaaaacuaguu

SEQ ID NO: 15913 - RNA, 9150 nt, Homo sapiens
uaauggggugcuucaaaagcuccugcuguacaaugaaaagaagagacagaagacuggagggaaggaguuaauuacauguauugauuaauggauaggguaaacagacgaaaaucaauaaaccugagccaggcugccccagagugcucccaugccugggcucugucugcuaagagggucagaggcagucuuuccuggucagugccaggaugaagccaguccugggccagggugcucaggccuccagauggauugcccuggugggugacaucagcaugggcuacagaucaguccuaggaucccgcucaucacucgcuauuggccucggccucacugccugugccugcccagccauaugggugcaauggccugccugagaggagaggacacuggggagggggagaaggccuggcacaguacuggggaagauggaagcagcaaacaaggcugugaacacagccaggaugcaagccaguggagccagugcagagcacacaugcucagaugauguuguucuccuggaucuucucucccaaguaaaagcggguaaagaggaaggggcucaggucgauggucuggaaccugcccuucaguaccaucucugcuacagcucgcccaaugccaggggccugcuggagcccgugaccacugaagccaguagcaaaguacauguugacaacuagcgggugggggcccaccacgccauucuggucaaagguguuguagucguaauagccggcccaggcgcucugaaccugcgggugcacaaaacacugggguucucgggaaggcuguagccacacuccauccucacuccccucagggcucagcacagaguacccucuaccugcugcugaggggucuaugggaugggauguguccaagaaauuccuuagcaguugugacauggagggacuacggcagucacggguccgaggggaccaaugugcuccacugucaucugucccauccaauguccaaaaauaaaaaggaaaaccagcccuugccaguuaccuucagagucucaaaagcugggacccucagggccaaauggggccacaccuuguccuggaagaaaucaugguccacuuccagguucgccggguccgguucuuccugcuggagugagagguggggacaacgcuuacauugccugggacacaaggacaggcccagacuuguuuaacaaucccugugcagguaggggauggggagaaauggucccaguucaaaucuggagggggcucuaauaucaauuaacacagcacacagccccccaaaaaaggcugauucuuuuucuuuuuuuuuuuuuugagauggaguuuugcucuuguugcccaggcuggagugcaauggcgcaaucuuggcucacugcaaccucagccucccggguuccagugauucuccugccucagccucccaaguagcugggauuacaggcgcccagcaccacgcccagcuaaguuuuguauuuuuaguagagacgggguuuugccauguuggucaggcuggucucaaacuccuaaccucaggugauccaccugccuuggccucccaaaaugccaagauuacaggcaugagcuacugugccuggccaaaagccugauuguuucgugacaauuauucuaugucuccuugccagcaugucccaccccacucagcuuaccucaguggggcuacgaccaccuagguaguugcuaccuaauccuucccggcgaaaauaggcuccacuggugucugcaacaagcggagucucuaggccuggucccugggggcagugccacacauacacauaccugccacaaccagugcgguuacgaacugcagaaacagcauggccggcaacccuccccaacccuguccaccccacaccccacacacacacacacacacacacacacacgcuauccaacuucgaugucauuucuuucuuucucaccaaccuccucagcuguccggagggcaguuaccuuuuccucggcuccacagguagcuuggugcccugcagggugccaggcggccccucuccaacaccagccagugcugcgauuugcgcagaccaggcuccggcugcguugaucacaauggcgcauuccacaggcugguacuccaggcugcgguccaucuucaccugcagacaccagagggugaggagugggaaggcccggaccacacaccaggcacccugagagaugcacugcuuccugagccuuaguuuacccauacuggaaagugggucaaagaaaaccaaaacaaggagagucacuaccuucccugucccuccauuuugguaaaggacaucacagacuagaaacuuacauggacuucauggauccuuuucaagaccaccgcuuugucaucuguggucaacaugcguugagaugaagagacaaaaccugcagagaagaaaaugaaaaauaggccguagaggugcugaagaggaaugaaauggggauuucacugguuucuuaaggaaagaaagcuggaaggaugggagcuuucccacagacacugaagcaaacagagaugagggagcuggcaugagcuuggccacacucugacaggacagugcucaggugcaaucaucaagcagaucacaagucacaacgcagaucagugaggagcccaggucaagaugccuaggaccugcucucagggagaccccuuucccccuccagcccuugcuuagcuugugagugagaagauaagaccuagucuaggccuaugccccgguugcuagaggaaacaagcucagacucacgugucaccucucccuggcagaaaaggacucccaaggacuggaccuuucgccgaagccccuggagcagacaccaggggucaaaccaaccuucguccuccaucccugugauaagaaaaagagaacucacaaagagggaugaggacuucugcucuuggauuguauuuccugugccccccaaccccucucuagggcuuguaagccggggaaggucaucuuaaccaacugaaccacagagacaaagccugaugaaggacagagaacuaccacggcccagggcaguucccgugacacaggagggaaguguuccuccuucagcuuggcuguggaguaccgagacucccaacguguagcaccccuuagucuccaucuucaggaaaaaagcuguccccucugcaagcaagccucaccauaagacgccaaagccacucccucuguguuuauccagggaaacuuguuccgaagcugaucaggagacaucagagaaacuuuggcucccuccugccugagauaaacgugugggucgguguaugugugucagagaggggagugugcagggggaugauguauggaccccaacuccacaaguggggaguccagcucagucaugucacuucucugccccaaaugccccuauuuuuccucauugcugagcggcugaagaccaagccuccuagucaggcucuucagccuugacugccuuuccuucccuacucccuugucucccuucagcacacagagcucccugcuaucccagucuauuccaugacuucuuuuuuuuuuuuucaaugagucuggcucugucacccaggcuggagugcaguggcgcgaucuuggcucacugcaaccuccuccucccggguucaagcgauucuccugcuucagccucuggaguagcugggacuacaggcacacgccaccacacccagcuaauuuuuguauuuuuaguagagaugagguuucaccaguuggccaggcuggucucgaacuccugaccucagguguuccaucugccguggccucccaaaaugcugggauuacaggcaugagacacugcacccagccuauuccaugaacuuucacaacaaggugguaaccuuguucccuccacuccugccuggauccaccuccucuccacuccuuguacaauccuguuccugagcacagguaucuccucugggacacugucccucaaaggcagcauagcggacacaccaacagaacacucacaagccagacugcuggcuucaaauaagauccuaccgccaccacuuacuagcgccuuaugccucaguuuccucauauguaaaauggggauguucugaugauuaaaugaguuaauaucuguacagcauuuaggauauuaauugaugucacucugagacuuggguguuuguuaaauaaacauacaaauaaagccucuggccauauugcaucacaaacaugcccacccucaccugaccaugagaaucacuuagagcagggguugccaaauccgaccugcugccuguuuucauaaaugagccacacuccuucauuugcacuuuugucuauggcugcuuucaugcugugauagcaaagugguuggaauagagacuguauggccagcaaaaccuaaaauauauacuaucuggcccuuuacagaaaaaguuugcuaacuccugacuuaagguucuuguuaaaaacccagauuugugggcuccuucccuagagauucugguuuauuaggucugggauguguuccaggugguuuucaugaucugacaaauuaggaagcaccucgcaguguuuuguccauaucugugguacagcacucccagggcauugcaggucuguguauuuucuuccugacacacugagguccuagaccgcagggaucugucuuaucaacuccacuuucucgcuuccuaaccuggugcaggagucacccaacaccuuuggcugccaagcagcuaagaggcugugccaggcacccaccucugcacuuucacguugcucuccauggcugcagcauccuuuucugaagccagcaagagguagcccgagggguugaaccggagguccaggggaggagcaucgacuacggccagguacuccugugugcagacagaagcuccugaaagaaacugacuuaaggaugccagaaagaguuuuccugccuucuucccccacagcuccccaggcucagugccccagaccugcggcaccaccacuaggaagaaggccagggccccccucuccuaguuggcugacccauucuugcucucuggcuaccuugcuagcugggcugcuccccacucugggcuaaaggagggguaaccaccccaacaucccggauaucauugcaccuacauugauguuccguagaaagcuggcugaaaagagggagagcuggauguucucaggcaaugagaacugcugacaaaucccaccuacugagagcccaguggaggccugugaauacuguggaaagacaagaaaaguugagguagaccaguacccuaucacaugugacuagaauacugcaaugaaagcuucgagcuauacaccuaaaguugaaggggaguccuauuugcaagucuauaaucuaagacccauguguaagucaacuugaaggcaaugguguuuaaaaucauuaguaguggaugugcagagcagagagggucagucaucuggaaagagcugacacagugguacaaaaugguaauggccuggaaguccaagggcaggcgauuaacguuugaccuaccauuugggaaaugaaagguuaugauugaaguaaaguagcaagacucguggcuagcuggcaaugcaaacaggaacaccuaaaguguaaaaaccagccggguggguggcucaugccuguaaucccagcacuuugggaggccgaggcgggcugauugcuugaguucaggaaucugagaccagcugggcaacguggcaaaaccccauuucuacaaaaaauacagaaauuagccaggugugguggugcaugccuguggucccagcuacucuggaggcuaaggugggaggaccacuugagccugggagguggagguuauaccguacuccagccugggcaacagagcgagacccugucucgaaauaaauaaauacaauaaaaugcaaaaaaccucagaaguaacgggacccaaaagaagcaaguugagggcugggaaugguggcucaugccuguaaucccagcacuuugagaagccaaggcgggcagaucacuugagguucggaguucaagaccagccuaggcaacauggugaaaccucaucucuacuaaaaauacaaaaaauagcugggcaucagggugugucccuguaaucucagcuacucagggggcggaggugggauaaucacuugaaccugggagguggagguugcagugagcugagauugugccauugcacuccagccugggugacagagcaagacucugucucaaaaaaaaaaaaaaaaagagaaaauugagacacuuaauuauagcuugaaugcaggcucucaugaccagagcuaugagaucucgaaaaauccaauauggugauaucugcuuucaaaagaacaaaccuuauugccaagcuuccugguucgacugaggaagauccuaggaaaauuucucaacaaaguccaaagcacaaucucuguccguuggacccuccgagauugaggucuuccccuccucuccuucccuugucgcuagaguccuuaauaaaaugagucaucuuucuugccccacucaugacucugcccuaccccagaccucaccguguggucccguuccaccacuagcacucgaauagcaccucgucugcucuccagcuucuucagccaauaggccacagacaagccaagcaccccaccucccacgaucaccacauccgagugcucgggaggcagguggcuggugucuugcaguagaucacaggaccuuccaggcaggaucgacuugaucuucuucuuaaucucagacaccuuuccaucccagucugugggauguaguuagggucagagggccaaacauuuccuucccacaugguugggggguuggaggaugggcacaggaaaaggugagcuaaacagacacaugaguuggcaguccccacugucagcccaucucauaaggucaccuugcacccaacaguguugccacaguuuucugaauaguccacaugccaucagucucuucaugcauugugccaagcacugcaagauucaauuuccuaaaauuaauuuucuacauuaccuccugcauagaccucuccugaucccaacucacauauucaacugcacugucauccccacuugggucuuccaggccuuggaccaagaggcccuggcacaccccaagucacggcacccucugaagcaugucaccgcuaagcggugccaugcuuauccuggauauccaucaccaccaccaaaccuacauuuauauccuauccauaaucaaguucugcgggcuccggcuuccaaguaacuccucaaucuguccccuuucuuccucugccaccaucauccuaggccaagccacuaucaucucucaacuggacaaaugcaaaagcauccuaacuguucccacugauuccccgcuuccauccuacccccugcugugaacauguuuacaauauagcuagaaauaucuuuucaaaacacaaauuuaaucacaaacccucuugcuuaaaacccuccaaugaguuuuccauuacucuaagaaccaaaguccaaagacuuaaacacagccuguaagauacugcacaaucuggcuucuguucaucuuauccuccccuacacuccaggcccuuuaguuccuugauggcaccuuauuuccucccaccacagggaaccuacauaugcucucugcuuuuaaacuguguccacuuccuugccuaguuaauuccuugcuugggaaagccuuuccugacccccagaccaggucaaacucuacaugaucucuuggacacaacugcaguuuguauuguuacauacucuaaaauccaugaggggggaggcuguguuuaccuucaccacugaaucuccagccuaucgcaacacccggcauauucuaagugcucaguaaguaucuuaaauaaaugaauccuuuugccauuucauaccucacucaaacucuucucagcagcacuggaaucuuucuuuggucuggccuuagcuuaccuguccacacuacauuucaugcuacuacucacaccgucuaucuagauggcuuuugccaguuccuugcauaagaacaauauuuuucuccuagucugcacucaguuauuuagagacuggaacacacaccuuucuuaagccaguaaacauccuccaaggcugaucucaguucccaccugcuccauguacuucuaccguuauacuagcuagcagugcaaagcauuaaguugaguucuagcuaaucuuuuuuuuuuuuuuuuuuuuuuugagacggaguuucgcuaagucgcccaggcuggagugcaauggcaugaucucggcucauugcaaccuucgccuuccggguucaagcgauucuccugccucagccucccgaguaccugggauuacaggagcccaccaccacaccuagcuaauuuuuguauuuuuaguagagacgguguuucaccauguuggucagguugcucucgaacucuugagcucaggugauccacccgccucgaccucccaaagugcuaggauuacaggccccgcgcccggccucuauccagucuugaacuggccuacugucuauugaaauuuucccucucuagguacacucuagccauuuuccagaacauucacugaaucccgucuucucuucacuccuuuaccgcaacagcacuaaguacagcauccugaacacgggcaggacuuaaugcacaucugugccaccgauuaucaaucagucugacuguaagcuuaaauggagaaugaugugagaccugccaccugaaaagggccgccuugggagccauacaccugcacagccccuacaagcucugguagguaagcuaacccccuuccccaagccgacccacuguccugccagugugggccaugguuucggguccugaaggacacacagucggagguuggggacaacccagaaccacaauacccucugucguccucaacuuuacccagagaaaagccuccucugcgcgugccuggccuccgggucaagaggccccggcccaugccgugcggcagaacccuccgaaucauaaccccucugagcccggacccucugaaagcugcacugcugccucgcuauuaucgcagccgucacugcuccgcgccaaacgccauucagacgagcgcgccaauuggccagcggcccucagggcucugccccgcccaaugcucuagguggccgucuccccgugaccucuccu

SEQ ID NO: 15914 - RNA, 9150 nt, Homo sapiens
aggagaggucacggggagacggccaccuagagcauugggcggggcagagcccugagggccgcuggccaauuggcgcgcucgucugaauggcguuuggcgcggagcagugacggcugcgauaauagcgaggcagcagugcagcuuucagaggguccgggcucagagggguuaugauucggaggguucugccgcacggcaugggccggggccucuugacccggaggccaggcacgcgcagaggaggcuuuucucuggguaaaguugaggacgacagaggguauugugguucuggguuguccccaaccuccgacuguguguccuucaggacccgaaaccauggcccacacuggcaggacagugggucggcuuggggaaggggguuagcuuaccuaccagagcuuguaggggcugugcagguguauggcucccaaggcggcccuuuucagguggcaggucucacaucauucuccauuuaagcuuacagucagacugauugauaaucgguggcacagaugugcauuaaguccugcccguguucaggaugcuguacuuagugcuguugcgguaaaggagugaagagaagacgggauucagugaauguucuggaaaauggcuagaguguaccuagagagggaaaauuucaauagacaguaggccaguucaagacuggauagaggccgggcgcggggccuguaauccuagcacuuugggaggucgaggcggguggaucaccugagcucaagaguucgagagcaaccugaccaacauggugaaacaccgucucuacuaaaaauacaaaaauuagcuaggugugguggugggcuccuguaaucccagguacucgggaggcugaggcaggagaaucgcuugaacccggaaggcgaagguugcaaugagccgagaucaugccauugcacuccagccugggcgacuuagcgaaacuccgucucaaaaaaaaaaaaaaaaaaaaaaagauuagcuagaacucaacuuaaugcuuugcacugcuagcuaguauaacgguagaaguacauggagcaggugggaacugagaucagccuuggaggauguuuacuggcuuaagaaagguguguguuccagucucuaaauaacugagugcagacuaggagaaaaauauuguucuuaugcaaggaacuggcaaaagccaucuagauagacggugugaguaguagcaugaaauguaguguggacagguaagcuaaggccagaccaaagaaagauuccagugcugcugagaagaguuugagugagguaugaaauggcaaaaggauucauuuauuuaagauacuuacugagcacuuagaauaugccggguguugcgauaggcuggagauucaguggugaagguaaacacagccuccccccucauggauuuuagaguauguaacaauacaaacugcaguuguguccaagagaucauguagaguuugaccuggucugggggucaggaaaggcuuucccaagcaaggaauuaacuaggcaaggaaguggacacaguuuaaaagcagagagcauauguagguucccuguggugggaggaaauaaggugccaucaaggaacuaaagggccuggaguguaggggaggauaagaugaacagaagccagauugugcaguaucuuacaggcuguguuuaagucuuuggacuuugguucuuagaguaauggaaaacucauuggaggguuuuaagcaagaggguuugugauuaaauuuguguuuugaaaagauauuucuagcuauauuguaaacauguucacagcaggggguaggauggaagcggggaaucagugggaacaguuaggaugcuuuugcauuuguccaguugagagaugauaguggcuuggccuaggaugaugguggcagaggaagaaaggggacagauugaggaguuacuuggaagccggagcccgcagaacuugauuauggauaggauauaaauguagguuuggugguggugauggauauccaggauaagcauggcaccgcuuagcggugacaugcuucagagggugccgugacuuggggugugccagggccucuugguccaaggccuggaagacccaaguggggaugacagugcaguugaauaugugaguugggaucaggagaggucuaugcaggagguaauguagaaaauuaauuuuaggaaauugaaucuugcagugcuuggcacaaugcaugaagagacugauggcauguggacuauucagaaaacuguggcaacacuguugggugcaaggugaccuuaugagaugggcugacaguggggacugccaacucaugugucuguuuagcucaccuuuuccugugcccauccuccaaccccccaaccaugugggaaggaaauguuuggcccucugacccuaacuacaucccacagacugggauggaaaggugucugagauuaagaagaagaucaagucgauccugccuggaagguccugugaucuacugcaagacaccagccaccugccucccgagcacucggauguggugaucgugggagguggggugcuuggcuugucuguggccuauuggcugaagaagcuggagagcagacgaggugcuauucgagugcuagugguggaacgggaccacacggugaggucugggguagggcagagucaugaguggggcaagaaagaugacucauuuuauuaaggacucuagcgacaagggaaggagaggaggggaagaccucaaucucggaggguccaacggacagagauugugcuuuggacuuuguugagaaauuuuccuaggaucuuccucagucgaaccaggaagcuuggcaauaagguuuguucuuuugaaagcagauaucaccauauuggauuuuucgagaucucauagcucuggucaugagagccugcauucaagcuauaauuaagugucucaauuuucucuuuuuuuuuuuuuuuuugagacagagucuugcucugucacccaggcuggagugcaauggcacaaucucagcucacugcaaccuccaccucccagguucaagugauuaucccaccuccgcccccugaguagcugagauuacagggacacacccugaugcccagcuauuuuuuguauuuuuaguagagaugagguuucaccauguugccuaggcuggucuugaacuccgaaccucaagugaucugcccgccuuggcuucucaaagugcugggauuacaggcaugagccaccauucccagcccucaacuugcuucuuuugggucccguuacuucugagguuuuuugcauuuuauuguauuuauuuauuucgagacagggucucgcucuguugcccaggcuggaguacgguauaaccuccaccucccaggcucaagugguccucccaccuuagccuccagaguagcugggaccacaggcaugcaccaccacaccuggcuaauuucuguauuuuuuguagaaaugggguuuugccacguugcccagcuggucucagauuccugaacucaagcaaucagcccgccucggccucccaaagugcugggauuacaggcaugagccacccacccggcugguuuuuacacuuuagguguuccuguuugcauugccagcuagccacgagucuugcuacuuuacuucaaucauaaccuuucauuucccaaaugguaggucaaacguuaaucgccugcccuuggacuuccaggccauuaccauuuuguaccacugugucagcucuuuccagaugacugacccucucugcucugcacauccacuacuaaugauuuuaaacaccauugccuucaaguugacuuacacaugggucuuagauuauagacuugcaaauaggacuccccuucaacuuuagguguauagcucgaagcuuucauugcaguauucuagucacaugugauaggguacuggucuaccucaacuuuucuugucuuuccacaguauucacaggccuccacugggcucucaguaggugggauuugucagcaguucucauugccugagaacauccagcucucccucuuuucagccagcuuucuacggaacaucaauguaggugcaaugauauccgggauguuggggugguuaccccuccuuuagcccagaguggggagcagcccagcuagcaagguagccagagagcaagaaugggucagccaacuaggagaggggggcccuggccuucuuccuagugguggugccgcaggucuggggcacugagccuggggagcugugggggaagaaggcaggaaaacucuuucuggcauccuuaagucaguuucuuucaggagcuucugucugcacacaggaguaccuggccguagucgaugcuccuccccuggaccuccgguucaaccccucgggcuaccucuugcuggcuucagaaaaggaugcugcagccauggagagcaacgugaaagugcagaggugggugccuggcacagccucuuagcugcuuggcagccaaagguguugggugacuccugcaccagguuaggaagcgagaaaguggaguugauaagacagaucccugcggucuaggaccucagugugucaggaagaaaauacacagaccugcaaugcccugggagugcuguaccacagauauggacaaaacacugcgaggugcuuccuaauuugucagaucaugaaaaccaccuggaacacaucccagaccuaauaaaccagaaucucuagggaaggagcccacaaaucuggguuuuuaacaagaaccuuaagucaggaguuagcaaacuuuuucuguaaagggccagauaguauauauuuuagguuuugcuggccauacagucucuauuccaaccacuuugcuaucacagcaugaaagcagccauagacaaaagugcaaaugaaggaguguggcucauuuaugaaaacaggcagcaggucggauuuggcaaccccugcucuaagugauucucauggucaggugagggugggcauguuugugaugcaauauggccagaggcuuuauuuguauguuuauuuaacaaacacccaagucucagagugacaucaauuaauauccuaaaugcuguacagauauuaacucauuuaaucaucagaacauccccauuuuacauaugaggaaacugaggcauaaggcgcuaguaagugguggcgguaggaucuuauuugaagccagcagucuggcuugugaguguucuguugguguguccgcuaugcugccuuugagggacagugucccagaggagauaccugugcucaggaacaggauuguacaaggaguggagaggagguggauccaggcaggaguggagggaacaagguuaccaccuuguugugaaaguucauggaauaggcugggugcagugucucaugccuguaaucccagcauuuugggaggccacggcagauggaacaccugaggucaggaguucgagaccagccuggccaacuggugaaaccucaucucuacuaaaaauacaaaaauuagcugggugugguggcgugugccuguagucccagcuacuccagaggcugaagcaggagaaucgcuugaacccgggaggaggagguugcagugagccaagaucgcgccacugcacuccagccugggugacagagccagacucauugaaaaaaaaaaaaagaagucauggaauagacugggauagcagggagcucugugugcugaagggagacaagggaguagggaaggaaaggcagucaaggcugaagagccugacuaggaggcuuggucuucagccgcucagcaaugaggaaaaauaggggcauuuggggcagagaagugacaugacugagcuggacuccccacuuguggaguugggguccauacaucaucccccugcacacuccccucucugacacacauacaccgacccacacguuuaucucaggcaggagggagccaaaguuucucugaugucuccugaucagcuucggaacaaguuucccuggauaaacacagagggaguggcuuuggcgucuuauggugaggcuugcuugcagaggggacagcuuuuuuccugaagauggagacuaaggggugcuacacguugggagucucgguacuccacagccaagcugaaggaggaacacuucccuccugugucacgggaacugcccugggccgugguaguucucuguccuucaucaggcuuugucucugugguucaguugguuaagaugaccuuccccggcuuacaagcccuagagagggguuggggggcacaggaaauacaauccaagagcagaaguccucaucccucuuugugaguucucuuuuucuuaucacagggauggaggacgaagguugguuugaccccuggugucugcuccaggggcuucggcgaaagguccaguccuugggaguccuuuucugccagggagaggugacacgugagucugagcuuguuuccucuagcaaccggggcauaggccuagacuaggucuuaucuucucacucacaagcuaagcaagggcuggagggggaaaggggucucccugagagcagguccuaggcaucuugaccugggcuccucacugaucugcguugugacuugugaucugcuugaugauugcaccugagcacuguccugucagaguguggccaagcucaugccagcucccucaucucuguuugcuucagugucugugggaaagcucccauccuuccagcuuucuuuccuuaagaaaccagugaaauccccauuucauuccucuucagcaccucuacggccuauuuuucauuuucuucucugcagguuuugucucuucaucucaacgcauguugaccacagaugacaaagcgguggucuugaaaaggauccaugaaguccauguaaguuucuagucugugauguccuuuaccaaaauggagggacagggaagguagugacucuccuuguuuugguuuucuuugacccacuuuccaguauggguaaacuaaggcucaggaagcagugcaucucucagggugccuggugugugguccgggccuucccacuccucacccucuggugucugcaggugaagauggaccgcagccuggaguaccagccuguggaaugcgccauugugaucaacgcagccggagccuggucugcgcaaaucgcagcacuggcugguguuggagaggggccgccuggcacccugcagggcaccaagcuaccuguggagccgaggaaaagguaacugcccuccggacagcugaggagguuggugagaaagaaagaaaugacaucgaaguuggauagcguguguguguguguguguguguguguguggggugugggguggacaggguuggggaggguugccggccaugcuguuucugcaguucguaaccgcacugguuguggcagguauguguauguguggcacugcccccagggaccaggccuagagacuccgcuuguugcagacaccaguggagccuauuuucgccgggaaggauuagguagcaacuaccuagguggucguagccccacugagguaagcugaguggggugggacaugcuggcaaggagacauagaauaauugucacgaaacaaucaggcuuuuggccaggcacaguagcucaugccuguaaucuuggcauuuugggaggccaaggcagguggaucaccugagguuaggaguuugagaccagccugaccaacauggcaaaaccccgucucuacuaaaaauacaaaacuuagcugggcguggugcugggcgccuguaaucccagcuacuugggaggcugaggcaggagaaucacuggaacccgggaggcugagguugcagugagccaagauugcgccauugcacuccagccugggcaacaagagcaaaacuccaucucaaaaaaaaaaaaaagaaaaagaaucagccuuuuuuggggggcugugugcuguguuaauugauauuagagcccccuccagauuugaacugggaccauuucuccccauccccuaccugcacagggauuguuaaacaagucugggccuguccuugugucccaggcaauguaagcguuguccccaccucucacuccagcaggaagaaccggacccggcgaaccuggaaguggaccaugauuucuuccaggacaagguguggccccauuuggcccugagggucccagcuuuugagacucugaagguaacuggcaagggcugguuuuccuuuuuauuuuuggacauuggaugggacagaugacaguggagcacauugguccccucggacccgugacugccguagucccuccaugucacaacugcuaaggaauuucuuggacacaucccaucccauagaccccucagcagcagguagaggguacucugugcugagcccugaggggagugaggauggaguguggcuacagccuucccgagaaccccaguguuuugugcacccgcagguucagagcgccugggccggcuauuacgacuacaacaccuuugaccagaauggcguggugggcccccacccgcuaguugucaacauguacuuugcuacuggcuucaguggucacgggcuccagcaggccccuggcauugggcgagcuguagcagagaugguacugaagggcagguuccagaccaucgaccugagccccuuccucuuuacccgcuuuuacuugggagagaagauccaggagaacaacaucaucugagcaugugugcucugcacuggcuccacuggcuugcauccuggcuguguucacagccuuguuugcugcuuccaucuuccccaguacugugccaggccuucucccccuccccaguguccucuccucucaggcaggccauugcacccauauggcugggcaggcacaggcagugaggccgaggccaauagcgagugaugagcgggauccuaggacugaucuguagcccaugcugaugucacccaccagggcaauccaucuggaggccugagcacccuggcccaggacuggcuucauccuggcacugaccaggaaagacugccucugacccucuuagcagacagagcccaggcaugggagcacucuggggcagccuggcucagguuuauugauuuucgucuguuuacccuauccauuaaucaauacauguaauuaacuccuucccuccagucuucugucucuucuuuucauuguacagcaggagcuuuugaagcaccccauua

SEQ ID NO: 15915 - RNA, 423 nt, Homo sapiens
gccuuccgccacggccgccauggagagcagcagccauggcucugcgcuaccuuauggccgugggccucaacaagggccacaaggugaccaagaacgugagcaagcccaggcacagccgccgccgcgggcgucugagcaaacgcaccaaguuuguagcgggacaugauccgggagguguguggcuucgcuucguacgagcugcgcgccauggagucacugaaggucuucaaggagaaaugggcccucaaguucaucaagaaaaggguggggacgcacauccgugccaagaggaagcgggaggagcugagcaagguacuggcugccaugaggaaagccgcugccaagaaagacugagcccccuccccugcccucuuccugaaauaaagaacagcuugacggaaaaauaaaauaaaaauaaaaaau

SEQ ID NO: 15916 - RNA, 1300 nt, Homo sapiens
ucaguuuguaagaucccuagauucccaagggagcugggaaaccucacuugggucuaaaaggucauuuaagggccgcuuccagaccuggcucaugcucccgauugguggugggggguggaggggugcuggcugggauuguggucacugaagagggucaggagcaagggucauuggguagaacggcucccuuugucccacuaggccacgaauugguucuggcauucccaaggggaaugcuccaagccaaguaagggccacuguguccagguggaccauucccaaacccauuucuaucauggaucauuuuccagaaacuuuccaacaugggaaaucacaacugaagcugguuguuuagaucggaaaaucuggguguagugucauuagaaaaaccagagucuccucacaugaaccuuugccugcaaccucucccuggccugccugcugcucucugccugagucacaacagcauucaacagcuuggacacagagcuuuacaaugugccaagugcucccacgugcccuguggcauuuacuccgccuagcagccuggagagauaaguuaguguuagcuccacccagcagaggauggaagcccugggaagucaccggccucacugagguuguacaggcaguagguggcaggacuugaaaucucgcguccuuuccacggaaucuuuucugccagcaacccagagagugcagggggaauccaaacagucuggugggcaccaacugucuuggcuggcuuccagcugggccuuuaguggugacuuuggcacgcccgccccccccaacccucugucaaucuuuaggagcugggggaauagggggugcuuucuaggaggcucugcucucuucugagaugucccccuuacuuccuuccauucucucaggugugggagucacuuuucugugugaauaccaggccaaacuuguccuuuucuuccuuuucucagagucaccugccccaaagcgccccuguuccucccucccuucucugccucuucccccgggauaccuugcccuugcuucgggaguggaggcaguguugccccagcagaggcaccggcacugccaggguguccagcuuugcacacggccucaggcgcccucacguuagcuuuggcuucuugauggaucuugaacucccuugggaugcuuugugggcuccugaaggaccucccaggauguccccucuguccucagaccugcuaugugaccucaaacaggaauucagacucuucuuggccuucgcguuccagagcagaaggauaugggugcccaaauccagacucggaga

SEQ ID NO: 15917 - RNA, 1300 nt, Homo sapiens
ucuccgagucuggauuugggcacccauauccuucugcucuggaacgcgaaggccaagaagagucugaauuccuguuugaggucacauagcaggucugaggacagaggggacauccugggagguccuucaggagcccacaaagcaucccaagggaguucaagauccaucaagaagccaaagcuaacgugagggcgccugaggccgugugcaaagcuggacacccuggcagugccggugccucugcuggggcaacacugccuccacucccgaagcaagggcaagguaucccgggggaagaggcagagaagggagggaggaacaggggcgcuuuggggcaggugacucugagaaaaggaagaaaaggacaaguuuggccugguauucacacagaaaagugacucccacaccugagagaauggaaggaaguaagggggacaucucagaagagagcagagccuccuagaaagcacccccuauucccccagcuccuaaagauugacagaggguuggggggggcgggcgugccaaagucaccacuaaaggcccagcuggaagccagccaagacaguuggugcccaccagacuguuuggauucccccugcacucucuggguugcuggcagaaaagauuccguggaaaggacgcgagauuucaaguccugccaccuacugccuguacaaccucagugaggccggugacuucccagggcuuccauccucugcuggguggagcuaacacuaacuuaucucuccaggcugcuaggcggaguaaaugccacagggcacgugggagcacuuggcacauuguaaagcucuguguccaagcuguugaaugcuguugugacucaggcagagagcagcaggcaggccagggagagguugcaggcaaagguucaugugaggagacucugguuuuucuaaugacacuacacccagauuuuccgaucuaaacaaccagcuucaguugugauuucccauguuggaaaguuucuggaaaaugauccaugauagaaauggguuugggaaugguccaccuggacacaguggcccuuacuuggcuuggagcauuccccuugggaaugccagaaccaauucguggccuagugggacaaagggagccguucuacccaaugacccuugcuccugacccucuucagugaccacaaucccagccagcaccccuccaccccccaccaccaaucgggagcaugagccaggucuggaagcggcccuuaaaugaccuuuuagacccaagugagguuucccagcucccuugggaaucuagggaucuuacaaacuga

SEQ ID NO: 15918 - RNA, 30959 nt, Homo sapiens
uacaaagcacucugcuucaccgacugugauccucacaguccuguccgguggccucacgcagguggcggugcagccuuucaggcccagagcggccaggagcgaagcccgcagccccgccuggaagcgcagcgcggucggucgcgcgccccugaggcuuggaggccugggcuucccccagcagcgcucgagcaccgcccagucgagccucacaccggaugccacuucauauuugggcccagagcucaauucgcgccgaugcgguccgccguccuuaaaucucuucagccaggaucucuccccgacugcaaagcagcccugggcgggagcggcaacaucuccacgucacccuuuuggagccgccgacauucagaggggcaggacacgggaacgcgcgcugucuugcuuuacggcgcgggugcgcgaguuugcggcagcgugacgcccucaaguuuuggcgggaaaagcgcugcauuuggauuccugcaguggugggcaaaggacaguccggugaggaagggcggccgguagaguagggaagguuucuaaagaaggaguucggggucuagauuagugagggagggcauggugggagaaaguuagcauugacuagcgcaggggauuggagagacuccugcggaggggcgguuucggaggguggaggaaugguaccaggagguucccguugugggggcgggggcaggagggacuaacccgcugcuagcuaagaaccccaaggaagagucccagcccuuccuuucgccucugggggcaguuuggccccgccccggccuuugggacggguggggcuguggauggggaugggaauuggaauugagcaauugggaggaggcgcugccgcaggcguuuucugccccauaccgcucccuauauccucuuccucucuuccccagacccccaccucucccuccuccuuccccagucguucgccggaaagcauuugucucccaccucuucauaacaacaauuaauuuccucuggggccugaggagggcagaauuucaaccuucggugugcuugggaguggcgauugugauuuacacgacaaaauggucagguuuagaauaguuguucgugguugaaagacuuggauaaauguggaugagauagaaggggaaggcaagagcuguuaauuuucgugggcaauccuggggagaggcggggcucaguggcuucacuggugaucuuacacucuacaucuuuucuggauuccugccuuuuacagccgaggugcucgguggagucauggcagugcccuuuguggaagacugggacuuggugcaaacccugggagaaggugccuauggagagugaguucuuuuaagcuugccuucguuuucugagugcauauucauuguuuuggagucucacacucuggugauuuagaaaguagauguuugagauccaaggguuuuggcaacugaaguuacacagccuuuugcuaggauuaaaaauuuuuuccuucccuuuaaaaaaaaaaguuuucuuuguagagagcuggaagggacacgaaguuauuguuuccaugcccacaaauggcuucucaggguuuaagcauugcgguuaaugagcaaaugagcagacucuggagauugccugccugguuucagauccuugcucuaucacauacuggucauuguuuugugaucuuaggcaagcuucuuaaugucauuguguaccucuccuucacuaccuuuaggguggcaauaaucgcaucuaccccauaggagcuuaggacagucaguuacacaagcacauauaguaugggauuaaugcucuuaaaaguauaugaguagaacauguauauaugugauguggcuuagaauuaucucaaucuauuuuaugaagcguuuauuaaaugacuugugugacagcauaaugacgucuuuggaggguuagcuauuguauuucacauuuuagaaaagaguaguguguguugagaacauagcagaaaccacuuccuugguuucuccuuuguggaaaaaguaauagagguaaaaucguuuuggaugagucauguuuaaucuuuggaaguuuuagaagaaauggaauucuguaauguuaaaacucuuuuccuuuuuagaguucaacuugcugugaauagaguaacugaagaagcagucgcagugaagauuguagauaugaagcgugccguagacuguccagaaaauauuaagaaagagaucuguaucaauaaaaugcuaaaucaugaaaauguaguaaaauucuauggucacaggagagaaggcaauauccaauauuuauuucuggaguacuguaguggaggagagcuuuuugacagaauagguauggaagaaauuuaagauaauuauuuuaaacaaguuuuuaaauuuguuuuuuaaaucuugggcaugcuauuuggucguuguccuuucaaaauugcucaugcaacugugaaauuggaauacauuaucuuuaaaaaauuuuuccaccugguguuaauaacauaaaagcauauauagagucaaugaaagaaaacuucuuucccaaguuauauaagugauuuugauuuaagauuggugucuuacagaauuuaagagugacaaacaaguuuuaugguacaucauaaaugcaguguauccuaaaugcaauguauugccuacacaauuuuuucuuuguagacauucuaguuacaugaaaucauuguauacauuuuauacauuuacagaucuaaaauagcaugcuguuuccucuugguuuacaugaaauaauugagaauuuucuaggauugcuuuuuguauauuaaguaaauucuauguuugcuauuaauacuuaaauauucgauguagaaucaaaggauugauauuucagaacacugagaaguacauaaaaucuggaucuaaauuuauaauuuaaauuuauaauuuaaagcuauuguauuaaauaaguuuaucaguuaaaaacugauaaagagguauuaggaucuccagugugacucaggagagaguugaggguaaaagaaauggaguuaaugagagagaucaaaauauaaaaagauaacugauaaaagaacuuucauaauaaaacuguuucacgaaggaccucacaggcauuugugguuuuguacugugagacuauaugaaguuuaaaucugagccagguguggugguacaugccugcaauccuagcuacuuaggaggcaggaggauugcuugagcucaagaguuccagguuacaguaaguuaugaucucacgccagggcacuccagccugggugaaagaacaagaccguaucucuaaaaaaaguuaaauuauaaaagaaguauaaucuguaaaauauuuagugaaauuggcuuagauuugcccagacuuccccuuuggcauuauauuucaggaaugagaaaaauaauuagcauagcauuuagaagaaauggggggaauuucaagguuacuaaauaaaucaggguuaguauaagaggaagcagaggcuuugaagucauggcuugcauucuugauuuggauauugguuuucucuuuauaauuuuucugugaugacgccuuuugccaccuaacacagguaaaugugaguuaagccccauauguguuaguggacuccugaaucuuuuguuggcauuugcuucuguuugccuaagcacauuuguaaaugucuaagcuucaaauuaagaagcuaugugguugcuaccugauuauauuuagucaauaaacuuacuuucauauuuguuuuagagccagacauaggcaugccugaaccagaugcucagagauucuuccaucaacucauggcaggggugguagguauaguugucuauuucccuuuuacuuaaaauuagagugaauacauuacauuaccaaauucuaguguguuucucucugcaucccucuuagguuuaucugcaugguauuggaauaacucacagggauauuaaaccagaaaaucuucuguuggaugaaagggguaaguuuagcauuuuaucacuaccuaaaauaaaauaaaauaauuaccuaaauuauuuuaauuaccuaauuauuuuaauauagccauacaaggcaaaaucaagucuuuuugcauuacuggaauuucaagacaagaucugaaaaaucaaggaaauuuuggagacuucguauauuuggaaaucacaagucucauuuugcaauacaagugcggaucagguagagaaaucugaccuaggugcaagccuagcucacuauauguauaagaauaauuuuuuuuuuuuugauacaggcucacuguguuguccagucuggggugcacuguauuaucacaguucacugcagccuugaccuccuaggcucaagcaauccuaccaucucagcuucccgaguagcuaggaccaaccacaggcaggugccaccaugccuggcuaauuuuugauuuuuugaagagguggagucuuccuguguugcucaggcuagucuugaacuccuggacucaagcaguuuaccagccuuagccucccagaguguugggauuauagacgugagccaccaugccuggccaagaauaguuuaaaauaauccuuuaauggauuaauaaagggaaguuccuguggaauacccuggaccuuagucuuguccuguucacucuuuuuuuauguaugacguggauaaaaauguaagaaauuuaguuauauuuucugaaugucaucaaauugagaaggauggauagcgaaagcuuuaagcuuacagggucagaaucaaaaaagaaaugucagcuguaugaggcaguaguuuuugucugguuuaaugcuuuauucuuaguauuagaauagugcuuaacaaauggucagcuuuuuuuuuuuuuugaaacagagucuugcuguguugcccaggcuggaguguagugacaugaucucggcucacuguaaccucuaccucucugguucaggugauucuugugccuuaggccccugaguagcugggauuacaagccugagucaccacaccuggcucauuuuuauauuuuuaguagagaugggguuuugucauauuggccaggcuggucucgagcuccuggccucaagugaucugccucccuuggccucccagagugcugggauuauaggugugagccgcuguacccagccuauacaugcuuuuuucuuaugugcauauggauuuuacuuuuuaccccuuuaaacugaguuuauaugacauaaaaaucuuuauuuuuauuuaaaacuuuaaaaauucagguacacaaaaauucuuauguauuauaaugaaauguaaauauauguauaucaacccaccugguuuaaaaauacaacauuauucguauauaagaaugcucacaguggugauguuuuuaauauagcaggaaacuaacccaaaugucugucaacaauaaauuaugaaaugcauggcuuuucaagccaugucacaagcagugacacaagcaugucacaagcagugacauggaugaauuucagguauauaaugauguagagcaaaaagagacaguugcaaaagaauucauauggucugauucuguuuauacaaaguucaaaaauauguaaaaccuaguauauuguucaaguauguaaacauggagaaaaaaacaugcagaaaagcaaggguauaauaaaaccaaauucagaauggucuaagaaaguaggggagggaauguauuuaaggaaguauuuaaagauuucaaaggaaauagagcauuguuuuucuaaagugaguggguguuuauuacauuguuauucuuuauaucuuguauuaauauacaagauauaauucuuuguuucuauuuaauauuuaggagucuuuuaaaaaaagaaauaaaauguuaccaguauuuaauguccuccuguuuauuucaucacaaauauauucuuccuuuguuuuucuaagagcuaaacacauuccuacauuuaaauuuuauuaugugcaguucucuaacauagcugaguauuauguugcagacauaacaaaguccaaggaauacuauaguuauccauuaguauuuuaagugauuacuacucauaaguaauuugaaacucaaucucagugguuuguccaauagugucauauuuaacuacugaaaagauaaucaacugggugcaguagcucaugccuguaaucccagaggcugaggugggacgauugagugauucuaggaguuugagaccagccuagacaacauagacccugucuuuaugaaaaauuaaaaaaaaaaauuagcuagacaugguggugcacaccuggagucccagcuacuuggaaggcugaagcaggaggauugaucacuucagccuaggaggucaaggcugcaguaagcugugaucacaucacuacacucuagucugggcagcagagugagacacuuucucaaaaaaaaaaaaaaaaaaaaaaaaaaaggguaaucacaguagcuaccuccuaagucagauagagguaaacauuucauugguuuacauauugugugaauguacuugauuuuuaaagaaaucaguccccuauuuugagacauuuaaguuguuucuaacuuauaaaauaggacagugauggcuucuaucaauuuguguaaaaggccaauauaaaaauugcgucaugcuauaauauuuuuuaugcuauaauauuuuuuaugccauuagccuuuuugucccacuuacacacuauuucauguuaguauguauagauauaccuuguugauuguuuucaaaaccuaccuccacauuuuccauuguacaaauuuggacauuuauuuacaaauaauauugcuaugaauauucuuauguuuaugaauuugugggauuauuucuauggauauagaagugggaauugcuaguucaaagagugaauguuucacaguuuaguauguuuugccaaauugcccucugauaauagagggccuuuucuaacucuuaagacuggguuacauuccuuugcucuaagauccuauagugcucuauauuuuuauaaccuucauaacaguuuucuauugucagucuucacuaauuuaucuauuaccugcauuggcuggcauagugucugucacuaaguuacaguagauauucacuaaacauaaguuaaguccugccugcaguuuuuguguguugaagaugggaaguuaggguggaaguugggucuucugauauuuuuuuuuuguacagaguuuguccucuuuuucucagacucucuacuuugaagaaaaaaauuacugugguuuguugaauuuuggugugucuucacauauuuucuucugccaacuggguuuguuugcugcugagaaaguugugccuaacauacuacugauguuuccuuccugcccuccacccuaccugaugaggggccuugcuuuacuuucaucucagguuuagagugcucuuuuccagaagggcagccccuucugacuccagccucuuucuuuaaucugguccagacuguucuguguguugauaauacuucuuuuaaguuaauagaagaggugaggccuuuuucuacuuuuagcauagaugaugauuuauuuuauuuuuuuaaauuucuuuuugucuauuuugcuuauuuuaagagaaguucuacaaaccuuaaguaacaccagugauuuuuuuucaguaaaacuuaauuccuguaaguauaucuauuugcaaaacauuuuuauucagugucaucuuuuuuucuuuugguuuagauaaccucaaaaucucagacuuuggcuuggcaacaguauuucgguauaauaaucgugagcguuuguugaacaagaugugugguacuuuaccauauguugcuccagaacuucugaagagaagagaauuucaugcagaaccaguugauguuugguccuguggaauaguacuuacugcaaugcucgcuggagguaagagcuauuuaaucaugguaaaacuccuauaaaaagucagauuaguuauacugaaauaaaugaaauaaaccaaggaauucauguuuauauaauaguuuuuguuuucuuuuuuaagagacagggucucacucuuggccagacuggaguacagugagcuguuauagcucacugcagccucaaacuucuaggcucaagcaauccucuggccucacucuuccaaguagcuaggaccaguggugccugccacaagacaucuggcuaaguuuuaaaaauucauuguagagaugggaucuugcuguguuguccaggcuggucuuaaacaccuggucucaagcaagccuucugucuuggucuccaaacuguuaggauuaaaguaaagacaugagccaugguacccagcuuuuauaguaguauuuuaauagugucuugaucgguuugguaacugcuguaacaaaguaucauagacugcauagcuuauaaacagcaaauuuauuucucacaguucuggaggcugaaaauaugagauuaggggugccaaccuggucauguuuuagugagggcccucuuccugauuugcagauggcugucuugcugugcucucucaugguggacagccaagagagcagaagcaagcucuauugugguuuuuuuuuuuuuuuuuagaccagagucuugcucugucacccacgcuggaguacagugaugugaucucagcucacugcaaccucugccucccagguucuagcaauucugucccaggcucccaaguagcugggauuacaggcaugcaucaucacacccggcuaauuuuuguauuuugaguagagacaggguuucaccauguuggccagacuggucucaaacuccugaccucaagugaucccccaaccucagccucccaaagugcuguuuuuuggguuuuuuguuaaaugaccagauguugugagauauugugucuguuuuuuguuuuuuugugguuuuuuuugagacagggucucacucuauugcccaggcuggagugcaguggcacaauucaaggcucacugcagccuugagcucccaggcucaagcgauccuccugccucagucuccucaguaucugggucuacaggcgugcaccaccacaccuggcuaauuuguuguggguuuuuuuucacagacggucucuccauguuacguaggcuggucuuaaacuccugggcucaaguaaucugccuaccuaagccucccaaagugcugggauuauauaauuagugcccuauaaagauacaauauuguccgggcacacaagcccuuauuagacauuaauaagcucuuaauaagagcacuaauaccauuuuuugaguggucccaucaccaggaccuaauuacgucucaaaggccccaccuccgaaugccauugcauuaugaguuaggauaucaacaugacuuuugagggggauacaaauauuuagcacauugcaaauaguaacuuauuuauaaucccaaagauuuuuuaagcuaaggcaugcauaguuauuaaauaucacaacacuuaucucuccuguguaucauguaaacauuugugaaaacaagacuagggcaagaaaugauucaucuguuuuuugguuuuuuuuuuuuugagacaaagucuugcucugucgcccaggcugcagugcagcagugugaucuuggcucacugcagucuugaccucuuggguucaagugauccucucacuuuagccuccugaggagccaggacuacagaugcacaccaucacgcccagcuaauuuuauuuauuuuuuguagagauggggucucacuauguugcccaggcuggucuugaacuccugggcucaagcaguccuucugccucagccucccaaagugcugugauuacaggccugagcugccaugccuauccugauucaucuaucuuugaagugccucuaaaguuuccaaguugggauucuuagugugaaaaccauauugaauuaauucaaaggaaacuuuucauggauuuauauuauuauuuuuccuugaaaucuuuauaauaagaacauuuaaaaaaacugggacuugcuuuguuuuuagaauugccaugggaccaacccagugacagcugucaggaguauucugacuggaaagaaaaaaaaacauaccucaacccuuggaaaaaaaucgauucugcuccucuagguaacugaauuaucuugagugaaagaguaccgauuucuuggauaugaagucuugugcuauuugaauuuuuucuuacuuuuuuuuuuguuuuaaacuuacaaauaauucauguucguuguagauaaaauaguaacuauaaguaaaaaauuaaggaaaaaauaacucuuuagucccagaacucugcaauagauuuuuaaaaauauuuuggggaguguauauucagagcaacuugaaucugcucuuagauggcuuuuuacuuaaaguuuucauaugugcuauacuuuguugcaaauacacucguuuguugcuuaauuauagggaugcacucuaacaaauguuucauuaggugguuucaucauugugugaacaucauagaguauauuuacauaaaucuagauaguauagcuuacuauaaaucuaggcuauuugguauacccuauugaucucaggcugcaaaccuguacagcauguuacuauacugagcacuguaaggaauuguaacauaaugguauuuguguaucuaaguauagaaaaaguauaguaaaaauacaguauuauaaucuaaugggacugucuguuauacgugugguccauuccugacugaaacaucauuaauguggcccauaaguauguaaaaugaauauauguauauuauuuauauguguuuuuauacaaaaugagaucacacuaauaauauuuuguaacuguuuuugguuuuagugcgcagcgaacauucuuccaugacuauaauuguaggucuacaucguugguuuaaaggcugugauaauauucugccauguggauaugccuuacuuuacucuuuuaaucacuuuguuggagauuuuucuaaauuuucacagauacaaaagagauauaaguaucuguguaacuuaaucaugacacauacccuuaaauuguucauugaaauccccagaagcaaaauugcaggaucaaggauguaguuuuuauuauuauggcuuauuuugucaaauugcuucccgaaaguucgaaccauuucaucacagucucaucaauuuacauuaaggaaaaaaacuuuaaauaauaguuuuucauuuuuauuuuaaauuuaauacuaaugaaguuguauacccuuuauguauguauuaguuuuuugucuauuuugcucauuuuugucaaggauauuguuuuucuuaccacuuugaagcuuuuuuuuuuccuugauaacacauugaccuuugcacuuguuacaaauacuuuucacaauuuaucauuuauuuucauuuuguuuugcuauauugacauucaaaucuauuaucuuguccuuuguggucccugacuauaauuucuuuggaaaggucuucuaccucuacuauuuaaaaguucccuauguuuucauuuaguguuuuuauggcuucauuuuuccauuuaaaucuuugguccauuaggaaauaaucuucacauaggaagauacgugaauuuuuucucaagaaaauuaagauaccuuaggaugguuaguuagauuacugucucuuaaaaaguuauugguaaguaaauguucauuauaaaacugugugaauaaggaggucacgugagaacaugacauugaaguaaugaaauucgguauugaaaauggauaagagggguuucuguaucuuuuuguuaaucucgucacaugaggagaaacauuuccaucuggcucuuguucucaguugcaaacaauugagaaucagaucagggaagacuacuccaagauacagcagcagagaaaaacugcaugaaauuaaagcaguaauuuaguagcuuuaauucuuucucuuccccaggaauaauauuuagacauaaguaggcuaacagaaaauguguuucuuaccucaagccauaggcuucucuaacaugauucuuucgugaauguugucguaauguuuguuuuuagcucugcugcauaaaaucuuaguugagaauccaucagcaagaauuaccauuccagacaucaaaaaagauagaugguacaacaaaccccucaagaaagguaauauccuuaaacuacaaguuuguuuguuuuucuguggaagaaaagguaauugcaaaguuauuaucacaagucaacaacacaugauagcuaugaucucuguccucauggagauuauaauguccaguagaaaaaaauacagaaauaauuuuguuuauuaauaauuauaaaggggaaagucaggguacuauagcuaaguguuugaccaagucuaagggacagggaagacuuuucuuccugaagaaauuacauuaaaucuaagauuugaagauuaaagggaagcuaggcaggcaaaguaaguggcagauuugauucugaacaggggaagcaguauuugaaaaaucuuagauuuuagaaagucugaugcuuuugagaaacuugaaagaucaguauggcacaagccgugucuguuguguucaucauuguaucaucagugcuuuagcacaguauauggugcaccauaggcacucauuaaauauuuguugagugagugaacagggaagugggagaggaagacagguuugagaugaggccagagaggucgcuaguggccaauuuguggaagaagaccuuguaagccauguuaaggauuuugggcuuuaacuuaagaccacuggggagaccucugagagauuuuaagcaagacuaugacauagucauaucuucgguuuaaaaauauuucucugacuuccuuauuuuuuuuccauuguuuuuuaugaauagggaaagauucagggugcuguagguuuuucugcuaguugucuagaagugggaggcugguggcuuggaauagguuagggcaaugguauuggagaaaugagaugauuccaaagaaauuuaagaacuaguauugauaggacuguuaggcugugaauggaaggagagaggacaaugacuagagaugaugaaugaaaaacauucagagaguuauuaauguuuaacucuguccucauggauagaaaagaguuaauguuuaaacauucacucuucuuuaauaccucucugcauguuucuuccuccuuguccuaacuuaaaguccaauucuccccugaggacacugcuuccucugaagcgguagguguuuucuuucccauacccucauguccuuugaucuggacaugguacagguguccuccuuauucuucauugucacuuucucccaucuuccuuuaugucucuccccucuaacuuuugaaccccaaauuaaaauuucugccguacuaucacagucugcaaaaugacucuugauguuauuuucgucaugauucuuggugauuuaaauauuuauuuggaucauccuccugauauccugacuucacuguuucuugacccucucuccuauagugauguugucuuugaacacgcugcacugaucaccaguauaauuuuuucugacuuccucccuuaauauucuaacuuaaacaguccuuuguaucuggacuugcaauuaauuaauucuaucucuucagucucuuaccugcucccucucuagguccuugauuucaucuuuaccuaucuuaaaucuuuagguuagucauuauaaaugacugcuuugcguucaucaucuucaauuuccuuguccccuucucucuucaucauacuuaguggguaaaacccaguaaguaguuucuggguuuaaucuaguaguuuucuacguacugcacacuuguaccugcacaacagauugcagcaggagaaaaauacccaaaaauguucacuuuaaauucaggauuacuaaucucaagugggcccuuaaugcuuccuggcauuuggccuucguuuccccacaucuuucucuguccuguucuccuaaaucacguuuuuauaauacuuuucucuuuuuuuuuuuuuuuuuuuugagacagggucuaggcuggagugcaguggcgccaucuccacucacuucaaccucugccucucagguucaagcgauucgauucucgugccuuagccacccgaguagcugggauuacaggugugaaccaccacaccuggcuaauuuuuauauuuuuaguagagguuuugccaugcuggccaggcuggucucaaacuccuagccucaagugaucccccugccucagccucccaaagugcuggguuuauaggugugagcuacugugucuggucccuuaacuuuuauuaucuucucuccauccucacucucaguuguucacuuugcuuccugugucacugggaaaugaaagccacaagagaacuuaggcaagcucccaccaccaucuccuccauacuaacugccucuaugcucauguauucucuuucauccuguauugcuguagauaaauugcucuggauguaagccaggucuuucucuuacccacucaaugacuuugucuagcaauuuuucucccucuccuacauuauuaauuuuuccuucucuaccggaucuuucucaucagcauaucuacaugcuuuuucucccauuuuaaaaucaaaucauaaugguaauaaaauuucucuuaacuccacuuuucccuaccauuccaucuucuucacaauugaauauuccuaaaauugcuucucaucucuaacaccucaaaacuaguuuucaauuucaucuauuuuguugccaagagucacagugauuuuuggaacguguugccaaguucaauguaauaguccacuguggucaaccgaggucugaaaagauuaaauggaaaguaccagaaguaaacaauucaucaauucauggguuuuggccgggcgcgguggcucacgccuguaaucccagcacuuugggaggccaaggcgggcggaucacgaggucaggagaucgagaccauccuggcuaacacggugucaccccgucucuacuaaaaauacaaaaaauuagccgggcgagguggcggucgccuguagucccagcuacucgggaggcugaggcaagagaauggcgugaaccccggggggcggagcuugcagugagccgagaucgcaccacugcacuccagccugggcaacagcgagacuccgucucaaaaaaaaaaaaaaagaaauucauggguuuuauuuauuuauuuaauucgagacgggaucucgcucugucgcccagacuggagugcaguggcguggucuccacuuacugaaaccucuaccuccugagcuuaaaugauccucccaucucagcuucccgaguagcugggacuacaggugugagccacuaugcccggcuaauuuuuguauuuuugguagagaugagguuucgccauguugccuaugcuuuucuaccaaaaauacaaaaauuagccagguguggugguucacgccuguaaucccagcuguucucaaacugcugggcuuaagcaauccacccaccccggccucccaaaguacugggauuauaggcaugagccacaaugcccugccauagguuuuaaauugugugcuguucugaguagcauaauaaaaucuugugcuguccuacuucaucucacuugggaugugaaucacuccuuuuuccaguguauucacguuccaugugcuaccugcuuguaacucccuuaguagcuguuuugguuauuagaucgaaagaacauauauaggguuugguaccauuuguacuuucaggcauccacuugaacauaucccucuguggauaagggggguacuacuguagucaguucucagaccucuuguuuuaucucaucaauauuuuauacaguugaucaugcccuccuccuuuaaacacuuucuucauuuggcuuccaggcguuacacucuucugauuuucguccuucucacuggucgcucuuuucagucucuugaugguuuuuuuucaucugcucagccuccuacuauuggaguucuccagggcugaaucuauggaucuccuuuguuuucuucuccacacucacuccauuagugauauuacuugguuucauggcucuaaauaaaacuauauguugauagucacauuuauaucaaccuagaccuuuccucugaauuccaaacuuacaugucuuaacugccuucugaaauuucacuugaauguuaagaggcaucucacacuugaugaauuccaaacugaguuacugaucuuuuccuuucaaacccauuccuuuucaaagucuuucccauguugguuaauggcaacugcauuauucuuauuaugcagaucagaaacuuuggaaucauccuucauuuuucucauucucuuuuacuucacauccaguacaccagcuaauucuguuaaccucuaucuuuaaaaaaaucuuagaaucugauuaccuuuuuuuuuuuuaccucuacuguuacccuaucauuccaaauuaccaugauaucuuuccaaaauguucugauuuaaaagugaauuagaauauaucacuauucuacccaaauccuccaaugcuuuaguucucacguguaguguaagcuaaaaucaguucaugaccugugaguucuuacacaauuuuguuccuuacauuaccucuccaaccucaguucugcuuugcucccccuuggucauauuguuguucuucuuauuguucuccaagugcucuaggcacacuucuaccucacuguuuuuguagugacuguuccuaugucugaaaaugcuuuuucccaugggacuuauuugcaugucuuauucucuuacuuucuuuggauauugacuucagugucaucuuuccaauaagccuuuccuggccaugcuauuuaaaaugguauccucuucccucuaacacauuucuuaaauuuuuaaaauuuuuacucucuuguggacauacgcaauccaacacguuucuucauuuuauuuuccuucaguguacuuaccaccauuuagcuuacugauuuuuaacuguauuuguauuuauuuuauguuauuuugucucuccucaguagaauguaggauuuaaaaggucaagaguuuuuuuucuauuuugcucacugcugaauaccugauaccuagaauaaugccuggcacagaguagaccuaauaaaauaucugaaugaauggauuaauaaauaaaaagcagguuuaaaaaaaaacuugagcauguuuaaaaagaaacaaacuuaagcauguuuaagugguuuggguacggauccuguagagaggaagaggcugacagucuaagagaaaggaaauaaauaacagaggaucaagaucccuaaggagguagaaggguaugggcuccagagcacaaguagagagaugaacauuugaugggagaauggaagggaugaaaagauguauaauaauacaaauaacuuagcuuugguagggauaaguugauguaguuucugucuaauggcuuuauuuuuucucugaaaugggaggugguaguauagguacuggaugguagucuugggaauuacagaaaaguguaguuuugaaaugauccuuguggagaaaaggaaaggaaacuagagaaacaaauauuaucuggcaauauugagguuuagcuagggauuguaaccauaaauuuacaguggcgucauuuuccauauaauauucuucuuuauaaagcuuuuccaaggaaucaaagaauguuggcuauagcagauucauaauguuuauugcuauuaucauaaauuauuuuuuauuuuaaaaaguucuaguccuuuagccaggucuguugucuucauagaacauuguucuguuacccauaaaagaugccauuaagacuguggccugggccgggcgcaguggcucacgccuguaaucccagcacuuugggaggccgaggcggguggaucacgaggucaggagaucaacaccauccuggcuaacauggugaaaccccaucucuccuaaaaauacaaaaaaaaaaaaaaaaaaaauuagcugggcgugguggcgggugccuguagucccagcuacucagggggcugaggcaggagaauggcgugaacccuggagacagagcuuguagugagccaagaucgcgccacugcacuccagccugggugacagagcgagacuccgucucaaaaaaagaaaaaaaaaaagauuguggucugagcauacuccacacuuugaacaugucuacagaucauacuuagguauuguaaaauaccuaauuugacaaaugaguuuuaguaauuuuauaacuuggccauauuuuuuauaaaaucauauaggaagacuuuguuuuauaucuuacaaaaauuuuguguuaaauaaauagauuuagacauaguuuuacuucuucaaguugccaguuggguuaauuuaaaaacauacuugcauagaagacuugaaagcauuuguauuuguuuucuuuuuuaggggcaaaaaggccccgagucacuucagguggugugucagagucucccaguggauuuucuaagcacauucaauccaauuuggacuucucuccaguaaacagugcuucuagguaagacugauaaagauugaguaguuuuugauuguaguauuccccaugaagaauaauacauguauguguuuuuucauaauaaucgacauuaacauaauacuguaagcaugagaacuugugugugauauaagaaaggccugauagauuuuauuuuauuaaauguauguuucuuucugucuuaaugccucagugaagaaaaugugaaguacuccaguucucagccagaaccccgcacaggucuuuccuuaugggauaccagccccucauacauugauaaauugguacaagggaucagcuuuucccagcccacauguccugaucauaugcuuuugaauagucaguuacuuggcaccccaggauccucacaggugagggaauuuaauuuuuuaaaaguaauggcagcucuuuauuuuuuauugucuuaaaguccuuuuuuaauguguaaaucuuagauauauaacuuuuaaaucacauguauucuuuuuuggucaaggaagaaagagaggagggaggccuucaugcaaaauaauuuuaagucagacuaaauagcuaugauauuacugucuuuaguccuaauggauuuauucauuugucuucuguuugacauguagaaccccuggcagcgguuggucaaaagaaugacacgauucuuuaccaaauuggaugcagacaaaucuuaucaaugccugaaagagacuugugagaaguugggcuaucaauggaagaaaaguuguaugaaucagguguguuucauugauuuucauuauaccuuuuccugaagaagaauuuaaauauuugaguaaaagcuaucauuaguauauuuuuuaaauauaggcuguggcucacaccuguaaucccagcuuuuugggaggcuggggugggcggaucaccugaggucagggguucgagaccagccuggccaacaugguaagacccugucucuacuaaaagcacaaaaauuagccggccugguggugcauggcuguaaucccagcuucucgggaggcugaggcacgagaauugcuugaaccuggaagacggaaguugcagugagccgagauccugccagugcacuccugcguggccaacagagugagacugucucaaagaaaaccaaacaaacauaaaaauacaaaguaauuaguuaauuugaaaaagaaacuauuuaaguaaaauguucuuuacuuuaagaaauaauacuuuuuuuuauuuuguuuuauuuuuuaauuuuuaauuuuuagccacugugccuggccuaagaaauaauauuucuuaaaagaccuuuuuauuguuauuaaaaauaguagggagcuggaaucauuaucuuuguaaaaacuauguauacuuaaacuguagacaauaacaguugacugccuacuaugaaagacgaauacauuagcaaucccacacuuucucccaucucccuugauugcacccgucaauuuuuauuguuuauauuauuagagcauaguuauaacauugguauucuaaacugucuuuaaggcuuuucaaaaaaaauguuaaugucaaugaaagacaaauaggguagcuguuuuuuacucaaggagacuaaagaggccugauaacuaagugcaagugcaaugcaugaucuuucacuagaucauguauuugaaaaaaacuauaacggacauuauuggaacaauuggggaaauuugaauauggacuguauauuaauuagguaauguuuuuguaucagcgucagauuucuugggugugauaauacugugguuuguaggagaaugcccuuguucaaaggagaacaagugucaaagcaaaguugaagugaagugauauuuucauucagcuuaaaauuuaaaaaaauaaagggcaaacaacuacauaaaggccaauaaacacacacauaucugguagauaaggccaaugaagaguauaugguuauuuauuauacucuuuuuucaguuuuucuguagauucgaguuuucaaaauuaaaaauugggggaacuguuacuguguagaaaucugaggucagccugauagucuucucacucacauaggugauucacuuucuuucagguagacucagagauaaaauuugcauaacauaagaaucaucacuuuaaccauuuuaaaauguaaaaugcagugcuuuuuaguauauucacaagguugugcaaccaucgccccuaauuccagaacauugcaucaccacggggaaaaaaaaacaaaacaccucuguaccaccuagaaucacucuuuauuccuuucuugcuccauucccagacaaccucgaaucuacuuucugucuuuagggauugccuuuuuggacauuuuauauaaauggaaucauauaacauguaguccuuugggucugucugcuuucauuuagcacguuuucaagguucauagcaucuaucaguacuuuauuccuuuuuauggcugaauaauauucuguuguguguauguauuacauuucguuuauccauucauccacucauggacauuuggguuguuucuacuuuuucaucauuaugaauaauacugcugugaacaaucuuguaccaguuuuugugugaccauauguuuucaauuucuuagauauauauggaggaauagaauuguuggagcauaugguaacucuucauuuaacuuuuugagaaacugugaaaugauuuuuccaaagcaccuguaccauuuuacguucccaucaguaauguaagaggguuccaauuucucuacaaccuugccaacacuuacugccuccccuuuuugcuauggccauccuaguguguaugaagucuuaucucauuuugcuuuugauuuucaucucucuaaagacuaaugaucuugagcauauucuuauaugcuuauuggccauuucuuuauaacaguauccggauauuuuguccaugcuuuaacuggcuuguuuuuauuguugaguuguuagaguucuuuuacauucuggacacuagaaccuugucagguaccugauuugcaaauauuuuaucccauucugugggagaaaauucccccauucuuuuguuuucuuguuagugucguuugauguacucaaguuuuagauuuugaugaauuccaguggaucuauaauuucucuuuuguugccuaugcuuuuagugucaaauuuaagaaacuguugccugauguaagauuguaaagauuuauacuuuaugcuuucuuuuaggagucccagccuccuaaguagcggggacuacagucuuaaaguuuagcucuuauauuuaggucuuuguccauuuugaguuaauauuuguauauaguaugauguagggugcaaauucaaauguuuguaugugaauauucagauuccagcaccauuuguugaagauauguuuuacuauuagauggucuuggcaccuuuguugaaaauaaauaggucauagauguauggguuuauuucuggaaucucaauucuuuuuuuuuccuuuuuuuuuucuuccccuguggacucaauucuuuuauuucauggaucuauaugucugugcuaugccguuaccacacuauguugauuacuguagcuuuauagugaauuuugacauuagaaaauaugaguuguccaaguuuguucuuuuuuucaagguauuuugguuauuuguggccccuuguuuuucugucuuuuaggauuaucuuauuucugcaagaaaaaaauuuggaauuuuaaaagagauuacauuggggaguauuuccauuuuaguauauauugaguauucuuuauucaaggugcuugggaccaaaaguuuuguggauuuuacauuuguuuggauuuuggaauauuugcauaugcauauugagauaacuuacagaugggacucaaguugaaacaugaauaauuuuauuuaugcuucauauauaccugauacagauagccugaagguaauuuuauacaauguuuuaaauaauuuugugcaugaaacaaaguuuguacauugaacuaucagaaagcaaaccugucagguaugaaauuuucaguuugucacaugaugucagcaccugaaaaguuuuggaguuuggaacauuuuggauuucagauuugagauuaaggaugcuaaaccucuaauaguaacucuucuaauccaauaacauggggccuuuuuuuucccauuuuuuuagggucuuuaauuucuuucaagaauauuuuguaguuuucaguguucaagucuugcacuuccuagguuaaauguaauccuguuuauucuuuuuuuuuuuauccugaugcugauguaaauggaauuuuuuaaaauuuuauuuucaaauuguucauugcuauaugcaaaugaauuuuguauauugaucuuguauccugaaaauuugcugaauucauuaacuccaguaguuuuuuugacaaauucuuuagguuuuuuaauauauuaagauuacauuauuuggcagggcgugguggcucacgccuguaaucccagcacuuugggaggccguugcggguggaucaugaggucaagcguuugagaccugccuggcccacauagugaaaccccgucucuacuaaaaauacaaaaaauuagcugggcgugguugcgggcaccgguaaucccagcuacucgggaggcugaggccggagaaucacuugaaccugggaggcggagguugcagugagccgagaugacgccacugcacuccagccugggcgacagaucaagacuccgucucaaaaaaaaaaaaauuacauuguuuaucaauagagauacaggaaauuguuuuacuuuuuuuuuuuuuuuuaacccagaugccuuuuaauucuuuuuguuuaguuguccuggcuaggacuuccaacauuauguugaacagaaauagagucuuugucuuguucuugaucuuaggguuaaguuucgagucuuucagcauuaaguaugauguuagcugugggguuuuuguuuuuauggugaaagaguauuggauuuugucaaauguuuucuccgucuauugagauaaucauguggauuuuuuuucccuuuauuaauauagcuugaccuccugugcccaagugauccucucaucucagccuccuaaguagcugggacuacagguguacacuaucauacccagcuaacuuuuuaaaaauguuuuuguagagaugcagucucuguguuuaccaggcuggccuugaccuucugggcucaagugauccuccugaguaguggguacuacaggugugcaccaccaugcccagcuaaauugacaguuuucaucagucuguuuauuuugucuaauguuaguauauccacaucagcucaccagcuaucuuguguauuuuccuuuuuuuagauggagucucacuauguugccuaggcuagacuguaguggcuacuuaaaggcacgaucauagugcaaugcagccucaaauuccugggcucaagugacccuccugccuuggccucccaaguaggugggacugcaggcauguaccaccauacccagcuaccagcucucuuuugguuauuguuuccauggucuauuuuuuuuuuccuuuuccuuuuaaccuauuugugucuuugaaucuaaagugccuuagccaggugucauggcugacaccuguaauuccagcacuuuaggaggcugagguggguagaucacuugaggccaggaguuugagaccagccuggccaacauggugaaaccccaucucuacuaaaaauauuuuaaaaauuaguugggcguuguggugugcaccuguaaugccagcuauuggggaggcuuuaggugggaggauagucugagccauuggagaucaaggcugcagugagucgugaucugauugcaugacugcucuccagccugggugacagagcaagacugucucaaaaaaaaaaaaaaaucgcuucuuagccuuuuggcuaagaucaaguguaguaucuauuccuaucaguuuaagugccuuaauuucucuuccacuuuuuggacagguaguuuugcuggauauagaauucuuauuagcuuuugucuuucagcacuuugauuaugccacuacugccuucuagccuuugugguuucugaugagaaaucagcuguuaaucuuacugaggaucucuuuuaugugagacguugcugcucucuugcugcuuuuauguuucucuguugaccacaguuugacuaugguguaucuugguguggauuucuuuuuucauucuguucggaguucguugagcuucuuggauauguaaauuaauguuuuuaaucacacuugggaaguuuuuggccacaauuucuucagauuuuuuuuuuuauaucuaacucuccucucccucuuggacucauuauguuuauuguugguauacuugaugugccacaguucuuagacucuguucauuuuucuuuauucuucuuucuuuauguuucucagggacaguuuugguugcuguuuuuccuuuauaagggccauacuuuguuuccuuacaugcuuuguaauuuuuuguugaaaacuggacauauuguggcaauauguggcaacucuagaaagucagauuuuccccucuugccaguguuuguuaccgcuugauguaguuguuuguuuuuuuuagugguguuuguuuuuuuuuuuuuuugagacggagcuuugcucuuguugcccaggcuggagugcaguggcgugaucuuggcucacugcagccuccaccuccuggcuucaagugagucuccugccucagccuuccaaguaucugggacuacaggcaccugccacugugccuggcuuuuuguauuuuuauuagagaugggguuucaucauguuggccaggcuggucucgaacuccugaccucagguggcugggauuacaggugugaggcaccaugcccggcccuagugauuuuucuuauauaauuuuuuaaaguugguauuguuugucaugcauggcuguacaauuucugucccauuaguuuuaguggucagcuaaugauuggacagagauuuccuuaaauucuguauaccaaaaacaaaaaaucugcagaguguucuguauuuguguuggggcacaccugcaauacucaaccaagaaguuuacaacguugcuucagccuucgcuaucugcuugugcaaaaugcaaaguuagggcacauguagagcuuaggggccuucucagcucuuuccuaagcauauguacugcccuggucaugggugugucuuuuuagauucccagguauauguuggaccuuuucagaguccuauuccccagaaacaucucacucccuaaccucuucuuccaaacuucuuggguagucuguuugcaccaguugcuuucauugcuucaggcaacagagacuaaagcauuuuccuguaaguguuuucagcaaacgcuacucaggaguagcuuuagcacaaggugaguuagaguuacaaaggugaaauaaagacaagccucuuuuuuuuuuuuuuuuuuugagauggagucucgcacuguugcccagucuggagugcaauggugugaucucagcccacugcaaccucugcaucccggguucaagcgauucuccugccucagccucccaaguagcugggauuacaggcgccugccaccacacccuacuaauuuuuguauuuuuaguacagacaggguuucaccauguuggucaggcuggucuugaacuccugaccucaggugauccacccaccucggccuccccaaguguugggauuacaggcaugagccacugugccuggccaggacaagccuuuugaucaggucauuuuagagggucagaucggcuuaagauaguuuguaaaugagguuuauucugcucccaccuggaccuaugccuuaaauaugaacuguuauuuucaaggcugcuacugagugaggagcaggggauaaacaggguaaguuaaaaugccagaaagcucacuguucuuacugcguuucacuuguuuugaauaaguugcugcaagcuuuuagcuaguuuacaauguucugaaaaaguugauucugacaggcuuuggcagguuuuuaaaauugcuuuuguggaguaauggacuucuggaguucuuuucucugccauuuucacugacaucacuccuugauucacucucucucaguucuugaaguauuuucuuugucuuugaaguuuaagagcuuaauucagauguguugaguugaauaucuuguauuaauuuucccagaacauaguggguuauuucagugcugcacagucgugguaugguuguguguuuucauaguuucuugaaguaagaauuauuacaaaaacuuuuguaauuugggcuguguuuuuugggcaaaucugcugaucucgcucgggcuuaacucauccagcuguagucauuugaugucuuuacuguggcugguggucuaaaacauccuuacucccauauuuggagucuuggcacugucuguuagcugagucuuuucuuucugcaucauucagcuaggcugagcgucuuuccaugccauaggaacguucuaaaagacugaaaguggaaguugaaggccucucaagaccuuugccaucuucuaauugccgcucuagcuuuucagccacaagucaggccuuuuucuuucucacauuuuaauaaucuuguuuuuccucccauuauguuuucaucuuugauuguuucuucuuucagugguauuuugguaaaagacaguaaguuuuguugcuaugaguucauauacacucaaucccuaggagcugcaccccuguugauagauuggguuggggacacacauacccacugggagaagagagacucuggaaugagugagauuaucagcauacuuaauauuacuccuguuauggagguagccagcaaauuuuuuuuaauugauacaauaauuguaauguauucaugggguauguagugauguuuugauucauauaauguauaaugaucagaucaggauaauuagcauauucauaauuucaaacauugugggaaugggaauguucagugaugggaauguucaguauccuucuagcaauuugaaacucuauuauuguuaaguauagucauccuacaguggucuagaacuuacuccuaucuagcuguaauuuuguauucuuucaugaaucucuaucuuucccuucccucuccccuuccuggacucuaguauccucuguucugccuucuacuucuaugaaauuaacaguuuuuuuguuuccacauaugagugagaacaugugauguuuaauuuucuguuccuggcuuauuucacuuuacauaauguccuccaguuccacccauguugcugcaaaugacaggauuucauuccuuuauauggcugaguaguauuucauuguguauauauaucauauuauccucaucuguuugcuuggcuuuuuguuuuguuuuuuugagacagggucucgcucugucgcccaugcuagagugcaguggcgcaaucauagcucacugcagcuucaaccuccugggcucaagugacccuucugccucagcccccugaguagcugggccuguaggcaugcaccaccaugcccgcuaauuuuuugggaauuuuaguagagaugagguaucgauauguugcccagccuggucugaagcgauccuucugcuuuggccucccaaagugcuggauuacaggcgugagccacagugccuggccuacacucaucuguuguuggauaccuagguugauuccauaucuuggcuauugugaauaaugcuguaggguugcaaauuucucuuccauauaauuuccuuuccuuuggaucaguagugggauugcuggaacauauagguaguuuuauuuguaguuuuuugagaaacuucuauucuguucuucauaguggguuuacuaguuuauuaucuacucacccauguggcuuaaccuuauuuuuguugccuuagguuacuauaucaacaacugauaggagaaacaauaaacucauuuucaaagugaauuuguuagaaauggaugauaaaauauugguugacuuccggcuuucuaagguauuuuuauguuuuauuguauucuuucuauggaaauauuucuauaugaauuuuuuuaauggcauuauguuuguauauauguggcauuuguaaauagguuacuugcuuuuuucguuuaauauuaugagcauguguuuucguuaucuauuuuucccgaacauuguuuuuuucaaaugacauuuuccuuauuauaaaaguuuuugccaggcgugguggcucaugccuguaaucccagcacuuugggaguccgagacggguggaucucgaggucaggaguuugagaccagccuggccaacauagugaaaccccaucuuuacuaaaaauacaaaaaauuagccaggcgugguggcgggugccuguaaucccagcuacuugggaggcugaagcaggagaaucauuugaaccugggaggcggagguugcagugagccgagaugacgccacugcacuccagucugggugacaauacaagagacucugucucaaaaaaaagaaauuucugcuuuugugaaaaauguagauaagcaaaaaaugagaaaauaaaaauaauucuaaauuuucagugaucacauuaauauuucgaagcauuuuaauauuuuucuuaauuuaugucuuuuaauaaaaauuaugauuuguuacaaauauuucauuauaauuuaaugaaccuuuaccaguuauaauaauucugugauugcuauuuuaugcauagauuuuuuuguucauauuucugaugauuucuuuagaaaucauugauucuaagaugauaguauuacagcccuugauauauaaaaccaaaauaacauuuuucucuauuuucugagagauuguauguggcucuaaagaggguuggagggguagcugcuguguuagagcauuugccgcaguacucuuuguauuagagauuugcugcaauacuguuuuucagaugcuugcuacagaauuaaauuaagaucguaguauaaugaaauucuucucauaacuaaaucuauugauuuuggucaguaguguuaugacaacaagacuucaguuuaguuguauaguuuauuguuaguuuccaaacccucacugccuauggaauguaaugacuuagguccagauauaccaacaccugaaacagauaggaugccauguuuaucugcucucugagcucagugcaguaggaacagugaugggcaugaaaccacaucagaauuauuuguguaacaauuuucucuuccaggauauuuggucuucauaaacagaccgaaaagaaaaugguagcuagacauaccuaaagauguuugucucuuguuaccacuacaaagagauugauuuuaggacagaauuuuguuuuuguuuuuguuuugacauaauuuuuuaauacuauuucuaauauagggugauggauuggaguucaagagacacuuccugaagauuaaagggaagcugauugauauugugagcagccagaagauuuggcuuccugccacaugaucggaccaucggcucuggggaauccuggugaauauagugcugcuauguugacauuauucuuccuagagaagauuauccuguccugcaaacugcaaauaguaguuccugaaguguucacuucccuguuuauccaaacaucuuccaauuuauuuuguuuguucggcauacaaauaauaccuauaucuuaauuguaagcaaaacuuuggggaaaggaugaauagaauucauuugauuauuucuucauguguguuuaguaucugaauuugaaacucaucugguggaaaccaaguuucaggggacaugaguuuuccagcuuuuauacacacguaucucauuuuuaucaaaacauuuuguuuaauucaaaaaguacauauuccauguugauuuaauucuaagaugaaccaauaaagacauaauucuugugacuuuuggacaguagauuuaucagucugugaagcgaagccagcuucaaaacauauccccaagauuuguacuuauauuuucaaaagggccuggccaguuauauaaaccuguuuuugaauuauaaugauuaauuaaaauugcaaguagguguuuuuuccaguguaguuaguaaaauacuuguauuuuacaguguugcauaaacucuagugcuuaacuaacuuuacucuaaaaauuacuguugaacaucuuaaauauuuuucuauauuuucuacuuucauagccauauuuuaaccuuuucaacuuacuggugaccaagcuuuuaggugauaaagaauaaaagagggaagggaagaguaaggaagcuauaagaaaaauagaucugauucuuuguuccuuuaccuguuagacuuacaaaaaguuuguuuuucuaauaaaauuuguaucaacuuuggggcauauuagguugaggccuuggcuccugccuguagucccagcuacuuaggaggcugagagaggaggaucgcgugaaccuggaaguuugaggcuguagugagcuaugauugcaccagugcacuccagcuuggaugacagaguaagacccuaccucuaauaaaaauuuuuaaaauuguaaaacauuauaaaauuaaucaguuauuuuaaucugaagccaagaacauguagaauguuaugauuagaguuuaucacauauuaauguauacug

SEQ ID NO: 15919 - RNA, 30087 nt, Homo sapiens
uaucaguggaaacauacccugaaaucuucaggcuagaggcagucacuuucaggaccacagaagucccugccugguggcugcuugccuccagaaaggagagcaggagugacugccacauugucauggcgggagcgcgugggggccggugucugugaagccggggaagagugggguccuguggaauaugagcagggcaggaagccccagccugagccugugguguguuuggggccgaauauugucccccccccgcccccgcccacgaaaaaaacuccugcgcucccagaaggugagaguaccgagauuagucaugcagggccgcugagugugacuuccagcccuccagcgucucgugucccgcccgugucggagcccauggcuuuuuaggacaggaagcgcugcgggguagugcgggcaggcaggcacgucacaccggacagcgucgagauugcugcuuucgguuccccagcggguggugaggcagaaagugcagggcggaaugaggagccccagcaccucagagcugucgggcaguggcggggaagcaaagcacaggagcgcuguggugccagcggccgggcuagggacgacuggcggguuugcgcuggacccgaccccgagggcgggcgcaagggggcgggcgcugccguacucaggccgcggggccagggcgggccggccggcggggcauuuaaaccccgcugacagccaguccagcccgggacacgcgcccagcucuguagccuccuccgucgacucagccuuagguaccggucaggcaaaaugcgguccucccuggcuccgggagucugguucuuccgggccuucuccagggacagcuggugagcggggcaggggagggaggcgugccgggaccuccugggcucggggcuugcaggggccgcggggggccucggagaucaccccagaucggccccggcgucgccgcguggccaggggugcuggggggacuuggucccgagcuccuccagcggcgcccgccucggagguugauaacccucccugcccaacuccgcccgcgcucccccagaccccgcgacgcuggcucggugacacuggggaagaacaggcugccagggagggucuccaucguuucccguuuccauccuccccuccuaacacacauccggggcgccuucagagcgccuuucugucguugggcagcuggggaaccugggcucgaaggcuggggaaccgaggccaggggaugguagaggaaagggguugccacugggguuugugagugucccucuuggucuccuuuagcccucgaacaccaaggccagaacucagugguccugggagcucgucucgaggccuuucagcaccuggaaagggcacagcucucagagcagagcagggcagccccucggcagugggagaagggcuucacagagguucucuuccugaccgcagggaccacauguugggcugcaaggugggguggagggguuucagccacucuuccuuagaggcggucaaccauuggagcaguccguuuggucugcacaguuuuuaaaauauuguguuaguugccauuauuuacaaaucauaaaauuuaacaaaaauagcuagauuccagacuucucuugaacaauagacgacguggaccgggcauggugguucaugcuuguaaucccaccacuuugggaggccaagaugggagaauuacaugaggccaggaguucgagaccagccuggccaacaucgugagaccaccccuccauuccccccucacaccccucccugucucuagaaguaaaaaaaggaaagaaaagaaaaauggaugauguagcaauacugggccuaaauuuccaaauuaaaugaauaggauugaggaguccccuuuagauagggcaggugcuauuaaaguggccaauuuguccugguuuugaaacagucuuuugucggcaacccucucaauccugggcaaaaugagacaauuggcuacccuacacacuuuuuaauuguugagagcucucaucaauucuaaccuucuucacucguuuagauuauuuaccuagucuuuuuugaguuggagacuguuaaaagauauuuuucagaaaaagauuaaaauccugacucucacaaagacauaagaaugaacccauguuaaagauuuucuuuuacucauaauaaaggaggcagaagauguuauaaucgguucaaaagagaaucuagagagggggauuggggaauuauuguuuaauggguauggaguuucaguuugggaacaugaaaaaguucuggaaauggaugauggugaugguugagagacaaugugaacauacuuaaugccaccuaaauguagacuaaaaaugguuagaauggcaaaauuuauguuauguauauuuuaccacaauuuuaaaaagagaaucuaaagaacauauucauuuauagguuaggaauauugagaccaaauuggucuucuacagguugugagggaagacuacugaaauuaucuucauagguauauuuugcauggcuucucaguuaccuaccacuucaaagaauuuuaaaauagcucaaggucaauuaaaagcuggaaucugauaaccuggcggacuaugugcuagacaaggcauaguuuuccacggaaauacauuguuuuucuacagucucuccuguuuugauuuuuaagaaaauucuuagaaggauuauucuugaucacaaaauaaagcugaucucauuggauuugacuugauuguggcugcaaguguguuaguuuaccauauaccccuuguuaaguuaauaaacuuagcuggaaguuuucauaaggaauccuagauuagauuuuuuaaagccuuuaauuauuuauuguccugacauuaguaagccgagucaagaaacugucuucaccagguuuuaccuacuguacugauguauuugggcaaauuccucuucucaggguccccauaauauccuaaaguuucugggcuagccagagagugaccuuccuuuuggcuuguaaaccuggaaacccaguaagcccauuuucuugggagguuuuucuuaguauuggcugcauagagugaaccucaguuuuuagaggaggcugguuguaucugauuaaauaggcauccugaucaaauacaacaucccggcaaggucuugguugcauaaccaauuuuucuaauuauguacugguaaaaaaaaaauucuuacugaaccugugcaaauaaccauacuuccaugaaaagcaagaagauuccauaagaguuucugaauucugaggagucagguagggagaaaaagauauuuauaaguguuucauuucaguuuaugaaagcagaaucuacuaaguucuuauggguuaauauagccuaagaagaaagagaaaggucuuccuuauauguccagaaaauagaacacuauaucaacaucaacaguauucugaacauagaagacagucauccauccccaguucaugcgguccugugugauuaauucugucccgcugaaucuuggguuagcaaucucaaaaaccuaucugcuucuugacuaaagaguucuggaacuccugacucaguccacuaguacguucuuaauguugucuaaguaguuccaucagaaacuuauauccaagagcaauuacucaguacagugcuuuucugagacaguauuugguuguuaaagauaaaaacucuggccugccaggcccaguggcaugcuuacagucccagcuacucaagaggcugaggugggaggaucccuuaagcccaauagugugggacuguagugcaccaugaucaugccugugaaaagccagugcacuccagucugggcaacacaguaagaucccaucucucaaaaaacaaaaaucucccacucuauucuauaacugauuacagagccuuuaagaagcaucaaaguaaaauaaaaacuaucuguaggugacagagacuuaaaaauuguugauuaacuucuuacugauaauuuucaagaaugaaugaucugaugagaauucaugacaagaauaaugcaacugacaaggaaauuugguugcuucuguggugugcaaaacaaaaagauguuaauccaaacagaaaaaaucuagacaacgucuaaaaauauaagguuaauuucaaaaaacacaaugaacauauuaauuuauaaaaaugaacaugauuuuuacagagaaaaaauuuuaagauauaauauauaaaaauucugggauauaauuuacauaaaaugccaagaauaucaacuaaagauauucaguaagcuuaacauaaguucuaaauaucuguauuuuaauaaaacugcaaaggaaaggcugauguacaucuccaguugaaaaccaguggccuggaagaugcuacauuuaaauuaaagaaggaaaguugcagccuaguaacuauuuuauuuuauuuuauuuuauuuuauuuuuucgagacaaagucuugcucuaucacccagauuguagugcaguggcacgaucauagcucacugcagccucaaacuccugggcucaagggauccucuugccugagccuccuaaguagcugauacuacaggcaugcaccaccacacccagcuaaguuuuuuauuuuuguagagacagggucuugcuauguugcccaggcuggucucaaacuccuggccuaaagccauccuccuaccucauccucccaccucauccucccaaagcaccaggauugcagacaugagccaccaugcccagccuccaguaacauuuuaaauaauaauugaaaucgugacuaguaacacguauacuguuguuaucggggaaggcaccaucagggugcugauaaauagaaacaugucauguacagagagggcauugagaagucugcacaacucuuuuauagcauauaauuucucaaauauuuagauaaauaauaauauuuuaccaauauaaauuuaaccuagagaaggcugagcaucucuucugacuugacaauuauuuccaagcaauugaucaauauuaacauauuaaauaaaucuaaugauuucuagcaccucucuuuuuaaaagaugaaagaacaaaucuuugugguuuuccaggagcccuuccucuuuuuaaauuaaauauucacaaacuuaucaagauuuugccaacuuuggcaaaauuuuaacacauuuaauugcuuauuuuuagacuuauuguuugauguacuauaauccaagacaaaucaaauuuccuuucuacaaaccuaaaauguauccauucagauuugaccuucccuguucccuuucuuauucuggaacaaccagucauuuuucuuauguguaauauuuuuccuuuuaauaaacaaaaacagguuucaauaccauguauacaaagucauaccucucugccacgauuguuccuaguagagucucauucauguauauuaguuauaucuuuuaaccaaaguaacuaacauuucagagagaauggggaguggggaggguggaucauuauaaaccaucuagaacacauuggcauucuagaagggcucaguaauacgcauaacaugacuuucuccagccuccaacacucuucacuuucacacuucucaaggugugaauucagcuacgguauuccccaacaucucugggauuuaugacagaccuugguugaaauccuuucaccacugugagccuugacuuugcugagccccaguuuccucaucaauaaaagucagauggguucuugaggauaaaugcgauaauauaaggaaacauucuugacgucuuguggcugcuggaggguacucaacagguauccuuuuacuuccuuccagauaaguuuagauuuggauuccuaucaaacacuaaaugucacguaguucuucuguaaguacauuauuaugcugagcucugaggccugcaaagacaaucaagacaggguucuaccuucuuggaacuaagaaucaagcuggagaggggcuguguacacacagucagcaauuuuagaaggcccugcucuacuuauugagugccaaaggauggcauuuccuaugugccaugucauucagaggaccagcgaggggaaugcagaagucgguuggggagauuuugaagaaaacugacuugcugagcacuuaacacauaaaagguuagagauuauauguauacauugccugguauacaggaagcauggaauacauggcggcuuuuacuaucauuauuaaugauggugauguuauuauuacagauacauauuaacccaauucaccuuucuugugcuaaacaaaauacaggccagggugcagacaaauaaaaauaaagacuuauagucugaaaaugagaaaucaaaucucugucacauuuaacugcuuucacauguccccaaggagggcauuuaagaagugaagaagacagaauaggaagcugaaaguggacuggcccugggccuuggacuccuccucuguaaaaugaggauaauaauaauaccuguaucacacgaguguuuugagguuuaaaugagguacuacguguaagguacuuaggucagugccaggcugauaugaaacacugaguaaacacuaaugauugacuauauucuauuuguuuuuccuacuacuuugugccaggcauuguuuauuuguaauuuuuguggaacugcaaggugaauguuagcuucccuguggaacauaugaguguaaugaggcacagagcaguuauguaagccuguccagcaccacacagcugauaaaugacugagcuggaguuggaaucaagauuagucugacucguaagcccauggucuuuccgcugccuuccuaaugauaguguuggguggggaaaagauuacauggccauuuggccuuggacaaauuacuuaacaucucccaggcucaauuuccuuaucuaugaaauggaaaaaaugauguaccuauaucacgggguuuuggugaaauuaaaugagaagcugcuuaaagcacuuagcccagugucuagcguaguugguauuggcuaggugcuuauaaauuucuguggagggagagaaucaucuccauuaggagaagaaggaagucuuugacuuggaucuggagguguucugagcagaggucacagagccagcaaaggcaugcaaguggagacauggccuguccccugucucugaaguaguaacauguagcuccagcugguaggaacaaaaggugccccuggacaggaggcugggagucauguggcgccagguguguggagacagcugcagacauccaggcaagagucagagauggcggaguuucuguccaggaagauguugcucuccuccuccuguuaggccuuccucgucaggaugacaaugaauggcuuguccauggcguuucagagccacagagcaccuggagguuccccagccuggagccuggcugguuccugccuuuuguaccagugucugugugggugcgucugggggcagcuggcagcaugggagaugacuguggcuggugcuuauggggcugggcccauuuccuggggcccucugagggggauggcccagaacgugcagaagaagagccugugggaggaaauaccagggugaccacagcuggaugagcaggaaugggcaggagggugaauugggcaggcaggaagagcaggagcugugagcuccuguggugccauuuuucccacaccucgaucuuccccugugagcugcaaaaggccacagcugagcuagaauggaugguucugcccuguggaguuagcuaagggcuuucacugccggauccuggugcccacucugaggaggacgcaggggaaagacauucaaauucauacugagagaaaaucugcugugugccagacacuuccacauccaggauaucucauuuaaucuuuauaacacucucgugcagcaggggaauaugaucuuauuuaaaggaagaucgaacugaggcuuagagacguacaacaacuugcccaaggucacauuaaguggcagaaccagaaauuaggacucagccaauuuugcucgaagucugaugucuguuucccuguccuaugggcuagcucucucaaaucuuacuuuccuguugacugcaaagaggugcaugguaagggcagcagaaagggcuguuuaaaaugagcuuugaugggaagaggcugcuuggaaaaggaaaugagggcuccuggggagaaccuggagucucagcccaugaucccuacuccggccccccagaaggggcaugugagccuguggaggucccaucccccaccccucgugacagcagcuucucccccagcugcuuuuugggcuuccucuuccacccugcuguuuccucucucccucccuacaguggacuggcgugcaccucauugaccucggguggggcugucugacucaggcccugugggcuggucuagaagguagcagcaagguuucgaaauagucuguaugguuggccaaggccuuguuuuuuccauucaagcuucuguaucaacugagagcuggggucaggguugacagucccaaaguaacagcagaauugaggacagacaccagagguagagucccugaagcccaggaccuccuaucugagucacuaacagacacuaaguugguguguguguggggugggggggcggugucacugcucuccuguuggcuucuggcucaggucuuguccccuggacgcuucuugcucaggagaaggaaggccauccuccucccccucuaagcaggacugcagcucugccaucaucaacacgcuuccaucagugcuauuuacacaaccuuucuucagaagagacaccaacuuaaaaccuguuggcugccucuucugagccccaccaacacucccacccucccuguuauuccggcugcugaucagagucccugcugcagcaugaaggcugucuucauucugccugaccauucagggucccccacucagcuuucuucccaaagcaaaacaaucuauccuguauuuuccucuuuccuaagacagacugucaucugagccaccagucucuucucaaauguccugaguuccucguggcuccuggccaauggcuucuuucucuaggaaggcucucagggcaagccccgagucaucucgaucucucugagcaugugcccacgucccagcuggaggaaggacagcaaacagaggauucccugaggggcuggcugcugcccugggagagcuuugcgccucccaaagagggucuuguccugucuugugugcuaaagaccuggcucagggcucugcaccugugguaucuguuccuggcuggccuuuuccuagcaggguaucucccagugcugguggagggcuugugggggagggggggugggcacugucaccauugacccuagcuugguucuuacugugcccagcccucuauccuuuucagaucugcuuagucucagaacagucacguccgagaagagacuacugaauccauuuucucuggacaagugccaaagucaccugcagccacagccagccuagccugggacuggggagugacuagggagccacuggggaaccggggcuguuucugacaucucucgggggcagcgucccucugcugggcuguuucuuguuuuuugcuguugcaguggugguggcagucggucuuuuggggguuuuguuuguuuguuucuaaucugucacugcuuugggacaugccauuucuugauuuuuaccccagaagcauuccuagugcaaagucucaacaaggucaauaaaguuauuaucaggcuccuucgaaagaguagguuggacugucagcuaauaguuaagagauagcuagucaaccucccuaucuaacuugguuauucaguaaccaguauccggugggggggaggugggauucugagaagugccaucucuugcuaacaaggucuuugagggucaugggacagccgccccaucuggagcagccgggggccuuccccuccauccuuugguccuuggccuacuugcccagccuggcccagccccugggcugccauccccccgucacagccacccuggggccagcuaggcaaggccuggcugugcauauucugugcccugcuucucuucugggaccucuugauucacgagggaaggacuggugagaggagaagugaaaccugcggguucuaaacauggaaggagugcgucagcugccuuucugaagcuagcaugagcuuggcagucuuggccuccgucuagccuagcccuuaaccugaccgaaguucccagucuccugugaaccacggcaccuugaucuuucucuuagaacaccugacaauggggaauggauagagcaccagacucagaggaggcccagcucugacuaugccaugcccagcgaguggugugacuuugagcucaucccuccaucccucuggaggccaggaaggaagucccagaaaaggccagugccaggccuagugucacacaacacagcugaggaccccccacccgccacccucaagacucaugacucuccugcuaucuugggugucaggguuucuacuggcagcaucaugggggacuccaggugguggauuucagggaguuggggucagagcuggcggggacaucaggcuaccaccuggaggagggcagggcuggaaucuuggaaccuaccaggucaggaugcacguggggaccccuacugacuuuccugucugcccacgggagcaggugggagggccccggggcuggagucuccccugugucccaccguaggcuccccaagaagccauagggcccaccauggaaggccagagcuccaggagcuucagggcauccuuauguucaucuagacccagcuaugcacagcgggaggcgggguggagggggacaggcuggcagccacaucucuaccuuccagguaaauccagggcccggagccuccacuucccagaagaguuugguucagccccugacccuacucggcuccccuaacagagcagugugggccgccuccaccccuccaguccuucuuccuggucugaacauuggaagcacacuggcugucaucuaagcgcccucugggcaucaggaacaauuucagacugguuaggugcaucucacuaacccaucaauaggucugagaaaggugauagacucugcuuuuccaaugagcaaaaagauguaaggaaugaaaccagcuuuugcccgauucccaaguccuugcuguuuucucuuauagacaucaacucccugacauccaccaccuggguucccccgugaugcugcuaugucccugggaguggcuggcaggaugaaaaaggcccagggaacuggccuugagccucagugaggaagccugucugcgcuucccaccaaaaccuacagggcacagcccugggucuucaccuggcuuaggcuggcugggguucagagcugccgaccugggaacucccgcucucuucaguggcuucccaucaccuucagagauagccuaaaugccacaguuuggcaccugaggcccugcgccacgccaccugaggccccugcccuucccagccagcucugcuucucugcuuggcucaguuucacccuacagauacccccacugaggcggaguuccccaaacagguagugucauuucacaccuccgugccuucgugcacgcugcuuccucucccuggcaguccucccugccccagcugugguugacuuggccucguccugcuuguuuuugaagccucagcuccaggaauccuuucccgacacugcucccuccugcuggcucggagucucuccucugugucaucucuguaagagagagacaucacaccaggucuaacugucucccugcugaccugugcgcccaggcagguggagauuccgcucacggauucucuugcuagugcuggauuguagcauggugccugguacaggaugggcacagggaugcaugggagagcagccucgcuucagccgaagggaaucaagauguuagaaaugggcacagcuccuccuacugagguugucggggacagaacuccaggcaaaagggccauggagcagauaaggaagaacaccuggggccacaagcaggggagucggggagggcgggcuggaguugacacagugcaguugggggaguggggugggaggggaaagggugcuggcagcaggcugugccucuggguccccauuggcucugaccagcccugggagggcucagcaugaguguggaggugcagucuggcuuccuagucaacaccaggcuacggagccagcaagggcuucacugccgagccugcaaugaaagaacagucauagcuggggccccaguggggccuugggucccugaggaucuuucagacacugaaaggaucugauuugucaccauggucaguggccaaacaucauggcagaggcccuggcacauccaaguggucaugaaggcugguccugcugccuggggggccuuaccggcaguauaaccagggaccuggggacugggggagagucaugcuguguucucuuaucuugugggacagcugggacugauacuagcgcaauguguaacugaugaggaaaccagaggcaaaaaaaaggcuuagggauucacgggagguuacacaggcaauuagugagaggugccacgcaaagcuucccgccucucccugaaccaggugcgucccaggcggggcuugguggcugcuaucuguaggacugcaggguucuuccauccauugcucuuugcagaaggccagcugggcacccucuucaaagucucucagaggauuucccucagauucuagaaguccccgaacuaagagucaugagccauauggcaacagguggaacccggaaaacauuguugccacaagcuugccuaugucagucacugugacaggcacuuggaguagccccagcuucccuagacaacuugagucccuagaggaccucugugacccacaugugugccuuugggaaccgguggccagagaggccggggcguggagcugccugcauuccagacuacacuguugcaccuucaugcuggaugggauggaaaggcacugaaagcguuuuagcagagcuguggaggggcaggagcaacuucagucucucaagaagacagacaggaagcucgauccaggggcaaagugagaaggagccucguagcccaagcccaauucagccuucgcugaaaugccccuuuguuucccaagugguaguggguguugcuucaugccacauuugggggaauugggucugggguguggaggaggauuccuaggccgagggagcauccaguguccugcccuugggcucuuggagccaggacagaaagggcuucaggagcccucccacccuuuuuccugacccuucuccaugaagucuucagugagcccugggucucgccuaacuccuggccccuucuccuggacuggggcuccacucugaggccuauuuuccaugcauguccuggcuccuggcugcggcgaggaagcagauagugacucagcagggcucuggggcccuuccccaggccucaggcuuggggagcggccggggcacaguggaaaagcugagugccacccgccugcacuguucuuuccaucccgggccagggcaugggaugagacgugaggggugagaaagagcacgugugugagccacagauggaaagaaugggcucuguccagugggauggacggacugggacuaagaagagggcuggggucugucaccaccugucccacugccacuuccuuuccaacuaccgccugccugaaggaggugcugugucugcccuguucgaagcuucagaggagugucaaccucacuuuaaaaacagacccuucucccgacugucucccuccuacccccaucauuuuagacaugugaaaaccacucaaacucccugcccccaccucugccacacacaugcacacacacacaggcgcccugaccucagggaggucgacaaaaagcagaggugcugccagcuggucagagcaggcggaggugcuucuugugggcuggggccgagccggcugcaacagaggccucaggaguugggaccagggagacaggucccucugagcacccuggccucugggcauuuuuucccagccuccccuuggccucugcaccaagaaggaaagaguuggugguccucaggcccugggacugccagaggggacacgggucagggaugccggcccagaacuuccagcuggggcugacuucccacuaacgcagaugcugucccuuccugcagguuccgaggccucauccugcugcugaccuuccuaauuuacgccugcuaucacauguccaggaagccuaucaguaucgucaaggugaggcuggcuggcagcaaggaagagugcagaagcacacugucguaaccguccuuaccccuucccauggccaccgagguugcaccuucaccuggcaggcucccacucucaguggcugucuuccccaggagcuccuuuugaguuuauuccccaagacagcugugucgguggcuguggauggaauaagcgugcagggccccugggcuauguggaugcugcucaugggucugauguggcugcuuuccccugcagccaguuccugcaggaggaggugccaguagcggggacauagaaucugguaggaggcagugucuccaguaugguuggggcaggugguugcuugcuccccucugggucaaccccugaccuguaugucccauugccuauccagagccgucugcaccagaacugcucggagcagaucaaacccaucaaugauacucacagucucaaugacaccauguggugcagcugggccccauuugguaagaacagggcaaguugcucuucccauuccccauucccucuuccucgagaaggggcuguccagggagggcuuccugcaggggcauccacgcagucagcuuucuguuucucccaucugcuuucagacaaggacaacuauaaggaguuacuagggggcguggacaacgccuuccucaucgccuaugccaucggcauguucaucagguaaggacagaggcugagccuaugaccaagaggaggaugguuuagagcugcuaccuccccuuaaggaaccugggggcagcugggaaugagcccagggaugcugcauguacaauccacccacagccauccuccuugccuuaccgcggucgcagagacugcuccuucgccugguagacucccacugguagcagcucuuuugccuggaaauguucuccuggaugcugcuuuugagucuauucacucagauaccacaguugguggguauggacuaggacccuuuaagaauggcccugcgugcacauauaucugggagaauccccauccucugcuguguccaaaccagcacgggaagcaugcuguuccuugccaggaauccacgaucaauaaggcugcauacugccuccaaagagcucacaggccagugggggcaauggaugcauuggcagcuggugcuaaaacuguggcggcuccaugacagagguggccaucauguguucuaggagcuccgaggucauuacucaguccaagcugagcuagagcagaggggucggggaugcuucuuggaugagauggugccugaccugaugcaagggacuugggugcggcggugcagauggagaccugggcagaaggaauagcacgagcaaguagggcaaaugugaagaaacagcaugaucuacgggaggaaccgcgggcagguguauggagggaaugacaguguaaggaagguagcagcagggcugagggcugaggucauuugcacaugagguccaugggcagagacgcauggaaggguuuucgccagggcgucccauccagaugagcauuucugagagcucacucugagagugaugcugagguggaugagacuggucauacagagugaccaauuugacaguagcccaagcuguugagcuuauguuacuacaguggugauagagguggaaagaggcuauguacuggagcacuagcuaagagguagcccggugagucuuggagacugaaugugagggguggggaggaaaggugggaggcugagggagcucugagccuggcuugagugcccaagggguggcauucacucagaugaggauagcaggaugaugaaggcgucagggugguuggugggaagaggaagaggaauucagcuuaagagcacuggguuuauuuaaaugccccgggggcauccaaauaaagauguccaggaggcaccugucugugacugugaagcucugggagacagaucaggccugaagauaugcaugugaugccuguggagcuauuuagccuaugggugguuguggcaauggugaaaguguugcaaaagaccgcaccgagaggaaaacgcacgacacgaggggccggccaagcggaggaagaugggaaagcuaaauucauggagcauggccaggugucacagaagcagugggggacagagguuggccccgucacauggcaacacagaagucauuggugggaccuuggccagagccacuuccuagcguggugggggcagaaacaugguagggaguugagguggacacagaggagcuuaaccgcagauccaacuuucucuuccccagugggguuuuuggggagcggcuuccgcuccguuacuaccucucagcuggaaugcugcucaguggccuuuucaccucgcucuuuggccugggauauuucuggaacauccacgagcucugguacuuuguggucauccagguaugaaucaccgucuugcacuugggccuguguugccgucucgggaaggaccugggagaccgcagcucacagcgggugggagccuguguuccuggcucccuguccagugcucucuauuacacugcacugaguucuaccuccuggccccacugcccccgcauuuguucacucagagaguuggccuugagcacaacgcuguggucacuuccaaugcacgagaggcuuggucucugcuugaacaaucuugagcgagagaagccagcucaugccauugaggagguguggcauguguguaagggaaggguaagguuuguagugugggguauggagggccccuuggccacgaaauugaaccuccucagcccaggguggucagagcagggagccagucgcacagcccaggccuguucccacccucccuucucucucccugcaggucuguaauggacucguccagaccacaggcuggcccucuguggugaccuguguuggcaacugguucgggaaggggaagugaguguaacaagggaggaggagugggaaggauugggagggcuggggguccugagcuggucaccguggccucugauguaauuucagagggaagggucagaaagcggccuccacguugcuguucacgugcuuagaaguggcuaaaagcagugcugauuuucucacugaugaggcuuuaacccauagagcaggcaaccuuaguuauguuuuuuucuaauaauagauuaauuucuauuuucaacgaagacaaaaagaagccuauaaaacuuccgcccugccccccaaccccgaccccgaauuggcuugugugcaaaacaaaguugcuuuggagaaggaguucucacccuuggcacuacugacuuucugggcuauuggacccuuguuuggggacuguccuaccacugcaggcuguuuaguaguagccuuccuggcaucugcucacuggaugccauagcacacccugagcugugaccaugaaaaaucucuagcuguuaccagauaucccuuggggguaggaucaccccugguugaggacagugcuuuagagugagaucgugggacagaagagaagaacgagggccggggcccccaugcccucaguguggcuagagcucccaucggcacucacucagggagcugggcaggcggagcgagaccacaggcccugcagccaccugcuugacaccauccaaggucucccacuccuugcugacuuggggcuuuggggcugucuuuggugccucggggaagcuguagucagcccagcuuuagagcuuggcuggggcaguugcuaugaacaaugugcuuugcuuuuuacuuuuuauaccucuucccuucucucccucccuuccaggcggggguucaucaugggcaucuggaauucccacacaucugugggcaacauccugggcucccugaucgccggcaucugggugaacgggcaguggggccugucguucaucgugccuggcaucauuacugccgucaugggcgucaucaccuuccucuuccucaucgaacgugagugggccccucacuccccacaagugagccuagaaguucucgguuucugggagaaggcagcuggaucuacuggaaagauugcuggucacagagugggaggaccagccgugugacuuuggacaaucuuucagagccuuuauuuucucauuuguaaaauaauaauaguaauaauaaugucuauuucguaggauuucugcaggcuuaacugagacaccauaguuaaaaugccaggcccacaggaggugcuuggcaagcauugguugaaucugagaggugugaucagggaggguggaguugaagggacauuguuacagugaccaggcucuccacuugcugcagguggucuugugcacuagccaggccagguaugagagccacucuguagcuaagaguacuaaaguccaagaggcaguagugacacugcugguuguuaggaaagccaggccuagaaagcugucuccugagccccaggccccgcucccuccugcugggacacacacuggccaccuuaggagcuggaggcggggcugguucccgggauggcuuagauccagugcaaggugagggccuggcaaucaccucgggauugggggggcggggguugggaaacuucuuagaaagcgauuuuuuuuucuagacccagaagauguggacugcgccccuccucagcaccacgugagugugagcccucccagcccuaucccugcccuccaacuccauccagagggcuggacccggagaggccuggggagcuagagcagggaguucuggcccucacugaccucaccgacccagugcuaggcccauggguuggcccuacagccugaugagucuggcaggucaguccagcccgagacgaacgugugccuccccauccugggagccagugucucuugccugggcugcaccuucagcuggugggaggcagcacauggacgcacccacagcagggcucaucuccucugcucagggugagccagcugagaaccaggacaacccugaggacccugggaacagucccugcucuaucagggagagcggccuugagacuguggccaaaugcuccaaggggccaugcgaagagccugcugccaucagcuucuuuggggcgcuccggaucccaguaagaaguuuguggaauggaggaaagagaggggcuuuccagauuuuuucuguuggugaugaggagauggggugcuugggugaucuauuuuucuagaacuucuuuauaggggagguguaaguugggcagccugcuuggggagggcagugugggagauuugucuugaaacaaccuugcacaguggucauguugcuuuuauugggacuggauguguuggaggcugccuuguguggcaggugauggaaaguacugggguggugcugagcaccccuuggggccaccacugaacccaggaccucuggaccccuucccaugugcccccuguugcacuccccagggcguggucgaguucucucugugucugcuguuugccaagcuggucaguuacaccuuccucuacuggcugccccucuacaucgccaauguggguaaguccaagagaaggggaaugaaggggucucugaggaggccaaggcugccucuggugggagaggaagcccgucguggugaugccugugauuccaguauauaggcagaauuccugcugaaccucuccuagagugaaaggagcuugauuuaguuguuuacuuaaaugaaagcuaaacccagcaaacuacccccuagacccugacuccagccaccuuuucuccccuuggaacugagcuggggguuaggaacucagagcucuguucugcaauucuugcuaucuucuucucuagcccuuaguguaggagaaacccccuccaggcugcuuggcucauaggugguagcauuggaggugcuagggaaggccugccugcuagaucucucccccagcccaaggaagagggccuggugagugaccccacuccuuguagccugguggugacccugguggucuucuccccgugggaccuaaugugaucgaugccccugugccuggaucugcugggcugcacugguguucuguccugucucauggaccuacucccgucugcuccugcccagggauguauagaugagaagagcucauuugaaaaaggauguuucauguccaccuggccugggucucugcuuuuccauaggucaggcugcucuaccaaacagcagcccaccccgcccugcccagcccccaggagccuccaagcuccaccagggcugagggccugucacccaguacugcugcccucccucccagcccuggggaggaacaacagugccuugccacacauugugcucgcucugaacaggauacuguaggaauuagucauggccaaguucaagccauagcuugccccgcagcucugucggggccucucucgugacaguguggagcacuagggcagcuuuguggacaccgugacucuuuguuuuguggccuuggugcugacuucagaguaugaggcacccucgaggguggggcuacaaucucagcuucuggacauuccuuuuuuaaaacauggagccaaggccugugaccugaggccccugugucccugcaagucuccuuccuggcucuguguaugagcacagccuaagguaaacgggaagaguuccuagugcugcuagggccggagugaagcagagaaagggcugggcugagcuucagguugcgcuccaggggaaagguggccacgggacagcaggcucgggggccagaucccagagcuugccagggagggcuuguucugagaggugaaggucauccugcaggggaagagggcaacacaggacgggaccaagagggcgucuauccaaacugcugcauucucacccuguggcccuggccagccugcuccacagguccccagcucuuccucggaaaagggggcaguggucuggaucacgcucugcagggcuucuagcugugacacuccaggauguuugccccaaaccccaggucugaccacauaccuguauuuuccacagcucacuuuagugccaaggaggcuggggaccugucuacacucuucgauguugguggcaucauaggugaggccuugcccugcucugccagcaggcucccuuccccucuuuucuuguggggugcaggaagaagggacagguccgaugggcuaugaccuggguagguggcaccagaggaaaaauggcuccuggguuuauucucagcucugauccugccuggcugggugggccuaagaaagaugcccuuuuguuuggucuccaguagugaugggcacuacaggaaggggagggcuguggaaaaagcagcucugcugguucuugcugacaggcccaggccagcacuggggcacagcuggggugccaggcgaggggauggcaggguccugucugggagucagugcgugaguggcuguguguuccaggcggcaucguggcagggcucgucucugacuacaccaauggcagggccaccacuugcugugucaugcucaucuuggcugcccccauggugcguauaaccccgagggugaagugcgaaugcaugugagcaggagccugugugggccucuggccuaugugcacguccacgcguuacacacauugaugucgcuguguacgcgugcacaugcaucauugugcacacacgggggaggagaagcgagggucagcagaggcaccuuggaaaaagagccagacugcagacuuuagagggggauucaugacucuuuggccuugguagaggagaccgccuccuaaacuucuugaucaaggaaagaagagauugagguugaaucugagagaagacuguuuggagaaagggagaugauagaguaccacguuuuagaccguccaucccugggacauuuaaagaccagagaaaucugcauaggcaggggaaaaggaauaggaugcccucugggguuucagggcaggagaugguuguugcagaccucagggcuccaggccagcaaagggauuccgggugacucugccucuccccucuccucucucagauguuccuguacaacuacauuggccaggacgggauugccagcuccauaggugaggaggagguugcaaguccugccaggccaggggaaaggcacugccuugggggccccaugaggcuggcccacggggggcacugacagguggaggggcugggagggcugaaggcuggagagugcuccugccuugggguuggggcugcggguggugcugcuucucugacuggcugucucuaugcugucccagugaugcugaucaucugugggggccuggucaauggcccauacgcgcucaucaccacugcugucucugcugaucuggugaguggggccaccucccgagggccagggaccguucugggggcuuggucagggccaccaucuccagguccauuucucccugucucccaucccgcagaggagaaaccgucaaaguccuucagaacgcaccaugggccccucuccucucaagcccaaaccccaguuaccaccuucccugagucagccccucuccuguccugguucugcucaugcugcugcucagcugggcuuccccacuccacugucucucuccaggggacucacaagagccugaagggcaacgccaaagcccuguccacggucacggccaucauugacggcaccggcuccauaggucugugacucuagcucuguugugggccggccccuaggcauagugcccuccggugggcaggggaggugcaggaccccugcucacgaggcugugcuccauucaggugcggcucuggggccucugcuggcugggcucaucucccccacgggcuggaacaaugucuucuacaugcucaucucugccgacguccuagccugcuugguaagagucuugggguacacagauagguauugagggaugcucuguccugccagacuggaacccuggagguccaaagcguuggccauuugggguucuggggcaaugagagcagcugcccuuugcucagaagcacucucccucccccgagugaccccuugccaaguggcagcgugucucucccccuucuccacugccaguccacgggucacccuggugcugggcacucagugcucagugcuaacagugcccucccuucccucugugccuugugcuccacagcuccuuugccgguuaguauacaaagagaucuuggccuggaaggugucccugagcagaggcagcgggugaguccggggagcugaagcugccccucuaccaaccucauuucucgugggaaucagcccagcgcucaguuucuccaaacgcaggcugaggcucgaccagcccagaccugaggagcacugagccagucccuggguggcccucacccugcuaaccuguccucuguuguccccguguaucucuauagcucuaguaugguccuaacccaccagugauaguauuuuccucaagucccaugacuuuugugaguauuuacuucgagucugugacucgagugccauuugagugggggcugcaugcaaauccucuguccugcaguaugacuuuuuccaacuuucucuuucuucuugugggccaguuguaaagacuuucaaccucagcagagcauggugcuugggaaguguuuuccaaggggucugagaugccacagagguugguggccucuucccugagggacagugugagaacuuuggacaugcccucggggacagaggaggcagaaauagggaaaccaguuucccucugagcugcgacugagcugcaagugccuccugaaguucagaaaccaaggucaucuggccccucugccugggguaugcagaacaaaagcaacuaccaaucaaagucucugaaacaaaugugaaucaagcauggguggcuggccuggugugcucucugccuacugucugguggugguggauguggugguggcaucagcaggucaguggcugaggcuacacagugcugguggucugauggucgggcgacccucucccgcuggccguccugagcaggagccucgugcuaacaaggaggccgcuaaugagcuggccggagcuguggaccugggcuggauggcaaaugugaggaggaacccccgggacaugguaaccagcacgcaucuggggacacacuuccacuuaaggaagacaccacccaggggagagaaagugagagcaggaagacacacaacacaggaagcacgcagagcaccuguccugcccugcccugcccugcccuggaagaggggagcagggggcuggacugcaugacccaaaguuccugugccugugcuccuuggagccaggccugagggugggaagggaagaagagcagcagaaagcgaggaggauuuagugagcaacugcucuguccuggaauugugucuggcuuuagacgugugagcuugccucgcagcagccucucauugaaggugagagacagaggcucagagcucgggcacagccuaacacugaaacugggccugggguuuguuugcuuuucucuggacugccaccgcugucccaggcugguccugcuccaugggaggccugugugugaggugugcagugauuuaucagagcagacagagcacugugcuuggaauccaaaaaccccuggacaguccugcuuucuccacucacuccaugagaccuugggcauagcacuccaucagacccagauucucugaaccaccacaucuuuauguaugaauggggaugcuuaucccugaauaccuggcagaauugacccaaggcugagauaaaugggauaugugauauugcuuuguaaagcugucaaauguggcaugaacauuguaagguuuuauuuaauuucuuuuuuuuuuuuuuuugaggcggaguuuugcucuuauugcccaggcuggagugcaguggugugaucucagcucacugcaaucuccgccucccagguucaagugauucuccugccucagccucccgaguagcugggaccacaggcaugcgccaccacgcccggcuaauuuuguauuuuuaguagagacaggguuucuccauguuggucaggcuggucuugaacucccaaccucaggugacucacccgccucggccucccaaagugcugggauuacaggugugagccaccgcgcccggccagguuuuaaauauuaaucuagcuugcuauuuccugccugagaggugaaagggaggccucauuacagagaacugagaugaaagcaaugaugaagggacccugggacccugccuuuccucucccuacucagcaggagcuuaugaagucaucucacuuucucuucuguccccccucuccucuucaugcagguauaaagaaauaugaggccccaauuggaacagcagcauggagggucccaguuggguccccaacgugcuccccaugggcaagacaauggaaacuuccacaagcagggaaggcaaacccucuuuauugaacauuagccagcccagcccagaccccagggcugccuaaggacacagagauucuccaugggaaggggacugccaagcaugaggaaauagaagauucaggggccugagcucuggaagcugcaagcaaaagggaugggacuagggcugaguugugucuccauuuugauaaggaaaggauaugcucagacucuugcuuguucagauuccaagacagaaggcuucacaaggccaacgccuggaaaaugggcaucucuccuucccauguuaagcuuuaaccucuguaaucugccuguaucuauaggugggcaucucacuccaccaaaggagcccagccucucuuugucccucuauccaugcaacagucuucucugugcauuuccccaagcugggcccucuucuacucuccauuuaggccuguugauaacuccauuacccgcccaucacugcuguuccuccagggccagcacucgggcgaggcaggggagcugccuucgguacauaauuugaaggggcacucccucuugggcacaugccggcccugagugccucccuugccucacucugauccuggccccauaauguccucaguggaaggugaugggggccggugcuguggggagaguagaaagagggguuggcaugacuaaaaauaccaguauguguauuaaguauuuugagaaugaaaugccaaggagugccuacuauaugccagcucuaggaauggaguagacaguggacacaagaaggacuuacgcccugagcacaggugccaauggugacaagacuggcaagacgugagggcaugaaugguucauucaggcagcugcugcagauguggucaccuggugccaucugcugcucccuuuuccacuuuucuauguccuccuuccaccccaagucccggaucacucgcuguuuucuggcuagcucuuggcaucuccaucugagccuaaaguugcccacuggcaccaauagauucuguuugaccugcugugcccaugcucaucuuugucggggcuuggcuuggcagcgagcgaggcuggcauggggugcugaaguggggucucagugaggggugacagcgugcuggcaguccucacagcccucgcucgcucucggcgccuccucugccugggcucccacuuuggcggcacuugaggagcccuucagcccaccgcugcacuguggggagccccuuucugggcuggccaaggccagagcaggcucccucagcuugcagggagguguggagcgagaggcgcgagcgggaaccggggcugcaugcagcgcuugcgggccagcuggaguuccgggugggcaugggcuuggcgggccugcacucggagcagccggccggcccuuccggccccgggcagugagggacuuggcacccgggccagcggcugcagaggguguacugggucccccagcagugccggcccaccugcgcugugcuugauuucucgcugggccuuagcugccuucccgcggggcagggcucgggaccugcagcccgcggugccugagccucccacccgcuccaugggcuccuguggggcccgagccuccccgacgaguaccacccccugcuccagggcgcccagucccaucgaccacccaagggcugaggagugcgagcgcacggcgcgggacuggcaggcagcuccaccugcagccccggugcgggauccacuaggugaagccagcugggcuccugagucugauggggacguggagaguccuuauguccugcucagggauuguaaacacaccaaucagcacccuguguuuagcucaagguuugugagugcaccagucgacacucuguaucuagcugcucugguggggccucggagaaccuuuauaucuagcucagggauuguaaauacacccaucggcacuguguaucuagcucaagguuuauaaacacaccaaucaacacccugugucuagcucaggguuugugagugcaccaaucaacacucuguaucuagcugcucugguggggccuuggagaaccugugugucgaaacucuguaucuaacuaaucugauggggacguggagaaccuuuguaucuagcucagggauuguaaacgcaccaaucaacgaccugucaaaacaggccacucggcucuaccaauaagcaggauguggguggggccagauaagagaauaaaagcaggcugcccgagccagcauuggcaacucgcucggguccccuuccacgcugugggagcuuuguucuuugcaauaaaucuugcuacugcucacucuuugaguccacgcugcuuuuaugagcuguaacacucaccgcgaagaucugcagcuucacuccugagcccagcgagaccacgagcccaccgggaagaacgaacaacuccagacgcgcugccuuaagagccguaacacucacugugaaggucugcagcuucacucuugagccagcgagaccacgaacccacuagaaggaagaaacuccgaacacaucugaacaucagaaggaacaaacuccagacgugccaccuuaagagcuguaacacucacugcgaggguccgcggccucauucuugaagucagugagaccaagaacccaccaauuccggacacaccaggaccaccaaguggguagguuaaagcucaugacagugggcacuccugaaggggaugcucaugauauugaugaugugugggcaaauggggagcuuagagcgccacgcaagauaaaagccuugcauuuccugggacguugugggcuggugcauuagccagauacacacccuuccacacugaagcaggcugcacagcgccaauggcaacaaacaaggaaggcuccuccugccugcagucacuucagcucugagcgcaggagucagccagggaccuccaaguccucagcccacaggggcaagagcuauacucuggccuuauguucagcauucaggaaagcugcucucugcugcucuuugacauugagaaugaaaugaaauuaguuauucauuuaacuucacauuuggucucaauuaagcucaaaauguucuuccuuagagaugcuccaauagcacuuguaauuaaggaguuuaaggagaagcuguguugcuuauaugagccacuagauggugacccaaucccaucauacagcccagggugggcugugguuccauccugcuuccuggaagagagacaggagccgaggccucuugacuuuucagacuuucagcuugcuuucugcuucagagggcaggggaagaggaaugguucucucaaggucuucucuuccccaacugcacugcuuacuaacuuuaagccuguuucaucaucaggaaaauggugacauuaucuaccucauaggauugguaugaagggagacacauacucaacacacuccugcccuugaagaacuugucuaguuaggggauaaauaggaaaacacacggagacagugacuccaggugagagcuaugcuguucauuaguccagccaugcaggaacacggcuggcagaagggcaauuccgggggcaacgggaagaguccuucuuccuuaugaaggcagaauucugaggacuuggaugacucauuugauaagguagugagggguaauggaagagggaggaaguuaacaugaauacuuauccaacuccuaggauguuaggccuuagagacugaaacugaacaaauggcauuggcuccuaccagcagguaaguguggcacuagacacaugcaaaaggcauugugcgagcucagggucuggccucagaaaugaggacuuaggcuguggguagggaguuggaaaaaauacugaagguugggggaaccccagcacugagaucugccugucugcacccaucucccaggucccagguuacuggcccuguuugggcagcucugggcgcagccuguucaccacaggccugguaccugccuucucccugggccucagcacucacucacacggggcuaauguaggagcauuacguuaauuaguuauucauuuaauuuaacuucacauuuggucucaauuaagcuuaaaauguucuuccuuauagaugcuacaauagcacuuguaauuaaaaagcaguaacucuuuguguuucucccuuagaaauccacugggaggcugggcgagugugugugggguggcugggggaggaggaggaggaggcaagaggcaaagaaaagaaagggaaagaagcucuuggucgguccuagcaccaugaggccaccacuaagacugaggcuggcaggaggaacucaacacauccugggugucugagugggggugggagaguugcuguugggaauccugagaagugacaaaggagcagaccuccuacugaaagguguggggguagggaggauggcagauggggguggaaggaggcaaugcuuaggggagaaggggcccuauauucugugauagguacaa

SEQ ID NO: 15920 - RNA, 389 nt, Homo sapiens
uucuuugucuucuuuccuuuuucuuuucauguuauuuuaauuuagaaauagaaaacaucuuggaagaaauaaaaaggaagaaaccacaaaauauucagcaaauuuucacuccaugagcuucucaaacccucacuuguucacccaucccuaagauggaaaacacuccuccaaaacauauucagcuaccagcaauuauguuauuaauaggaauaugaaccaauugcacagaaaauccaaugaaucccauuauagcaaaucuuauugcuguugccauggcaaucuucugaaauuuuuuucuaucagguucggagcaucuuuaaccagcugaacugaguccuuuacaaacugccaacuuggcucaacaaacuguauuacaugauccaugauug

SEQ ID NO: 15921 - RNA, 4810 nt, Homo sapiens
ggagacaguaugguacccacagacuuuaauuauugauauucccccucaccgcccucagggaucgggagaagucacacgaccauagggagcuuggacuugguggucgucacggugcuggcagacgagggucuuuccaggaaccccuugcuagaaucagcccucauacaagugugcucagagaucccaggagcgauggcauccucccugauggguauaggcaaguucugagugaacaguagaagccuccugcggaggagggccguccucuaaccuggggacucuuaaauuucacugugcuugagaauaaucugcggaacuuugguuaaaaugaaauuucugggccucaucacuccccaacgcacaacuacaggaaggcuagaaguggccugaaucugaauguauaacuaguucccggugauuucuguccagguaaucugaggacuccaccuggagaaauguugcucugaucccuauccuagacccugacuggcagcuaaaguggaugacagaggcaguuuccccuccccuuuccugauuuccuccacagaagaauugaacucagcugacugcucaggacaaauccauuuccuggcaucuacaagccacuacuacucccaggugguuaaaauauaugaaaauaccuucggaacagaaaaguaaacuuuauuaaauaugaggaggggcagggcaguccugcaaacagcuucccugccacagcuuguggaccagccacuccacccuguaccgcuugccuguacccucaaauacacagguuacacugcugccaccagcaaauuccacggcugaacaacaccuccugccccuaaacacacugaaugaugucggaguuugaggguugcaggcacccgcuuuuaacucaagcccuuuccucccuccuugcgccaccccccagcccuccugcucaccgaaggucacuacccccauaugucuccuugggcuucuucccccucucuuucuggaaccugaccaggcagaacgcagcaacugacagcaacagcacgcccaggagcaccccaaucagagcuccggccacucggccuugggaggguucuaaggagauacaggacccucacucagaauugcaggcuuuccucggcccaccagccgacagcuuccccaacacaaggcugcuggccuggccuccacccagcaucccuaccggucacagagagggucagcucacaggaugcacugcccaucugguugguggccacacagcgguaggugcccgaggaggucagggagagguuggugagaaugagcuggccagacaccucaucuagaggaugaagaggaaguguuccacgacucauucaacucagugagcagcucuacgaggacagcacauuucaugucauccuuauaacaauccugucagggagcaacuaauuuuuuuucacuggggaggaaaccgguucagaagaaggaaguagugugucugaggugacccagagaggaauuccaaagcugcuacaacuuaccuguucuuuccacccuacauagcugccuuuuugggaggaggaggacugcacacucaugaaggauucagaaacuggcaauggagucgggguggggugcuuacuggcugaugucagguuccugguuugggguaaaaggcuugauugcuagaaacugcauccuguaggguggcucuaagcugacacaaaugcuuuucuaaacuguuuaccuuugccuuagaaggcagagcacauaccaggaaggugaucugggggugggucauucauuucuggauugauaaaggaguuugcuggggcuggagagagaacuggauccaggaagaggaagccaagaaacuaaggcuccuccaaagaaacugguuaaaagauuccagccaguccaugcuacucugccucaguuuccucucuaggaaguuuggaagugguccacgacccuuaggaaaccuaaaagaaaucuccccaaggcagauggguggucaucaucagauugcucccugcccucuacucucuuccaggauaucagcaguauauucagcuugagaaauacccccaggaucaugcagccacagacugcagaaagacaggcaggagggaacaauacaggaagccaaggaagagacagggaaagguauagugguuugugucauaccccuagucauggaacggauaauacgggugugugggauuuagagaccagauuugcccaggucuccaguacccucuuccugaugcccugggcccuuaccuugaaccaugcugccaggagaagguguaggaaaaguuccaagacgcacccaguuguacacuggcuuaggagcccccucggaagagcugcaucucagugcaguagagccucccacagagguuuguccacucugacugcauaagggauuacuggggggaacugcaaaaaaaaaaaaaaaaaaaaaaaaacagaaaguuccucagcaaucuuccagccccacucccaacuccauuaggugcuacauucucuacuucaauaccccuaucaaacagugguccucuuggguccacacaccacugcauccccaggaacugagggauuuccacuauuggaaauucugauuguuagagaaaauucuucuucauguugagccaaaauguguguuaacauaaccuccacccauugguuucaguuccugcccuuugggcccacaaagagaaauuaaaaucucuccuccacaugacagcccuuuggauaguugaauccagcaguaauacacccauccgaggccuucucuuuuccaucuaaacacugccagucucugugauaguuuuucugguugcucaucucugaaaaggcucuaguuuggggugagacagaagcucugagcacgaaguuggugcucaguaauaggggcccuuguuccuuugguggccacuccccuucucugccauugaccuugggagggacagaauccaacuaccgaugagagccucccccaugauggagcugcugggagcaggcucagauccccauguaugggaaggacuuucucucacacacucuguuauuaggcucugauggaggagaugcucucgguggaggguggaguuggaguaugaccaucugaauuagaagacuuggaaagggaguauuuucacuuggggcccccagugcaguugugugcuugggcuaaaagucagaaaccagagauuuagcaagaccagugcaaacgccccaaguaugugaaagaguauguggcucguggauccccagucugccuuacccagcacaguaagguugauuagccccaacccauugguguagaaaucugguggguuguugacuuggcagagguagguuccaguaucugagggguggacgucagucaguuucaguguggccacccccacuguggggggguucugaagcaggcugacccgcuuugacuuagaaccaguuggauacagauggccauuggugaaguacaggaucuggggagaggcagaagacacacauaugugccuguuucugccuggcaucaacucuacaguccuuccucaucaaaguggguauaagaggccucugacuuacaucagccagggaggcugauacccuuaagcuggaacuccaaaggucucucuguccccaaacaccacccccuuucaggugcuaaaugaaccugauccauuggucucucucucucucucucaaagagagaggcagaagaggcagcauauuaucuugguaucagucacaacaccuuagugucaauggauacacuaaggcaggggaguuggaaauaggagcuauggaagaggaaaggaagauacacggucaggcagacugcagcucugaaaagaucuagggagagcccacuuaccuuuucauccaagcauacugauccccaaacucccccucccgaccccaugcccucauccugggcuccugucccuccaggccaacccagcuucaugcagucgcucucagcucacuggaugggacucagagauggguuucccaggcugcacaaagcuccacuccagggcgaagcugucucccaccgacgugcuguaggugcaggucagcucggcugucuuccccaggggcgugcucagcggcucuguggguaccuucaccuccacggccagcccuggggccggggaccagagggaggugggaacccaaauuccagugaucuggagggucgggcccacccccgggcaucuauauuggaagcugggggcucccuccccagagcacaacccucuccccucaauccaaccccucccuucccaaaaccugagguuuccgggaggggccgggucuuuguggguaaaagagccggaaccgggccagguaagaggguguguguguuuagcagagaaaggaaaacacuagcccugcgguggggugguucaggccugugccgcggagaggcccaacucgcucgccggcuugggggucucucuccuacgcccuccgggccuuggacacccccucuccggccucaccucaggcgccuuagggccccuggcgcccacggcagccucaucuggccuggcggggacagaguggguccgaggagccggggaagccaggccuaugccccccagcccucgccguggucccgcccggccccuccucaccacucaggcacaggaagccuagcagggccccgcagagaaagggccccgggagcucggccauggccgcguccggccguccuguccugcuccugccaggugggcggucaaggucggucugggugucgggcagggaagggagcacccaagggcagccgcccgggcugggcaggagcgagacugguaucucagagcaaaca

SEQ ID NO: 15922 - RNA, 7470 nt, Homo sapiens
gaacacuuggacauuccucuuuauuguucacauuccaacccagcacagucacaugcacacacggagaucagaaaccuuucggccacagccccaggagcccggcgggggggagggcgggaccgacaggggcggggcggggccguggaagacuccuccuaccgagccucccaggcgcucggcguuugcauaaacaagagagcuggagaggcugcccucaacagugcgcuggggaaaggggagggaacgugacaggcaggugugggauagggacuucucuuccggucagagcaagggucguccgaaaccaaaacaacccucuucccuucaucucgccccggauccaaagucuuggggcuaggcuggggcgggaguggcacggagauguagggcgccccuuuuagcugcgcacagaacgaaagaacucguuuuuucuuuaagugagugugcuugggugacgcuuagggcgcccuccgcagugcgcgcaggaaagcgcacugaggcugcggaggcagagcugcaugcugggugcgggaagaggugggcgagaagcaaaagaaggaagauugggagcgcaugguuuagggugggguggaguggaagggcaaauggggaccauacuagacugcagaacuaacuaaaagggcacggacucagcgacuccgcgacggagccugccugggugagggagucucugggacgcagggggcuccuguagcuggcagguugcugggcaggagggggucacaaacacggcagggaagucucgucgcugcgaaggggacgcggcauccaucucuccucgggaacugaggagagaaaaggucugagaaccugcccucuucugcuacuuccucuuccccccacccuucccccuuucaguaccaggauucuuugggcggugagugccagagggccccagucacccagaacccccaccccgagucaaagcgcugaaaugagccccgcggcagguacgugugcgcgccgcgauguauuucugccccuuggccgggcuugugcagccaaaugggguggcugcgcaugucuugguccagguauguccccgucgcagccucgggcgucuggauguaucagaaaacccgcaggggcagggugcauuuuccccggcugggaggggugagggugggcagagggaagggcuggggauucgauccuuuucucccacucacgggucccaccccgccgccuaggggccguguucauuaccuuugaaaaugcucaguucuucuucgguccagggcggggcagaagggaggaugcagagggagaaacaggugagcuccuggaauccgcgcaaccuucagccucuucccacccaccucccaucucggauuucuaucccccaacccuuagcucccuccacgcccccugcaccuccaacccgcccuuauucucccccugcuccuggggagggcuggggaagggcagcugucagccagccgcgcgccgcccgccucaccuggccuagucuccgcuggggccgccgcccgcgccuccccgggccaccccagcuccgccaggccccccagggcccgggcccuuccggccgcgcucuccgcucuuuaucuucuuccgcgccauguggccccgaaaacucgccuggauuuuggcggcggccgcguuggcgccgggaucguccagcgggaugucuagaaugucgucguccggcuuggagcaggcguucuccugggggcgaagcagggggguucuuguggggucacugggucuugauccgcgggagugggguaggaauagagcccugagggacagggacuauggcgacgcgggggugggagguacagagaggggugucgagccuggagcagggcuauggcagggacacucacuggggcaugggcagcgacaggcgaagaagguucagggccagguggacagucaugucucaauucaggaaagagaagugcaggcaggauugggugcgggagagccaggcccaucaccagcaccgaguuaggggucugcagagcugauuggaggguggguuuggaggggcaaggaaaacagcagcaggcacuccuggaguggccgccugucccccugcucucagaggguaccuccagcucagaaggacccagucugaguccaggguuuuccguggagaggauggagaagccucaguccgccagcccucuccccaguagaaaugcagaaagcucacagcuggaauuagggagaggauggggauacuagucagugagccagccucccccgaccuaaggcuagaggcccagagauuguuuucccauugacucuucauuuuccacugcccaaggaugaacucaaacacaggagauaggagaugauuuggaugaagugauaaagaaaaggcuucacuccaagaaaaaaaagaaaaagaaaagaaaaugaaaagaccugcaggagcaagaagcccuuuccagggugugcuuaugaggaagaagggaauuauggugauagcuaccacuuaagcacuuaccuuguuccaggugcaauaacgguguuuuacaggcauuauuuuauuuagucccccaaaauaaagcuauuacguaccuuuuuaucauuaccccuaauaaaacuaaugauuagacuguuuaaaaaccuaccugggucauacggacaguuaccaguggacccaagauucaaaccuuuguauuucagaguccagaauauauauuuuuaccccuacuuuguaggauaagaaaaugcagcccagucaaccagccaaggucuaccauuugcuauagguguguggccuucggcaaguuaucuaaucuuuuccuaucucagcuccuuccucuaaaauaucaggauaaugguauccaccucuaugggucguggggaagaauaaacagcaugauaugcauaaagucucuugcacaaccuagcugcucaauaaaugguagcuuuuaugcuugucuuaaaaauaacauuaaguuaaugugaaauagucauuuuuguaggccaaaaguggucauauaauaacaauuucauaugguucaaccuaauaauaaucaggcccaccucuaugccccaaacuagguuucugcuucucugacagccugcccuggcugaaaguagaaggcgugaggggauugaugguauagauugcagaggaaaggcuauggaacggagaggaauucagccucugagcccuuuuguugcauuaacauuacuugcaguauuagugugggucaggauggggaugguuacuaugaaguuagaaggacauuucuccuuugaucuggcucacuggcuucuaggaauuugccuccuucuuuuuuuuuuucuuuucaugaagucuuccacugcuuugacuaucuuuuucuucuaggacacgagaugaccaagguuucacauaauaaugguaauucaguucugcacauuagcucucccugccaucauccauccgguucauagaaguggacaggauaugaggaaggcuucagugaucacuguccuagccagauucugccccaggaccacaagcuuaaacuccagaugcccaagccccggcuuauaaaugguuccccucgccauguuucccaagguuagccucauuuccugggcuucacauucuucaauucgugcucaagaugcccauaaucgauuuaaacacaguuaaaaggaguuacauuuugguagaagagucaaaaaaacagaaagaaaaaaagaguuacaaaaaggcagguaugguuguggaaaggccaaacacaggucuagggugcucagaaaagacuccuuuggaauguuuuauucuuagagcucaagucuuucuugggauauccucagggaacagugaggcuucuucucaagagggugacaaccauaaaaaagcauuccugaccuaccuuuccuccuuggccucgcagcuguggaggagugggaagguugaguggaggaagggauaucugccuccaaccacgcuagacccgaccugcugucaccgcccgccccagcuggauccagaauggaaaccuggaauagcaggcaaagccacccccgacacuccauguuccuccccagaaccagcucccucuccuaccagcugaauuuucaggacagagcugccagguggccaguccacagguggaaguggaaggagauugaaaggaccugggaagagguucauuggucauggugccuggcuggugcuuuccaaagccaagguugcuggugugugccugacaguuccauaggaaguagggacuucugggagggaggaggagguggaaggugcccuggucagcaaagugggguccaagccuucuagucccaacugggcacaucacuucaucucugagagucucauuuucuucagccacaacuaaugaacaaagucuccuucagcucccaaauccgaauagcuuuaaggauauccccugcuugcugcuuguuauuaugucaggcccugugcuaagcgcuuugcauauauuaccucauuuaauccccauuuuggaagucaggaaacagccucugagacauuuuguaacuuagcuaaggucacucaguugacaaauagugaagugaugggauucaguagccucugcugcuagccacugccucagggcagguaauuauuucuaugaauucagcagggccaagccaacuagacuaagcaaaagaaaugaggauccaaaaaaauucaugcgcuuuuucaugcgcggugaaugcaggaaaagucauauauauauauggcuauguaaaucagcaacugcaauauuugaaucagcaugaauaaaaaaccauuccucugucucuuaaaaaaauaggcagaucuguuuucuucuuccucauuucuaucugagccucuguaccaaggagaaacgggaauaagacaggacuagauucuucccaaacaccaggugaugcggucagugaggagagcuccagaaucaaaagaugaagaaggaccugccucuagcccccaagagguaugcuguucuucccacacaucucagcucucucccagcacugaguccagcccuccacagaaaggggaggaaaaugcccaccccuagcccugcccuuccccaacccuccacacaucacuccuucuucuuccugcccuccugcacagucugauaauggugcucucucuugcucagcccuuuagcccugcagaccuaggacagggcaugacuugggaaggcuccugugcacagggugcacuggaggaggugccccaggcccugggccauggagauaauuguguaucugcuucucuuuuaccuuuuggguggguagccucuccuuuuuuaagggacacugacuucaaccaugucuacuaaucccucaguauggcucccugggcacucaagagcaacaguuccaggcagggacccccacauccuacucuaauuacuacugcagacacagaggagaccaauuccauuccuucccuggccucuuggauucuuuguuuacucaccucuuuccagugaccacgucucccacuuccccuuccccagcaauacuccccugucauccucaccucuccccuccccccagcucauuucccagaacccaccauccauuuaucuucucuacuuuauacaacacugcugggaggaagggcucuuccucaguggagcccaggaaccuccaugaggagcccauuucucccuucacaaccaaaaaauugcuuccuguagaauaacaagcagagggaaaaggcuggaaggagauauguuaucgggguguucuccagggggugggacuguaggugacugacauguuuguuuuucauacuuuucucuagguuuuacguuuucuauuaugagcagauuacuuuuauaaucaguaaauauuuagaggagagguuaaaccacagcucuucgaagaagacagggcuauguuugaauccugccuccacaguuaggagucaugcuuccuuggaaaaaucuaacuuucuaaaccucaguuggcacaucugugaaauaauaccuacuucacaggguuguugcuaugauuaaauauaaagugcuggcuacagggcaggcauucacaaacuggcaacuauuacuuaaacuaauaagaguuaaaaucgcaaccaccaccacuugccccuaaguguucucugccucuugguacccagacaugggaaagucucaccuauuauagaacugggcuauccuucccuuccaaagcccacuuuuuuuuucuuuacuaugccauaagguggcaaagucaguaaccucguguaucauuagcugguugacugaaugacugaaaauacaaggacuuuggaauagucuuucuccaagugcagaggcaaaaaauaaauaagcaaacaaauaaauuucauauacguaugaucacuguacucuuccagugaggcaggagccagggccuaugccaggcgcuuucauaccgagucaccuuuacagcaaaccccucgggcgcugggcacuugcaguacccagguuuccgcgugggcgcugacaaauugcagacacuuccuuuccucgccagcagggcucucucgcggucacuucacccagccccuuccgagcgagaaggccuugggggccgggacaaccccuccccagaaccacccugacuaggcucuuugcagccagcaucacuaccgagcuaaccaauauggaccagccugcgcugcacagggcgcuuaggcgaucguuggagggucaugaggaucagccuguccgcccaccgacggcggcgcagugggauggggaacggggugggggccgaaagacgggaggaaggagucgcugcagugucuccaggcgaugguugccagcgucucacuggggaggaaguuccuccugucauccaacccgcaguuccccucuugcagagcccugccgagcucccaguccagccuaggcugucuaacggaugggcgcucagacgcccccgcgaguugaggagcauuuuuccuagggcuuccaagucgggcgggcgccuuccaccauccaccacccacgucucggcaaggaccccuuuucuuucugcuccuaggucuuccgcauccacuuccaucccucucucgcccuccagggcuuucucaggcgccucucgcagcggaccccgccaagugccccucccccgggcccucuaacuuacggugcagcaguccaugcuggugucgggggguccucugcggggacgaaggcuggcgcagggcggggguggggucuguguggugccgggugggggcucuggggcagucggccgccagccgacccgcgccgaaacagcagcucugcucucggguccggucucccgcgcucggcuccgcucgcgaauguaaccugagccccgcggccgggaagccaaucaggagcagccuccggcagggugggcggggagaaguggagggagggccacgcccucucgcggcucucugcgccgcgcucccgcuccugccccagccccuccgccuacacgcuuguauccaagccuccuacacacuccauccucccg

SEQ ID NO: 15923 - RNA, 106456 nt, Homo sapiens
augcagacacacacacugcccacacacccagagacacacacccugcacggguugucacccacugacauccaaagacaugcucagcgugggccccuuaaccacuguggggccaaggcacccacuagcgcuggggaaaggucccucuucugagccucuagguggcugggguuugucagcaaggugggcuggugggacucagccugugauacucaaauaggugagcuaggacaaaggacagaugcaguaagggauggcugggucugccucugcaggcucuggucuuuggcagaaugaugccaaguuauacuccccaugguaaccugccuggccuagggccugggugccaccggucaacauuuggaguaugaccuacuguccagaugggcuuggacucguaguuguucuugacuuuucaaauuuuaaagcuucucaucuacagucuccagcccccauagcuacugaaggaaaacugcuggccuggaaaggagaugagcucuggaagggaauggccagguuagggaggcaacuggggcauguuggugggugccgugggauggagccagcaggaagcauggagaugacaggggugaggaauagaagccaaggcaggugagggauagacaaaagagaggauaaaagauggauuagugggaagcuccugugguccaauacagauucuucuugggacagauggaaggggauuuggagaggguugguccuaguaagcaggcagaaaagccaaggcacgugacaaucuauuucccaauaacuuguggcuuccccuucucggagugggcaccuucugaacuucacauccuggcucaagcccguggagggacccauaaucagaagggggcuagaaaguaugaggccugugucuuugguggagcugaucugggggcuucuuaggucaggauuuuacccauuugaguggaggggguggagguagcaggaaauucaguuuucucugcaaauauuucagcuuuugcuguuguaguauuuuuagcaaccugguuggcagaggaggagcccggguacauuuuuaaaggggccucugccaggcuggaggccucuucccacccucaccccacaugucaggaaggagagggggagaaagcacauggcuuaagggguccauucaaagguagaaaucagguuugcuggacauuaggugaccguugagucauuuucaccaguagucauuuuguucugucauugucagcaucaugauuguuaccagcauuaucaagaggaguaaauauuucuugaacuucugcuauguucagggugcugcuagagaggcaauacggaaggcucgguauaauauauuugcuaagauggggaaauaaccaauauucuagagugaguucuaggcuaaaucugaauagcacuuuacaaagugcuaccacauccauuauuuaaaguggugcucucgagaacagugugaggagguauuacucuuucuuucuuucuuucuuucuuuuucuuucuuucuuuuugagacagagucacacucugucacccagguuggagugcaguggcacaaucuuaagcaaccuccaccucccagguucaagcgauucuccugccucagccuccugaguagcugggauuacagaugcucaccaccaugucaggcuaauuuuuuuguauuuuuaguagagacaggguuuugucauguuugccagguuggucucgaacuccuggccucaagugaucugccugccucagccucccaaagugcugagauuacaggcauaagccaccgugcccagccuaggagguauuguuauuucuaaccucuuuuucugaggaggaaacugaggcugggagagguuaagugacuugcuauuuguccagcauuagaucucugaggaaaugcagaacuaggacuaaaacccaggaguucugacuuugaauucugcauuucuccuguacagugcuccuagcguaagcuaagcaaaucagacauaaucucuuuucucuuggauguuguaauccgauggaaaaaguacauauaugugcguguauaaaauaaugaaugauagauacgaaaggaauuaagcagacaguaaauguucugggaguugagguguggaagaaaugacugagaauuuggauggucaaggaagccucccuggaugaugguuugaagcaagcaugaauccaaaaguaucugagacauguaucaaucaauuuggagaguucauuuugccaagguuaaggaugcaccuguugacacaucuucaagagguccagaugacaugugcccaagguaguuggguauaagcuugcuuuacaaguuugugcaagggguacaguuugcuuuuaugcuuuuuagggagacauaauacaucaaucaauacuugcaagauguaccuugguuugaucuggaaaggugggauaacuugaagcugugguggagggugguggcuuccagguuauagguagauuuaaaauuuuucugauuggcaaucaguuaaaggaguuauuaucuaaagaccuggaaucaauagaaaggaaaugucuggcuuaccaugauaagcagaguuuuaucaugcagacaaagccuccaaguagcaggcugcagagagaauacaugguaaauguuucuuaucagacuuaaugucuguguugauguuaaugcuggucggcuuuuccugaauuccaaaagggaggaggguauaaugaagcaugucagacccccugccuucccaucauggccugaacuaguuuuccagguuaacuauggaaugcccuugguugagaggagggguuuguucagauggcucaagggagccuuagaauuuaauuuuuggcuuacgcaaaaauacgacuuagauaagugaagagggccaggagugggcagaagagcauuugaggcaggagcaauugugagcuaugcaccacacuuagugucccugugagugcaugccaucccagcccagaagggcccugaggucagcaaucccaguauccuuccucuuacccaggguuuuauguccaaagcucagugcucugaauucaucuacaguaccauagcccugcugcuccucagagcucuaaugcacaccugccccuugcuccuauagaugugccaggugucuggauccucugccuucaucccauuuuuucuaggucucagauguaguucaaaauccuggaugcgguagcuccuuauuccuauuuugcuccaaacaccuacuuguucuuaccuuuccaccucccuuuccucagcuugcuuccccaccucuccuaaugugugaaagcucugauggcuaagcaaugugugucccugcugggccugcacauccugccugcaaacauuagaccaacacaauuuuuuuuuaauaacaaggcaccaaccauuugaauaacaagcucuagaacaaaccuaauaauaagcauuucaguguugguucagacaacgaccuguuuuaauugauuucugcaaaaagacuuacaugagauguaguuuuuaccuuauuucuuagucuauuuaaagacguuugcuccuuuugugguucugcuggauagucagauccaagaaauuccugguuuaaccagcaaugcaugccugcugaaccaaaugagguuuaagccauucuccccaacauugucuaccucugggcagaaggaagggggaacucuuauccaggagagcgauauucucuuaaaaucauccagaaugaguggcucuugccugcguguauguggucagcaucccaggcucacacuuuuccaugcugaugcucucuuggucugagagcuuguacugauuguucuaaucuggauccacuggcuauggcuaugucauuaauuuggcaucuaguauuuauugccucauauuaacacuuaaaaaacuuuuuuauuuuagaaaaacuuaaacauaugcaaaacuaaauaaaguaaugaacuccacuguacccaucauccacauucaauaauucucaacuuaucaucaaacuuauuuaauucauaugccuucugauucccccauuaucauuucauucauaaauaucuaaguaugucucucugaaaaauaaggacccuuuaaugcuuacuuuuaaagcauauguucauuagccuauacguucuguggggaaacagauuagauucugaggauccaauguacaauauggcagcuacaguuaauaacacuauauuguuuacucgaaauuugcuaggagaguagaucuuaagugugaucagcacacacacguacaccaaaaauggcaccuauguguagugauggauguauuaacuaaugucaugugcuaaucauuucacaaaguauacauauauuaaaucaucccacuguacauuuugaauauauacaauuuuuauuugucaauuauaccucaauaaaaccugaaaaauauaaaaugaaggcugggcauggugacucaugccuguaaucccagcacuuugggaagcugaggcaggcagaucaauugagcccaggaguuugagacuaaccugggcaacauggugaaaccccaucucuacaaaaaauacaaaaauuagccagacaugguggugcaugccuguagucccagcuaguuggguggcugaggugggggaucaccugagccugggaagucaagccugcagugagcugugauugugccacugcacuccagccugauagagcaagacucugucgaagaaagaaaaauacaaaaauguaaagaaaaaaauaaagaaagagaugagagauguuuucuuuaccgcuguagccuuagcacaauauccagaacauaguggauauucaauaaauaguuuuugaauaauugaaugaauaaggcggagaaugaaagaauguaugucagaggaagcaagcaguaaagaaaaguauauugcuguggucaggcaugaccuucuuugcagcaggucaugauucuguuagagguccagguaugucuucagcaacaacuaagaaguuaggccuuaaauagggaggcaacucuucaucucucugagauuuggugcuggggcuuccauuuugaggaguggagacagagagaaaguugaugcugagguggccucuuuuggggagcaguugggagauagaacaagacugggccugaaagccaggaaggagccacgucuguuccaauguaucugguuuaaugucacucucugucuaguuccauuuuauuauuuccuuccuuuaacuugguuaagcaauucuacuuugucuuagcugugugaggggacauucaaagaagaguuauauacuuggccuugggccagagaggccaggguggggcagucagcuugguggcagcaguccuuacggaggcaucacaagaggaagcgacuuuaagccuucauggccuuaguguccugucgcaaugcagggauuuguuuccagugcuaaucuuggaggguuuuauuuuuauuuaaaaagaggagacauuucuuucauuggguggucugacauagcagaucccaauugcuuaaauaagcucacaggcuaaugacuucuaccuaucaggucaaagcggcagccugugggguagacgaagaccaccuuuucacugcuguuuaugaggaauuaagggccuaacaccuaucaucucuaaaccaauccaagucagccaucuggcugaagaugguguuaccaauaaucaucuucuacugaguuuucauaugagcuucucauauaaguguuggcauguucugaaguuuuagacuucagaagaaagaagacauugacaggauuguuccaguggacugucguccgcuauggccaagauacagaugagcagauauuacaagucagccauugcaaggccuggguggcaggccaugugcaagccaaggcuucuucaaggguauacccaaagugaaagauacuucacauagcccuggacuuggaucaugacacaggaauugguuauaugaacaaaugucuuucuuuauguaaaaaugagaguucucuuacccagauaagcccuggcucuaaucuuggaaaaugaugauuauuuugacuuuucuuuuucuuuuuggucagacugaagcauugaaagguaaaggauuauuaacuacaaguuuuugcuauucuguaguuugggugggacauuuaaguuaaaugagauaaguagcgauaguuauuuggguugcuguauuuguguuauuuuugcuuugccuucaugggauuguguguuggaguggggugacugaggggagagcugggacgugagcuguuuuuggauuggguuguuaguggaaauguuuucucugcuuagagaaaaggcauguuuagagagaaggaaaugaaaguaaaaaccacacuucauuuugacuuaggauaacuuuuccauggauguucaguguucauauauaccuaguagagagagucaaagguuuguacuggauacaauccuaucuaguagauguucuucaaaagaggaagaauauaaagcuugauccuuaaaggagagacaauauugcuguuuuuuuguuuguuuguuuuuaaucuggagucucacucugucacucaguuuggagugcaguggugagaucucagcucagugcaaccucugccucccagcuucaaagcgauucuccugccucagccuccugaguagcugucaccugccaccacuccuggcucauuuuuguauuuuuaguagagaugggguuucaccauguuggccaggcuggucuugaacuccugaccucaagugauccacuugccucggccucuuaaagugcugggauuacaggugugagccacuguguccagccugaagaagagaaaacacuuucuguuccacuggaacaggaugguggagcuaugcuacuuuacuauuugcugaacacaugucagaucaugacagcaagaagguccugcacuugggauaauaaguggggcuguguagacuguaacgaaaccaucauggcagacaccguugcuuaccuagucaauauccaugcagucccucuucuugcuugauaaugcaacugcaguuuuguuggggugguuguggauccagacaugacaacgggucauagucuaagccuguuuagggcuagucaugagacacagauauagccaaugagauacaagccaauuucugcugaggaaucugaaaaagcuccuacuucccagauaggagagggcagauaguacuaccagccccuguuucuuauucccucaaagcagagcugaagucuggagcuguaucagcugucuuaugaccaugaagcaaaaugucaacaugauaaaaucaugagggaaaaaaacccucauaaucccauagacuuaagccacuaucauucagucuuucuauaauaauauguauaauauguauauaauauguauaauauguauauguauauucagucuuucuauaauauaauauaguaauucuauaugaauaaggcugggcucaguggcucaugccuguaaucccagcacuugggaggcugaggcaggcaaaucacuugaggucaggaguucaagaccagcuuggccaacauggugaaacccugucucuaccaaaaauagaaaaauuagccaaguaugguggcaggugcuuguaaucccagcuacucaggaggcugacacaggagaaucacuugaacacaggaggcaaagguugcagugaguugagauugugccacugcacuccagccugggagacagagccugggggacagagagcaguuuuuuugucucaaaaaaacaaaaaacagauuuaagugaacgaaucccuaauaugccacaauaauauaagagauguucgaaugcaucagaucaaugcaccuaucuuuuugacaagauggggacagcauguggaaguuguuuccagggauucuuugauaacagacccugaaaugucuaaguugggaugccuuguaauucagacauaaauuuaugcaaucuuaugcaaccuugauuuccuaauggguuguucuagcuuggcuuugcuuagccgaaagaaccauugcaggauuccaagugacuguuuguuguucccguagucacacucaagccuuuguccccagucucucucauuauuucuaucaugucaaccucucccaguugucccaugucuggaguaugggcuugcuauaauuugaauuacuaguaacuaaggaaaauuccuuuaagacaaagauacccagagauagaugaggacuggauggguuuaggcauuuuaucucuuagccaaaaggccgauguauauugguuuuaaaaaagugauaggcgguaggcccuuacucccuuaugaauggcaguggcuggcugguccucauuccauccaacuggccacugguuuggccugguaggcagcagucauuaauccaugaacuuagucaagggaauuaggaucaaccaugucagacaacccagugaggaaucuucucuuuucuuucaaugaaaacaaaacccuccaagguuagcacugagagaagauugauuaaaggcagagugaauguucaucuagagucccucauuugugaagccuuuggagcuccuuuggggaguggcgcccguucucugcuguuccugcagacagcacucgguaguccauaacagaugccaaucuaguuauucggauauucugaaagauuaguuagauacccuuaggacaaggacucccuaaaaguucuugucucccuuaaaaugaguauuauuuacuuuuaauuauuagauggaaauggcuuauacugaaaagcagaaaccucugggacacugguagggcacuucuuuuuauuauacauuuuuauuauuguaaaccaauguauauauacauauauacaagggcuuaaaaauuuauuuuaggcugggcacuguggcucacaccuguaaucccagcacuuugggagggcaaggcagaagaacugcuucagcccaggaguuccagaucggccugggcaacacagugagacccuguauuuacaaaaaacgaaaauuagcugggcaugguggcacacaccugugaucccagcuacucagaaggcugcggcaggaggauggcuugagcccaaaaguucaaggcugcagugagcuagggucgcaccauugcacucuagccugggcaacagagugagacccugccucuaaaaauagaaaaauaaaaagaauuuaucuuaaauuaaagcaaagauucuauaaaucuagaaggucuuaaaccauuuuccagggagcacuuucugugccaaaucuuuauuaugagcauuuauuaugugccaucugcuuuguacuaagugcauuacauacuguauugaucaagacucuuuggguggaaaaggauagaaacucaacuuacauuaacauaagcacugauucacugaaagggcagagguggaguuccaggaauguaaaauccuauuaagacucucuuccucccuuuaugucacuuguuucugcuuccuucugcauaaugcugacaucuccaucaugcuggaaccguggcugcaggcagcucugaacuuaagccauuauagccuugggacuaaggaagaaauagaauucuucaauugcaaccucauuaauaauaauuguaaaauucccagaggagaucgcugauaaaccagauuugagccuuaugccuauccuagcacuaacccuuguggcuaggugagggaaguauuauaauugacccagccuguggcacaaccguguggccaguuggauucauugacuggcagggccugcagaaccauuugguaagaguaggggaaaagcaguuccacaaaagaaaaggguguuuuggacuggaugacuaaagaaugcacguacaucucaauacauuauguugugucauacucacaauaauccaagcaaauaccauuggugaagaaauaccauucuccaauguuuucuagguaaaaaaauauauauauggggaaaagaaagguuaaguaacuugaacaaggccauacagcugguaggcaguaaagcugggcuucuauucaagucuguuugacuccaaagcuguccccgcuauuuggccaccucuccugccuggaugaauuucuccucaaucugugcauuuuacucagagugacgaagccauuaagacagaagacuaaauuugcauauuaagcaacauucucccgcucugcuccccucugggaaaggucauuuuugcacugagggcucucccaggguucugcuuccuucuggaauaacuaucucaaacaaaccuggggauguuaugaagccacuuaacugggcugacguggcuggaccaagggcuuagaacaaugccaucagguuucugucucccuuuccauuuuucagcagugccucccucagggugucucuguguuagauucacccucagauuggccuuuuauggugguggaggaaggaagguuauuagaauccccaaacucucaagagaaaaagacaccgucucucucuauguacccguauauaaaauuucgugaaagggcucuaagcaaccuuucuugggcguuugcucauguuacugacaaacacuccaggaccacacagacuggggcagggaugagccagcccuaggaagggaccuuggcagucgaaaacauggccacguugaugccuagcaaggcagaaucauugcagaguaaagagcugugaucagcucccccacuucccuguaugcccucucgccaagugugugccuuauuggcagucaucacacugccuugccguuguuucugucuuaccuuccucacuaggcugugacugccuauagaaccaggauuuggccuuucauuuuuuugagguggggggcugggggggaggguggugucucgcucuguugcccaggcuggagugcaauggcgugaucucggcucacugcaaccucugccucccaguucaagcaauuuucuugccucagccuccugaguagcugggacuacaggcaccugccacacaccuggcuaauuuuuuguauuuuuaguagagacgggaguuucacuauguaggcuaggcuggucuugaacuccugaccucaggugauccccccaccucggccucccaaaguguugggauuauaggcaugagccaccgcgcccagccuggccuuucauuuugacaucccagcaucuagcacagugucugacacaugguaggagcucaauaaauauuuaaugaaugaaugacuauaauauaaugcuaugguuuauaugauuuacaaugcuaugguuaagaaaacaagcauuuuccaaaaaucugguaugcaccacaguaguaaaaaaacuaccacugagaugccauugcauaauuuacaaaguaaauuauaggcacuuggucaacacauuuuacauauguaucucauuuaaaccuaaacgcuguggaaaguuaugugccacuucuuaucagccuugcacuuggcuggaugagggugagggaagaucgcaacguagaggacgcagucuguacaaaguguuuggucuuauggagaggcaagacaaucaagauaauuagaaaaccucuuccagaugauacauaauaaguucuuccauucaaaucgaugauuaggugcuuccuggccaaaguccagugucuguuugggguugcaaggaggaauuggggauauauucagagcaagguuaaaggagugacaacaagaugagcuaaaaaaaaaacaugauguguggaaagguucacggaacgggaaugacucagguuggagaagagaagaccgagaggaaacugaaucauuuccaagacaaagaagggcucucuugcugggggaugauggccagcuguccuccuuugccucugcuugcagagcaaggggaaaugggcuuagaccgaaggcagggcuaagauuagagagaaggaagaacuuggcagugaaggauguuguauaaccuaguuuuugagacaacuuggggacugaggagacucccacacgccuggucugagcccaguggacgugcauguggggugaucuggcugacuggcugggaagggaggaggagguccugaggcugcauuuuucuguguccucgauuucccguuggaaguuaaguucccaaauuguggagcuggcaaggcagcaccucccccacccaccacgcacugcaccaguguuccugggcuggguaauaaugccugucauuuccucucccgggggaguggggcugcaaccgcccugacagccccgagggauugaaggcaacuaaaaauagugcauuaaauauaaucuguugaggggcacauuugcauugcuuuucuuucccccucgccugucucuucauccuuccuggcagggcaggccugggucuugcucugggcacugggaaucagguuccgggcacuggcugcucucauuuuguugcagaagggcucucuagacaagagggccgaggucaaggauccccaagggugucccauuccacuccucuccauucccccugggccucuggguccuucagggccugaaggugcagggggaggagcugcaaguaggggaggcaguguugaaaaggagagccagccagggcuuuguucucccaucagccacuuccgucugcuacacaaucucucugagguuaaauauuaauuaagagcagaaugacagugagagcugagcagugucacuuucugucccaacacaaaugcuaauuuccuccccuguagaaagugacuuuggagugggauuggcagcgcagggggaauagcuggggagaggggaggagaggcagcagggagagauggguggcggcggcagcagcccugcgucagaacuauuaagaaugauaaggcaaggaagguguuugugcugggauuccagagggaagacaggacacauccagucacagaggacaccaucacggcacaauccuaagcucuucccacuuuaacgacagucaucuaagaaguugagguagagcugggucuccccacuucccuaagacugaguucuuaaucuugggucugugcguugguuucggggcucaucaaaccugggaaguuguuugcaaaacuguuucugugcacaucaccaguuuuuuuggagacagaguuuccagcggggcugguaugugauccacagugucauccucagcauguggugccaucuuugaggucagcuuaugguuugagauggcugcuggagccucagcugaacaccuagauucuaggcaggaagcaggaaaaaguuggugggcaggaaagaccaaaaaguuccacuccaguuuucugucccucuuuuaaugagcuuucuuagaaauccauuucuaucuuacuguccacaccuaccugcaagagaggcugggaaaauaugauaguuucgcugacauggggcaucuccaugucauacugguguuuguguuuguaggaaagaaaaggagagaaugguagacaacuaggacuuucugcugcagugucugucucacaaaaggucaacaaccuuggauuugggggaggagaugcuaccaucucucaagggucucugugcucccugcucagacagagcugacuggaggaaaaagccuaccauggaaaugccuacuuugguauggauuccuaagcucacaauggguccucagaagcugguccuccugagugaggguggcaggguuauucucugaccagggcuugguuauuagaaaggaggcuaaaaaggagacgcuuguuccauuaaggaccauggccuuguggggggcuuugcagcguaugcgugggaacagcuuuguuuggucucugauaaucaucuucuucuuggcaauacuuugcuccgcacagccuggaacagguggcugaggagagggaagauguuuucaccucuuagggaaagaugaagugaggaaggcucugggguguggguaugggaugggugagcugggccagucugagauuccacuuguuugggaccugggugguauauuuacuucaaucccuuucucuuagaucuuugagccuuugcacaagcuguuccaucugauuggagugguuacccauugguggacucuuaaucccucucuaagagucggguccaugaagcuauuccugauuuuucuugaccauucucucuauccccaaccccugccccaggaaccuucuugugauucuguaauccucuguacguguucugugaucuuuacaaccacaccugucacauuguuuaaaacaaucgacuugccuuccuccacagcgcuaaaagcucccucaugguagaaaauguuuucggccaucuauggcauacgacucucaaaguguuccauggggaugaacaaacuuuacaaaguguuaaucaacaccugcugugagcaaaaugcacuggagauaagaaggggauuaacauuaaaaaucacaaagacagucaggcaugguggcucaugccuauaaucccagcacuuugggagacugaggugggaggaucacuugagucuaggaguucgagagcagccugggaaacauaacaagacuccaucucuacacaaaaaauuaaaaaugagaugagcaucauggcacaugccuauagucucagcuacucgggaggcugcggcaggaggaucgcuugagcccagaaggucgagacugcaguaagcuacgaucacaccacuccacuccagccugagcaagagugugagacuuuguuucaaaaaaaaaugaugaagacacuggcuucuaggaguucacagucuagugggggagacagaaguguagauuacggaucugauaaaacgguaaccgugauaaggugcagggaucuucagaacaggggagggagagauuaauagaacugaggggcucugggaaggcgacacugauuugugcuaaggcuuugaaggaaaagucacaucucuaucuuuagggcagagaaagggcaaagacaaaggaaaaagcaggagucaucucuggagaucagguguuuugggguuggagaauccacaugggaaucugggaguauuucuauuuguuggguuuuuuuuuaaacauggggaagcugguccuguguguguguuagguugauuugaagacuugaccuuugucugcuuuuuguguaagaagacugggccauuuguuccuguauggacugaagguguuugugaaagugucaggacugggagauggugccguucagggaagaggaggcaagaggccuggguggggacagggucugcgaugguugucaccuuggucugaguguuuugggggccugugggaaggaggacccaugcuagguucuccccucacccuuuccuuuuuugucuuucuuaaaauacccuguguuccugcagcagugcggcugcuaaucuaaaauaaaaacagcaggaaaugcaaauggucagguucuccuagcaacaggagccaacccacgcagggcguguggagcagagcaaaacuguccugaggcugggaugcggguggcugggguaaggaaaacgucuucucguacagcuuggccccuccaacuuccaagagggacuggcugguggacagccaccugcugugcagaagaaacucucacugggcuggacuggggcagaggacuguguaccagggagaaggugcaagggugggggagagagcagagcccuaguugaagacaccugacugcaguggcuggaauacugccucucagagaaccgacacuaggagucuaacuaggugcaugguugggaagggccuggauuuguguacacauuuccauguguccauuucgauaaaccuguggauccuugucauuuuuaagaugaugaaaugaaaggaugugcaaggugacucagauuccuagguaagggguucaaaaucaggaaacugcaagauucccagagacaucuuguuccauccccuuuuguuacaaaggaaaaaacugugguccagagagguaagugacguucucagaacacagacaucauuaguggaagggguggaaauggaaaacaggcauacaggcugagacauuuuauuuuaaguagaagcugacgaugucucuacucuguucacagcuagacaguuagaagccaugauaaccucacugggccccagggggguugcagggagaaaucgucuuaggcacaucaaagaaggcugaagacauuugagagauaaaugagggucaccuccccaguggggugccauagaaaagugagcaccuggaggugagaggggcaucggcuggggguagaaaccaaaggauguugcucagacugccaagcagcuccagcggucgcuaugcacagccauucuuuggggaucucaucauggaaaaggguaaaaaagaacauugcugugucaaggcugcacagcaggaaacuggagaaggugaggugacuugcucaaaaagacagacccaagugugggugaacuuggaagagaaccuuggaauucuggcucccuggaucccagagaaguccgugugcccuagacagugugguuuccuauuacauaagcaacucuuuuauuacucacacucgcuugcuccugcaagacuccuacagcaucucccccuagaaaacacaguggaagaaaaggguucuuaguuccagcugagucuuggugacuugaaugccuggucacuccuaaggauuccaggugaauaacagcaacaagccacaucacggaaacuggugcacuaagagcuugauuucagaacugugggccugcaaaugaucuguacauacaucugcguacuucacuuccccauggcugcauggcgccccauggccagagcacucugagugcccucagugccuucccaugcugccucauccuuuccggccaaagccccaaauaaggcaguugaugaauagaagaaagaacaugggcuuugauaucuguagccuugacucaaauucuagcuuaguaacugugugaccuuagggaacuugcuuagcuucugaguauuggauucuuuagcuguaaaacaagagcaauuaugccuaucucauagauguacguaaaaugcuagcacagccagacauacaguaggcauucaacaaauauugguuucuacacuucuuacuugugguugcaguugcucagggaccaggugggaguuucaauugcuauugccaaggcagggaaugcuauuuuccagguauuccaagauggagcucagaaugcaaugcuuccacagacaaagaauaguuugccuuuauuauugauuaaauagguuuuuauggguggaucugggaaugcgaccucuguuuuucaccauuauauucccagcaucugauagaguagacaauccauaaacauuuguugaguguugcauauaugagaaaaggcauucuaaauuauagacaaccaccuuacaaaauaauauuugaaacauaaugagguucauaauacuugaaacguaaguucaaucuacuuauagaaccucuuugaagucaggccuagaaagacagaucugggggcccagggugguagcugcuaugcuagugacucuaccaagccaugacccauugcagcccagccccuggacaacucccugggucagacaacagacugcacuagucccuauacauggguuuugaggaugugggguuggggguggguucuucccaggagaccucuggguugauggagccacuaaaguauaucaucaucacccuuggccuuggccacuccauccucuauuccaaccuuccagcagcacagacuaggggcauauucaacugagaucuccucccuccaaggaguuguuuguucuuuccucuuagucauaaaauccccuuuucccugucucucuccuuccuccuucucucucucucucucucucucucacacacacacacacacacaugcacgcacacacacauagagcuaugaauuugaauauugauucugccauuuuaacuccaaauucuguuucucaaauguggguaguguuggcuuacucacuguucucuuguugcuggaguuguaaaaaucaaugucccauugcugagaucgaagcucccugugucucuggggggcucagcagggacgauggccuccagaguggaccucugagaaauugcagaggcaucagagcugugggcucagcauaugagguccccagggggccauagacccccuccuccugggaagagugcuccugcagagcuuauuugcaaucuccuggagucccagacucaccaaaggauucagauccucuucuuuuugccuccuacauagagcacauuauagaccugaaacaggaaucagaauuccagacucccuuagugagagacaaaguguuaggucuuagcuuuuuccuuucuaaauuaaggguccucccuggaaucaggcugccugauagcauuauccgugaaacugguggagaguaggaaaaucguauuucucuuuaugggugggaaaucaggucauccucugcaaagguauagaauacucccccaggcuguggagagcauguucugguuucuacccagaaaaacuauagaggaaaacuguggcugccuacuacugaguaucaggggaaaaagcagagauauuuuuaacagacggaauaucagugaacagaaugcuaaggaacuagaaaacuuauuccaauaaauaggaagcauaugcucugccuaaagcaaacucggcuuuugcuauauacaaauuucaugagggaaaauaauguaggaaauugcggaaauaucugaccauaggugggcuacuaccgcuugcuacaggagaccuggaaggcuguguggauggaucggggaaagugaccggugcgccacggugcguggagcccuuggccaucuugucacgugggucugggaucguccagacucucaagaguccugggggcacaggguccagacggacacucccccccacacaaccccacuguguaauggggugcacagcacugacaaucggaacauccccgcaggcuucaccucccugagucuccaggcauggacgauggcagucucacuggcagagauuccugggcuuuggguuuuaugccacagguucuucuugcaacuaggaaaagcaauuuguaugcaucucauuagcgagaugcuaguaauuggggauauuaauuuuauugcuaaaccugacaaauauuuuacugucuccuguaguggguaauugcauccccaacagcccauccuuuugugcugccagauggaaaggauguguguuugccguuuucauuaauacaauuauuaccuuagcaucucgccugccugaucccuggcugcaggcucccugagacggggaggagaaggggagacgaagcgggaggccugcccggggcgaggcucugggacgcggugcggaggggcaggcgggaguuacugggaaccgcagccgccagccgggagcgcagcggggggaggcggcgcugccaggcgcuaaaccacaacaauaauaccgccgcugacaagugugugguuagggagcaacaacucauuaagcugccuaaaacucccccugcuucaucugggucccagagcagcuccccacacaaagggcgucgcugccacccucccuccccgcagucggacggcggacucgcugcugcggccacuccagcccccgccguccccauccucuguucccgucgccucaagcgcagccgcuccccugggaggugcuggaaggccccuccggucagggggauagcagccuguucccuuucgcucaggaauaggagcaaaaguccugcuccggcugcaggggccugcacguugcucucugaaucacucacucccuucucuauucccgcuccgaaggcugcuaacuuugccaaauauuuacuaugcucuucgcccaggcuccucagccaucacaggacugagacuggcagacgcucacuuuugauucgauuucccucucgaagagaugcaggcaauggcauaaccuuccugauggucucacagaggagaacuugaguagaaguggguucuaauccuggugggaaacucugagcuuaauaugaacucuuucauuugggaauacuuccugagccugggauuuuugaaacaaggcuacauggaaauacgccagcugauuagcuguuuucccugacuggacccgacucacccuuccuuuccagcauaugaccccucagcuuuacuauuccaaagaagcuuuccuugaacacagcugugcaagauaacccuucuagagaaugcacuacgugcugcguucacuuaccacuuggucaguguuauccugugugacucaaagugaaaggauagcuugccuggaccuguugcgaagucuuuuuuuguuuuggaucccacucaaaacagacagucuuauuaccuuauuaugagcuucccgauaaauggguagaaggaauacauucguaggugauauauuuugauucuaaaauccaaacaggcuugccaagcacuaugccucuuucuuugguagguagaugcaaccuguuguuuuuuaauuuuuuauuuuuuauuuuuuuuuugagacagagucucgcucugucacccaggcuggagugcagugaggugaucucagcucacucaaccucugccucccagguucaagcgauucuccugccucagccucccgagugacuggaauuacaggcgcugaccaccacgccuggcuaauuuuuguauuuuuaguagagacaggguuucgccguguuagccaggcuggucucgaacuccugaccucaagugaucugcccaccucggccucccaaagugcugguauuacaggcaugagcaauugccccuggccauuuuuuacuuuaaaaaguauaucuugauaugaacuagaccuguagaccuuuaugaacuucacugaaguggcaagccuuugaacguucuaucauguuaccaauacgauggacuagugugauguucuauaaaauauuaagacaaucaagauucuccaggcuacaugaugacaaugugcaggagcacugccauagccugagguaagagauugcuucugauuuccuuuggcgguaggaauggguuggggggaggaauuuguuaggcuaauaucugcauaccagcuuccaagggcugcauuguggcacugcugauuaaguguguaauaauccacagucauucuccaaaaccaucuggcuuuucuaagagccaggaaggaaguuaaguggagaugugguuagaaucccaccucugccucugucaagccuuuaauggguggcacuaacccugcaguuccucugggguaguggguuuacuuuggguuacuaguuuggcaugggggaguggguuggguagggcaauucuagggucuucuacuugcuacuggcuccucccuuauggccauaggauaccucacucugugagcuaggaaauagauaugaggaucucggcaguuuuuugguuguuuuuuuuuuuuuuuuccuggagaccgagucucacucugucacccaggcuggagugcacuggcgcgaucuuggcucacugcagcucagaugugagggucuuuuaauuacuaaauauaucuauuuuaaauauaccuccugaggcugggagccacaaaaugaauccaugaucccacuggacuuagaccaaaacucccgcuuuuaccugacuuccauaagcacauucugauuagugaaccaagguaggauuucagguuuuaggauuagucaguuuaauuccuuucuuacugccuuaaagaagggaguauccucugggccuuccuggggggauauggcuaggagggguuaaucaagcugcauauaauagauccauuuuagcuuucucaugccuguucacauuuagacuucuuccucugucuauaguaugccaaguucuggcauuucaucuuuacugacuguggcuugcuguugagauugaccaaucuagccgacuauuagugccgcuucccaagugcucaaaccaugacauuaaauacugauucccaauugugcacccauuucaauaaauucagcuuaaucaagucuuaaguuacauucuucuuggccuaacaaccuuacaauccacuuaaauaaauguucuccagacuccugcugauaaaaguuaaugaaguucugcaacucuuuuggcauaaagucuaucuccuugaggccuagccucuauacuuugcaaucuggacuaugcuggcauuuuacuuucuuuguggaucuggaagcaaugaggggcaguggaggugggucuugaggaaagucacauuuuuuuuuuguaagggaacugccugaggaauagucauugaaaggauuuuauucaauggaguugggguugcaggguauaaaccuccucagagagguuuagggggauuuuaggauucagauucuuagucucauccaugucuacacaaaugucuauaucgcaucucucagggucccaucucucucccuuaguacccuuugcauauuguaagaaauugaaacggaaggauuugaguauuuaauugguuuugcaucucugcagcuauuaacaucauuuuucagauguggucuucuuccauaucaguccauugacuagaggagaaggacuccauuagagcuacuguagagauguucugauuucccauaauguuuucaguuggguaugcaaggcuuucaauauguuuuuuuccguguuuacucuuuagagccaucagagacagucaguugacuccacagucuuuauaaucacuauugucaccauggugacuaaguaccacagucacuuuauuucuauugccauccuccuugaauuuauuccuugccaccaacaaugguaagucuagucacuguuaugucacugaaugccauggauuaccaguauccacuguucuccugguaaggagguuacuuaagaaguuuugugcuucuuaaguauaaaagcaauagaauuucagaauccuacugugggguucuguuuucuugggcccuuccugguaccuauuccuauauuucucuggaacccagaaggcaacaugaggcaaccacuaagccacacucaaauguggcuaagcucuaggugcucagguacacgagaauagggguaauugacguggauuuaauaaagguaauauuuauaaagaugaaggcaggguggcagauuaaaaaauugacuucaauucuucauucuuaucuguaucuguauccuuucaugcccucuugauggguggaccgugcuucccugccuugugucguugggcuuggccgugugauuuguuuuagccaaugacaugcgagugggaaugacagcauggcaguucuaagcuuaggcuuucauaggcaucauguauuuuuguuuguucuugugugccucugcugccacaagcaacauguuugcugaucuaaugaagaugagauacauggggaacagaguugcuccaaccaccucauagaucuacagugggaagcauagcugcucuagcuagcaaggcaugagguaaagaugcucaacugagcccagcguaacucagccccacucuagcugaccugcagauguaugagaaaaaaauagucuuuuaaaagacacuggacuuuggcguagugguuaugcagcauuaauguugcaauagauagcugaugcucuggaguaaauaaaaaacauuaagagaugggacagaaccucagagauguugaugguaggccgaaggaucaaggggaggaagcaguuacuagaaccuggagaguagcuagaggagaggacuguaugauaagagcuguggccuuugguugagggaugcaggcaauccaugagaaccagggagggaggcaaggggaaugaauagcaucaccuugcucuccucccacccucugaucuccuccuggugccugccauuguccaaccuagaaggcuaaggagcucauugaugcaguuuauuuaaaaaauccuccuagugcauaaacacaaugaagaauaggucuggaagggaaaauagaaaauaucuaagccauugugugucugaaaauaucuuuguuuuacccucauacuuguaggacaguuuggugacacagaauucuagguuugaaauaauuuccuugagaaguuugaagacaaucccacuacuguguauguaucuaaaggaaauaaaaucaauauguugaagagcuaucugcacucccauguuuauugcagcauuacucacaauaaccaagauauggaaucaaucuaaguguucaucaacagaugaauggauaaagaaaauguggggcugggcgcuguggcucacaccuguaaucccagcacuuugagaggcugaggcaggcagaucacgaggucaggaaaucgagaccauccuggcuaacauggugaaaguccaucucuacuaaaaauacaaaaaaauuagccuggcgugguggcgggcaccuguagucccagcuacucuggaggcugaagcaggagaauggcaugaacccaggaggcagagcuugaacugagcugagauugugccacugcacuccagccugggcaacagggugagacuccaucucgaaaaaaaaaaaaaaagugguacauacacacaauggaauacuacugggcgguaaaaaagaacggaauccugucauucauauggacauggaugaacccagaggacauuauguuaagugaaauaagccaggcacagaaaaaugaacacugaaugauuucagucauauguggaaucuaaaacaguccaucucacggaaguagaaaggagaauggugaugaccagaggcuugaguaguugauggggggauagggagguguuggucaaaagauauaccaucaugugucauguaaugacauuucagucaaugacagauggcauauacaauggugguuccauuagauuaugauggaguuaguugaagaaauuccuguaaucuagugaggucguagcaauccuaaccuuguagcacacuuauuauuauuuuuuacaaauuuaguguagccuaaguguacaguguuuacaguguugacaaagucuacaguaguguaugguaauguccuaggccuucacauucacucaccagucacucacugacucacccagagcaacuuccaguccugcaagcgccauucauggugagugcccuauacggguguaucauuuuuaaucuuuuauacuguacuuuuacuguaccuuuucuauguuuagguauguuuagauacacaaauacuagccauugugccacaauugccuacaguauucaguacaauaacaugcuguacagguuuguuacaggagcaauagacuauaccauauagcuuagguguguagugggcuguaucaucuaagguuuguguaaguacacucuaugauguuugcacaaugauaacaucgucuaaaggcagaguucucaguauguaucccugucauuaagagaugcauaacugcauaauuacaguuaggauaaauaaguucgagagaucuauuguauagcacaaugacuauaguuaaugaugauauauuguauguuugaaaaauguggccaggcucaguggcucacaacuguaaucccagcacuuugggaggccgaggcaaguggaucacuuaaguccaggaguucaagaccagccuuggcaacauggcaaaaccccaucccuacuaaaaauacaaaaaaaaguuagccaggcaugguggcgugcaccuguaaucccaacuacuugagaggcugaggugggaagaucacuuaagccugggaggcagagguugcagugagccaagaucacaccacuguacuccagccugggugacagagcaagacuccaucucaaauacaaaauaaaagaaaaagaaaaaaaaugcaaagagagcaaaucuaaguguucuuaucacaaaaaugauaaccaugugaggcaaugcauucgauuuaacuguuccacaauggauauauacuucagaacaucauaugguacaugacaaaugcauacaauuuuaucugucaguuaaaaauguccagaauaggcaaauauagagagauagaaaguacacaagugauugccagggccugagggguuguagggagaggaugggggcagagagaaacagggaaugacuacuaauaauuauggagcuuuuugggggguuaaaagaauguucuaaaauugauuuuggugaugguugcaaacugcaaacauacuaaaaaccauuggauuguacauuuuauuuuauuuuauuuuauuuuauuuuauuuuauuuuauuuuauucuauuuuauuugagcagagucucgcucugucgcccaggcuggagugcaguggcgcaaucucggcucacugcaaccucugccucccggguucacgccauucuccugccucagccucccaaguagcugggacugcaggcgcccgccaccacgccuggcuaauuuuuuugcauuuuuuuuaguagagacgggguuucaccauguuggccaggauggucucgaucuccugaccucgugauccacccgccucagccucccaaagugcugggauuacaggugugagccaccgcgucuggcccauuuuauuuuauuuuauuuauuuuuugagacagaguuuugcuggucaccuaggcuggagugcaguggcacgauuucggcucaugcaaccucugccucccggguucaagugauucucccagcgccgaccaccaugccuagcuaauuuuuguguuuuuaguagagacagguuucaccauguuggccacuguggucuugaacuccugaccucgagugauccucccaccuuggccucccaaauugcugggauuacaggcaugaagcaccgugcccggccggauuguagacuuuaaauggguaaauuguaugacaugugaauuauaucucaauaguuuuauuuuuuuaaaaaaaaguuugaaggaauuuccaguggacuccacugagagguuugaaauucuuuggaguucucacucuucaugugugcacuguuuugucucucucugucuaucucuaucuggaaacuagcagaaccuuguuuuugccccagucaaauuuucacaaauuuuuaccaugugccuugcaguggacuugcuuuuauucauuguucuagacaauuauaaguuucuuucaaucuggagacuaugccuuuuguucuggaaauguuucuugaauuguuucauccaugaguuacccuauuuucuuucacugcucucuguuuccaaauuucuauuuuucucucuucuauucucucucuuuguauuuuuacucuucuuucugggagauuuccuuaacuuuuuuucuucaguccuucuauugaguauuguuuuuaauagcauucuuuuuuuuuuuuuuuugagauagagucuagcuguaucacccaggcuagagugcaguggugugaucucgacucacugcaaccucugccuccuggguucaagccauucuucugccuuagccacucaaguagcugggaguacaggcgcgugccaccgcaccuagcuaauuuuuguaucuuuugguacagaugggauuucaccacauucaccaggcuggucucgaacucuuggccucaaguugaucugccugccaaaauguugggauuacaggugugagccacugugccuggcugauuuuuacuuuaaaagcauuuuagaauugaaauaugcuucacauaacauaaaacucaccauuuuaaaguguaugcuucagugguuuuuauuauaauuacuacauuguguuuuuaauauaauuacuacuugcauaauugcacaaauuacuucauccccaaaauauuuccaucacccuguaccuaucaguaguuagucccaacuccccucuaccuucagcacugaaaaucacuaaucuauuuucuaucucuguauuuaccuauucuggacaucuuauacuaauagaaucauaaaauauguggccuuuuguguuuggcuucuuucacuuaacauaauguuuugagguucauccauguucuagcguguaacaauaucuauguuauuauuuuuuaugcuugaauaguauuuugugguauagauauacugcauuuuuuuaguccaucaguugaugaauguucgaguuguuucuccguuuuggcuacuaugaauaaugcgaccaugaacauguguucacuaguuuuaguguucgcauguuuucaauucucuugggauuuaccuggaaguggaauagcugggucauaugguaacuccaugucuaacuuuuugaagaacugccaaacucuauuuauagaguuuuaaaauucugcuaacaagcuuuacauuucuaaaagcucuuuuuauucauuuucugaauguuucuuuuuaaaaauugaauguaauaucucucuucccucucugaugaugucaauacuuuuuuuuuugaaauuuucuucucccugcacagucugucuuacaaaguuaauuuaauuuuuuaaaaaaaaauuuguuuucccaaauaucucaauccuuggccaagccagagugauuguauucaggaguggggaaccagaaagcugauuggaucauggucuugaucaugugguguggguggucucaacuuggaguuucaaagugauucgaucggacauuuguugagaacuccuaauguuagucaucuuuaggccagauguuuucagagaaggaccuuccaaucucaucuagaagguuaggaucuuucuaccagugcucuggggaguguuuguuaaagacgauuggaagucucuguacuuaugauucggaacgcccgugaccacugaauccuccucuucaggcaugguauuuccguccucaaaggggccugguaccucccagucuagagacuauucuauuucuucuggacucuacaccuccagauuucugccaguaugagggaggggcaggcucccaguggcauggaaucuaaggaucaaauaacucucaaaaaagcuuuuacccaugguuuuugaaauuuagcccucuuaacuuuuacuucuuuuuucuuucuuuuuuuuuuuuuuuucggauggggucucacucuguuacccaggcuggagugcaguggcaugaucucggcucacugcaaccuccaccuccugggcucaagugauucuccugccucagccuccugaguagcugggauuacaguugcccaccaccacaccuggcuaauuuuuuuuguauuuuuaguagagacaggguuucuccauguuggccaggcuggccuggaacuccugaccucaaguaauccacccgccuuggccucccaaagugcugggauccgacuuuuacuucuaguucuggcaguaccugguacuugcuaaucuugugcuguuugugaauuuugggaugcuaauuguguugauucucagccuuccucacucugugggcuugggauuuggcucucguaguccugcuggauaaauuugguuuccagcuuucaaaacgugucgaugcugucucauuucuuguugcccuacccauguguuaguuaaaaucauuugcuguuguuguaauggaguuuuuggaggaugcagaauuagcuguauguuuucagucauucauguuaaucuagaagucuccaauccaccuuucuaaguaaauaaaucagacauuuuuauuucuauccaaaucagucauggucuaaucaggagacagaaaccacuauacuuauuuuaacagauagaauuuaauauaaauaauuguuagucagguauaaagaauuguuagcauagugacugagaaagcucaaagagaagacacagcuauuauggagauagaaacuucaagaagcagcuaccaccccuaggcccgaagcccugaauuacuaaaacucugaaacuuggaaaaagagccucaggcagcugaaacucaguacucugaggaggaaccugauaggcuggggcugguguuucucagggagcaugaugaggccgaacgcaagugcugggacacuggauuccacuguuccuggacugaauugcugcuugggaaugaggaagaagcaacgugauaccaacaggcauuggaagauugugccacucuccacuuccagccuugaagucuccucuaaggaccccuauucucugagccuaaaaaauccaccuggcaggggaaaaaugugguuugaagagcccgacuccagcaucacaaagccaaccagaagugggacuggaagcugagcacccacagcuuaguaauugguauggucuaccccuuuggcuacuuggauucguaugcacaugacucaacucacuuaaauuuccauacaaucacaaaauugacuguuucuaccuuccuacaaacaaagguauuuucacuuucucccccaguaugaggagacacaaaguucaggcagcaaugguauucauaugggggagagucucaugaucuauucugggcuauauauuaacuacuggucaaauucagucauaguccaaucugaauauucuguuucuaaacacuaccuugcuuuuuuuuccuauagagaugaggucuugcuaugaugcccaggcuggucucaaacuucucgccucaagccauccucccaucucagccucccaaagugcugcgaauacaggugugagccgcugugccuggccuaaacacuacuuuuucaucccugcucuccuccuuaguuucccucaguugguucagaauuuggguugggaagaggggguauuauauauugacccucuuaaacucuaagugugcuuaucauuguguuuauuagcuauugugcccauuuacauuuguaagagcaguauaagugaguuccagucauuccacaucauccacuuaguauugucagacguuuuaauuuugccaaucuaugaaugagaaauuacaucucacuauugcuuaauuugcauuucccuuguggaggaggcugagcaucauuuugccauauguuuauugaacuugaguuucucuuccgcucauguauuuuuuuuuuuuuuuuugaggcaggguguggcucuguugcccaggcuggaguguaguggugccaucauggcuuacugaagccuugaccuccugggcucaaguaauacucccaccucagccucucaaguaacuggggcuacaggcgugagcaccaugcuaggcuaauuuuuuuuuuuauuuuuaguagagaugaggccuugcuauguugcccaggcuggucuugaacuccugaccuuguaaucuuucugccucagccuccuaaaauaauugggauuacagacgugagacacuucucccggcugcucauauuuuuugcuuaauuuuugaguuuuuuuccuugcagauuugcaagaauucuuaaaaaaaauuuuuuuggugaaauauauuugaaacauauagauaagaagauaauuuaagagauauucauauucccaccauccagcuucauuaaaucuuaacauugucuuauuucuuuuaaagaaauaaaacauauacauacuugccguccuucgggccuucuucuucaauccuguucuccuacuguuccuccccuacgauaaucacuaucaugaauuuaguguuuaccauucucaugcaaagcuuuuacacugagcaggaguuuauauucuggauacuaaucauuuguuaauuuuaugcauuuugaauugcaaauaucuccucgcauucugugcuguguuuuucacuuugcuuaugguguuuuuugauauaugaaaguuuuuaauuuuaauaugaucauauuuaucagauguuucuuucaugguuugugcuuuuugugguauaacuuuucuguggauguaugucuuaucugcuuggugaaugucuauuuuuccuugaggaaaggaccaugauuuuuauacuuuuuucauccucuauagucuuauuauuauuauuauuauuuucugagacagggucucacucugucacccaggcuggagugcgguggcacaaucuccucucacugcaaucuccaccucccaggcucaggcaauccuccccaaucagccucccgaguagccugggaccacaggcacauggcagcaugccugguuaauuuuuuauauuuuugguagagauggggcuucaccauguuguccaggcuggucucaaaccuugauacucgaggcauuugggccagauaauacuguguugugggaggaucuguccugaacauuacaggauguuagguggcaucccuggcaucugccuauuagaugccagcagcacuccccuuuuccacauggagcugugacgaccaaaaauguuuccagauaucgccaaguuucuccuggggggugaaaucaccccuggcugugaaauacuauccuaauuaaaugguccuaaauuauggguucagaaauaaugacaggcugcugagugauggaaggugcugacuggcuuaagcuaaucuagauuuaucuccagguuugguucaaccuuuguucuggguuaaugaauguucuagaaacaaaaagaaaaguuagguacuaguagaaagggcaaagguggaaguggaagugaugcuaaauaaucaagaaauggucacccccagaaaauugugauaugaggcucaacguggcagcuaagugaucauugccacccuucucccauuuuauuuuauuuuauuuuauuuuauuuauuuauuuauuuauuuuuuauugaucauucuuggguguuucucacagagggggauuuggcagggucauaggacaauaguggagggaaggucagcagauaaacaagugaacaaaggucucugguuuuccuagccagaggacccugcggccuuccgcaguguuugugucccuggguacuugagauuagggaguggugacgacucuuaacgagcaugcugccuucaagcaucuguuuauuuaacaaagcacaucuugcaccgcccuuaauccauuuaacccugaguggacacagcacauguuucagagagcacaggguuggggguaaggucacagaucaacaggaucccaaggcagaagaauuuuucuuaguauagaacaaaaugaaaagucucccaugucuacuucuuucuacacagacauggcaaccauccaauuucucaaucuuuuccccaccuuuccccccuuucuauuccacaaagccgcgauugucauccuggcccguucucaaugagcuguugggcacaccucccagacggggugguggccgggcagaggggcuccucacuucccaguaggcgcagccgggcagaggcgccccucaccucccggacggggcggcuggcugggcggggggcugacucccccaccucccucccggacggggcagcuggccgggcagggggcugaccccccaccucccucccagacggggcggcuggccgggcagaggggcuccucacuucccaguaggcgcggccgggcagaggcgccccucaccucccggacggggcggcuggccgggcgucucccauuuuaauauccaauaauuaauccagagcccucaccagcagcucauccauuccaauuuucucuucucuuugucacucagguguauacauuauagcaaaauuagaaaggaauaacuacgucagugguucagaaaagauggcaaacacugacgugguauuaaguuuugggcauaucagguguucaguuguuacuuaucuuggucuuuuuaagaugccauaacaaauaccauaagcugggugacuuaguaacagaaauuuauuuuuucacaguucuuggggcuggaagucugaaaucagggugccagcaugguugaguucuggugagggcucucuuccuggcuugcagacggccaccuucuuacugugugcucacauggccuuuccuuggugccugugugaguggaggcuggguggggggcaagcugucuggugucuuuucuuauaagggcacacccuuguaagggacccaccacauuaaccucaucuaauccuaauugucucccaaagucugucuccaaauaccaucauauuagggguuauaggacuucaacauaugaauuuugaaaggaacacaacugaguccauagcauuacugguuggggcuuugguaauuguaauucauuuagagaagaaauguguauuuuuuucuguuauagauuauccccugacaagcaaauacgcuuaucauugaauuuuuauacaggucacauuagaggaagcaaaggguuuaaaaaugugcaaguaugccagaaauuugcaacuuaaucggucauaggucagguuuuuugggcauaguuuuggagacagaauuugagcauaggugguuuacuagagaguacauucgggaaaaacaccuguaaggaugacagagaagcaggacuggauagaugagguugaacugcgauaagguuacaauaaaaguuuagccaauccuuugggugagagcugggacggcucugcaaaacugucuaaauuugagguaagggaucagcccugguaccagagcacugacuaggcauuagaugggggcugcccccagggagggcacaaauuuaaugcugagggcaauucuuagaauagaggcagcuuuaaguccugaaagaguggggagaagggggcauaucuggguagcacauuacagcauugacuauauuacucaagcaauccaaaggccagugucucuaaacucauuacugggacaacagcacugcaguaaucauucuuuccuaccaacugcuuguuaaggguccagguaagcauauuuucuauaauuucaaggacuuaauaaacaaguuuuucugauagcuuccaaaauuggguuuaguacuugguuuauuaaacuggaccguacuucuuaguaauauaguuucagugguguaagaugcuauacuuuuugucaugaagucuuugcccaagccuauguccugaaugauauugccuagguuuucuucuagaguuuuuaugguuuaggguuuuacauuuaagucuuuaauccaucuuaguuaauuuuuguauaagaugcuauacuuuuuggucagaagccuucugagauaggagugugucuucagggguagaauaguggcagauucucauaccuuccccauuguaucugacccucuuaggguuguaguucauacacuuucugugguaaucugauggucuugcaguguugauaguccuuugucaaaguguaugguggcuccugaaauuuugguuauaauaacaucacuccccagcaggcuuuaauuuuuuggaucuacacaacagaggcugcuuacuuugaagccuauuucauucaugaaaauaauuucacauucugaaguauuguauucugcauguacagacucuucugagacaaucacaggcauaaauaauugucaauccgaguagcuauauuuguuuuauuuauuuauuuuuuauuuuuuuucugagacagggucucgcucugucacccaggcuggagugcaguggcacaaucucggcucacugcaagcuccgccuccuggguucaggccauucuccugccucagccucccgaguagcugggacugcaggugcaugccaccaugcccagccaauuuuuguauuuuuaguagagaugggguuucaccauguuggccaggaugugcucgaccucuugacguugugauccaccugccuuggccucccaaagugcugggauuacaggcgugagccaccaugcccggccuccaaguagcuauauuuguaaaaagcacuucagauuggaaaugaguuugucaacaucaugaauugauacaaaauggauuauauguucauuacagauagcaggaaagggaaaauaggaauaaaaguagaguccuaguccuguuuauaaugcacucuagaaauauccucaagccaagaaaccuacagguaggaaauuaguaccuaguuuuuguauuuccuccacccccgggcugccccaauaaaacaagaacauuggaauaauuuuacaggggaaaauccaaguuugaagauaauauggugucugcugaaauauuuccaaauguuagauagcucaaguggaauaccuaggaauucaucuaaccaaggaggucagagaucucgacaagaagaacuacaaaacacugcugaaagaaaucagagacgaggccaggugcaguggcucaugccuguaaucccaccacuuugggaggcugaggugggaaaucacuugagcccagaaguuugagaccaaccuaggcaacacaggaagauucugucucuacaaaaauaaaaauaaaaaaauuagccagauguaguggcauaagccuguggucccagcuacuugggaggcugaggugggaggauggcugcagugagccgugauagugccacuguacuccaacauggguaacagagcaagacccugucucaaaaaaaaaaaaaaaaaaaacccaaacaaacaaaaaacaaaucgacaagcaaauaauccaauuaaaaaugggcaaaggacaugaacagacacuuuucaaaagaugauguacaaguagccaauaaacauaugaaaaaaauguucagcaucacuaaucaucagaaaaaugcaaaucaaaaccacagugagauagaucucacaccaguuagaauggcaaugauuaccaagucaaaaaagaacagaggcuggugaggcugaggagaaaaggaaaugcuuauacacucuuggugggaaugcaaacuaguucauccacuguggaaagcauuuggauauuucucaaagaacuuaaaacagaacuaccauucacccagcaaucccacuacuggguauauaccaaaggaaaauuauucauucuaucaaaaagacaugcacucauauauucaaagcaaagauaaggaaucaagcuaggugcccuucaacaguggauuagauaaagaaaaugugauacauauauaccauggaauacuacauagccacaaaaaagaaugcaauaauguccuuuguagcaaaauggagcuggaagccauuuuucuaagcaaauuaacauaacaggaaaccaaauauugcaugguuucacuuauaagugggagcuaaacacugaauacacacagacauaaagauagggaacaauagacacuggaggcuacuagacgggagggaaagaagggggagugagcugaaaaauuaacuauuggguacuaugcuuacuaccugggugacaggaucauuuguagcccaaaccucagugucacacaauauacccauguaacaaaccugcacauguaccccuuaaucuauaauaaaauuugaaauuauauaaaaaagggaaagcucaaguuguuuugagguauagaaacuauugggcuaauuuuauugaggaauuggggaaauuacuguucaguuugcuuuagaacaaagaaagugaaugauguaauaguuuagaggcagaaugacagugauaauucaagaccuuauucuggguucaucucggaaucacagagacauuguuugacugagcuucauaucacaguggaacagagaaaaauucccuccaaauuaugcuggguuugugucuauuaaaaagaacugcuugaugaucucgacggaagauuccuucuccauagguacaguguucauaagaauguuuuaugaaaaauucauguugacaaacucucacacuuagcuucccacagagaaaauuuugcauauauuucuaaaacaguucaaguucucucucucucucucccucucucaugauuuuucauacucucuuagacccaaagcucuuucuauacagccuauaguccucuguucuaccagcugagcuaucaaagggugcacccaaagcucuuucuuuugggagagucuccuuuuugcauugcauagcuccaagaagcaccauuagcauugcaauuuauguggcaggcuacccaaauuuccacauucccaugucuuguuaaccccucauaugcuguuucauuuuucuuccuuuuauucuugauacuucucucaucuuugguuuugaugaauaauucacaaaugcaguguagugagaagccagguggugauuaaagcauugugguggauauuuguuaguugacaacauuccucuauuccucuauuuccuauaggagacuucaaauuuccuucacuuucagccagauauuuuugggcagaacugaccuacuccagggacagguucugacagucaaaugcauaaauuuauuagcauauuccuuuucccugaccucaauaauugauucaaggauagauguauuacccaaucaaagcuaauuagauggaaggagauuugcuaggacuccuucaacuucuguaugaggcacuagaagugauucauuccuucccacugcauauaaaaaaggcgcuaggcagugaauagaauaacaaaucucuaucuucauggagcauagauuuuacugagggaagcaggcuguaaacaagauauauuagaugguguccagaacuauggagauacauaacaaggagaaaggggagugcuuuuuuuaaaagcuguuuuugguaggggggugguucagggaagaucuuauugacuuuugcucauugacuaaagacuugaaggaauggggcaauguuuggggaaaagcauucccggcagagggaacgacauaugcaaaaucccugagacaggagcaugccuggaaugucugaggaagagcucugaggccagaguggcuggagccaagugaacaagugauaugggggucagagguaacaggaggaaagaucuccacagggcuuugugaccauaaggaagacuuuuacucugagugaaaugaggagccguuggggguuuuaagcagaggagugacaugaugugacuuaaauuauaauaggauacucuggcugauguguugaaagggggaaagggugugugaugguucauuuuuuugugacaacgugacugguuaagggaugcucagauagcugauaaaauguuucuggaagagauuaguauuugaauugguagacuaaguaaagaaggucugcccucaccagugugggcagauugacauugaggacuuggguagaacaaaaaggcagaggaagggcaaauuaucuugggaagggugcaccacaccuuuugguacauggaguugacuauagucaaauucauaggaaguccauaaaguuuaaaagagaacuuuauuggcaaaaguaccaguaccaacuaaaaggcagaggaagggcaaauucucuuuuggagcugggacauccauuuuucucuguccuuggacaccagaggugcugguucuugggccuugggacuucaggacucacaccagcagccccccugguucucagggcuuuugccuuggacugagagcuacaccauuggcuuccaugguucucaggccuucagacucagacugaaucacaccacuggcuucucugguucucugcuugcacacagcauauugugggcucucucaaccuccauaagugcaugagccaauucccauaauaaauuccuagucauauaucuauauauauucuauuggcucuguuucucuggagacccugaguaacacaagguggaagcugggagaagaagggauagugaaugcucggcaguuaugauaucuauauauugaaauauugguuccaauuuuucacucuuaacagaauuggaaacagagagauaaagggaggcaaaucuugaaagaaauugcgagugcaccacaccuuuuggcacguggaguugacuauagucaaauucauaggaaguccacaaaguuuaaaaaagaacuuuauugacaaaaguaccgguaccagcuaaaauagacauucuacaagauauaaacagauuauuggccucuaauuuucuacaggcagaaagcagguugaagaacccauuuauccaccaaaaagggcauauucucuaauguccuuugcaagugacuaaggaagaugagggaaaaagaaugauucccuagaguguagaacaaagagcuguggaggauagacuggaaagucauuuuuaaggagcagaaacagugccuaaucaugaaacacaauucccuccaauggaggaaccugacaaccauuguccaaugaguuuuccuaauuguuauggaccaguggcugugaucugcuuccauuucuccccuuugugaauaagaguauuuuuuugugguuauuauugucucuauuccaucauuuguuguauguuugguaugugauaaaaagaugcuugcucuuuuaauucauaggucucuauaucaagaagggcuauaucuggaccugauguagaucaugagauccuggauuucaaagaugugauggaacuuuuagggguuuugggauaggagugggucaauuuuugcaugugguaaagacauaauuauaaucaagaaagcagaucgugguagauuaaauuacuggucgcaauucuucacuacccuguaguaguauuaugcacacaugaagccuuugcuauuggugaacaguguauuuccucauccuccucacuuugggcuucauuagaugacuuucuuuuguauaugggaugucaguggaagugauaugagcaaaagcuugaaauauucuugcaugcuggguuuuccugcuugucuucugugaccagcaugagaagagcuuguccuggauaacgucuuucagcaggggcucagaaaaggacacgugaagcagaggcacugugcugcagcugacccuugggcccacagccugaagcagaccuuccugucagcccacaaacccacagcuuagagcugaccugaaccuaaccuugagauuguaguccagccuagcuuagcuacauuaccacugaccuacagacccaggagaaaauauaauugucuuaaaccacuaacuuuggaauggguugugcaguaguagugagauaaucacuggccaauauagguuauugcaauaauucacaaggcuaucaugggaacuaggaccaaggcgguaacaauggaagugguuagaaguaggcagauucugaguauuauuuuauagguacagcccacagguuuugcugauagauuguauauggggugugaaagaaagugacgcauuaaagaugaauccaagguuuuuggccugagcaaauggaagaauggagcagccauuuuugaauggaaaaacuugggugugggggaaguuucagauuugggggcaauaucaggauucauuuuuuauauguuacuuuugagaugccuauagacauccaaauggggauguuauguaggcaguugaauauagaaguucgcaggcagaggagagaaaggucugggagugaucauuaagaagauuggauuuuaaagcuaugaaacugcaggaaaucaagugaguguagaaauggggucgaaagacugagccuaagggcacuuagcauuuagugguuggggaguugaagaguuaccagugaagggaauugagaaggaacagccagagagauaagaggaaaaccagauaaguucuaauaaagugucauucauauguguuguucucauaauaucacauccauugcucaccuuuuccuuuuccuccuucacuaccaauaucacuaccaugagaucuguguguguguguguguguguauggaaugcauagugcuagucacuuuauguguauaacaggagaauuacugaaaaagcuaacucaucuuuuuuuuuuuuccugcuauauacucacuagggaaaaaaucccuuuuuuccucuucugaucucuccaggucagggaaucuaagucuuugcauaaauucuggguccccccuugacaauccgcuaagcaggauggcucugucugagaggggaagguguuagaagcuggugcuuucaguggaaugggagggacgaacagcuggaauccuggaggagaacugauuucuuuuccucuguaagccuggaggagagggguuaaggaggagaggaagggggauauuagagacuuguguuuagcuagcaugaaacucucuacaguggcagcaagauuuuggaaggagaaaggcugccuguaugaguggacauuagagaaugaaagccacaaccuugaaaggguuggugugaaucaacuguguuugaguggcgaucacuugggggaaccucuguugcagagccugauaaaggcucagugccagggaagggcagugaggcaccugaaauaaaacugcuuugcagaaagagcaugucuaagccuaggacaaggaucaaaguguuuguaggagaguauuuguugugacaacauagaccugguuuuagaaucuccucaggacugagccauccuggcuuguuuuuaagcuuugggggaacacuggcuuugugacuauaaaccaagagagauguaauccuggaacuaaaucaugggccauccacuauggugcaggcaggaauuggaaccagccagagaaucaccucagucugcuggacuaugcuacaacauuaugguagaaggcaacagcauuaacuaaaugguaagacuccacuuucuaccuuuuguauugggaagagaacugcacccuuuggucuaagacaugaacccucaguuucuuggacaaucaaggguggagaggccucaaaaaggagagacggaacuuucuaaaacuaaggcacuagggauuugaaugaaucauugaaaacauaaaagagauaaagccucugaguuuguuaaacaggcauuaccauuguauauuuaaaaacuugggaaguuuuaacugaagaaggcagcaugauaugauagcuuuugcuuuuuacaauaugauguuauuagucuuguucugugugguucuggagagcaaaacaauaaagcauuguaaguuguaugaguguaagaacaaguauucacuacuaauucccagcacaugaauaguacucaauacauuuucaauaaaugauugaauacauguaugauaaaugaaaaccaguggguuaaacuuacaaggaggcagaggcuuuuuuuuguuuuguuuuguuuuugagacagagucuugcucugucgcccaggcuggagugcaguggugcgaucucggcuuacugcagccuccacuucccagguucaagcgauucuccugccucagccucccgaguagcugggauuacaggugugcgcaccacgccuggccaauuuuuguacuuuuaguagacaugggguuucaccauguuggccaggcugaaggaggcagauuuuugucccagcuuaucuuucuaaaaauuccaaaauuaaauagacuauccuuaaaaagcagugaaauucuuuaccacuaggagugaaacaggagcuaaagaacauuuuugggggaugugauagagaggauuuauucauuugauaauaguuagaacacauaaccucugagaucucuguaaucucagauacuuuaguucuauaauucuaaauccaagggucucuauagauaggcuugagacaaguguaaacaaacucaugaucucagagaaaucuucaaguggcauguuucaaugguaugcuuauuaaacaaaugcucaugacagauuuucacaacaguaacgaauguuauuucacaacaucaaaucuuccuuccucaggaagaaaugacauuaauaagaagguugauggauuuggauuauuuuucauguuuccuggagguaaaaccaguguccucacuuguuuuccucuuuuuccucauuuugaagacuauuuguuuucauuuucuuugccuccucucuggcuauguguccccggaaggcagcuuggauuuugacagcagcaaccucuucuuuuuccuuaucuuccucagaagaguccuucaucgaaaggagaaaaaguaagagacucuuuaaauauggcguaguuuugaugccacaaaaauaaauggaugaaauuuaaucauuuuagggaugcaacuaucugagagcuguugcuuccugagggaauuucauauauugucacauuguauauguaccaaauggcaaaugccaaaauagcaggcauuuuguuuugucacucuuuuaauaugucucugcaacaaaagaucauugccaacuuucuuuccccuaaaauagugccuauuuaaguuuccugagcaacaacauuuuuugggggguuggggggacaagaaagaauccuugaggcaugguaaaaauguuaagaagaaagaacuguaaauguuauguuucaaaauaaucacaauuacauauaaugaauuagaauaacuucucaauuucucaaugauuaguuaaucaucgucauacauuuaaagugaggugccaaagagaaauccauuuaguccaauaaugucaguuuuaacaggguugguugaacuuuggcacauacccucuuuuaaaaaaauuggguauaaauuuuuagcuauaaauuuacagacaguaaaaugcaugaaucuucagcguacaauugaauauacagcuuuuaauauaucuuuuaaaauuauagaaaugacauguauacacuuuaaaaacucaaaugucacuggcagugauaguuuucuccaccuauccaaauccugcucuugggagauacccauuauuaugaguugaguaucuacauccuuccaaaauuucucuauaugcaaauauauucauauggguauauauauauauauaugucuuuuuauuuuaaaaaugagaucauccuaaucacagaguucugcagcuacuuuuuccauguaacgauauaucuugguucucuuuuucuguauuauuagucaguguauaacucuccccauucuuuuuuuaugacaucauuauauuauacugauguaccuugauuuaauauuuacucaaucucauauuaauggaccuuuggguugcucaagccuccuaucccccuauuauaaauaaugagacaaaucuagcucuuaaacuuuuaaaugcaaacagaaugguauaaaauucuucgagaugacauccuaauauagcaaacaaauacacucaaguuggaaaucaaugagaucccuacucaaacucaugaaaaccuguguaaaagcaccuaugaaagauguaaggaaauaaaacucccuucuuccuugacuuccuguuacaucuuaauguuaaucuuccuguuauauccuaauguaauguuauuucaguacaacccaauggcaauuguggaacaaccuguaaaucuuauagggaaaagcaaugcaucacuagguaggaaguaggguauuccuugaggggauauccauucuggcugccaguucuugggcaacuaccugggaccugagacauaaaaaggaacucagaaguuugaacuucgacauuuuagagagugaguucuucuuucuuaugaggccuaguccacaagagucuggaguaugaagaauauagacaaugauguacugguaaguguuuuaacaacuggcucuccagaagaaacaaagcccugauuugcaguguuugccauggucuuaauauucucauuguggcugacuucaaguuauuaaagugacauuacugaacaaugggccuuugaggguggacuucgcuaugucuuuuuuuuucuuuuuuugagaaggagucuuguacugucgcccaggcuggagugcaguggcgugaucuuggcucacugcaaccuccgccucccggguucacaccauucucuugccucagccucccgaguagcuggaacuacaggcgcccgccaccaugcccggcuaauuuuuuguauuuuuaguagagaugggguuucaccguguuagccaggauggucucaaucuccugaccucgugaucugccugccuuggccucccaaagugcugggauuacagacgugagccaccacgcccggccuccgcuaugucuugacugcuuggauguaguacaucaggcacgaaggcauuuuuguagagcguuaugcauggaagaugaauaagccacauuguuguaaagccauuauuuuggcuguauguaauucccugugauuuuccuuuuguuaucucugaaauuugccauuguguaguggugacagcaccaauuagugaaaaauucccaaaguggaagaugaaucugaaggaucaugacugggucugugaguucugucugcccuuccccauagggagauuuuuccauccauuaacaaucuugaaaaauaagauuucauuuuuaaaggaaaaaugaauuuuugaucaagagaggcauggcugaaaauuaucuaccaguuaguuuaucacugauguuaauuaucuggaaaguaaagucauaauuuugacaauaaagauaacagacauucauauuuggaguucaguuuuaaauugggcaauaucauucuuuguaggaauccaauaguacaugaaaaauauuacauacuaagauggugacugaugucucuuccuccuucccagauaucugagacucuucuuguuuaggaucacuuuucucaggugguucuugcuccuggacagauaggagagagccacaauuagcaauguuuccaaaauggcaaagucuuguaucaaacugcuuagaaguaaugaaacauuacuuuaaauuacugagaaauagggggaauuaaauacuacguauuuaucuuuuaauaaggaaaauacauugaaacaagaagaaauaauaaaagcucuuaaggaaauacguguaaacaaauauuaaagaccaaauaauuggcaaaaauguuugaucuguugcuuuuggaauguguguaccacuguuuuauguuaaaaauaaaccacuguccuauacuaaaaguugauaagaugauguaaugaauccugaacaaaguauaaaaaagaggauccaauaguuucuaaaauaggaauaaaauaaauggcauuguguuccauaaugugacaucaaauugacuuuuuagugacguuuauggauuaaaacuagucagagaaguaaguuuugcuguggaguuuugcuuuaugauuuaaauauaaaaggagaaaccaccucugccuauuuugacauggcuauuuaagucuuccuucauugcuaauucacaccuauggaaagagcuucuuuaacccauaaaaccaaaauuuaagaauauauaaguuaaucaaauaaagccuuuagaauuaaaaaaagaaacaccccaaaauugcuaugugaugcaaggauuuaaaaucuuucaacauuauuccuuugacuucgauaaacaugaauacaaauaaaacaugagcacagagaaucuaguaaaauggaaauacacagaacacacccauaccugcaggcacaaauggauggaacuucacuuucaaacuuguguaauaagugacagcuccuucuucaagaaauuccccaaaucuacuggagaacuugaacuuuguuaauucuuuucaauucuaauaucugcugugcuuuguggcuaauaguacuaccucaguugucuagagcaguguucucaaauuuuaauguaccuacgaauuauucuggugaucucuuaaaaauguaacuucugauuuguagaccuggaauggggcccaauacuuugaauuucuucuuuuucuuuuauauuuguacaaauuuauggaguacauguacaauuuuguuacauguguggauuggugaucaagucagggcuuuuaggguguccaucacccaaauacugcacauuuuagccuuuaaccaauuucucauuauucuccuuucucccaccucuccucacucuucugagucuccauuaucuaucauuccacgucuauguccauuuaaacacauuuuuucagcacccacuuaugaaugaaaacaagcacuacaugucuuucugugccuggcuuguuucacuuaagauaauggccuccuguuucauccauguugcuggaaaagacacgacuucauucuguauuauggcugaauuguauuccauuguguauacaucccacauuuuccuuauucauucauccauuggacagauacuuagguugauucaauaucuuugcuauugugaauggugcugcaaacaacauaaaaaugaauguaucuuuugauguauugauuuauuuucccuuggguagauaccuaguagagagauugcuggacugaauggucauucuauuuuuaguuauuugcgaaaucuccauacugcuuuccuuagaggcuauacuaauuuacauuccugacaacaguguauaagaguucuccuuucucugaauccuugccaguaucuguuauuauuuugucuuuuucauaguagccauucugagugggguaaaauaauaucuuacuguaguuuugauuuguacuucucugaugauuagugauauugagcauuuuuuaauauaccuguuggacaucuguaugucuucuucuaaaaaaucucuauucauguccuuuuccaaguucuuuuuucuuuuucuuuuucuuuuuuuuuuugagacagggucucacucuguugcccaggcuggagugcacuacagccuugaccugugggcucaagugauccucucaccuuagccucccaaguagcuggggacuacaggugcacaccaccacgucuggcuaauuuuuugaagagauggguuucaccauguugcgcaugcuaaugucaagcuccugggcucaagcaaucuuccugccuugccucccaaagugcugggauuacaggcaugaaccaccacgcccagcccuuugcccacuuuuuaaucagauuacuuauuuuuuguuguuguugaauuguuggacucccuuguguauuuuggauauuagucccuuguuggaugaauaguuugcaaguaauuucucccauucaacagcuuaucucuucacucuguugauuauuucuuuuacugugcaaagcuuuuuagcuuaauuaagucccauuugucuauuuuuguuuuuguugccugugcuuuugugaucuuagucauacauucuuugccuagaccaauauccaguaaaguuucuccuagguuuucuucuaguauuuuuacaguuuuaggucuuauguuuaagucuuuaauccaugauggguugauuuuuguguaugaugggagauagggguccaauuucauuuuucuacauacggcucuccaauuuugcuagcacuauuuauugaagaggauguccuuuccacaauauauggucuuaucagcuuugcuaaagaucaguuagcuauauguauaugcuuuauuucuggcuccucuccucuauuacguugauuuauguaucuguuuuuauaccgguucuaugcuguuucgguuacuguagccuuguauuagguuagugcaaaaguaauugcugucuuuuccacuaaaaguaacagcaaaaauggcaauuacuuuugcaccaaccuauaauaucauuugaagucagguaaugugaugucuccaguuuuguucuuccuguuaaggauugcuuuggcuauuuggacucuuuuuugguuccauaugaauuuuaggauuguuuuucucaauucugugaaaagugaguuggugcuuugauagggacagcacugaaucuguagauuguuuugagaaguauggucauuuuaaagauauuaauucuuuugauccaugagccugugaugcuuuuccauuugcuugugucaucuucaauugguuucaucaguguuuuguaguuuuucuuguacagcuuuuucaccuccuugguuacguuuacuccuauguguuuuuuaaagcuauuauaaaugggauugccuucuugauuccuuucucaguuagacuguuauuaguguauagaaaugcuacugauuuuugugcauugauuuuguauccugcaacuuuacagaauucauuuaacaaaucuaagaguuuucugguggagucuuuagauuuuucuagacauaagauuauauugggagucagucauggugaugcaugccuguaaucccggcacuuugggaggccaaggcaggaugaucacuugaggccaggaguuugagaccugccuggacaacauagcaaaagcccguuuuuacaaaagacaaaaacauuauucagugugguggcacauguuuguaguccuagcaacuugggaggauaagaugggagauucccuugagcacaguaggccaaggcugcagugagcuaugauuacaccauggcacuccagccuggaugacagagugagaccccaucccugaauauauauacauauauauaucagugaacagagauaagugacuuccucuuuuccaauauggaugcuuuuuauuucuuucccuuaccucauugcucuggcuacgacuuccaguacuauguugaauaggacgggugaaaaugggcauucuugucuuguuccuguucuuugggggauugcuuuuaacuuuuucccauucaguauaauauuagcugugggauuuuugugcauggcauuuauuguuuugagguauguuccuucuaugccuaguuuguugaguguuuuuaucaugaagggauguuggauuuuaucaaaugcuuuuucugcauaugguuuuugucuuucauuuuguugaugugauguaucacauuuauugauuugcauauguugaaccauccuugcaucccugguuuaaaacugauuuuaucaugguuuauuaccuuuuugaugugcuguuggauucuguuugcuaguauucuguugaagauuuuugaaucuauguucaucaggaauauuuaucugcaguuuucuguuuuuguuggguccuugucucauuuugguauuagggugauauuggccucauagaaugaguuagggagaauccauucuucucaauuuuuuggaauaguuucaggaggcuugguauuagcucuccuuuguauguagaacuggguagaauuuggcugugaaaccauccaguccugggcuuuuuuuuuggugguguuggggugggggagauuuuuauuauggaaucaaucuugcuacucguuauuagucuguucagguuuucuauuucuuccugguucaaucuugguagguuguauguuuccaggaauuuaucuauuuccucuauguuuucuaguuugugaguguauaauuguucauaauggucucugaugaccauuuguauuucugugcuaucaguuguaacgucuucuuuuucauuucugauuuuguuuauuugggucuucucucuucuugguuagucuagcuagccauuugucaauuuuauuuaucuuuucaaagaaccaacuuuuuguuuuguuaauccuuuguauuguuauuuuagucucuauuuaauuuaguuuugcucugaucuuuguucucucuucugcuacuguuucguuuguucuugcuuuucaaguugcuugaguucauccuuuaauuguuaauuuguaaucuuucuacauuuuugagguaggcauuuauugcuaucaacuucucucuuagcacuacuuuuucuguauaccauagguuuuguuauguuguguuuccaguuuucauuuguuucaaacaguuuuuuuuaaauuucugucuuaaguucuuuuuugauccaacagacauucagaaccauguuguuuaauuuccauguguuuguaucauuuccaaagcuccucuugguauugaauuuuaguuuaauuccacuguggucugacaagauacuugauauuauuuugacuuuuuaaaauuuguugagacuuguuuugugcccuaacacaauauggucuaucuuugagaauguuccaugugcugaugaaaagaauauauauucugcaguuguuggguagaauguucuguaaauguuuguuagguccauuuguuuaaagucaaguuuaaguccaaugcuauuguaucaguccauucucacaguguuaugaagaaauaccugagacuggguaauuuauaaagaaaagagguuuaauugacucacaguucugcauggcuggggaggccucaggaaacuuacaaucaaggcggagggcaccucuucaaaggguggcaagagagagaaugagaguggggcaaagagggaaaagccccuuauaaaaccaccccccccccacccaugauuccauuaccuccacgagaucccucccaugauaugugggaauuaagagaacuacaauucaagaugagauuugggugaggacacagccaaagcauaucauuuggccccuggccccucccaaaucucaugcucucacauuucaaaacagaaucaugccuuuccaacagucucccaaagucuuaacucauuccagcauuaacccaaaaguccaaguucaaagucuuauuugagacaaggcaaguuccuuaugccuaugagccuguaaaaucaaaagcaaguuagucacuucccagauacaauggggguacaggcauuggguaaauacaccugcuccaaaugggagaaacuggccaaaacaaaggugcuacaggccccauguaagucugaaauacaacagggcagucauuaaaccuuaaaguuccaaaaugaucuucuuugaguccaugucucaaauccauggugugcugaggcaacaagugggaucccauggccuugggaagcucuaucucuguggcuuugcaggguaaagcucccuuccuggcugcuuucauguguaugcagcuuuuccaugugcacagugcaagcuguugguggaucuaccacucuagggucuggaggaugguggcccucuucuuacagcuccaccaggcagugccccaguggggacucugugugggcuccgaccucacauuccccuucugcacuacccuaguagagguucuccaugggggcucugcaccugcagcaaacuucugccuggacauccagguguuucuauacauccucugaaaucuagguggaguuucccaaaccucaauucuugacuucuguggacccacaaacucaacaccacauguaagcugccaaggcuugggguuugcacccucugaagcaauggccugaacuguacauuggccccuuuuaaccagagcuggagcugaagcagcugggacacaggucaccaugucccgaggcugcauacagcaggggagcccugggucuagcugaggaaaccauuuuucccuccuaugccuccaggcuugugaugggagguugcugugaaggucucugacauacccuggagacauuuuccccauugucuuggugauuaacauuuggcuucucauugcuuaugcaaaauucugcagccagcuugaauuucuccccagaaaaugggguuuucuuucuauugugucaucaggcugcaaauuuuccaaacuuuuaugaucugcuuccucuugaaugcuuugcugcuuagaaauuucuuccaccagauacuguaaauuauuucucucaaguucaaaguuccacagaucuuuagggaaggggcaaaaugcugccaguuucuuugcauaguaagagugaccuuuacuccaguucucaacaaguuccucaucuucaucuuagaccaccuuagccuggacuuuguuguccauaucacuaucagcauuuuggucaaagccauucaacaagucucuaggaaguuccagauuuuccaacaucuucuugucuucugagcccuccaaagaguucgaaccucucugccuguuacccaguuccaaaguugcuuccacauuuuuggguaucuuuacagcagugucucacucucugcaguaccaauuuacugcauuaggccggaagcaguggcucaugccuguaaucccagugauuugggaagacgagguggguagaucacuugaggccaggaguuugagaccagccuggccaacauggcgaaaauacaaaauacaaaaauuagcugggcaugguggcaugcaccuguaauuccagcuacucgggaggcugaggcaggagaaucacuugaacccaggaggcagggguugcagugagccaagauugugccacugcacuccagccugggugacagaaugagacucugccucaaaaaaaaaaaaauuacuguauuaguuuguucuuacacugcuaugaagaaauaccugagacuggguaauuuauuaagaaaagagguuuaauugauucacaguucugcauggcugaggaggccucagaaaacuuacaaucaugguggaaggcaucucuucacaggguggcaggagagagaaugagagcugagcaaaggggaaaaagccccuuauuaaaccaucaucccccaugauucaauuaccucccacugcaucccucccacaacauguggggauuaugggaacuacaauucaagaugagauuuggguggggacacagccaaaugauaucaguuacuuuguugauuuucuguuuagauaauuugucuaaugcuaugagugggguguugaagccccucacuauuauuguauugcagucuaccucugucuuuagacauagaaauuuuuuuuaaugaaucugguugcuccagugcuggguguguauauauuuacaauuguuauauccucuuacugaauugaucccuuuaucauuauaaaauaaacuuguuuguuguuguuuucuacuguuuuuaacuuaaagucuguuuuaccuaauguaacuauagcuacuucugcuugcuuuugguuucuguuggcauggaauaucuuuuuccacuucuuuacuuucagucuaaaugcuuuuacagguaaggugaguuuccuauuagcagcauauaguugaaucauguuuuuuuuuuuuuuuuaaagaaauccauucagccagucuauagcuuuuauguugagcauuuaauccauauauguuuaaaguuauuauugauauguggaguuuuguuccuuuugucuuauuguuaauugcuuucugguuauuuuauacauuguuucuuuuucucuuacuguuugucauuguggacugguggaauucuguagugggcccauuugauucauuucuguuccuccuuuguguggucgcuuuaacagugaguuuuauacuuuccuguguuuucaugaugcuaacuuccauuuuuuugcuuccaaguuuaggauuuccuugaacacuucuuguagggccagccuaguacagacgaaugcccuuggcauuugcuuguuugggaaauacuuuauuucucuuucauuuaugaagguuaauuuugcuggauauagaauuccuggcugauaguuguuuucuuccagcucuuugaauuaucaucccacucucuccuggccugucagguuucugcugagaaguacgguuauuagucugaucggguuucccucacaguugaugagauguucucaucuugcuguuuuuagaauucacucuuugacuuuagacaguuugauuuuaaugugcuguggugaaaacuuuuuuuuuuuuuuugcauuguauuuggggaaucacugcaccgccuauaucuggauguuuaaaucucuugcuagacuugugaugucuucaucuauuauugcauuaaauagguuuucuaagccuucugaucuuuuuguccuugcggauaccaauaauucaaauauucagcugcuuuauguugucccaaaugucuuaaaggcuuuguuuauucuuuuuuauuuuugucuuacuggauuguuucagaccuguauucaaguucuaaaauuuuuuuguuccacuuagucuagucuauuguuaaaucuuuugaauguauuuuauauuuccuucaauaaauucuucaauuccagaauuuauguuaggguuuuuuuaaaaauaaaaaucuaucaccuuguaaaauuuuucauuuauauccugaauuguuucacugaguucuuuguauugguuuucagauuucucuugcaccucacugaccauauuuaaaaaucaguauuuugaguuccuuaucugagacuuuaagaauuucauucugguuaugaucuauuaguggagaacuguuguguucauucuggggugucauacuuccuuguuuuucauguuuccugugagacucugaauuucuaucaaguuuccaguugaugccaauaaugcugauuccacacagccuuucucaaccagcauucauuaucugaaccauggaacacagagaauguuuugagaagcucuuuucucaauucucccaaggaugguaccuaaccagaaccauucuagauacaaaucaggacacugauuccuuacaugcaauuagugccuuugguuuagggcuuaauuuuuuugaggaaacuugguugagaaagcugucuuuguaaagcugcuaaagagaaaggcucagacucugaaaaagcuagcuuuauagagaaaacuacaccauuaccaccuuuaauucuaaccggucuuuuguaucaauaauaucauaucgaugauaaugaaauaauuggacuaauaguguuuuggucuacgaaauaucaucuauuaauucaguaauuauuuguggaguaccugcuauugcuuagcacugugaugcugaaaacauuugaagaauaaaugaugaaauaauuauucauaacuuuuaagcaccuucuuccuguuguucaucauuaaacuuaagugaaauaucuguacaugacucagauacuuuagaaaaauauucucagcaaaaaaucccagcacaauuuuaauuuaauaaguuuuaauaagauuuaauaaguuuuuauuaaaucuuuuuaauaaauaaucuuuuuaauaaaauaagauuuauuaaauuuuaauuuaauaagauuuaauaaguuauuugugaugccuccucacauaauucucacaauucuggggauagccuaauaauugcuagcuguagacagagagaagaaauagccaaauccaacagcuucaaaggaccauaccucgaaugcaugauuguuauagaagcggucuucuaccuuacucccccauucugcuggaucaaaguugguuucuaaauaauaaaaauauaagaacuucagauuuauuugaauucauuaagguaaauguagaauagugacacaaauguaaguuucuuguuucaaauuacagguucuuuacuggcaguccaaaaucuuauugacauugugcauagcguagcacugcagacauuaccagugauuauuaaacauaugauaaccaacugaacauuggaugagccuuuggggauauuuagaaaagcacuaaaaacguaauuucugccuucauaaaauuuauaauaaaaugggaaaaagaacaaaugccaguacuuaaauauaaauguagacacuuagaacauguauuaguaaacacagaaaaauguauaaaccuaaaugcuaaguugucagaaagucuggaaaagugaaagaugggagaaauuuuuuuuaaugaaguauauuauguagacaguugacacagacaagcagagguauuuauuuuuaaacaauuuuuuucuuuaacuuuauauuauaaaaauuucaauacuuaaaaaguagauaugauaacaaacucccaugagcauacugucuagauucaaugaucaacccaugauuuauuuuauuuauaaccuuuucuucugauuauuuuucugcacuuuuuucugauuauuuuuaacccaaccccuugcauccuguuauuuuaucuacaauuauuuauuucagaauguaucucaauauauacucuuuuaaaauauaaccacaccaccauuaucauacuucaaaauacuaaaaauauuaauaauuccucaauauccucaacuauucagucaacuauccaaauuucuuccauugucuauuuauuuguugguucaaaucaggaccccgaaaacgggcacacacagcucuuuguaugucuuuuaaauuucuuuuaaaggaagagcccccagccccuauucuuuccuugcaauuuaucuguugaugaaauuacgucauuuucccuuuggaguuuuucacaguucagauguuucugacuauccccaugguggcuuuuaacaaguucuucagccuuugaauuuccuguaaacugguagcuagcuguauagguuugaucuaauucggguuugacgguuugauuuuuuuucugcaaguauacuugauugguagugcuguguaauucugucauaaaauuuauaauaucugguuacucuuuuuauaauuuuuaucggcccccugaugauccuugcuuagaucauuuccuuagggguugugaaaugguaaugcucuaauuugaucaauacuucuuuauuuucuggaguacucauuaaggaaaacuuuuccucaucaacuguuugguuacuccgaagaacaguuguuacagaaaagaaagguuaaagguuuaguucuuuccuuuccuuuuauuuaccaguuuucagaauaaucaguuggauuccuaggauccucucaggaugaccaaugaguuuuuuuuuaaccaucacaaauucacgaauguuuaagaaaauggaugcauuuuaauccaaugcacguauuauucuuauugaugcucuaauuauuaaacauuuguccagugguagcuuauucaggugcucaaauguuccugaguccuuuggaaacaccucuaguaaccuuugauagcuuccuuguucucugguauggcaagacguucagccuaaucugguauauucccugccaaguucaugaaauuagcuuguuuuccaagaagcccucauuccugggaaugguauuuagagaugacaaccuggaagcugggugcucacugguauuggguuggucauuguuuugagaccuuuaauguacagagcuagaaaauacuucuuucauuuuuuaaagagaaaacaugaggucacacugauauuuuucaacucaaauuuaagauuacaggauuuuauuaaccucuuucauuuucauaauuguauguuguuuuuccugcaccaaaaaucuuauuccuaauaacacuagcuuaguugcuuacuugcuuuguucuacaauauauaauuucacuauauaauuucagaauaaccauaccauaauaugauuaacaaugauuacugaaaacagcuuaaggguuuuuuuuuuugaaguucauuuuguuuuuaggauauaugcacuaggcauguacggucaaauuacuccauuuuaauaucacuugaaauaauuccuuucuguaugguuaugucacgcagucuauacuaguuaggcucauauguuucacuuugcuuuuacauuuuagaaauugcuuuuuuuuuuuuuuugagacagagucucacucugucaccaggcuggagugcaguggugcgaucucggcucacugcaacuuccgccuccuggguucaagccauucccuugccucagccucccgaguagcuuaacaauuuuaaauuuaaaauuauaacuauguuaaacuuuuaugauucgaaauucaagauauuuucuaucauguucucucuacccuguucacuuucuccuaaaggcaaauguuaaguuuucaaagauuuacuuuuccauuuaaaaauauaaacaaaguugggcauggugccucauucuuguaaucccagaacuuuaggaggcggaggcuggcggaugcuugagcucaggaguucaagaccagccucgauaacauggcaaaacccugucucugccaaaacaaaaaacaaaaacuccccaaaacaaaaauuagcccagcguguuugugcaugccuguaguucccaacuacuugggaggcugaagugggaaggcugcuugagccugggagguugcaguggagccacgauuacaccacugcacuucagccugggcgacagagccagagccaaacccuguggcaaauacacacacaaacacacacacacacacacacacacacacacacaguuauguauucauaucaaccucuuuuguuaaaugauagcauacuggccagguguuguuucucacagcuguuauuccagcacuuugggaggcugaggcaggaggaucaucacuugagcccaggaguuugaggccagccuggacaacaucaugagacccccgucuguguuuaaaaaaaaaaugguagcacacuaagcacacuuuuccccaucuugcuguuuucacugaauauaucccgaaaaucacuccacaguaucauccauaguauuaucgagagauaguucucauuuuugaaaacagcuauauauauaauucaguuguauagauguauuauaguuuguucacucaaacuccuguggauauuuggguuguuucuacaaagaaugaugcccugaaaaguguagaaguggcaccuccgggucaaagguuaaauacauauauaauuuugguagguauugcuaaguuccccuccuggaaguuauggcauuuugcuuaucuaccagcaauguauauaaaugcuuauuaucccacagccuacagagcauguuggcuuuuugccaauguaauggagggguuguuauugguagcucaguguaguuuugauuuggacuucuguuauuaugcauuaguuugaauauacuuucauaagugccauuugcauucauuuuugugugaauuguuugcucauaccucuugccaauauuuucuguuggauucuauaagccuauaacacacuguuuuuacaaacuauuuauuuauuagggcuauuaacccauugggauauaaauugcaaauauuuuuuguuugucuuuuguaguuuuguuuuccucacagugcuuuuucucauguaaaaguuuacuuuuauguugucaauuuauaacaaucuuuucucuaauugcuuccgaauuuuugaagcaauuaaagcaauuuagcuagcaaaauuuuuucuucucuuauagagaaauucauccauauuuucuucuaguaucuguaugguuucuuuuaaaaaauauuuauauacucgacuaauuuggaauuugucuuuguguauaagaaauugauccaauuuuaucuuuuuccuuuaucuuaaaauaacaaaaaguccaccuuuuuccuagugaccugaaauaccauuuaaaucauauacuaacauguuccccaucacaaaaauaaaaauuaagaguaguaaccaccuaugaugaaugcuggcaagggaauucuugcauugugugggagacugagccagagguccauaaugauuguuuuuuuuccuuuuugaagagacugaauucugauacuuguaucuucuagauaauuugucuuugguugacauggguggaauuggguguggugcuuacaauuuuuucaaaugguuuuacccauuguuuauuagagagcuaguguccugagaccacuaaucugaaucaucauuugcuuuaauuauugugauccaguaacaaugacgcaaauguuuuuauaauggaauauuucugaguucuaaaauuaaauaaaugacuaaagacuuuuacugcaagaauuuguaguuaaucuuauaauaaaauugauguucauuauaauucaccucuuuucccaaauaauuuuaguuuuuuccccuuccaacuuuuauuuuagguucaagggauacacgugcagauuuguuacaugguuaaacucuguguuaaggggcuuugguguagagacaauuuugucaccaagguaaucagcauaaugccugauagguaguuuuucaauccucacccuccuccuaccucugcucucacauaggcccccaagucuauugccaaaugauuucucuuaauaacguuccucuucuaaauauaguuuaucaaauguuuucaguggaaaauauuuaaaguuucagauugugcaacagauauucacccugaccggauauggaaaagaccagcaacauucaggaaauuggcagagauuuugagcucugcuagggcagggcaaaaaaagcaagggguggagcuaugcagugugugugggaguuguuuuaauucuacccuugugcuagguuuucuuccacuauaaaaugauuacaauagaauguuuguuugcuugugccuauuucuagucaccuuuaccacucuguuagaauacuguaauaaaaaguaaugaugacaagaauuuauacaaaauggauguucuaaucaacaauggcuuuccagggguuggggcaggggucgugggagugcccaggauggagugcaguggcuauucacagguuuaaucauagcucacuaccgucuugaaucccugggcucaagugauccuccugccucagccccugaguagcugguacuaaaggugcgcaccaccaugccuggcuuaggauagguuuuuaguacaaaacugguaaaguccugacagucauaaaccuucaagguuggggauuuguaaauuuuauuuauaggagugaaggaauuuugccuuggcuuucaaccaaauaguuauuguuagugggcaucugggucucugugcaggauggaauuuagcauaaagaauauaaauuaccuuuccaaacugguauuccaccuuucaaaucaguuugucugugccguuauugcagaacaguuucauauaccccagugaauaucaguuuauuuaaagagugcagaauucuuuuugcaguacuuaaaauacuuucaaauggaaggaaucaaaauugaaaggaaaccacagauacucaucucaggaauaacagucagcugccagggaugcauaggaacaguaugcuggaacguggcgaggguagacuguaugaucuuuuuuucccccacugauuucucccgagaaauguaugcucuuuugcaguuaccuuccacgcuguauguccgugagaaauacaaugaagacggucugaauaaugaacugguaaucuucgauaauaugaaacgaauuuaagagaacauaucaaagagguacauacuguuucaaagagcaagaacuguuaucugaaacucccugccucauaaaaggcuuucugcagaauggagauggucuuaagcaaguuuuaccauaaacaaaugcuuaguuucuuauuuuaaaaaaugacuaauuuuagaaagcuuacucucucuuuucucuagaaggcucucaaaauaggcugcugcaaaagcugguauauuguccgguugcucucucagaaucucgcgugucagcccuucaagaagauucccaaauccuuguggaauucgguaguggguguuggagaauggaaucgacaucuucuugguaagaacugccuauggaaccuaaagauucauuaaagaguacugucuuuaaauuugucugauuuuacuuauauaaucacaacuaugccaacaaauuauuucugagacucauacaucuggacuugaauucuuuuuucccuaacacaacccaagcccauccauuucuuccaaagaguuuugaaaucuccauugugaauuaguauaauacaaacacagacccauucacuaggccaaaucauuuaaaauccugcaaaaaacccauaauuuucaauaugacuuuuucucucuuuacccuuuauaugcucaaaagguaaggguaauuuuugcuaucacacaggaauuuagagagaaugauugcuaaaaaguuaaauucauugucaauugcugagaagaccuucuuugaggucuauuuuuuuuuaaagaguagaaauuaguccugguucuagaaauuaauuuguugaaugaagaaguugcacaaucuuuccccuugcugccacuucugaagcaugacccacaaugcuucgaacaccuucguacuguggaaugggguugugcgugcgugugugugagggagggaugggaugggauggggcugugugucaugauuuugaaaucccagccucuaaaguuuuagaauucuuauauuuuucgguuucuucuugaucagguugucucuuucugucuugaaauacaagggcuagauuaaggguagcugcuaagcagcgggcugagcuacuacugaguaugaaaagaauccuccgggaccuggccuguuaaugugagagugugcgucaaugcggaauagaggcggaggccgugguagggguccagguugggagaacuggacgguuuaaugaggcucagacuauggaggguucucguuucaucgcuuuuuuuuucuuugagagggggucucuggccucgaacuccugggcuccagcgaugaucccgccucagccucccgagcaauugggauuacaggcgcgcgccaccacgccugacuccucucuuuugcuuuuucugagggagcaguagauggggguaucgaaccauucuagaguggugaaaagagcuggcgagauucugaaccaaugugggcagaggagggcgggcggagggggcagacgggucuagucgggggcgggauguugaggaccugggauuucagacucgcgcagaaugggcugccucggcucccaaacggcccagggcuccgaggcugugucugggaugcugagagaauaagagagacgaagggaaaaggcuaggucuugguaucggagaggaaguggggaagcggccucaccuccuuucucuccgagcuggugccgccgguuccgguuguuuuucuaguugcuggguaaccguuuuuucuuuaaaaaaaaaaaaaaacuacggcggccgagaaggggcgaguacagcccaguccugaggucgcgggaggcugcgaggacugcaaaaggguggagucggccucgcccccgcccaggccccgccccugccgggaacccacuuucccaguccuaggcggcggucagauccuugcaagcauggucgcgccggggcuuguacucgggcuggugcugccauuaauccugugggccgacagaagugcaggugaggcggcccggcucggccggaccccugccccucagccugugcgggcuccgagaccccguguccucugcgggacacggauccgcgccccuuucucaaggucgacgaaggaaccuagcuaggcuaggggcucgcgucuccgaccgaggcccggucugcaggagucugcuggguugaaccccggccucuccacuuucuccaccccccacuuaccaucccugacaugcagccugugagcagggagaaagugcggcuugucugaguggggaggcccaaaugugcccagaaagaggccuucgggguccuggaguaacugcaggggagcucggagggaaggaggcgaagcuaguuagguaauauuuggaaacaggugacugaaucuuccaaaacauuucagcgcuacccccucaguggugcccuuggggaggguuugcuucaggcgggguuccuuaggggaauuaaauuuuacucguuuaagugguuaucagggcuaagaaauacaacccccucacuagcucugacuauuuaaggcucaguuuugauuucugguaccgcuuacagauauugguggugggaaaaugugaguggcauaggggaggcugguggcucccuuuggcuguugcgcaggucagaucuugccauucgaauacccuaggcuggacacugggucacaguauggagaaagcagaaggugcaaucugucugauaaugcaaacuaaagugauaauguuggauuucuuccuuucuguuucaaaacacucaaagaguggaccccagagaucccuguuaagaaaugauaguugggguaggagaacagcgugcagaaaaaugacuccugcucuaccugagagccggaaaaguaccuagauucagacaaacugcagcccauaaaugauuguucagagucuaacaaaagugcaaaaugcuagcacucuguaugccauuuccugacucuuaucuccacucagugaccuuugagauccaucuuaugagguggggaaaagauauuuuauuagguuuucaguuaaaggcuguuuauuuuagugucaguauuuuaucuccuccuuugggucuuauuguuacaucaccuucauuaacauugaucacauuuuucauucauuaguacucuacuugguugcguauccugacguuuuuccuuuaagucauucucccugugcccauguuuaccauguaaugcuugagauguacaaaauuauauguaacaaugacacaauaaaaugaacacccaugagagcaguacccaacuuaagaacuagaacauugccagucuauugagccugccauugugcuccucgccaaugcauccggagcuccucaccagaggcaaccacugcccucucuuccccauaacacuaauuccuguuuuucuacuccagccccaaaugaaggaaaaaacugaagaccuaaaaaauccaaauguuggcucacaccuuuaaucccagcacuuugggaggcugaggugggcggaucacuuagagucaggaguucaagaccagccuggccaacauggcgaaaccccgucucuacuaaaaauacaaaaaaauuggccaggcgcgguggcucaugcuuguaaucccagcacuuugggaggccaaggugggcagaucaugaggucaggaguucgagaccagccuggccaacguagugaaaccccgucucuacuaaagauaucaaaaaaaaaaaaaaaaagaauuagccaggugugguggcacaugccuguaaucucagcuacucgggaggcugaggcaggagaaccgcuugaaccccagaggcggagguugcagugagcugagaucgcaccacugcacuccagccugggugacagagcaagacucugucucaaaaaaacaaacaaacaagaaaucaaaugguaaauguaugugucuuguguuuggcacaaggaaugaccagccuugcucucuuucucauucucucucucuuuuuuuuuguccauugcacaauuccuugauguuccacugucuacucuaaugaacuuagaauuuaaacuuuacaaagaugaggaauaugauuuuuucuuugauuugccacaaguaucuaauuucggcaaagugggaauuucaacuuuggaaucaagugacuuguuuucuaacuugucauaaacugugugauuugagaccaaagaacauuaauguuugugguguguuuagcacugugccugccacagguaaagucucuaguagaauggaagcucccugugggcaaggauuuuugccugcuauuauuauuauuauuuuuucaucguuauauccccaaugcuuaaaauaguaggcaucaauaaauauuuguugaauuaacuaaugaacaugcaagcuauuuuaaaaaauuguuucaucugcuuuggucucaguuacuugaucaguaauaugauuauacuucuugaucaguaaguagcguguuuauacuacgauuaugaagauccuuuccaccucuaaaacucuuuagcccagcacagagucauccacaaagauguucacuaaguguauguuggugaaaacagacagacuugggaagguauuuccccuagccuauggacuacugacugcacacaaaugugcaagcugcagccauuccccuacccccacccucucucuacuuagcucuuauuuaugucugugguuuuccuuuuuuugguuccauaugaagcaccuacccaagacaaggcccucccacacaugugccucccccuucccuccagcaggcugccaaccugcuuaugcaauucuggggcguuguauucuuuucuuagagcauuuugcucaugguaaccgugcaucuccagcccaguaggccuucugggugaucuuucauugucauguagguuucuugaucacacuagcucauaagagagcgcugaggauuuuuagggacugggcuguuauuccaagagcaggauaaauaggccacggagcuguguaggcgacuccauuagcugugcugcccuguuaaguauagccgaaggggcccucaucauuuguagcuuccagggaggaaaaugucagccuuguuaauucugguucucuuuucugccuaucauuuuuguuuaaaaugcuuaaaaagaucuaaauuuuguuaauuauuuuagguaguuuggggucuguuuuauucagauaaauugggauauaauuuguuuuauuuuuuuccuuguuaaguuuugaugaggaacacgcugagauaauuuggauggauguuuguauuaauaaaauacuuuuauauaggcuggauguuaaaaauaggaaugaugucguuaaagcgaguucuuauucagucuuguuagugacucucuagaauagaauccaguuucuagugugcuuucucuuguccuuuuaguauaauuuagcuuguggaauggguaaaauugugacagaagaccuuuguucagacauguugaccuucuaucucucacugaccuuauuuaugugucuugauuuauuugaauuuaccugagaaggaagcugacuugucaugaguauuuauaagggcuuauuuagaauuuuugaugcaguacacuggguugucaaaaaaccaugauaaggggcauuauuugaaggaaauuggcauuaguggcauagaaaaggggagauagagaaggggaaaaagauuagggaaggcuguuuggagagaggcaugcuguuuuauucccagucauuaggagcaggugugguaauggaaaguagggaaaggaagugguuuauuuuucucauaaacaccaucuauaggugcaugaaaggagcauuuuagugauuuugcgggagagagcccagcguuagggccaagcccaagagcaaaaaaagaucaagagcucugaaggagagggaagacuaugguccauugguugccuugggcucugggaauuuuccuuaguggucaucaugugcuaugaugcauacuguuggaaacuguucuuguuauguugcuugccuaauuaggaggaagaagagccaguuuuagacgauuaaagggacuuaguauguuaaaauucucuugcauaaagacuguauguucuuugcuguuucacuugauccaguuggugcuauaucucuccgaugaugcuucccucaguguuuguuaaauuuuuuagguauugguuuucgcuuugcuucauacaucaauaaugauauggugcugcagaaggagccugcuggggcagugauauggggcuucgguacaccuggagccacagugaccgugacccugcgccaaggucaggaaaccaucaugaagaaagugaccagugugaaagguaaggcagcccaucuuccguucagcuauugcccucuucugccaccugcuggauuaucugaaaaugaaugcuaaugcuguagcucacauuauccauccgucccuacauccgucuguccauucauccauaaaaguuauuugaauauuugccaugugcuuaggcacugaggauacaaacaaaaauaagacugagucaaaguuccuguucucaaggaacuuacagaauaaugggaauagauaccaaguuauauaggacagcgugaugaaugcuaugaugaagguacauguggggugucuugggguacagaggagaaacauugaacucagacugggugguaagggaagguuuccacagaagaugguauuugagcugaaucauauauagaggagaggcaguauggaggagaggguaagaacucugguaguccuugcccaacaaccuucuuaccuucuuaccuuaaaaagucuuaaaacccaagacuagcaccauguaaaucccauuucuuauuuuuaaaccaauauauuagaaccagcaguucuuuggauuucuaagucagcaucauuuacugagagugccauaauguaagaauguaagacuucauauugguagucuaaggcucuggaagucacugcuuucaggcccugauucugucauuuauacggcugaauaaucuuggacauguaauauaacaucuccaugucucaguuuauaugugaaauggagaucgucaugauaccuacaggauuacugugagaauuaaacgaauuaacacugguaaagacuuguaacagugccuggcacacaagugcagagucaguuuuagcagucaugauuguaacuauuacuauuauuauuuagucagucauucaaauaucuauugagagccuacuaugugcccgauacugugcuagguacuggugauacagugaugaguaaaacagauauguccucuuccuuaaugaggcaugcagguuagacaggaagauaguaagcaguuaucguuaagugugauaagugccacagugaggaagaacaaggugcgaugggagugcuuuguagagaguagggauaauuacguagucugaggcucaucuugagaggugagcagggcacacuggguagugagaauagccuggcaaaagcauggaggccugaguguaccugggccaugggagagaugccaggcagguugguuggucuggaacacuggggggugugugacugggcagaugacaggagauagguuggaaagacagggagacuuguuugucauugcuaaggaguguauguuuuauucuaaacggacagauuuuuaaacagcaaaagaauaugauagauauuuuagaaaguucgcuguggcagcacuguggaagauggauuggagaucaguaagauagagguggugggcaggcugcugugauauccaagcaagagaugaugaggguuugaccucauagaguggcuguggggauguucaggaaggugagaauuagcaguuuucaugagcagggagauauuacaaaggagugagucucugucuagaagagauaaagauauagaagccgguguggaggaggcaaagcuagaaguuaugggaugaaggaaggcaugcucagggcuggauguuacagauagcgcuauagcugugugauguggaggugcgaaugagacagaugaggaggcugcucagagguggagguggaguucagguacaaauuggugguuugagcaauggcuagcauauauaugugacagggaugcuugugggaauuguacuggcccccgaaagcaaggauugucugguugguuuuaucaguauacaaaacugaugauccaaucccgagugauccagacccugaugcagucucuucaaaauucauuuccauucagcaaacauuuaaaaauacuauaugccaggcauugauguaagguaagugcuucuaauucuuggguuuuaagacuuuuuaagguaagaauguuguuggguaaacuaaaagaccgaaagggaagcuucagcugauugagacaugcuucucuguuggaucuaaaugccgucagugacuugcaggauguccugaaagugaaggauucaagggacucucagugcuuucuguuugugcugggucaccuuagaaauaaggagcauuguguacaaauaauggcacucucaguaaaugaugcugauuuggaaauccaaagaacugcugugguuuaaaaauaagaagugggauuuacauggugcuaacaauuaaguuaccaauaauauuuaggugacagagauaacacagugcuguagaaauacauacagaaagcauacaauauuacauagcauuucaguuuaaaaaauccuuuugcauuauuuuuagaguuuuucucccuucaugccuguuucagaacuaauauuugaggugggcagagaugaggcaggaggcuagguggaaugaaagguaauaauuaggagggaagccucccuuuuccuuuacagugauugugaagcugcucauuuaucuugaguuuaauuugauaaaagccaagugagggcuuacuaugucuaaaacacugagccagaaacccuaggaaaguauaaagaagaauacaaauagugcccaucuuucaagaacucacugccccauuccauccuuacacauuuaguaguuuaggcucaaguaaugcuccagcugccucacugcaaagggauguauccuucauuuguaguuaaaauaaccagcagcaacuuaagagaauugagugauucauggauacugaugauaauuucacaggaaaagagguugauguuauugguggugguggggaccuauuuauuagacuuuccacauuuacuugguagaaaaggggaagguauuugaguuuagagagaucugcaaaccugcuucaauggguaucuugcuuuguucugcccaucaagcaaaauagaugaaguguuaauuggaguaaaggagguagacauguaagaaauuucauaggcagaaaaugucucucaaaagagauaccacagagaauauuggaggguggauuucugguuuagauuuuaaugaggacucugagauuuucagccacauuaccucaauuugcugcuuugucugccucugguaauauuuaacuuauuacccauaguccccuagguacccagaacaaaguaagauauaacagcauaaagguuuuuguccagcagacugacacuuagacauugggaaaauuaauaccugagggaugauuggcaccauggucagguacuggguugguucaaacgauguugucaaaugauguaagaggauucuuucagacacaaggaauacgagcagggaaaaccaggcauauccucucacuuugacauacaugguagggguguguguauguaggugauaaaaugagggugugucugucuauauuuuugucaucaugauugagguaaauagauauauuuucucuaccuuaaaauaauacagaagccuaaaacccucccugccccugguuggcaugcauaccaauuuucuuuuuuucuuuucucuuuuuuucuuuugagauggagucuugcucugucacccaggcuggagugcagaggugugaucucgguucacugcaaccuuugccugccagguucaagugauccuccugccucagccuccugaguagcugagguuacaggcacccgccaccaugccuggcuaauuugcauacuaguuuucuaugcuacauaauaaauugccacaaacuuaggugcuuaaaacaacacgcuuuuacuaucucacaauuucugugggucugaagucuggucaugguuucgcuggauucucuacugagggucucacaaggcugaaaucaagguguaggccaggcugcguucccaccuggaggugcgaguagggaguuaccuguuuccaagcucccuuacguugcuggcagaauucauuuagguguugagcucauggcagcaccucugcuguuucacaucucugaccucuauaucuucuuugaaagagcucaccuuauuauguaugccaacccaggaaaaucucaauuuuuauuaacuuaaagugaaaugauuagggacuuuaaucacaacugcaaaaucccaucuuuuccauauaacauuaucuaaucacaagagugacaucucauugccuuugccauuuucuguugguuggaagccagucacagauucugccagccacacaagcaugugacuuuggggugucaccuuaggcugugucugccaccacaggcuauaguguaaguaacuugcaugagcaguuuuauugauacaaaagcacuuaagcuauuuuuccuuugcauucauauuugaugguggagaugaacuucagguuacaacagaauaaauguaguuuggugaggggcaguguaggcaguaaggccuucuugacuuccaagccaguuccacaaaccacugagccacuuugcagccagugaggaacuaggguucuguugggugggggugggggggaagugaacaggggcgcuuuuuucauuucuagguuguucuucucgggaagggaacggucauggauaacuuuccuuuuucucuucuuggcaucagauuuuggcacaauaauagaacaaaauaauuaacaucugauaugaauggcaagaagaaaaaacaagaaagcacuuuaugacuaugucucuagacaaauuauuuucauuuuuuccauugauuguuugcuuguucuucccauuaugaggugggaguuaauugggagguggagagaagguggagacagagaguuuuucacugcccuuggcuggaaugugagaagaagagcaacaauaagaaauaggccacuagaggccggaugcgguagcucaugccuauaaucccagcacuucgggagacugagguggguggaucacaaggucaggagaucgagaccauccuggccaacauggugaaaccucgucucuacuaaaauacaaaaagaaaauuagcugagcgugguggugcgcaccuguagucccagcuacuuuggaggcugaggcaggagaauugcuugaacccgggaggcagagguugcagugagccaagaucgcgccacugcacuccagccuggcgacagagugagacucugucucaaaaaaaaaaaaagaaauaggcuaccagaaaugcuaacccuagacaugagaacauaaagcccuagucaauuugcauggcucucuugucaguguaacccagggaugggguuuacuuccuaccauuuaauugauggagugccuggcacacuaagcacucuaaguagcuguauaaugaaggaaggaaauuaaucuuccuaggugguacgagaaaaaaugcgaggaagcagagauuugaaugcacugaaagugagaauuuacagaaaccugggccuggccuggaauagcuaauagcaagugauuagggcccagaagagggaugcagagcaacuuguugggaaagcugaucucuaucagcagaaaggcagcuggaugguaaacucuuugugguuaguggcucaagcuucuuauuuggacuccagcuuauggacuucgugggucaacacuguuucugaaaacucuuaacuggacuuaacuggccuguggugagcuccauuucaaccaaccaguccugaacggauaagcuaaggaccagccaguucuuaugaaacaugguggcuuuugccuuuuuaaucccacccuugcuuuuggucuaagaaacagucuucacaggugcugcuguccuuuguauaugcuuacauaggaguaaauccuuauuuauuuuauuuuauuuuauuuuugagacaaagucucgcucugucgcccaggcuggagugcaguggcacagucucggcucacugcaagcuccgccucccggguucacaccauacuccugccucagccucccgaguagcugggacuacgggugccgccaccaugcccagcucauuuuuguauuuuuaguagagacaggguuucaccuugucagccaggauggucucgaucucuugaccuugugauccgccugccucggccucccaaagagcugggauuacaggcgcaagccacugcgcccggccaauccuuauuguuuuaaaugaacugucucugaguugguuuaaccauuaguaaccucucuggaguguaucaaguuuucccugccuugccuggaaguuaacucuucuuaacacuuguguuauugucagaguuuacaugacuuuuuuuuuuuugagauggaguuuugcucuuguugcccaggcuggaaugcaauggugcaaucucagcucacugcaaccuccaccuccuggguucaagugauucugcugccucagccuccgaguagcugggauuauaggcauaugccaucacacccugcuaauuuuuguauuuuuaguagagacaggguuucaccauguuggccaggcuguucucaaacuccugaccucaggugauccaccugccucggccucccaaagugcugggauuacaggcaugagccacugugcuuugccagaguuuacuuuucuuuuaucaaguaggaaaggaaaaaaagcuagaaacuaacaucuugaggacuagcacagaaggaaguuuucugaggucuuugaggaaguuggaaggagguuucucugggaggcaguucuugggaacaaggcucgggucuugaugccuaguucucucgauuccuuaggcccuagagggagugcauccucuggcuguagcaggaugguauugcuauguuuggccuaaauaguuuggcauuaucuuuuaauuacuggguagcagaguguuuuagaaccucuggugaagguaguuuucuucaccagccacguugccuggauugaggcuaaguguaaauacccaguuaauagcagugaauaggaauaaauuguauagcaauagaaggcuaagaaauaguccuugguuuucuggagguugaccucaccaccauaaguaaauaacguugguggcagaaggacagagcuccaguaagaugugucagugcaggaagccuggaaagaccuuggcaagccuggaguugggacagauuggagugucugccugcucagaagugugagccacauggaacacaucacaccugugcgacacaaucuguccuagcugcccacuguuuccaaaacagugauuuuucugguuuaggugaauuauacauuuaauacguugacguguggcuacugaugguauaaaagcaauacugaacauuuggucuuagauuuaauuaaccucuuagggaugggaguagcaagcuuaguugcuuaugcuuuuaagaggagcaagcaugcacccuuccucugaugucuuggggcuuuuggacauuuuccccaggacucugagaaauccuuuaugaauugaguuuuuauuagucaccuguuguacauuaggacaucucaugcuucugcuuagcucuugcugauuagaaagaacuuugcagugucuagcacauaguaggcccuuggauaguauuuuuagaauuauuauuucccauagauuggauguaaucauuuuaggaugcuccauuuccaguucuuaucauucuuucccuuugaauuuacauugaucugauggguaugaauuauaaaucaguucauauucuuuggcauaaugccaagaguauuuauuuuaaaauguuaauuucccauuuuuuuucuauuuucccaugcuuguuuuaucaacuuuguucauguugcuugauucuccuuggcauaauuuuugccauuuugaagauauuuuucugaagcuucuaaguauguuguuggcagggguggucuggugagugaugagagguaggagggugauggggugguucuagggaauaugcuaugaguuucugaaauagggucucagacagcuucucauuucccuaauugagucccaaagccuuaagucuuguaaauaagucugugaaaauaauuaauugggcaaauuggaauaucuuuuucacagagagauuaauuuauaugccucccacuacuuuuugaugugucgguuucuccacucaacaguuugcuguuaggaaaacccagaccacugguaguguuaauccuuguuagcaacagaggaggagacggggagugaaggcaagggugauacugucaagccaggggaaguuccagauuaucauugauuuucuauacccuguggucacauucaauugaguaauugcaaguuaguuuggggcacuauaagaugaaauuaauguuaauuuugacagcuggauaguauaauaagaauuucucuuuuauguuuucuauuaaacucuugaauuuuaaucuguguguauuuuugucuauccucauuuaggauuauaacuggguaacuuacuuuuuuuguaaaugcuucaguuaaaaguaaggagggauugguacagauuaaggauaaaaaugcugcugcucguguuaguucuauccucuuaucugaaauuuggccaaucuucauagcuuugaauucgguuuauuacagaggcugggaauagccacaaaugaguauaauugggcuuugauuucacuuuaauugauugauuaauuccuuggaguccuguuacuauuucagcucacucugauacguggauggugguacuggauccuaugaagccuggaggaccuuucgaagugauggcacaacagacuuuggagaaaauaaacuucacccugagaguucaugacguccuguuuggagaugucuggcucuguagugggcagaguaacaugcagaugacuguguuacagguaauuugcagagucucagcaauaauacacaguguuggugaugaagaaggaaaagaaggaggaauaagggggcaacaaggagaagcagggcuguuucuauuuagugaguaccaugagccaagauauguucuaaaugcuuugaaugaauucauuaauuugacuuaacaaucuuaagagauaagcuauugauuaaauugguaguuauugauuggugcuaauguauucuauauagguuaagaacuuagaaggaguauuguuuucucuagcacuuucuccaaaacugaguuucuucucaaguugauuuuuauuuucuugcuuuuuuuuuuuuuucuuuuuugagacggaguuucucucuuguugcccaggcuggggugcaauggugcaaucucagcucacugcaaccuccaccucccggguucaagcgauucuccugccucagccucccaaguagcugggauuacaggcaucugccacuaugccuggcuaauuuuuguauuuuuaguacagacgggguuucgccauguuggccagguuugucucgaacuccugaccucagaugaugcacccgccuuggccucccaaagugcugggauuacaggccugagcuacugagcccggccuguuuucuugccuuuuaaucauuccuuugagaaauauuaaauuugagauguaaaccuguauagaacuagaccguuaacucaauucaucucuuuuugaaaaauuuaugaaauacaauauguuuguauacucuaugauuuauuguuuugcuucuguuucuuaguuuuuucuauuuuuuucuuuuuguagucuucuacuaaauaaugcuacuaaaaugaucuuacucugaacauaucuacuucauuucaucauuaguuuucugauuuagaauuuaaauucuugcauugaagucuuccuuaucaacauuuuauuuacucuuacauucugucuuauuuauauauacggaagcccccccccccccuuuuuuuuuuuuaaagagauaagguccuucucugucacccaggcugaagugcagugguaugaucauagcucacugcagccuagaacuccugggcucaagggauccuccugccucagccuccuggguagcugggauugcaggugugagccaccauauccagcugauuuuuuauuuuuuauagagauagggucuugcuauguuacccaugcugggcuuuuugaauuaaaauguuuauuaaacugaacuuuggacucuuuuagcauaagagaguagaagcagaaucaaaguuuuauuucuugauagaaaggaugguuuuguguagaagcagaauugcuguuaacucauuaaggaaaacaguauuuuucuuaaugcuguaauugcaguucccuguuugcacagaaaggcauggaccagaucuguuuguaucuauauagucgcuuucucaacagcagucuaugccaggggauuccaucccauuuucugucaagcuaaauuagauuuugauuguuaagaguaaacauauuuucucugccuagaauuuaccccugagcaucuucuguauaaagcuaggucucuaagcucugagauauaggggaacagaaaaaaauucugucugaaacauccaaguguuaauauuuauuuuuuauuuuuguuuaaaucaugcacuuaguuugcaagauaacauuuuagaugcugacaguaccaaaagccaaguuucuagucucuuaacagucuauggaaccuuguuuuuugauuaaaagaauguucuacauggcuuucuguuuauuccuuuugcuccuuuccuccuacaaacccccaacacacacacauacaucacacacacacacacacauacacacacgagucuuucuccuucccuccuuccaugugacuucucugaggagguaagaguuccacuauaaccuaccacucuucacauucaaaucaaggaaauggcagauugugugcccaucuuguuguuaggguaaaguggaauuuuaaaauugaguguuauuuauaacgcugagugagauguuuauaaauggagaagagucuaaauguucaucugucgccuccuaagucaggguaggucuuaagauuuggauauuucuaguuaugcucagaaaaagauggccaauauccaucaggaaacccauuuuucaauaucucagaacuccccacauuccuacuuuacaaauagagaaauuaagauccagaagagaagggcugguaccacauuccaacaaaagauucacaggacuuaugaggcuggcuuuuuuuuuuuuaauaguuaucuccucaauuuuagaacugcuaccauaguagaagguaaaguaacuuagagcauuuccaaauucuuuuaaguaaauaaaguuucuguccuucugugugugugugugugugugugcacagacacacacucacacgcaugcuuugcuccccuaugcagaccccaugccaagauucucugaggaaauagauucuugacgugucuucauuaauucaagaaugugguauaaagguuacaaaaugaacaccagugagcagcugcuuugauggugaacgguccagucccuagagaggcagcggugcucucucccagcgucugugguguuaaugacuucaaauaccuugguauucauuuacauccucauuuaaauacuugguaaaaaaauaauaacacugcaguguuugaugagaugaaaucugaucucagcagauggaguaagguuuccccuuucaucagcagggaaaccaaaugucauuuaaaugaaaaucuuccugcaaucucuuuauuccuaaguuugcugcacauauccccgaggaaaugcuuucaucaaaaaggccuaguuauuggggaaggauaccaauuucugaaguaauugucauuauguugucagguacagaaggaaugguccccacccccauuuuugcugacacucucuguggcuuucaaguuugggcuugaaauuacacacaaaugugaauuugaaaauggaaguuuuccagucaauguuuuggauccacuuccgugugcugguaucaauauaggagaaugccaaccauucugacucuauuggccucacaguacucuacaguguuagcaacgggucuaaaagacaaguagcauguucucucauacugccucccaagcuggcgucucacugugaugaagcacuugaguucccagucagugcggaagcuaguguggguggagagaaugaaagcaguuucauccacuguuuccauggaagcaacauaggauccugagugcuuagugcagaacugaauuccaaaggaggcggcuuuuuacagguacuugcugcugaaaaauaauuucccugccagauacacugugagugcauuagccuguucuuacuccuucguguuuacuuuacauuaaccugccagguaugauccugaacaaacaggucuggauuuccuguggaauuuucuugagaccauguguaaccuguccugagaaugggaagaccagucaguaauccugacagccuagagcugccaccaccaagggagcauuucagguuguggcucccacugugaucaaaagagcuaucucauuuccaucuggccaucuuauugggcacagccggcucaguggcaaguccagagagauucaaggggcagcaucuuucagaguuucucuuacgcuguggcuggagggccagcuguauucucugugguggguggguggggguggaaagcgagccagcugcacacucugugaccagcggccaauggaacguacccggccuccugugccucucacugcuguggcagccccgacucagcuggagcgccugcucccugaggcaagcgguaacugggcuuccugaugcucccguuggcccuuuguuuugggagaagcugggccaguccagggggauagaaaggacucaagaagaaauacacaaauaaaaaaaaacaaaaacaaaauauuucugauauauuuguuuuaaaauaaaaaaauaacuaaaaagucaggaugagaggaaauagcacuugugcauaaguucauagaggaaugaugcuuuacuggacuaacaaagaaggaacugaguguagcauacacauucuuuuccagaaaacccuaagccacuccucucauacuccugacaauugaugagguuuaauacagugauuugggaaaauaugauuuaucuuuggagggacccucuucuuuaauuccuugggacuguucugagcuguuacccugaacaccaccuuucuagucuccaugccucucuugcuuuucuuuggugauuuaccaagaccaagaugaggauacugucagccugugguauccaccaguuccacaugugcagauucaaccagccauggauauaaaauauuugaaaaauaaaaauuaaaaguggcaauacaacaauaaauaauacacauugaaaaaacaauacauacggguugaguauccuuuuucugaaguugcuugagauuggaaguguuucagauuuuggauuuuuuuuuggauuuugcaauauuugcauagacauaaugagauaucuuggggacgggacccgagucuaaaccugaaauucauuuauguuuccuauauaccuuaugcacauagccugaagguaauuuuguacaauauuuuuaaauaauuuugugcaugaaacaaaauuugucugaaguauuuauguguggaauuuuccacuuguugacaucauguuggcacaccaaaaauuuuggauuugggggcauuuuggauuuuggauuuucagauuaggguugcuuaacauauauaauaaauauuuacauagcauuuacauugcauuagguauaaguaauauagagauacaggaggauguuuguaggcuauaaacaaauaugccauuuuguauaagggacuugaacaucuucagauuuugaugugcugggguuuggugugggggggugugguuccuggaaccaaugcccuguggacaugaaggauaacuguauaugcauuuugagacuuauuccaguauguuucaguacuucaacuauguuucaguaguucaacagucaugucugagcuguguuucuuuuaagcaugcuucucuugugugguauggauuagacaaaucuaccuccccacggccuuuuugguuccacauaauauccuaagcaccauuuuaaaaagaaguuaauuggcugggugcgguggcucacaccuguaaucccagcacucugggaggccaaggcaggcggaucacgaggucuggagauugagaccauccgggcuaacacggugaaaccccgucucuacuaaaaauauaaaaaauuagcugggcaugguggugggcgccuguaguuccagcuacucgggaggcugaggcaggagaauggugugaaccugggaggcggagcuugcagugagcugagauuggccacuacacuccagccugggcgagagagcaagacugucucacacacaaaaaaaaaaaaaaaagaagaaguuaauuggucugguuuuguguuaugagauacuuuuucagaguagaaauauuucaguuucaagguaucagaguguuguaagugcugggcaauauucuuuagccucagcuacuucacggcuccucuugucuaacauagaccugcuccuuaagaucacagauuucauuauauuucuacccucuuugggaacaugauucauccuggucucuuuugguaaaaguggaucaaggugauucagugcagcccauugguuuugguuauuaauuugaucucaguauauugaaagcucaggagcucagaggacugauguuuacuaagaggugucaggcuaguucaccaccugcuagguuaaaugacguuucaauuucuuuuccagauauuuaaugcuacaagggaguugucuaacacugcggcauaucagucuguccgcauccucucugucucucccauucaagcagagcaggagcuggaggaccuuguugcgguugacuugcaguggucuaagcccaccucagguaugugacggcuugaacgugcugucucuuauauaauggguuagcgcccuaaguggaaucuguaagacugaauuugguucuuaugugucuauuuauuauuacucaugccuuuuauuccuuucuuauugacucuucauccuuccugauggugacuauuucagguuucuucccaagacuaccaacaaaucuucccucuugcuguggggaaaugagucuuccuucaacaucuucagugaaaauaucaaggcccuucggcaugggcuccgccagcaucucucgccgaugccuucacuccaaauccucucuucuuucuucccuugucucugugucuguagacaacuggucucuuuucagggcuaacucugauuuggguucuccuuucuccagagccuucuuuaaucccuuaggcacugugguuuuccccucaguccauucagcaugagcucuccauuucuuuuuuuucuuuuucuuuuuuuugagacggagucucagucugucgcucaggcuggaaugcaguggugugaucuuggcucaccugcaaccuccgccuccuggguucaagugauuccccugccucagccucccgaguagcugggacuauaggcaccagccaccacgcucagcuaauuuuuguauuuguaguagagaugggguuucaccauauuggccaggcuggucucgaacuccugaccucaugauccgcccaccucggccucccaaagugcugggauuacaggcgugagccacugcacccggccacucuccauuucaugacugcuuugugucaggaucugugccaggccccagggauacagcagugaccaaacggacacacagucccugcucucugagcuuagccuuucuucuauucucacaaaauaaaacaaaacaaaacaacaguaaacaucgcaaacacccuucacagaugcuucaucuuucuccuuugcuuuguuaaaccuuucuagaacgucuucuguuuucauucuuuucacugccuuucccuguguucacucuucagcccuuugucaccuggcuucugcuuccaccucaacaauuuguucaccuugauguuacuaucauucuucuaaugauaaaccuagagaccuuugccgcauucagcacugcggaccacccccuuuagaaacugcaugucccuccuugcuugccugguacuuucuuuuccuacuucuccuccucugucuucucugucccuuuuucuuugcuucuucauucccuucccucagagguggucccuguguucccccuggacuuuuucuuuuucuccugugcaugcuuuccuuggugcucagaugcuccuacauuuauaaguaguaauucacuuaacaaauauuugagugucuacuaugugcucgacacuguucuaagugcuggggauauuguagugaguaaaacaggcaagaauaccugaccucauggagcuuacagucuaguguaagggaacucugaaagugaaucauaaaauaagcaaauuauagacaaaguaucugaugcuauccagucuuacacuauccgaacucucccuauaaaagagcucaggaacugaauggauucagguaaauuuuuggaugaauccuuugcucuaugaacucuuacuacaugguauccaaaacucaggacucaaucaaauuuggauaauguauuaugccuuguuaucugaacuuguuuucacuuugugaaaucagaaacugaaugaauaaauguggauaucacaggauagguuaaugggugacgugcuaaugagacaaaaacaaauaaauauaucagggaagggaggcaauaggaaguguucgugcugggauggggaaaggcaacauuucaguagcagccugaaagaggcgaggcaauucagauaccuaggaagggcacagaggauccaucucucccacguugagaaucucuccugccugcugugcucuucccccuuuuuuuuuuuuuuuuuuuugaccgagucucacucuguuacccaggcuagagugcagugaugugaucuuggcucacugcaaccuccaccucccagcuucaagugauucuucugccucagccucccgaguagcugggauuacaggugugccccaccacgcccagcuaauauuuguauuuuaguagagacgggguuucacuauguuggccaggcuggucugggacuccuggccucaagugauccaugaucugccugccucacacucccaaagugcugggauuacaggcgugagccaccgcgcccggucuccugccucuucugucaucacaucacugcugcugggaaagguuuucugauuuuaaggacucuuguaauuagauuggacgcaccuagaugagccaggacacucucuccaucucaaggucccuaaccuuaaucacaucuacaaagugccuuucgccaugcaagguaacacagccacagguuccagggaugagugugucgacgucuuuggggucuguuauuuugccuacaccccacauucucauucucaagcauuuucaaguggguuuccauuuucuuuacuccaagauguggcucuaaccuccccuccagucuuaucuuccacuguucucuuuuauaaucucugcuccagccaaauacucucagaauauuuccuauucugugugccuuuucacguauuuuuucuucugccuugagugccagcucugucuguuaaacuccuguugcugguuuaaggcuucuccagcucucuucuucccuccuguuuaccacuccccucuaccuacugucagugaaaccacagccacccucaaucagucagcaaacacugacucuccaucauguccuggacgcuggggauacagacgugaaucaggugaagucucugcuaauaguguagugagcuaagggaaacacugaacagaugguuauugcaaggucuagugauggagcgaugcacagagugucguggaagcacggugcggggcggggaggucaguguuuauuaggccuuuuaggaucugccucucauuugauauucuuucuuuguguuaaaacuccuuaauacuuguuuguacuuaccaucuuuugccauauauuuuauucaacuaaauacuugucuuacucuuuuuuuuuuuuuuuugagacggagucuugcucugucgcccaggcuggagugcaguggcacgaucucagcucacugcaaccuccgccucccagguucaagcgauucuucugccucagccuccuaggcagcugggauuaaaggugugcgccaccacacccagcuaauuuuuuuguauuuuuaguagagaugggguuucaccacguuggucaggcuggucucgaacuccugaccucaugaucugccugcuucagccucccaaagugcugggauuacaggcaugagccaccaugcccagcccuacuugccuuauucuaucaacuaauagaccuaugaggagagguuccaugugucucuauauugcuuucaucacugucucccauccaucuaguaguuccugauacaugguaggugcucuguccauuuaauuauuuuggaauugauuugaauccucacuauugcacugucuacuuuuggagugccagugacuuagccauagucagucuuuaauaaaccuugggcugaacugaucccauccuuguguguacaugcaugccccccucuucaccagcuuucuucuaacaugaaauugcucacucuugccucuguugguuacugggcaguguaauuggaugaaugaauuagacugugcugagaauuuaaacacuaguuuuggcuucuguggcuuucccuuugggccgaauuucccaucacuuaucuguccauguuuucuuuaccauagcuauuuauuuuuauuuuuugacuuuuauuuuauuuauuauuuauuuuuuugagacagaguuuugcucuuguugcccaggcuggugugcaauggcacgaucucagcucacugcaaccuaugccucccagguucaagcgauucuccugccucagccucccgaguagcugggauuacaggugcccaccaccacgcccagcuaauauuuguauuuuggguagagacgggguuucaucauauuggccaggcuggucucgaacuccugaccucagaugauccaccugccucauucucucaaagugcugggauuauaggugugagccacugcgcccagccucuuuagcauagcuauaaaauuggguauaaagccaccagaaaaaagaagaaauacacauuucuucuuaaguugcccccuccuugcuuuuucccuuccacagagcuaagugggaaugaguggcugaguaagaggggagacacagaagagaguagcauggggacaugauggcccucccaccucucaccuauuugagggagagcauugauuauccgagagucugcagauccuguaagugaugggaagcauggggaagccuauugccuagccagaguuuuaacuuccauguuauguaagugaauuauuuauaaucagacugagagcaaaaucgcuaucauaucugccucucucccaggcagagagagcuauuuccuuguuaugagaacaagcauuuugaguaacugaaaaaacaugaagacagauaaaaggaaacuaucacuaagguuacaguuuucucccuuggaaaagauucuccuuagggaagguuuggaagagauaauaguguucagaccagcauauuggucuugaugcuguaucuucucugugccucucaaucuuauccuacuuuugaaagucuuagaaaacaacagaagaaugaccucugcccacccuucucaccucgacccaccuagcagcugcaguuuguauccaucaaccuuucucuggcucuuuuucuuuaaccauuucucugaacagaaaacuuaggccauggauauuucaaguacaugucagcagugugcuggcucuuuggacgucaccuuuaugacacucugcaguaucccaucgggcugaucgccuccagcuggggcgggacacccauugaagccuggucaucuggacggucacugaaagccuguggggucccuaaacaaggguaagacagcauucuccagucugagaaagagccuaccagggaauuaugcaagagagagggucaucguccucuguggggaguuaaguauauggugaaugucccaauauguguugaauguauguaauuuauucauguagagggaaagcauuauuuucacugucacugccaccacaaucguuugagaacauguaaaaaaaaaguaucuuuucccccaguaauaguaauagcuagugguuacugaaagcuuuuuauaugccagacacugugcuaagcacuuuauauauauaaauuaugaauauauugaauauauauuauuauauauuaauauauugaaguguagauauuaaagaccaugggugaagacacuacauuucagagagacuuaguaacuugcucaugagcaugacuaguaaguggcaagucuggcuucagugucugugcaccuaaccauugugcuguauugccuagaagaauaaacaauccaacaggaagaacaaauguuauaaacauguacucaaagaaauguaucaguauacugauuaugaacaccugcuuaggaaaggcuggaucaggaagaauacuuggggagggaaagggcuagugaauacaaaucccgauacuaacaucaauguagagaugagcaguaugugacuugcuuucauggaccaugucucauucacgcugggaagcccugugggaggaggaugggcuugagcucuggguauaguuuggguaaaagcuugccugugggggagugaagauauucaacuuuggaacaggaagaauggccugcaguagaguaggagugagcguuagaccagaucucuggggguggaagggauaaucccgagggugugggcaagugggcuucucacacgcagcagcuacaggauaaauucauauaaauauucuacagagaaauuugagaacguguucagagccuuaaaaaagaugcccuuugacacagcaguuucauuucugggaauuuaucuuauggauauaguuaagcauguaugcaaugacuuagcuauaaggaagaugaucuuggcauuccauauaaaagcaaaaaguuuaaaacaaccuaaaugucugugcauuaaauaaagguuuauuuaauaaaaguuagguaaauuuauuggcccccccccacaaugugagaaacucaacaauaaagcacuccuucccuguggcuuuaauuaccuuagaaauuaccuuuaauuaccauagaaagcugaccgauacacuuauuuugggaauaaccuggaggugaaauucagagaauauucauauguuuucaagaaaaagaguuucgauucaauuuuaauucuguguugcuuucaucagaaguuuaccacaagugaaaguggauagaugaccaauuagggacccuuaugugaucaaucacuggcucucuggugacacuugugcaucauaugauuucagguccauuccauacgauucuguaacuggucccaguaagcacucuguucucuggaaugccaugauccauccacugugcaauaugacucugaaagggguaguaugguaccaggguaaguguucaguguacucuuucuccauuguaucagauagcguuugcuguauaacacagcacccuagaacguaguggcuuaaagcaacaauaacuuuauaauuuuauucagcucacuguucugugggugagcaggguaguuuuuaugucugggcugcuucagcuaauuccugcugggaccucuuaugugucuuuggccaccuggcagauugucugguggcuggaugaccuaggauggucucucccuagauguauugucugggggcuguugcaacaugguucugaggugaccucuuauccuucagcaagccaguauagacucauuuauuauuuauauaauagucucaggauuccagggucaucaggagaggacagagcccaaaccugaaguacuuuucaagccucuguucguaccacauuugcugaugccccacuggcuggaaaaagaccaguccagagagaccgugggaagaccacuaccucagggcauggauggagggaggagaguaauguguggucauuuuugcagucuacuccaaacucccuuuacaauuuggacuguuuuuaggggaguccaauauaaauuauaacacggaucuguacaauugcacauucccugcacucaucgaagacuggcgugaaaccuuccaccgugguucccaggggcagacggagcguuucuucccauuuggacuuguccagguacgauguggguaaaggcuucucuguucaugucaacaccuguuccuguguugagaggaagagguuuaugggcauugguguggggaugugcuauuuggaucucuuuccuggauuucaucuuccuuuuuuguccucauaaugugcuggucaagaacugaauguaaggcuuacuucaucucaguucacugauaggacaauuaaaucuucaaaaaaaguugauaaguaacuaauauuucuuauuuaaaaagcauuacaguuucauugaggaaauauuaaaaagauaagcaaaaaagaagcuaaaaaaguugauaauuuuccaauccaaaaauaagcagcugucuucugcucauuuauuuuugaaauagaucuguacuauaucuugcauuuuucucuaaaaguaauauuucaauuagagauaaguaguaaacgauuuuucaugucaauaaauauuaaucuucaaugcaguuuguaaugauuguagagccugaaauaugguuacauuguaguuuauuuaacuagcugucuauagauugggcauuucgguuguuuuaaacguuuugcuuuaauaagcuuuggcauguuuauuuuccuuguugcuaaaucacugcauauaugcuugauuauuucccuaagguaaauucccagaaaugaaauuucugguucaaaagguacaccuuuguaaggcuuugaacauguccccagauuucucugaagaaauucaugaauuuguauaaauuuaugcucuuaacaacugucugugagaauguccauuuccccacccccuccccaacuugguguuaucccuuccacucccuggaauccaccgugcucucucacucccuggccauugcacuugcuccuugccuuccauacuuuccuaguuaacuuuaaucauccuuuaggucccagacagccuacauauuaguuaggaagccuucugugacuauccagauuaguuagaugcccccuuucucucuacuuccccuuuuuauuugcaugagguugccuacaugacuacauuuuccugggucacacuuaacaucccuaguacguauguaguugauuggcacucguuaaauaguggcuuaacaugugaaugaaaaaagauagcaagagaaaccauacauuuaauuagagauaacuagucagaaagauucugcuuucagccuugcauaaaaagaauaaacauauuugaccaaguucauaauugccuagccuccacauguucauaugaacuacacuuuuuagcacggugguagugcugguuuuucuagaacauaagaaaucaaacaaguaaggugauauaaaaacaaugcccaucuuaaaacaugacaacagaguaggcuuuccuguguaaaugggacauccauggucccagacaccaccuccgcacgccccacagaugacuucucaccauccuccccacuccccuaccuuguccuuuucacuguaccuucuuuugaauauuuguauagaccuucucacuuaaaaugccuuuaugauuauuuucuuucuucuuuccugcauuuguucugacuuugaaauaagauuauucugcucauuauuuucaaaguagcagcuccugucaccaguucugcaucccuguugguggaaacuacacuugggcuuuggaaguacuuuuuucucccuuggccugugcacauggugauuugaguaugacuuuagccaacucaaaccaaaaguauguguugaaugcuuauuauaugcugugaaucuugugaggugcuagaaauauagcaaucaggccgggcuugguggcucacgcuuguaaucccagcacucugggaggccgaggugggcggaucaccugaggucgggaguucgagaccagccugaccaacauggagaagccccgucucuacuaaaaauacaaaauuagucgggugugguggcgcaucccuguaaucccagcuacucuggaggcugaggcaggagaaucgcuugaacccaggaggcguagauuguggugagcauugcacucagccugggcaauaagagcgaaacuccgucucaaaaaaaaaaaagaaauauagcaaucagaaagaccugauucuuguacuuaugccuuacaguuuagugaaagucccuuaaccuccagguuuuaacuuuauuaucaccaacaaaaacaugcugguuacuaguggaagucuggaaauauaaacauaucccuucaaagggaaauacccagcaugacagcgucaugguucagacugagucugagcuagacuaagugcauucagaugcuagcugugacaccuccugagccacgugauuucgaacacgauacugaacucuuuguuauuuuaaauauugaaugaguucauccauggaaagccgggaacauaccagauaauguuaguguugaauauuguugaugagagaaaucagaagaucuggagggacaguuggucuguaaggaaagaggaacuggcuucauagaagugcuaaguuugaaaugaugguugcagugacuagaguacagcuagagauggaggaugugaguuccacggagagaccagggcuggacacguguaucccagacuuauuagcagaaaggccaccuggagccugagagcgaaacagcaagaggcuaggggcuggagucccaaggagugugguuuuuaaauagggauuuggaggaacaguugaacagaccacaaacugcagcauguuauuugugagcguggccagcuuuauauucuuuggcugguccacgccuuuauuagccgcaguauuucuaccagccacugugggagacggauuagcgccccacuguaucucagauuaggaaaacaggaauuucauguggguguggaguacgccggugcccccauguggcgaguauauaauagugcagucaaugaaaaagugaauugcugcaagaauucucagcaaacugccauuuugagaaaauucccuugacuugagggacuguuauuagcauugcucccuguugagcuucaggcuaguuuuuuuuuuuuuuuuuuuuucucaccacagacucuuuccuguggcguuguuacugugaucuucauuaugacccuggcuggugcacaugguuccacuuugucuucuggguguggaagaaguagggugacuuaauagauuuuuuauucccauuuucuagucuucaugagauucuacugugaggcuucaguggcaccuucuaucauuuccuauguuaaagcugauuugccuaagauaauuuuaauaagagaauuguaaauggccuauugguuccauaucauauccaaggcuccuuucuguuauuauugcaaccucuccguguacuccugaugauuuucucaucuuucuggagcaacucagagagcagaaaauauccucgauucaaaguugcauuuggccacauucauagggaugaugucagguauuuucugggcugugaguaauaaggcuggguggaacagucuguguaaaaugcaguccucugauggggucagacauuuugaaauggagucaaaaaaaaauguuguugcuggcccagacugcuucccaguuugugguuugacuuacaguuagaucaugguuuguaaaagagagauaauagguugaugccucucauuggcuggaacuggagcuaagaauaagaugcuaucuaaaucaaaggacagggugauguaaacaucagaaaaagaaggaagaaauagcuggacugccugugucauaguaauaguaaagauuuuuuucucugggagccuguguguuuugcaggaguaggaguguaucaacuuuccguuuagaugaaaacaaauccuguuaacucacucugcauucagaaucugaccacuucucacuaccuuuacuccuccugcgcuagucuaagccaccaucaucucucccuuguauuauugccuccuaacuggucuucuuccugcuuuuaccuuuuuuucuccuccuguaggauauucucaauauaucaaagugacucuuugaaguguaagucgggucggaaggcuccaguggguccccgugugcugaggucagcaaggccauacaugaugugcccccugcccacauuacccgccgaccucaccuucuaauucucucugccuugcauaugccacuccagccacacuggcugccuuacuuuucuuuaagcacgcuaggcauacucccguccuggggccugccauuuucuuuuccauucuucauggaaaguucuuuuccugcuguuuuaguuuucuauugcugaguaagaaaugacugcauauuuagcagcuuaaaacaauacaacacacauuuauuaucucaguuucuaugggugagaagucugggcgugcauggcuuagcuggaucuucugcugaggguggaagugaaggugucagacagagcuggagucucaucugaggcuuggaguucuccuccaaguucaugugguugucggcagaauucaccuccuugaagcuguagaacucauggcagcuuacuucuugaaggccagcaggggagggggccuggcuucuagacccucuuugaaaggacucaccugauuaggucaggcucaccaugauacucucccuuuugaucaaugugaagucagcugacuggggacguuacuuguaacaucugcaaaaucccuucacuuuugccauauacaacauaaucacaggagugauaucccauuaccuuugccauagccuauugguuagaaucaaauuacgaguucccccuaccacaaagaggagaguauuguauaaggaugcggcucccugugggucauccgccuaacauacccagauauccucauagcuucuuugcgcaucuccuucuagucuucauucaacucugacacucucuccuccuucccuauuauauuuuucuccagugcacuugucacuuucucauaggauauguaguuuacagaucuaucuuguuauucauucucucuuuccacuaggguauaagaaugggaagggauucuuguguuuuguucacugcucuaucuccuaggccaguauuagugcaugacacagaguaggugcucaguaaauauuuguuaaaagcaugaauaaauacaugagcugacugauaauacaugagcuguggauccuucacaggcucuuucuggaacaauauuauuccccaaauauucuggugcuacuuggaugccugagaugccacacaguuaauucagaugccguggcuuccgaaugauggauuuuacccuuccucuuguucuccauauccaguugguugccugguuuugucaguuuuuauuauuucucaucaucccguucuacuacuaucucuguagauuagaucuuuguuuuugugucuagaauauuauaauagcugcuuaacuaaucugucucucugcguuaaguccuuuauuuugguuucuuuuuuuuuuuuuuuuuuuuuugagauggagucuugcccgguugcccaggcuggagugcaguggcacaaucuuggcucacugcaaccuccgccuccuggguucaagugauucuccugccucagccucccgaguagcugggauuacaggcaucugcaaccacucccggcuaauuuuuuguauuguuaguagagaagggguuucaucauuuuggccaggcuggucuugaacuccugaccucaggugauccacccaccucggccucccaaaaugcugggauuauaagcgugagccaccaugcccggccuuauuuuguuuuuugccagagccauuuguaugaucacuagaacaaucuuuugaaaugguccuuugaucaugucaguaauuucaguggcucuguaauuucuuaauugaggugaaagucauauaacaugcaauugaguucaguagcacguuagcacauucacgaugucgugcagcuaucaccucuacagagguucuuuauuguuuaauacaaaagaaucaacuauacaaacacuugccuugcuaucuuuccaacuuugccuuuccuucacaaauccuccaguccaccuggauugccccucucucagaacgaccauucuccuccccaccuuugcaucuuacaugcuucuaacaugugaagugugagcaguacugccuguagugacuucucauauuuuugaugcccauuuguuuuaaugaauucugagaccacguuuuccuauaauaauaaucuuugccuguucuaaauguuuaguacuugcugucuguggcacucauuuaacauuuaauccauacuauuuuauauguuuaugaaacauaaacccauucaauccuuauguuuauuucuuauguguaggucuguccuccucaacaaagcuguaaaguacuuguaccaguuagcuacugcuguguaacaaacuaccucaaaacccccggccuaaaauagccuuucuuauauagguagcucuugucuggggagcugggguuugggugauuuggcuaagcugcagaucuuugggcucuuucagaccucugugggucagcaggggcgcucuuguccuucuccagggagcagcaggcuagcccaggcacguccuucuuauggcgauagcagcagugcaaaugagcaaguggagccaugcagagucacuuaggcuaggaagugacacaccauacuuucugcuucuguugauuggucaaagcaaaccacauggcugagcuuagaaucaaggguuugggaaacauacuuguccuguuaacgggaggaacugcaaauccacauggcaagaggguguggauauaggagggagugaagaauuggggucacugaugcaauuuagcacaugcucaagggcagauucuucucugcuugccuacagugccuagcccuguguuguauacagauguaucaguuaucuauugcuuuguaacaagcuaccccaaaacuuaggggcuuaaaccaucagccauauuuuuugcucaugauucauuggguuggccagguagggcucaccugggauggcucauuucugcccuacaugauaccagcuaggcuugcuuauguggcugcaauuuuaacuggaggaucuagaaauccauaugacuggcccuuaucugugauugcuggaacacuagagccucucuuucuaugaucuuucaauuuccaaggccccucucacuccauaaucucuccagcaggguaacuggaugguguuuacaugaccagcucaggguuucaagagaaugaauucagaaggcaaggccucauaaggccaagacucaggagcuguacaacaucaauucuccugcauucuaugggucaaagcaaauccuagauucaaagggaagagaaacagaccccgcugcuugaugagagguguggcaaaguugcacugcaagagggcacaugggaugagagggacuguugcagcugucuuuggagagacacugccacaacaguaagaagcucaguaaauacguguugaaugagcauuuaaaugcaaugagagaagcagaagcagagucugccagugaaaaagacuccagugugggauucugauacaauaaaauuagcaaugucucugcuuucuaguuaucuucagauuugucuaagaagagcucagacgauggauuuccccagauccguuggcaucaaacagcagacuucggcuauguccccaacccaaagaugcccaauacuuucauggcuguagcuauggaucucugugauagagacucgccuuuuggcagguaugauugcuucuugggcuuugcaugaacaguguauguucuuuguagucuuucacucugauguucaccggugaggggcaauuagacugaggauuggcacuuaagagucacguaugcuggggugugcugcaguaacaacagcaaacacccucaacaucucaguucucugaugcaccaacaauuuauuucuuggucacucucucuguuaaaagaaggucaacagagacuuugcucacuguaaucauucauagacccagagcaauagaggcuccaaguugaccuaugcuuccauagucaucuuaaagugucacacuggcaauucagugcuuccacacaagucauuucugcucacauugcacuggccaaaccaagucauaaggcuacgguuaacuucaguggcagcaggaaauggaauuccagcauuccucuggccucacaggaggaauacugagauaccugugaucagccccagggaacaccacacacuaacuguaggaugugaggggauuccacauaggaaacagaguccaacacacagugucuggauuauaggaggaacuugauugauuuauugaauaaaugaauaaaagcucuaggggaccaaauaaugaaucagcugauuccaaagaaaccugacuuuuagugguuaggaacaaucuuaugaguuagcucucuuagguuaguucugguaucuuuccuucuuccaugucucccucccuccucccaaccugcccuuuauuccuuccuuccaagucaucuauuauuucaagguuuccaacccauagaaggcccagagccccaucuaugguuaccauucaccauuucccuugagcugacuagccacugaucacagaguucagucaacuuuauucuuacuuucauaaagggugcuuuguauaaucccccuuuuaaaaaaauguggugauuguugagcuuaaacccaaaguucucuacuuguuccuuauccuguagcauccacccucgagauaaacagacuguggcuuaucggcugcauuugggggcccgugcucuggcuuauggugagaagaauuugaccuuugaaggaccacugccugagaagauagaacucuuggcucacaaggggcugcucaaucucacauauuaccagcaaauccaggugcagaaaaaggacaacaagauauuugaggugagaagaacagcagaauaaacagggguucauuuugugguggagucaagauuuccuccgcacuugaggccaucucuuuuguuauuacgauguggcgggucuugguugguugggggcugagcuuauuucagagcugcaaauaaacagcuguuaauucaguagcuuggaggcacuuuugacagacagcacaaucgagaaagggaaaacaaguccauauuaaaauggacuuuaaaaaauuuuuaauuuccuuuuacauuuucucugccgaagcaaccaucuuugcuagggcagggccugcagcuuuauuuguagguuaccuauugaaggauccuugcuccagaauauuuaccccauccuuggguguauuuuuuguuacacucuccuaaauccugacauuuucugaguuuagguucuccuuugagaggcuuauucuuagguauuuguaacuuagugugacaauauaaugagaguccuuuuaauaccuagcaggggucauucugcuguggaacuggggccauugaugaaagauuauucaggagucuucgauauuugagggugggagauggaggcauuccuacauggaacauuuaaaugagugacuuugggaaucaugaggccuuagguugggaaggggugugugaaaagaaugcauuggagaagagaaaagaauauuaaaggcaaacuuuaacuacacgggaguuugucuagggcugcuauuucugaaguccuaacuacgguauccaccugccucagaugcuugguuggcacuuaccccacuuagcuucuuuccacacuggguuccaggugaauugagagacgucugcauucugagcucuucucuuuagucaguugccaguggucuggauaauuuguauucccauuucuggauugccuucuggcuugagaaagguuuuguaucuuaugccccuucuucauucugcaguggcucugggagugccagagcggagcagcagcagcugggccacucuguucacuuaaauuccugucugccuugcuguuuggcaagagggaucacccaaagaauguucaggggagcagccuucccuaaaugccuuaugugaucaugcuuccuugucucccucaguaaauguuuuauuuauuaaaauuauuuauuugaucacaugaacauguauuaucaaccuguggcugugcugacuagauccaaagugggcucagguuuguucugcuuacuguaggaguagguccuuggugaagagugucuccuuuccucccauccauucugucugaaagagcagugcccaguuucuuggaagacccuucugaccuaaucauuccuauuuuauggcucucuuauuagaucuccuguugcagugaccaucgaugcaaguggcuuccagcuucuaugaacaccgucuccacccagucccugacccuggcgaucgauucuugucauggcacugugguugcucuccgcuaugcuuggaccacguggccuugugaauauaagcaguguccccuauaccaccccaguagugcccugccagccccucccuucauugcuuucauuacagaccaggguccuggacaucagagcaauguugcuaaaugacuguuucaguaugaucagaacuuagauauaaggauggguccuucagauuuuagcauuuaggaguuucaauaauaaccauugcuuuuaaaggaaauuaauagaaagccucauugaauggcuuucagcuagcacauggcuguuucuauauucugaugagcccaggcuuauagguaacuugaaaugcuugcuuuuuguucccuaguuggucuaagggucuguauuggacuaauucugaacuacagacaaauuggaccucaaugucauuuacuucccucauauuaaugggagugaaaugucuaauacuuuugccccuuuuuauccagaguugugggaaucucaggauuggaagagauuuuaaaggccacauaggccagcuaguguucauguguucuuuauaaaauuucucccauccaaguacuaaccaggcccgacccugcuuagcuuccgagaucagaugagaucaggcgcguucagggugauauggccguagacgucuuuacaaaauuccugacaggugguuacugaaucucucuaugaacuuuccauucaaaacuuuccaaguuuuuccuuauguggaaccgaaaucuuucuuucucccgugaaacuuuacuacuaucagauaauugaagacagaucucuuuguauucucuucaagcccaaaccaauucuguuccuucaaucuaaauagugguaauaugaauguuuaagaaaugaaauaagaaacaugugcaggcacuuuggaaggugcuaagugacugcccuaaggaaugaaaagcaagggccaggugggaguagcccagcgaaggcacuugggcugccaggaacaggaggcgugggaaacucuggcuuaggaaaacaugaacacaggggcaacagaggcaaacuguuguucgaguuaaauauaaaucucaggcucuuuaaagguaaaagguuuaaggauaauccauuuggaagaagaaaagagugaggcugaaaguaaagccacaugacaagcauauaaaaaaaaaugcagaugauacaaauaugaaagaggccuucaguguuuguuuauuaagaaucuuaaugcaguuuacugauggauuaaaaacagcuaacauugucugaaaauuauguuaccuauaagaaguuggaaauaaauaaaagcauaaucacuagugauguguauguauuuauauccacuugcaaacuguccuugaagcaugugaaaaggaguaagaauacuaucuauggguagcuuuccuccccuuaaugugaaaaaugagaacuaaagcaaaaagcaucacucacuguacauauacaauguauuuuacguaguguaaaaaauaugguuuagauagugaauauauuaaugaaaucauauguaaauuuauuuuuaguggcugaauaauuuaaaacauuauguggaauucacuauguuucccccaauuuaggaacuuuuuacugugugaaaaugaaauuuauaauacucuguagggugaaugaugguuuuugcuuuaguucuaccccucuguagaguuccaagggguucugguguagcuccaaacagcaggaauaacuuugucagugccaagauuuuauuuaguuaaaaaacaaaaaaucuacacacuuuacaaggaacguuggcuccccugaggacuuccuagcauucaacucguucaguuaaccccuauugcccaugcuuugaccucucaugcaucuggccccauagaaaccaugaaccuuguaacagauugaugccugagaaaaagucaaucuacccguccacuccuccacucccaauacacauacccccaugggcuguucuaauucgggggcagccagagguagccaagaacucuaaguccagauuccuuucaccuccaggaaccuagaguacauagugugaaaaauacgguucaggcaaugauuauguuaaugacgccaugcacauucauuuuuaguggcugaguaauuuaaaacaugaugugggaauucacugcauuuccccaaauguaagaacuuuuuaguuuuaaaaugaaauuuauagucacuguagaaaauuuggacacuaaaguauaagcaaguaaaaaucacccccaaauucaucauucagagaaacacuauuuugcugaaccauucacuugacuugaguuauauaauuuuauacaguacauauuauuuuguaaucuguguuuuugacuuacuuacuuuaccaaaauaauuuucuuauguaaauaauagaauauagauuuagaguguuucaguuuguggaagccucauuuuauuuaaccaauuuccuauuaauggacauauagauuuuuaacaauuuucuacuauuaaaauaauacuguaaugaauaucacaugcaaacaucauaccacacucguccaguuauuucuuaggguucuuaacauggaagaggauaaauauauauuuaaaauuuagauaucuacagcuuaacccucccaaaggauuaaacaacuuacauucucaccaagguaguccuuuuuuugcccucacccucauugacacuggauguugucaaauuuaaaaaaaauccuuaacaaucugauagaugaaaagauaguuuaaguauacuaaggcaguguuuuucaagguguuuuuguuuuuguuuuugaguuggaguuuugcucuguugcccaggcuggagugcaguggcgcggucucggcucacugcaaccucugccucccggguucaagcgauucuuccugccucagccucccgaguagcugggacuacaggcgcgugccaccacgccuggcuaauuuuuuguauuuuuauuagagaccgacuuagccaggauggucucgaucuccugaccucuugauccacccgccucagccucccaaagugcugggauuacaggcgugagccaccgugcccagcuuuucaaguuucuuaaauccaugauccauaguaaaaacauuuuacacauaucuucauacaaguauauguauaugugguauacguacacacuauaguuguauaugcauuauagcugaaaaaccaguucaaccuuucuacaugugguauguuccaaaaauuuuaaaugucuuucuaaaaugaggcucuuuuaauacggguauuacucaggcuguaauagugggaaaauauuuguuauaugauaaaagcagcauauaucauuucuguguaaaugccaguaugcucaagccauuuaugcagagaaaaaaagaaaaacacugcauuaacauuuuaagcaguccccuucccgauuugcuauuauacaaaguuuguuucuuuuacauuguaaaguguauacaacuuauaaaaagacuauacucaaaaucauaaaauaccaguuaacuuagcuucucaguuuacaguggccaguguggugugcucuaaacacugcugccugaucccucccucugcuggucagauuuauuacuauaaaguaccaaucccauuuguguuguccucaauuggcaauuaugaauggcagugcauuaaccauucaauucucaccacuccauccccauucuucuacuucuggguccuuuugucccucccuuuccagacagcccuugguaaccugcugcuggguaacuaaggcaucccacagguaguguugagguguuaggugauagaguaaaccucuaccuuaaugcuauuaacaggguccaaaaauccaguugcauggaacauggaguuauauuauuacauggcuaaugaaaagacaggacuaagucuguuauagaguaugggacuaacccccaauuauaugugaauuuguguuaucauaugguuucaguguacugagcuaaaaagcacauuaucugaggugcaauacaaagguuaaagagguuaaagauccccuugaaggaugugcaaaaugugaagaaaaagaugaacaguguaccuuggacuggacuuuccaucuugaguuuaagcagaacauuggauuuugaugauacugacaugaaaauuaagcagcagccuggguugcaggggcugggacuugauauuccuugaauuaggaucacaaucaagaguagaaguuugucagaaucucccuaucucccucguuagucagcugcugcuacuacagacuuaauguuuauauguccccaaaauucauguuaaauccuaaccccuaaugugaugguauugggagguggggccuuugggaggugauuaggucaugagagcagaccucucaugaaccggcuuagugaucuuauaaaagggaccccggagagcugccuuccucuucuaccacgugaggacacugcaggaagacagcugucuaagaacuaggaagugggcccucaccagacauugaaucugcgcuccuugaacuuggacuucccagcauccagaacugugagaaauaaauucauguuauuuauaaaccaaccugucuaugguauuuguuguagcagccugcagcucucuaucacucuuguuuauaagaggcugaaguuuacuuuaccucaggcagagcuaagcaaaaaagauuacaucccgauuacaagaugaaaguaaacagaauugacaagagaaauuuauuacuaaaaauaaagcagcugaagguuuucccagggaaaaccaucaccacaggaccuuccaugaugaaauacguuaguaucuucuuuacuucugaauugcugccuucuuucauauacccaaaauuuuaguuuaaguuaaauuaaucacgacaaaaacgauguggcaucugaucccuucuuguucaaucugaagacugaauugggcuacccugugauggagacuucaagugcugcaggugaguaucuaccaaggguucaugugucagguacaugggcugguaagaagacacaaaggcugcaggcugaagcucugggagguccaaggauccuggagaaaacaauuccuuaaguuccacugcugcucgggagucugggcagacuguuuuggucagacauauacauguccuuucaaucaauuccuuaacacccuugcauuugucagcucaauuuugccuuuguuaagauaggacagauacuuuuacaaugaaaacugguugaaacauuaagugacuugccuaggguuauauaguauauuaggcaaagagugagaauuucaauuccauuuuuuaacccagaguuuucccuauaugaccccaaagccugaacccuugaucacucauuugugggaggaacucauggaacacaggcagggccaaggccuugacuugaccccacugacuucacuugaaauguuauucccugcacaguaaacuuuccccugguguucugcuccagucuugcuuagguuacagaaugagauaccuuaguuucugggguacccugccuuacuaugaucgcaggugcuccccaugacaucugugaguaaucuaggaagcuaugcaggccgcaggucccccucuaacucagcacuccgcaaggcugauucaaugaaagcuuuuaucacucaaugcauagauauuuaggguacucggcuaugugugaagaugggaagguagccuaaacacagucaauuuucaaaccagaaagguaaaguuaaagauaccuggcagaaggggaucauucugaucuucaucaaagaucugucucugaaaggcuucaaagcucauagcugcaucauucuccggcagccccucagguagcugcccaucuccagguuugcacacaucaaauuucacccacugguaacugcagaaucaagggaaaucacccuugagaguuaucugcuagac

SEQ ID NO: 15924 - RNA, 9738 nt, Homo sapiens
uuguuuauaagaggcugaaguuuacuuuaccucaggcagagcuaagcaaaaaagauuacaucccgauuacaagaugaaaguaaacagaauugacaagagaaauuuauuacuaaaaauaaagcagcugaagguuuucccagggaaaaccaucaccacaggaccuuccaugaugaaauacguuaguaucuucuuuacuucugaauugcugccuucuuucauauacccaaaauuuuaguuuaaguuaaauuaaucacgacaaaaacgauguggcaucugaucccuucuuguucaaucugaagacugaauugggcuacccugugauggagacuucaagugcugcaggugaguaucuaccaaggguucaugugucagguacaugggcugguaagaagacacaaaggcugcaggcugaagcucugggagguccaaggauccuggagaaaacaauuccuuaaguuccacugcugcucgggagucugggcagacuguuuuggucagacauauacauguccuuucaaucaauuccuuaacacccuugcauuugucagcucaauuuugccuuuguuaagauaggacagauacuuuuacaaugaaaacugguugaaacauuaagugacuugccuaggguuauauaguauauuaggcaaagagugagaauuucaauuccauuuuuuaacccagaguuuucccuauaugaccccaaagccugaacccuugaucacucauuugugggaggaacucauggaacacaggcagggccaaggccuugacuugaccccacugacuucacuugaaauguuauucccugcacaguaaacuuuccccugguguucugcuccagucuugcuuagguuacagaaugagauaccuuaguuucugggguacccugccuuacuaugaucgcaggugcuccccaugacaucugugaguaaucuaggaagcuaugcaggccgcaggucccccucuaacucagcacuccgcaaggcugauucaaugaaagcuuuuaucacucaaugcauagauauuuaggguacucggcuaugugugaagaugggaagguagccuaaacacagucaauuuucaaaccagaaagguaaaguuaaagauaccuggcagaaggggaucauucugaucuucaucaaagaucugucucugaaaggcuucaaagcucauagcugcaucauucuccggcagccccucagguagcugcccaucuccagguuugcacacaucaaauuucacccacugguaacugcagaaucaagggaaaucacccuugagaguuaucugcuagacauaaauacccauuccuaucacuaaagggaucagguaauuuuucuuuauauuccgcccauauauaucuaaaacacauauuugcuaacaaaaaccuaaaagaaauaagcaggccucuuuagugacaaauuagucugcuagauuucccaccccuuuugcugucaugguacauacagaaaauaguaauaaucagcgaacaguggaguccuggcucuugcuuaccuguccagagggcuaagggggccaauacugagcccuacuggucgagaagcaggcaggcuuuggacacagaaggucagugaacaaaguaggaacugccagucccuggccggaugaucacugagcuuuucucaagggaaugaauuugaucacacuuacuugaugcauuuucgagcuccuggacagcucuggaucagguuguggauggcuggaugagaaaauccaaaaaagucagcuccagcuggaagcagguuaggcauuaguuucccccuaaacaggagagggauaauuuuaguuugagagcuuagcgggagaugaagauggauuuaagaacagaauagugguaugaacaaacaggauaagcuuucuugacuuugauaauguggaggcucuaguuggcacaaugucaggaggauccaggauagguuucuauaaaauaaaguaucuccacccauuaaaagcaagagaaaagguuucacuguaccaacagugaucuuuuagccuguuuucaagcuuuuggucaacuuacauaguagugcuuauaguccugagcaguucugcaugacaagcaucugcagaagagcugacaauggcauucugggggucaucuucaggaacaauuucaaacugagaaagacaaacgagcaaugagaucaauccucaagaaggaaggagagaggggcauacuacucuguaaauauuucuuuacucuggaacgugaagcugacguauaccaucuucagaagggacacacauacuuuccuauagggcugcuaaaaauugaaacaaauccaaguaccuagagaaaguccuuugacuguuucaguucuacccuucuugguugacagcuuuccaaaagugagcguuuaauuuguuguguaccuuuccaauccacuuauuuauauccuuaaguacaaauacaaaugguauuuuaaaaacaaaugagaucacucuccauguaaucuuuuaagucaauuuuacaagaucuaggagaaacaggcugacugcaaacugccauuucauuguauuuacuuucauuuugaacguuaaaauaucuugguuauguuaauaaaaagaaacuguugcaucgaaauuacacuaauucugaggaauuuuugccaagaaaauauuuuuguaacaaauguaacaaguuaacuagcugauuuaauuauuuggccaguuuucuauaaagcgcaaugauuuuuuugccaggaaaauauuucuguaacaaguucuaucuagccaauuaaauuauuugacuaguuuuaaaguucauuuaaacaguuucuaguucuucaauguuuacuucagucaaauuauccugaacaggauuaauuuauuuucuguauaauuuuuuagaaugauaucgagcacuacugauuucuaaaaaaagucaaagcaauuuuuacugaguauaguuuccacuacuguuaguuuucuucugugguuauuauuucacuggauucaauuuaccgugucaaauuuuagagaucugucaauuuugucaguaauaaauucucuugugagugguuucaaucaauggugguuuucuuauuucaaccaauggcauaccuugccagguuaagauucuaauguuuuauauuuauuucucagcuaauaaaugaaaaaaccaugagcaauuaauuucuuuucuuuuuucuuuuucuuuuuuuuuugagauggaaucuugcucugucgcccaggcuggagugcaguggcgugaucuuggcucacugcaagcuccgccucccggguucacgccauucuccugccucagccuccccagcagcugggacuacaggcgcacgccaccaggcccggcuaauuuugcuguguguaauuaauuucaaauaguccaggauugcucuacuauuuaguauuugucaugucaauuucaauuacuuuuuuuguacugaaauuuuuacccuauuugaguaaagagcauuaaagauagaaauguuauacuuuagucuugaagauaccuccuuguuaguacuaauguauaaaucuaccucauucuucuaauugcuguacauacaacgguggauauauuuuacuuaaccauuuucucauugauagguauuuaggcuauuucuaauuucuugcuauugcaaauacugccacagugaacauuguuacauguuacuuuguucacauuugcacauuucucuaggugcaaauguguaccuagugcagucuagauacuagacuaucuagacauauucugggucaaaugauacacauacuaaaauuguugauacugccaaguugcccucccagaagacuaccaauuuucacuccuacuaacguguacuuguuuuccuccaccccggccagcacuggauauuauuaaucccucugauaugugccuaugagcaaaauaagaucucaguuuuguuuuauuugcauuuccccacuuacugaugaggcccacacuuuaccaucugcacuguuucugugaaaugccuguggguuuuuuuuuuuuuuuuuuaauauugcuuuuuccuacucuacaggagcacuuuaucugguauuaauccuuugucauacguuuucuuccuguuuauugcuuguguuuuaacucugaucauggugucuuuugccauucagaagaguuuacauuuuuaauaguuaaauauguuauuauguuccauuauggcuucuaaguuucaugucuugcuaaagaaagccuuuucaucucacccuaagauuauaaaaaauucuuuuacauuuuccuuuaacauauuuauagaauaaaauauucaauaaagcuaaaguaauaaaaagucauauugacauguauagacaaaaagaugaauaaaaaggaaucaucuggaaagagauacaagaauuacauauauuuagucuguguguguguguguguguguguguguguguauauauauauauauauauauauauauauauauauauauauauauauauauaaaacagcuacuugacguuaguuggaacaaaauuugaagcuagauuccuagcucacacaccuaaaaauaauguccaguuagguuaaugaccuaaaaaagaaaauuaaaaacuccacagauucuucuuuuucaaaaauguucuagcauuuuguuuuucagagaaaauuaagaaucggcuuuucaauuucuacuaggauuuugauuagauuugcauugcauuuaaagauguauuauaaauaugguauaccguuacaauaaugagucuuucuaaagaaacuauugcauaauugaggucacguaagcucucaacuaugccuaacaaugcucugauaggcgugaugcaauauuaucuauaagaagucaagcugucucaggguucucccagcuucugcucaaagguuccuuaccuugccucuacuuccuucuaccuuacuuucuagugaucuguaacuuccucagugaagcuuagaacuccgaaaauggucuauuuuuuuguuuuucccuaacaaucaggagaugaugguuggggaaaauguacugucucaaaucuuagcacugagaaggaugaaaaaagguauuuaguaagacuaggauuuaagacucucagguccuuaagaguauuugcagccagaaacuaauaugcaauuucuuugcuaacuccaucuugguccaacuugaaauggcaguguaucaaacuaaucuucccucuauuuuggccuguaccucacauaaguaggcuugaucaagccucacauagucacaaagucagcaguugaaguagcaugguucaagagaaaagagcaucaguuugagaaugagacagauaauagauucacauccaaacucaaccacuuauuagcagaggugugacuuagggccagccacuuuucugcaucuugggauuacccaaauggugauuauacauaucuaccuuguaagguaucagaacagguaauacauauccuagcacagagaagguucuaaagacaaacagugguuauuauuagaggggguaccugaggcugcacaccaccauccuugaucugacagguauauagacacuucuggucugggcacuucaugcuggcauauauucgaguacugcaauagcccacgggguagauggcacucucaucaugaaagccaggucggucggugaugaucuauaaaaaacauucccccaaccugggauugaggucacugaagaauuuagaaguccaguuuccugugguagccuuuagaaccacuuuggggcugcaaagagugacaaaucacacaaagacagagaguaggcuguguagcagacaacacugaccugguuuugcagggacuggagauacgcugggguugguauggaucagcaagaggcugcugcuaaugggaacagggagggaaggcucaaccccauucccguauuucccugauucuccucucuauauaucgcuggucucacucaccucccccaggcuauauacuguuagacccccuaguccgauggggaacacaggccguccugagggauccagggcaaugggcugaaccagcuugcgagcaccucccgccauuuucuuuuucuugcauguuuucuucagaacugaaacgcaaaucuggggucacccacuuuaggccccuuccaauguugaagggaagggauaaauuugcacgugaauggugagggcaauaagccaauccugguuuuauauacuuacugaaugggcauauggggcuuucgcccaaagcccugaguagcuuucuaaccugcccagauuagugcuuaggagccaaaggccuuauacuuuuuaaggccucuuauuucaucuguaagaucagaaauuuaccaagccagcagugugcuccaaaggccaccuagcccauuucccugccucuaggaaagacuaaauggaaugcaacccagagaguugggggaagggggaagucucagucugcuccccuugcauuuaacgaagucuagcucgaauuucuccacccaaaguggcucuaauacauuugacauuuguuuucucaagggcuccuagggcuccuuaagaaccagaugagacucuaaguacaucugcagcugugugugucugucaguuaguaccaggucuaacugucauuaguaggugagucacuggggcaacugauaucaucuccccaaaguaccuuccaguuuguuguucucuuugccuuuuucuuuuuucuccuucuuaguuuucuucccaaaugguuccucagccccagugcugggcccugaaauaggcccagcucccuguauaguucccacagagcuggccacaccauaagucaggggcaaacuggaacugugggaaggagcugcagccuguacuuccccuucaguuagagccugaagcuggaggagcuucuuuagcaaguaccugagaucaggaaggaaaggagcagagaaaugaacuuccguauugucucaauucaguauuuuacucaaguacugggaaaagccagaauuauauacaaagauuacuauacucauaaaagaaagguucuuauuaggcccuaugaaucauaaagcccuggaggauaaucaauacuucaagaggccaaggauaagaacuguagcuuaucucuugcaucuggacgguuccucuaccuugauguuggacgguguuaggcuucugaaaggcacauuauuuacacauguauauauacccauugugcuuugcacagaauaguacguacagaauaaauauuuguagaacgagaggcaguugcuuuuaucacuuggcuuuuauaauugggccauaagauuaaauaaucuuaguaagauuauuuauuagauguggcaagauggcuuuuucagaaagaugaguagaggagcugucucaucgccauggcccaacauaacuugggugugcaggcaccaaugccucaggcuguaaguuucucugugcuugaucaaguggccaaggggcugugcgauacgcaucaaucccacugggaaaaaaagucuccagagcaguaacaccauuaucaaucaccaaaucaaucaccaaaaaggugaugcugaacacaaaaugaagccagcucaccuucuuucuucuuuugcuuuaagaaauuuuuccucaagacgagcaauuucaucacaaauagcagcauuuuccuuuaaguaaaaaugugaauauaauaacauaaaaugaauaaaaaaaucacauuauuaugcugggaagaggauccauauuucaaaccaaaaaagcuuguauuacugagaagaaggagcuauucgaccgugugacaaacuauaaauaaauccauagauaaagguagucagguucuacuauggacaggguauagcuauguaauuuauuauccaauccgggacaucuuugagugaaaaggggguacuauuaaugcuuaugccagaacaauacggugaaccaggacuguccugggcaagccaagauuaauggucacccuaauuaguauagccuuuggcaaagaaaaaggcauacugcuuaaauccuuauaugcuuaaauuaaauacuauaaauaugaaaacugucuauucccaagugccucaacucuugaaaaacuuacaaagccagucuaacccaaauagagaaaaacuggacagaacaaaaucaaauuuaguguguaaaauucuuaaacuucacaaucuacuuauacgaauucaaguauuaucuuuuuucuuuuuuuuuuuuuuuuuuuuguaaaugaugacucaaucuaucucccaagcaccaauccugaagggaaugcugaaucugaaugcccccauagguggaacuucaaacucucaauguucaaaacaacaucgcuuuuucuucacaaaaucuucauuauguauuugauggaaccaauauccuugaaauaacauaaauuccaagcuuuagguaccuuugacguauaggggauaaaagaaagggaacagucaaucagaugcuaaguucucuuaguuuuacuuuucuuguuucucuccagugcaaauagcaagcaauacacauagcaagugcugaauaagugcuuuuggaauguguauucuaauuucugaaccuuuccuuaugcuuccaaaaaugcugagagacguucaagcuuuugguagagagaagagaugaacuguugacuuggauguggggggacauuugaggacuccaccccuauuuccaagcacugaggcaagccaaacuauucuaauauaaaguuauggcuggcaagcuauauuaaguuuauucacucaauaaauccagugcuucuacaauaaaagaaaggaagaaacacuuggaacacucaaagguuagaggggggaaauuacugacaguuucauguaccucuuugggcaaagggucaguuauggggauuugaggugcucagaaaauagucuguguacuggaagucauaaaacggaaucagguuuaucuaaguuggagucagggcucugacacaguacccuugggcaaaucaucucucugggcuucaguguucucauuuuacaaauaaugccuaauucucagggcuguaucucgagaaucaaacacauuuccuagaguccugcaguaacaacgaugacuaaaauuuauugguaugucuuuuacgcaccaagcacuuuucuuuacucauuuaauauucauuauucugcaagacaguuacuagcucauuuacagaugaggacacagagaaauuacguaauuuguccaaggacacaaggcuaacaaguaguaacguauacggaaaagccaacacuguauuaauacugucacacugggaagggggaacagcuuggggaaagauuuugugagggagucuccaggaggggaccggcugaacgugggucagacucacaaacaccguggccuuggccgcuuugcgcagccgcagguacuucagccgguacuucucauucuggcucuucuucgggagcuuuuucauccuggccuugcuggacugcagcggagcccgcggcgaggaagcgaggccguccagcaggcucaugguccagccccgcuacgggggccccaggacgcugccggcaucggauccuaagucggggagcgggcgggagcgcuggcuuugucuguuccgggcuagcggaaucgggccucuaggaaucuagcucuccgggacguucccagggcugaccgcagggccagagacacccgcaaccgaacgggcucccggcgccucccagcacuuccgugucugucuuggaaguaagcccuucccggaaguuacgucccggugucggcaguguguaacuuccggggcagggagaguaggguggucuggg

SEQ ID NO: 15925 - RNA, 827 nt, Homo sapiens
guuuaaaugcauuuuauuuuucgacaacauacauaacauguuuuucuuaaaaacaaugccuccacuccaaauaaaucacggucaaaauaaaugaagagcucaagaugacaucagccccaauuugucuuaaguccugguguuguguggaugacaagcagaagccaguuacaaugacaggugauagaucaaaguaauugccaaauuuguuaacauuuuuccauuucuaaaucauccuuaaagaaaaucauauauggggucacaccaucuucacgguaguccaauagagcaaccaugccaucuggauucauguuuucacaauuaaagaacugguaguuuuugaaauuagcaaggauguccuugauuuguuuugcagccccugucauaaaagguuuuacuguuucuggucucuguucuucaaguuuggcuuugauugauuucauguaaucuuugauauacuucuuguaggcuucuuuugugaaacuuguuuccugcaggugaugguucaugacaauaucaacaccagugauuacugugcuuucuguaccuucgcccuagggucauucagcggagguauuaccaccaaugagcgagucaucaauguuaccuucuauccuacugaccaucuuccccuccaccuccagguacagcccguccaugaucucccagaucuuguagaugucggaaaacaucucaucguggcugaugaggucgcgguagauaaucaugauggcggcugaagggagacgaugcagcacuagcuuagcaggagccugaagcuugcagcaagcgcagugcagccugagcggugcuaagguggagaggggagc

SEQ ID NO: 15926 - RNA, 960 nt, Homo sapiens
gcuaaggcagcaccauuggcucuacucaguuuguaauuuuauuuaggguuuccuuuagagcaaguuugacauccuuguuccugaggcuauaaaugaggggguucagcauggguaccacauucguguaaaacacugagagaaacuuccccugacccauauaccaaucagaugauaacuuaacaugagugaucagcccaaauucauagaauaggccaacaguuauuaugugggagccacagguaccgauggcuuugaaccaacccucggcugaggacaugugaaggauauugaaaagaaucaaagcauaagagauuaagauaaugaggcuugauacuauaacaacugugccuacaauaacagacaucaccagcucauuggccuaggugcugcugcaggagagcuggagcagugggaagaugucacacauguaaugguugaugacguuggagucacaaaagaugagcuucaucauacacucuguguggaccauggccccagcaaaccccaucacauaugaaccaagcaucaguagagaacagaucugaggggacguggugaccauguacagaagggguuugcagauggccacauagcgaucauaggccauggcugucagcacauagcacucagaguggacaaaaaagcagaagaaaaagagcugaguuaugcauccuggaaaggagaugauguuccucucugaaauaaagcucaucagcauuuuggggguaaagacaaaugaauaacagagaucaaugaaggacagauugaaaaggaaaaaauacaugggagugugaaggugugaauucaggcaaauuagauuaauuaaacucaaguugcccaccaugguggucauauaguucaccaagaacaggaaaaacaggggcaauuagaucucaggcuggucuguuaaucccaaaagaauaaacucuugucacugaagagucauuuuccacagccauu

SEQ ID NO: 15927 - RNA, 947 nt, Homo sapiens
caaaaacauucuccuacucagagauuuucccauggcaaauuuaacaucuuuccuccuuaagcuguagauuaaggagcucaucaugggaagcccauucauauaaaaaacagaagagaauuuucccucauccauagacccagcagaagaugguuugagauacauaaaugcacuuaauccaaagaacagagaaacagcaauuaugugggaacugcaagugcugaaggcuuuggaccuucccucauuggaacugauguggaggauccuggagaggaugucaccauaagagauaaagacggugacagugggcacaaugguauugaugccugccacaaugaaaaccaccaguucauugauguaggugcuggugcaggagagcuggaacacagggaggaugucacggaaguaaugauugaugguguuugcaucacaggucagccucagcaugcauccagugugggccauggccccagaaaaggauaggaaguaggaaccaagcauaaggcugaaacacacuuuaggggacauggcaaugugauaaagaaguggguaacagauggccacacagcaaucauaggccauugacgucagcauauaacauucagaaauaaauuaaaaaaaaaaaaaaacagaaaaagaaaaagaaaagcuagaucaugcaaaccauguaggagauaacauucuccucugaaauacacuuccucggaaguuggaguauaaacacagaagaauaacagaggucugugaagaacaauuuagaaaggaaaaaguacuugggagugugaagacgugaauuucgcauaguuagaauuaccaagacaaaguuucuuaucacagugacaacauacauuacaagaaacaugaagaacagagggaguuaaagaucuggcuagucuguuaaccccaccagaaugaauucauucaucaaagagccauuuccaggagccauu

SEQ ID NO: 15928 - RNA, 982 nt, Homo sapiens
aaaacauucuccuacucagagauuuucccauggcaaauuuaacaucuuuccuccuuaagcuguagauuaaggagcucaucaugggaagcccauucauauaaaaaacagaagagaauuuucccucauccauagacccagcagaagaugguuugagauacauaaaugcacuuaauccaaagaacagagaaacagcaauuaugugggaacugcaagugcugaaggcuuuggaccuucccucauuggaacugauguggaggauccuggagaggaugucaccauaagagauaaagacggugacagugggcacaaugguauugaugccugccacaaugaaaaccaccaguucauugauguaggugcuggugcaggagagcuggaacacagggaggaugucacggaaguaaugauugaugguguuugcaucacaggucagccucagcaugcauccagugugggccauggccccagaaaaggauaggaaguaggaaccaagcauaaggcugaaacacacuuuaggggacauggcaaugugauaaagaaguggguaacagauggccacacagcaaucauaggccauugacgucagcauauaacauucagaaauaaauuaaaaaaaaaaaaaaacagaaaaagaaaaagaaaagcuagaucaugcaaaccauguaggagauaacauucuccucugaaauacacuuccucggaaguuggaguauaaacacagaagaauaacagaggucugugaagaacaauuuagaaaggaaaaaguacuugggagugugaagacgugaauuucgcauaguuagaauuaccaagacaaaguuucuuaucacagugacaacauacauuacaagaaacaugaagaacagagggaguuaaagaucuggcuagucuguuaaccccaccagaaugaauucauucaucaaagagccauuuccaggagccauucuacucuaagggaaucuauggacacaggagaaaaggg

SEQ ID NO: 15929 - RNA, 1059 nt, Homo sapiens
aacuaaauaaaaaugguuauaagcuaugaagugugguugaagcgcuaguuacuuauuucucucuacaacugcucaggaaggaagcccagcugauauaagaccuuccuuagugauaauuucaccuccuuauuccugagacuguagauuaagggguucagcaugggggugaccagguuauucagaauuugaacaguugcauccaaccacaggcuguggguaggccucagguaaaugaggaccacuggcauguaaaaaagcaggauggcggugaggugggcgcugcagguggagaaggcacggcgucggcccucggcagagcagaucuacaagauggagaagacgaugccacuguaggaggugaggaugagaaggaaacagcugaggggcaugaggcccacacugaugaaccccaccaucuccagggcugagguaucugcacaagccagcuucagcaugacugggauaucacagaaauaauaguccaccucauuggggacacaguaaggcaauuggaaggugagaguggucagaaagguggccugaaugcagccaaagaaugagguccccauggcuaggaugauacaugcucuguggcucaugauuaugguguagcguagagggugacaaauggcaacaaagcggucguaggccaucaccguguacaggaaacacucagugcagcccaggaaaugguagaagaagagcugggaugcacagccugcauaggagauggcucggcuguucccugaaagauagcacagcaucuuaggggaacucacagaagggaaaaauaggucaaaaacagacagcuugcacaggaagaaguacaugggcgugugaagccgagcagaggagacaauagccagcaagaugagcagguuccccauaagggugaagauguagaaggacaaaaacaggaccaacagaauagucuccagacccuccgugugagggaugcccagcaggaugaauucggacaccaccgagaaauuccucauggcugugaaaacauccaaccuugaaaagguacccaagacaccaaagucuaaacaccaaugu

SEQ ID NO: 15930 - RNA, 1109 nt, Homo sapiens
uuuuccauuucauucaucuaaacacagguaauuuacaugcauauuaaauuuaaccacuuauuucuuuucacggacacccaagaguugauuccuccccaggaaugagaaaucacacaauggugacugaauucauccuucugggaaucccugagacagagggccuagagacagcccuuuuauuccuguucuccucauuuuauuuaugcacccucuugggaaacgugcuuauccuuacagcuaucaucuccuccacucgacuucacacuccuauguauuuuuucuugggaaaccucuccaucuuugaccuggguuucucuucaacgacuguucccaagauguuguucuaccuuucggggaacagccaugcuaucucguaugcaggcugcgugucccagcuuuucuucuaccauuuccuaggcuguacugaguguuuccucuacacagugauggccugugaccgcuuuguugccauauguuuuccuuugagauacacggucaucaugaaccacagggugugcuuuauguuggccacggggaccuggaugauuggcuguguccaugccaugauccuaacuccccucaccuuccaguuaccuuacuguggcccuaacaaggugggcuauuacuucugugauauuccugcaguguuaccucuagccuguaaggacacauccuuagcccagaggguagguuuuacaaauguuggucuuuugucucucauuugcuuuuuucucauccuuguuuccuauacuugcauugggauuuccauaucaaaaauccgcucagcagagggcaggcagcgggccuucuccaccugcagcgcucaccucacugcaauccuuugugcuuaugggccagucaucguuaucuaucuacaacccaaucccagugccuugcuugguuccauaauucagauauugaauaaucugguaaccccaauguugaauccacuaaucuauagccuuaggaauaaggauguaaaaucagaucagcccugaggaauguauuucccaagaaaagcuuugcucugggaaauaaaugagaacauuuaaagcuuugcuggauuuaagauuuugauuacauuuugaaguuugacucuccacucccug

SEQ ID NO: 15931 - RNA, 1109 nt, Homo sapiens
cagggaguggagagucaaacuucaaaauguaaucaaaaucuuaaauccagcaaagcuuuaaauguucucauuuauuucccagagcaaagcuuuucuugggaaauacauuccucagggcugaucugauuuuacauccuuauuccuaaggcuauagauuaguggauucaacauugggguuaccagauuauucaauaucugaauuauggaaccaagcaaggcacugggauuggguuguagauagauaacgaugacuggcccauaagcacaaaggauugcagugaggugagcgcugcagguggagaaggcccgcugccugcccucugcugagcggauuuuugauauggaaaucccaaugcaaguauaggaaacaaggaugagaaaaaagcaaaugagagacaaaagaccaacauuuguaaaaccuacccucugggcuaaggauguguccuuacaggcuagagguaacacugcaggaauaucacagaaguaauagcccaccuuguuagggccacaguaagguaacuggaaggugaggggaguuaggaucauggcauggacacagccaaucauccagguccccguggccaacauaaagcacacccugugguucaugaugaccguguaucucaaaggaaaacauauggcaacaaagcggucacaggccaucacuguguagaggaaacacucaguacagccuaggaaaugguagaagaaaagcugggacacgcagccugcauacgagauagcauggcuguuccccgaaagguagaacaacaucuugggaacagucguugaagagaaacccaggucaaagauggagagguuucccaagaaaaaauacauaggagugugaagucgaguggaggagaugauagcuguaaggauaagcacguuucccaagagggugcauaaauaaaaugaggagaacaggaauaaaagggcugucucuaggcccucugucucagggauucccagaaggaugaauucagucaccauugugugauuucucauuccuggggaggaaucaacucuuggguguccgugaaaagaaauaagugguuaaauuuaauaugcauguaaauuaccuguguuuagaugaaugaaauggaaaa

SEQ ID NO: 15932 - RNA, 981 nt, Homo sapiens
ccuucauaggaaacuucuuuuuucaaggagcuuauuuaaggcaacuuucacaggaaacuucuuuuuucaaggaacuuaauuaaggcaacuuugacaucuuuauuccucaggcuguagauuggggguucagcaugggcacaacaguagcauaaaacacagaagacacuccccugguccauggagcugacggaugauggcugcagguacaugaaugcugcagacccaaagaaaacagaaacagccgagaugugggagcugcaagugcugaagguuuuggaccugcccucaguggagcgaaugcagaggaugcuggcaacgaugaagauguaagagcuaaggauggugaggcugcggaaaaggauauuaaaugcacugaagcacaaacuacuauuucauugauagaaauacuggagcgggagagcuccaguagugggaaaagaucacagaaguaaugguugauuacaucagccuuacagaaaagcacucuuagcaugcagacugugugagcacguagcaccaauaaagcccauaaaauacaccucaacuaccauccaggagcagaccugauaagacauggcgacaugguaaagcaguggguuacauauggcaauguaguggucauaagccauugcagccaacaugugacauucagauaugacaagaacaaggaagaaguagagcugagucaugcaugcuggguaggagauaauauuccucucugacacaaaauucaccagcauuuuugggguaaugacagaagacuggcagagaucaaugaaggacagacugcugaggaaaugguacaugggggugugcaggugagaacugaacccuauuagagugaucaugcucagguugcccaccacugugaccacauagauucccaggaagaggaggaaaagaggcagcuggagcucugguuugucuguuagcccagcgagauuaaauucagucaccguggaaugauuuccuuuuaccauu

SEQ ID NO: 15933 - RNA, 1086 nt, Homo sapiens
auaacugugcagguguuuuggaauaauguuuaacacugagaacuauacauauaaucaauuucacaugaauaacuaaauuauauuacuauuuuuaaacaaacuaguguaucuacuuccuaguauuuauucucccugagaaugugcuacuuugucucucaguuucaacacagcuuucuucaccuccuuguuucucaggguguacacaacaggguugagaaggggugucagcacaguguagaaaauggccacaacuccauccacgacgucccuggagccuggucucagguaaaugaaaacacagggaacaaaaaagcaaaggaccacgaugcagugggaggcacaggucugaaaggcucugugccuccccucugagguguggauccgcaggauggaacagacgauggacacauaagacagcacuaucaggagaaagcagcccgaggccacuagcccaauguccacaaagaugaccaucucguuggcugaggugucugcacaggccaguuucaggaugggcggugcaucacacaaauagugcuggaucugguuggguccacaguagggcaaauggaaagucaauauggucuggacagcagagugcagagagccacugagccaagugcugguggccaggagggcacaucugcucccacucaucaugcugguguaccugagcggguaacugauggccaaguagcgaucauaggacaugacuguguagaggaaacacucggugcuccccaggaaguggaaaaaauagagcugagccacgcagcuguggaaggagauagcccugccgcuuggggacaccaaggucaucagcauuuugggcaccgugacaguggagaaccacaugucaaugaaggacagguuggugaggaaguaguacauggggguguggaggugagaauccacccugaucaccagcaggaugaggagguuccccagcacagugagcacguaaaccaccaggaagauuccaaagaguggggcguccagcccuggggcauggggaaggcccgugaggaugaacgcugucacgaggcuggucuuggacauuucuucucacccuuggucucucucccu

SEQ ID NO: 15934 - RNA, 933 nt, Homo sapiens
cuucucugaauuuuaaucagagcuuuccucagugcaacuuugacauccuuguuccucaaacuguagaugagaggauugagcaugggcaccacauuaguguagaaaacagaagaaacuuuucccugcuccauagauccagaagaauauuuaauauacaugaaugccgcugacccaaaaaacagagacagagcaaugacaugagagcuacaaguacugaaggcuuuugaucuuccuugaguggauuugauaugaagaaugcuagugacaaugaaaacauaagaaaugaggaugguacaacuggguaccaugauauuaauacccacaacaaugagaacaaccaccucguugacauaggugcuggugcaggaaagcuggaggagggggaguaugucacacaaguaaugguugaugauauuagcacugcagaaggugagucuaagcaugcacccggugugggccguggcuccagccaaucccauuauguaagcagcaaaagugagcauagaacagaccugaugggacauggugaccuuauacagcaauggauuacagauggccacauagcgaucauaugccauugaggucaacauguaacauucagagaugacaaaaaagagaaagaaaaacagcugagucaugcacccaacauaggagauaauauucuuuuuugauacaaaguucauuagcauuuugggagugaaaacagaggaguaacagagaucaaugaaggagagauugaagaggaaauaguacauugguguguggaggugagaauuuagaccgaaaagaaugaucaagccaagguugccuaccauggugacaauguagaccacuagaaacaggaaaaagagggguugcuggaacucuggaugaucuguuaauccagcaagaauaaauucagucacuaaggaguuguuucuagccagcauuuuu

SEQ ID NO: 15935 - RNA, 570 nt, Homo sapiens
uacgcaaccaugaagcaaauccuuagucucagagaucagaggcuuaaagaaaaggauagauuaaaaccuaaaaagaaagaaaagaaggaucccaacacauuaaaggaaagggaaguuccccaacacccuucccacuuauuuuuccaauauaauacacagcucggcccaccuuaccacauccucauugauaccaacuuuaucaacuuuuccauaaaagccaaacuggacuuaaugcagucaaugauggacugucuguaugccaaguguaucccuuguauaacugauuguguaauggcugaaauugagaaauuggggcagaaguauagaguggcucuaaggaucaccaaggauccaagauuugaacuauuaccaugugcacaccaaggaaccuaugcagaugacugcuuaguacagaaauaacucagcauaaguguuacauuauugccacaguugacugggaccuuaaaagaagaaucuguaagauuccuggaguuccuaucauguacauuucuaaccauagauacaacauugaauggauguccgaugauuauggagccccuugauucuaau

SEQ ID NO: 15936 - RNA, 1015 nt, Homo sapiens
ggagcuuucuugcuugucuuucuaggguaucaagggacaugagaaauggcacaguaaucacagaauucauccugcuaggcuuuccuguuauccaaggccuacaaacaccucucuuuauugcaaucuuucucaccuacauauuaacccuugcaggcaaugggcuuauuauugccacugugugggcugagcccaggcuacaaauuccaauguacuucuuccuuuguaacuugucuuucuuagaaaucugguacaccaccacagucauccccaaacugcuaggaaccuuuguaguggcaagaacaguaaucugcauguccugcugccugcugcaggccuucuuccacuucuucgugggcaccaccgaguucuugauccucacuaucaugucuuuugaccgcuaccucaccaucugcaauccccuucaccaccccaccaucaugaccagcaaacucugccugcagcuggcccugagcuccuggguggugggcuucaccauugucuuuugucagacgaugcugcucauccaguugccauucuguggcaauaauguuaucagucauuucuacugugauguugggcccaguuugaaagccgccugcauagacaccagcauuuuggaacuccugggcgucauagcaaccauccuugugaucccagggucacuucucuuuaauaugauuucuuauaucuacauucuguccgcaauccuacgaauuccuucagccacuggccaccaaaagacuuucucuaccugugccucgcaccugacaguugucucccugcucuacggggcuguucuguucauguaccuaagacccacagcacacuccuccuuuaagauuaauaagguggugucugugcuaaauacuauccucaccccccuucugaaucccuuuauuuauacuauuagaaacaaggaggugaagggagccuuaagaaaggcaaugacuugcccaaagacuggucaugcaaaguaaaacaugcaacacaucaaagugagcuuaaugcagauaaa

SEQ ID NO: 15937 - RNA, 1015 nt, Homo sapiens
uuuaucugcauuaagcucacuuugauguguugcauguuuuacuuugcaugaccagucuuugggcaagucauugccuuucuuaaggcucccuucaccuccuuguuucuaauaguauaaauaaagggauucagaaggggggugaggauaguauuuagcacagacaccaccuuauuaaucuuaaaggaggagugugcugugggucuuagguacaugaacagaacagccccguagagcagggagacaacugucaggugcgaggcacagguagagaaagucuuuugguggccaguggcugaaggaauucguaggauugcggacagaauguagauauaagaaaucauauuaaagagaagugacccugggaucacaaggaugguugcuaugacgcccaggaguuccaaaaugcuggugucuaugcaggcggcuuucaaacugggcccaacaucacaguagaaaugacugauaacauuauugccacagaauggcaacuggaugagcagcaucgucugacaaaagacaauggugaagcccaccacccaggagcucagggccagcugcaggcagaguuugcuggucaugauggugggguggugaaggggauugcagauggugagguagcggucaaaagacaugauagugaggaucaagaacucgguggugcccacgaagaaguggaagaaggccugcagcaggcagcaggacaugcagauuacuguucuugccacuacaaagguuccuagcaguuuggggaugacuguggugguguaccagauuucuaagaaagacaaguuacaaaggaagaaguacauuggaauuuguagccugggcucagcccacacaguggcaauaauaagcccauugccugcaaggguuaauauguaggugagaaagauugcaauaaagagagguguuuguaggccuuggauaacaggaaagccuagcaggaugaauucugugauuacugugccauuucucaugucccuugauacccuagaaagacaagcaagaaagcucc

SEQ ID NO: 15938 - RNA, 17332 nt, Homo sapiens
gcaaaggccccacguguuccgacccgcuaggccccgcgcggcucggauccggcggcgcuguuucggucgggagugggugggagagaagccggggcaggggaggagccgccggagcugucggagccgugaguccugagugggcugggcugggccgggccgggcuggaccgggccggaccagaucgggcagagccgggcagggcggggaggagggggagggaccggagaccccgccccccagagucuggggaaaucgccguguccuggggaagggguggcggcgguguacugagggugccgagacguuguggucucuguguuuccugguggccggagccaguaucuccggggacacggauggcgcucccggcuuccuuuccuuuccagccaccgcccuccgcccccuccuggggccugcagaaauguaguuaguccguaccucguaccuccuaacgcuuccgcgccaacuguccccccggaaccgagggaggaguggucuaggccccuuuauuuuccgcagcuuuuucuuaccccuccucucagauugcuuaagaucaucuccgcgggcuccuugccccggcuagccccaucuccuuacaccaccaagccccccucagccccccagcacacacccagauacacucacccgugaucuugucaccugugaugauaguaguccuuggcguccauuuggccagaggcuuuucagcugccacugugacagacccugagguccccucaagccaguagcugcugucuccacuugcaacuuuccucuccucccacuccuaacagccaguuuuggcaccucuucucagcaccugcguuacuuuuagcaggaguauaccuacuucuugagugucuugauuaaaaauuuguuuuugugccauggauaggcuguguuccuucagaaaggugucagucuaauuuuuguuuuucugaacaaugaauguucucaucuucuaggcgcuuugauaacccugucugccuuggaaucuguacugaccuccccagagggagacucuuagacccagccuuucuugaacaaccuugguccuggggagcagcgcuagaucccaggcucucaauuagaggcugggcuuagaacuguugcuuuuucucuauccacgcucugcaggugacacccagggcagcuacacucagaagccacaaggaaugcuaguggagccccucaucccucccagcuucucuuccaagcugccccguggggcuugauccaggaagcuacuucagaaagguugugggauagccuugggaggagguuuguuggugggaagcgugugaacgcggagcagucugggauaacuuucugcuguuacuaucuagcauaagagggugggcaggguuggagagaggacaggaauuuuuccuccuaggaccaaacgccugggauucauaaucuuucacccuuucuccuccagcuauacccuuuuuguacucuguguauauacuauauugcaguagacaaucauuccaaggguacaacaagguuuaccacaaugugagggacucagccauugcaaauuguacagaugagguaaguuacagguuuacauuuuuuuuucccaguaaauuuggcacagauuuaaaaugugaaacaguucuauaccccuuguuuuugcuguucucucaccagcaaacccuuuaguuuggccagcaauggcuuucugcaugaacuucagauuuacuucauuugcuagguggugguucucaaacuuacuauaagcaccugaagggcuaguuaaacgcauauugcuggggcccaccccuagaguuucugguaauaggucugugcuggggcuugagaauuuguacuucuaacaaggcucagguacugaugcugcagaucuggguucuucacuuugagaacaacuaccuuuuggccaaaugugauauauguauugcaguagguugagguucagaauaccuuuguuugaguacuucuguguuggaaacuaguaaucugaucuuuuauagauaaucacuuaggucugaauauuuuguucgcaaaauuaagaaagcguacuuaaaacaacugaaugcuauaugccaaauuugaggugaaauauugauaaguucuuccccuugauuuucuuaauucucuugauaggggcuucacguuuugaucaaaauauuacaccuguauucugggcuuuugcugugaauuccuaguauugcuaaaauucugcaauuucuuaacuaccuguuaaguuccucaaggucagagcuucugcuuuuuuuaucuuucuuugcccagcaccuugaauagugugggacacguaauugacgcucaguagauauuuguguauugaacuccaucccuuguccuccuccccucuugauguuuuucucuacuggccuuaugcuacacaguaaagcagggcaugauuaugccacuugauuacccccaagagauuggaauaaaugcuuaugccaaauuccuacagcuaucccugugaaugguuuauuacccaggagcccugacacuggcugauuucugaauuuucagugcuucuguaauauauacuaguugggggaggagaaauagaaagcuuaaacucaaugugcguuuauugaauaccuuuucuacuaagggcuccacaaagugguaggcacugggaauauaaaaaugaauaaggagacccuugcucucgagggcagggcccacaguggggagacagacguuaagccaugcccacgacaagaaugacuucugagauuccuucucuggaucaugauuuagucuucaguggaaaccugguacuccucagauuccucugguucaacaggcggggaucccaucccuuaucaucuccucaaaugcuaaaggacccuugagcaaagccaggaggaagucaucuagacgugaaacagggaguauccacacaggcuguguuaaugacaaagcuaaaaacauaguaaaugacuuuugaauuuacugcuguuaugaauuaucuauagcaacaccuccggucagcucuguuauauauguuauugcguuauuucccauuaaaugaugguuccucugacuaucugauuggcauugacuauguuuguuguagagauugcauacaucuaguuuaacucuggcugucaaaugagagcaguuacucuuaucaggaugggugucagguuugauguccccuccuuuuccugcuucagguuaauuugucauguucuguuuuaaacugagacauauagcuugaccuccuuuauuuaggccauuaacugcucugggguaguuuuccugaagguuaaaaagccuagcuucaugauggagguuaaccaacaugaccaugauggccagguguauaaaucuggccucuuaaaaaucuguauuugaggcugggugcaguggcucacaccuguaauccuaacacuuugggaggccaaagcuggcagaucacuugagcccagguauuugagaccagccugggcaacauggcaagaccccuucucuauaaaaaauuuaaacauuagcugggcaugguggcaugugcuguagucccagauacuuaggaggcuggggugggaggauggccugaaccugggaggcagagauugcagugaguugugaucuugccacugcacuccagucuuagcaacagaguaaacccuaucucaaaacuuaaaaaucuguguuuggccccuagccguccucagcucuugaguaaaucucagcauccuaggcuguuacauuauggcccaaauauucaauagagaugcuguauauccuuguuccucucaaaaccccuccucaucaccaucaaaaagcugguucaguucucuaccuuuagauaaagaaucaucccaagacucaacaugagcugccgugacuuguccaagaugacaccucuuuacaauguagagcaguggacagaacacaggucacccuccgccgaaggcaacuaucuacugucuaacauugccuccuaggccugccauauauaaccaucaaaaacaguuuagaauaaagugaauuguuacaauuuuuauuuuucauuuuuguguuuacauuuacucucaaugacauguuuauucccaccuaauaucuugaggcuaaccacaaaaucugcagcauuuccagacagaagauacuugugacuucccuguacuauccacuacauacuugaccucuuucucuuucuuccugucuucccuuucucuauaccuuauugucuuucuuuggaaccucuuguaacaaauuuugagccauuucuccccucacuacucaaauaucacuuuuaugaaggggcgggggggaaacuuagguggcaaaaauauuuuacagaaacaguuuuaaacauguuuugaagcauacuggucacguguuagaaggccaaaagccagggaauucauucccuuucauucauugugcugucuagguuaaguuuucacaggacuucuugguacacugaguuugccucagauugucuccugccaguuacagggaguggagaggacuuugauauauugguaauuagaagcauugcugauauggucuucggugggagaaccugugucuaagguuccuucucaucuguauuccaacacuuucauuuaauccuacuucauaagugccuccaaagcaaggauuuuuuuuuugguuuagcaugguuucuuugauauaacaauagaccgaccaagauuuuccuuaugccaucuguuuuuuuguaauuaugaugcaauagagaacuguuugcuuguuuaucauuuaaaucuugccuucuucccaaaacgauuucaaauagcuugaaggaaaaugaauaaaauauauugagcaccuacccuaugccagacucuauacugaaggguuucuauagguuauuucauuuacuccuuaaaacaaccacaugagauaaguaguauuagccacauuuuugaggauaagacugaggcuuagggaaauuguguuacaaggcuaauaagcgaggucagggauucgaggucagggauucaaacccagcgugccaaggccacuaaccauuauguggaaagcuuagguaagcgcuuguauauaggacaaucaagaauaaaagaauauguccauuagaaggauuguacugggcuaaucuuucguuuuaaagaacagcagcagcauuggaaaagagcgguuaacaguuuuuauuagccaauuucuauucuagaacacugagaggagcuguugacaggcccugguuagccccagcaaguaguuguauuaaaauuaccaaacuauaggccugcauuaagguauaaaauaagaauggggacuggaagggauauaaauaucugcuaaauauaauaauuucaguucuaaucacuauuuucuucugaagauuauuugccaguacauaggcagaucacugucucuccuuuagguugaugguauaugacuacagacuuugucauuuaggguccagaaagaucacccuagcuaguagcguuuuaagguagagaacuagauauuguuucauugccugugguuuucuguucuuguaagagaauugagcuugggucuucacugccacgugacaccuucagauaaggggcagagacagcuggccugaggauuguacagaggucuuaccuugauagcuccucuccaauccuaugcauccuaggaacacucaagacacuagguuguaucuuugcagauacuguuuuagugucuucuggaaccaagucucuuacuuaauccuggccugguuucauauucucucuauuguauucucucuauaguuuuugucuuacucuggaacucuuccaaggacagacauugaagaaagguauuagaauagcaaaggcaacaaauugcaagguauacuuauggcauagcacaucccauuaauuauagaauaaaaacacaacaucuguuuucugccucuaauauuaaaucuugacauuugcacaacacauuuuaguucauaaagcucucauaucucagauaaucacugaguuaggagacugguuaucugcagagggcuuuauccuuuacaagggcucuuggguacguuacuucacgaaacccucagggaagcuccaguuucuuggggaucuggggccggggcauaugucuuuggauacccaguuuggugcugugcacagcacugcuguaccuccuauucauuucccaucucuuaccccacaaagacuccuuccuucauuccuucuauugcugaucuguuuuccuucaucuuccuaggcugccaaaguaaaugcaaaacaagcaccagaaaucucagcuugugauuucugaagggcauuuuuaaauggcaaguuugguguggcacuguuacauguucuuuuuucuuuggagagcaaagcccuuugagagagcaggaacucuucugucaaugcauacguuguaggauccauacuguggaaucucuuguaccuagugcugcgugaaaacaaugaggauuccaagucuacuucacuggacgucgguucucaaacuuuuaagauacuagaaguccuuuuauuaagccaaaagacccuauguauuaauucugucuuccagggguaggaguuggggugggguuuggaaagcuuugucuggauaaauaauuaguauuguaguuccauuuauuugaugucugauuuugcgcuuauuaaaauugauuuaaauccucaauggaaaaugauuuuuuuuuuuucaaaugccaaguguugugugacuugcauuuggauuauucccggugcaaccugaagauuccuugugaugaguugugguuccaucaucuugggaaccacuaagagaauucuguuuuacucacaauccaaacaauaaauguuuuuuucccuauguaugccuuuauccagcacacaguuugcuagacuuauggaugaauauggguuaauauaacaugguaucuauccuucuggaaacagacuuuuaaaaccuuacuaagcauucucugcauucaucaaaugugaagugagugccuggugugugccaggcaucgagcugggcacagcauaucccugcccucagagcuuuacaguccagugaguucaacagaagaugaacaguuuugaugacacaaaaaauagacacaugugcaugcugugauagggggagauacaaguuccuguggaagcaucaucugggaggaccagggaaggcaucuuggaaaaacugagcucugaaagauggauagaguuaaccacaugaagaguggagaaggguacuucagacaaggugaacagcaucaggaaagcccagggaggguauagaaaagaaagaacaguaauucuugcaguggcuuucaaugggaguggcagucauggaaggaaggagagguagcagggaccagcuuuugaaggucuuuguguaucacauuuuaagaaguuuaaauuuuaaccuaaggucacugggaagccauuggcagauuuuguauguuaggaaguucaccacucaccuacuuggaguauugcagguggagcuaauguggaugggccuccugcccauuauuaaauccuguuccugucaggaacaggacagcccaugcugucucucccugugugucugucucucccugugugucugucucucucucucucucugucucucucucucaaaagcuaaaggaaagcgcauagguuccagaaggaaaaagaaauaaccacuagaaaaauaaguauaagcugacuuuaccauggcgcagugagauuccaaaccaaaauaagguuucuagggauugagcuuuuaauacugguacuccaacagggagauaggacuugggaagcugacgcugugugaaaguuacagaauuaagcagccugcaaaccuggaccuuugaaaaucguccuacugacccaggaaaagugcaaggaaguggguucuccagaaccuuggguaggccaaacauuacuugaaggcaucgaucuaaauaauacacaaaagcauuauucaggaacacccugagaaauuaacauaaaaacugauuuggccaggcaugguggcucagccucugguaacagugcuuugggaggccaagguuggaaaaucacuugaggccaggagauccaggcuguagugagcuaugauuguacuacugcacuccagccugggcaacagagggagagucuuaaaaaagcaaacuguccaagaucauugaaaccauuagcacuuaggaagaaacaaaugaaauuacauucaaggggcucacauuuaaauccagggcucucaggacucccaaaguaaaaagauggacauaaaauaaaaaaauuacaagccacuugagaaaaaaauaaaucaccaugagguagagauagcagaggaaaaauuacacaugaagaucuaggaauuagggagcuauccaagauagacugugaaaguauguugcaagugacugaggguaaugaaaaaaaugucauaagagcaugaauuagaagcguuuugagaaagaaugaagauaaugugaucauugacuguaaacucauuugaugggcaacaauagaugagacacagcuauuaagaguggaucgauaaccuugaauguggaugugaggcaacuguaguauagcacaaaaagguugagaaaugauggagcccuuaagcugcuuguggacacuggucuggagggggacaggaccaagaaaaccagucauggagguugaacuaagucaucucuccaauguauccgugccuguuacgugccagugccguuuaggagcagaggauauuguaauuuuuuuuaaaguuccuaugaauaccuucuagugggucauaauggcucaaccgggaaauggcaguagagaugaagagauggauggauucgaaagacauuuuuuggaaguuggaauuaacaggauauggugaauaaucaagagauaguaaaagcauaauggaggaaacaaugguucuuccuguuaccauaggaagaagcuuuggaguagaguuuuauucauuuuaaaugcauuuauugugcacuuuauuauagguauuggagauugauggaaaauagucucugaccucaaagaguuucacaggaaagaugagcgauggcuauguaauaugaccaauacugggauagagaggugcccaggucacuacgggaggacuuaggugauuucuaacuaugucugagaguaggggaaaugggaucaaagaaaacaucucagaagacaugaagcuugagcuuaugucuugaaaaauuuaaaguuuaaccuaaccaaggauaaagaaucagaagaaacagcauauucaaaagcuaaagaacacgggacucuugugugcuuugcauguacacacgugugugcgugugugucugaaaggauuggagaggagggcgaagagaauaacaagaugaacgucaaccuaauguagaauguuugaaguuuguauuucacuuaacaagacagcggggagugauggaaggaucuuagauaggaaagggacaugagcacguuugccaagagagcucguucugaucauaguggguacgugaaggugacaaaucuggaggcagauagcucacauuuggaggcaguugcagucauccagaugagaagugagagggaccuaagcuguaaauugugggaauaaagacaagacccguuaaaaagaaagagaacacaccauguagcguggaaaggagaaggguggagaguagccugugcagaaggaacaaccuucaaaaagacauggaagacugaaaagacacccuguuguagggagaucagcaaugcauuuuuuauaaccaggugauacagggaaaagguaggaucugaagcuugaaaaauagauugggggcugauuguaaagagcuucgugucauucccaggauuuuggaacugauuuuacuaacaugaaaaagguuuuguuuuaaaauacugaguaauauaguuggaacuauaauuuagaaagauaauagcuggugccaucacucuucuaagcaaagauaguaauacauuuaaugcucauaggcuuuaguaauacauuuaauccuuacaguaagccuauuagauaaaaaccauuauuaucucccuucuauagacagagaaacuggcauuaggagaaugagaacuugccuauggucccacucuggaaauaccuaguaagcgacagagccaggauucaaacccaggcagcuugacuccagaacuuucgcucauaaccuuacacaucucccucaugguugguguuucucaaccauggauacacauucgaacugcaaguagcaucucuaaacauacaguuaccugaauugacugaaucagagugucugaaaaaugaugugugauacuauguuuugcaaaaucuccacagguaauucuguuguacuuugcuuauaguugaguacugcagggaucuuaggaaguuagagcaguaguccaggcaggagaugaugaaggcucaaacuaaagcagucuguaggaaggaagagaagggaaccgguuuggagacuuaagcgggggaauuggcaguauuugugaaguggaaaugcaguauuuucuugcagaguaugaaccuugccuaggaaagggaguagaggaccauaccuuuaguuguaaauuauccucucccaacuggaucuguugauuuauggcuauggugguuggggaaaagaggauuuaaccauuugaagaaguuuguguagaggauuaugauugaacucaggcuguuguccuuguguauaguuucaugcuuauacucuuguuugucuuuacuucucuauccagggcccuuggaagaaaauccucgcuguguccaggcugaggcggggggcuaaugacagugugagcucuagauggugugagaccaccccaaagccaagaaauggcuacagccguggaaccagaggaccaggaucuuugggaagaagagggaauucugauggugaaacuggaagaugauuucaccugucggccagagucugucuuacagagggaugacccggugcuggaaaccucccaccagaacuuccgacgcuuccgcuaccaggaggcagcaagcccuagagaagcucucaucagacuccgagaacuuugucaccaguggcugagaccagagaggcggacaaaggagcagauccuagagcugcuugugcuggaacaauuucuuaccguccuaccuggagaacuacagagcugggugcggggccaacggccagaaaguggcgaggaggcagugacgcugguggaggguuugcagaaacaacccaggagaccaaggcggugggugaggagggggaguccugaucugugugauguggagggggacuauuugcuggaaggcuggauuugcggggagagcuugcaggauccccauaaauuauuagugggcucugcccuuggguugcucauauaccaugagccccauggauuagggggauguguguguaugaaugugacuuucuggauauuggaacaccuguauagggaccaucugaggggucucagccaccaaagggucauggcuuugguuuucccuucuuugaauguugagccguggguuccuggagaggagaauuuugugacuuccucgaagguucucauagauccccagucacagaucccccuuccuggcuggucagcuagggaagcaggcagcaaggagagcugcaggugggacagguggagaugggaaggaaccuugggugacaggggcccaggcuggggguggugagagagcagugcaggccugcgcauccccugccuuguccuggggaggauaaccuucagcuccuccuugccugcuccauugaaacuggaguuuccccuccuugucugggucccucugggaguguuuucucuaggcaucuucuccuaaaauaagcucccgugacaaccaagaacuuccuccugacuccauggugacuggaaguuggaauuauucccaggugacuguccauguucacggccaggaaguccugucagaggagacggugcauuuaggaguggagccugagucaccuaaugagcugcaggauccugugcaaagcucgacccccgagcagucuccugaggaaaccacacagagcccagaucugggggcaccggcagagcagcguccacaccaggaagaggagcuccagacccugcaggagagcggugggaagcaucagcagaaaggggggauuguggcagaaggcaggcaaggagggggacauuucucggacauuucuccuauaccaaggaagcuggguagauagacuguauggaaagacaucacagaauccaggaugucaagaggagacaguaccgccagcuagagucccccauaaacagggccaagcuuagacagcagauuguugcuuguucucuuggcauucugauagucucauaggugaugggauugggauaugggagcuacccuuaggccaguuucuugguucccauaauagaaaggauagggccaccuuccuaccaaagauggugggggaugcccagauuuuugcccauuauuggggcaugcugcauauuacugaucuuugccuucuuuucuucauagaggucccagugcccgaggacccagaccuuccugcagagaggagcucuggagacucagagaugguugcucuucuuacugcucugucacaggugugcccuaguuaccucuguaccacagagaauuuguuugaagaaccacugggcauaagccauacuaaacaggugaagcaggaugcacauuuacacucuugccaguuuuaagcucacaguucugcagguaccuggaaggggaggagauaaugagauaaauuaucauaccuuauauuggauccacaggcaccaacaccaguuuauuugccauugacuagaagaacuaacaaaaugggauuauuuuguaacacuccaguacaacugcgaaguugucaaaugaggguuuuuuaguuuuuuuuuuuuuuaaaggaauaaauuugauagucauuuguaaguaugacagacuguacugcugagacauuuaggaaguauucaccaugaucaaagcucugaaacuaagccauguggcuggagaaaaagaaauagaauucauguaugguuuuagauuguaaucuaacugaggaaaaaagucuuguuuuggcuauagaguauagaaacuauugaaagugauuagagucuuuagggaaaguguacuagaaaagaugaauuuugcagaaauguauauagcguuaaagugucaaguagggagcugaaugaugauuuuuaagaccuuuccuaaauuuuaaacaauaccuuaaagaagaagaacauaagcugguccucaggaaaagugguggaguuggagggggcagggccagugccacaggggacacauggcucccccgagaaugaguuuaagcagcccgccacucaagcuccuuucaucuccuagaggaguccaccuauuguaugaccuucaacagggacaaaauacgaggcuacccguagcaucacguuuugaugaaauccuuaugugguuucagggacugguaacguucaaggauguggccguaugcuuuucccaggaccaguggagugaucuggacccaacacagaaagaguucuauggagaauaugucuuggaagaagacuguggaauuguugucucucuguguaaggaauuucaaguauucuagaguguucuaagcccagagaucuuuuuccugcuggaaauuuugggggaucuuagaccuuagauuguaugcagugaacuucucuuaugccuuccccaccaauaaaauugagggauuaggugaaaaauaugguguccuuucaaguaaaagauaaauggauggaaauggaaaccucuaauaggaaaacaaacuuguaauaugacagcuuuagugcagaaauauuugaaguaagcacaugaguuuuaaaacaguaagaguuggagauaaucuuucuugaauaugggaaaagaggauaagguguacaaugguauaauuauuaaguugcaggugaaaaccacaagaaaggcaagagauacgcaguccuugguuaaaaguacacaaacuaaagagaugaaagauuucaucaccugagcuagcuauguauuugccccacaaccuaccaaauagaaaaggaccgcucuuaacacagggaauuguugagccaaucgugauauccuauuuucccucucuugagcagcauuuccaauccccagaccugaugagaucucccagguuagagaggaagagccuugggucccagauauccaagagccucaggagacucaagagccagaaauccugaguuuuaccuacacaggugaggaaugacaaaaacgguguuacccacccugagccagcaguuccucuaggcagugcuucucucucucuguagggccccgcucucaucaguucuucuaacaugucagccaguacugcuuucucccucugacagccauuucuucugucauugcccuccucuuuucuccucccaucauuugucugauagcaauguaauacaaaagggugaaagaaaaauguuaacuuuuggaauugcagcuauaccauuuacuguacaauucccuuaaacccucgauucucaaucucugcauuuguaaaaugaagauuauauuugugcauaccaagguuuguugauagcauaacaauaugagaaagugcuuggcacaggacaggcauucuauuuagucuugccaucucaaaacccuuuguaaaaaucuccccauuguguagaaggcauuguugccgcuacagugacccccuuuuuccucucacccuuucuacaggagauaggaguaaagaugaggaagagugucuggagcaggaagaucugaguuuggaggauauacacaggccuguuuugggagaaccagaaauucaccagacuccagauugggaaauagucuuugaggacaauccagguagacuuaaugaaagaagauuugguacuaauauuucucaagugaauaguuuugugaaccuucgggaaacuacacccguccacccccuguuagggaggcaucaugacuguucuguguguggaaagagcuucacuuguaacucccaccuuguuagacaccugaggacucacacaggagagaaacccuauaaauguauggaauguggaaaaaguuacacacgaagcucacaucuugccaggcaccaaaagguucacaagaugaacgcgccuuacaaauauccccuaaaccggaagaauuuggaagagaccuccccugugacacaggcugagagaacuccaucaguggagaaacccuauagaugugaugauugcggaaagcacuuccgcuggacuucagaccuugucagacaucagaggacacauacuggagaaaaacccuucuuuuguacuauuuguggcaaaagcuucagccagaaaucuguguuaacaacacaccaaagaauccaccugggaggcaaacccuacuuguguggagaguguggugaggacuucagugaacacaggcgguaccuggcgcaccggaagacgcacgcugcugaggaacucuaccucugcagcgagugcgggcgcugcuucacccacagcgcagcguucgccaagcacuugagaggacacgccucagugaggcccugccgaugcaacgaaugugggaagagcuucagucgcagggaccaccucgucaggcaucagagaacacacacuggggagaaaccauucacgugcccuaccuguggaaaaagcuucagcagaggauaucacuuaauuaggcaucagaggacccacucagaaaagaccuccuagcuagguccccaugugaggagaucugcuuucagcccucaccuaagggaggugaggaagaggaaaagcccucuugucagccugggaagaccuuuucgagggagucucccugaccugcucagaucugacauuaccucuuccugcaacuaaacacgagccugggcagaaccucucagccuuccucuacgccuugaggggauguuucauccaaaguacaaccugaauugaggcuucuccuucacuggagugcaccugccucuaccucauggguauaaaguaggagaacuaagagacuuaagaggucgugguuccuauaucguccaaaaaauaggcuguuacauauccuaaagacugcucaacagcuucaaguugaaaguggccaaggacagccccuuagguuugggaagggacgagccugaaggauucugucuuuacuggggucaaaucuuaaagcacacagcucuggacucaagacaggagguuugcguccugauggcuuugccacacauucacaggauaacugcauagaucccucgcugucugauucacuucuuaccaugcacuuuccuuugaugcugaggagaaauggaagugggcgaaaaaucucaaggcugcuucauguggaccuugucaagcugcucccucccccagcgucaaauuguuaucaggugccaaacacugcuagaaaggagggccuagucagaagccucuuuccauacgaguuuugguuuuguuuuuaauauuuuuuucuauuaaaauacucaugcauuuaaccuucccguuauucaaccagucucuugguugcaucccuagcacuucuacuacaagugagaugguaguguuugagugcuuauugaguaaagcauaauucggucauaaugaaaucguucacauucccucauaugcacaagcccaccaaccccuucacaccccccuucacaggggucguaugaguaaggggauuuggaaacugucaacuuacaaaggcacuauaacaauuacagaaucaugauugccaugggccacuuuauuuacaugaagacaacuggagaacgacuaagaccaaauuauggaaaauaagaaaaagcuguugcuggcaagaccaucaagacuguucugacacccuguccccaucaucccugacugaguacucugacaucacggaaaguguugaaccugggacccugaggaauucaccaggaguaaauggcuuucauguauuuguguuguuugcuuuuucuuacgugauuuuauguucauagagcuagaaaguagcaucucaugauggcccaacaaucucuguugccaguuaaagguuccuuggagaugaggcugaauaauuaugaaccucaccuucucugauugugggaguggcaagaacuggggagacguccuccauaaguggagcacaggguaugggguuaaagcaugacagggagagucuucugugccugguuucuucuccucuaucucauaaugcauuaugggcccgaggaauaggggaggguuaauaagacuccaacccuaauggcccaacagggaaauucucauuuuggucgaugauauucugauggacugguuuggucuuaauaccagucaaccguuguccuucuggaaauauacauauaugaaauaaauaaagguaacacuugcagcca

SEQ ID NO: 15939 - RNA, 17332 nt, Homo sapiens
uggcugcaaguguuaccuuuauuuauuucauauauguauauuuccagaaggacaacgguugacugguauuaagaccaaaccaguccaucagaauaucaucgaccaaaaugagaauuucccuguugggccauuaggguuggagucuuauuaacccuccccuauuccucgggcccauaaugcauuaugagauagaggagaagaaaccaggcacagaagacucucccugucaugcuuuaaccccauacccugugcuccacuuauggaggacgucuccccaguucuugccacucccacaaucagagaaggugagguucauaauuauucagccucaucuccaaggaaccuuuaacuggcaacagagauuguugggccaucaugagaugcuacuuucuagcucuaugaacauaaaaucacguaagaaaaagcaaacaacacaaauacaugaaagccauuuacuccuggugaauuccucagggucccagguucaacacuuuccgugaugucagaguacucagucagggaugauggggacagggugucagaacagucuugauggucuugccagcaacagcuuuuucuuauuuuccauaauuuggucuuagucguucuccaguugucuucauguaaauaaaguggcccauggcaaucaugauucuguaauuguuauagugccuuuguaaguugacaguuuccaaauccccuuacucauacgaccccugugaaggggggugugaagggguuggugggcuugugcauaugagggaaugugaacgauuucauuaugaccgaauuaugcuuuacucaauaagcacucaaacacuaccaucucacuuguaguagaagugcuagggaugcaaccaagagacugguugaauaacgggaagguuaaaugcaugaguauuuuaauagaaaaaaauauuaaaaacaaaaccaaaacucguauggaaagaggcuucugacuaggcccuccuuucuagcaguguuuggcaccugauaacaauuugacgcugggggagggagcagcuugacaagguccacaugaagcagccuugagauuuuucgcccacuuccauuucuccucagcaucaaaggaaagugcaugguaagaagugaaucagacagcgagggaucuaugcaguuauccugugaauguguggcaaagccaucaggacgcaaaccuccugucuugaguccagagcugugugcuuuaagauuugaccccaguaaagacagaauccuucaggcucgucccuucccaaaccuaaggggcuguccuuggccacuuucaacuugaagcuguugagcagucuuuaggauauguaacagccuauuuuuuggacgauauaggaaccacgaccucuuaagucucuuaguucuccuacuuuauacccaugagguagaggcaggugcacuccagugaaggagaagccucaauucagguuguacuuuggaugaaacauccccucaaggcguagaggaaggcugagagguucugcccaggcucguguuuaguugcaggaagagguaaugucagaucugagcaggucagggagacucccucgaaaaggucuucccaggcugacaagagggcuuuuccucuuccucaccucccuuaggugagggcugaaagcagaucuccucacauggggaccuagcuaggaggucuuuucugaguggguccucugaugccuaauuaagugauauccucugcugaagcuuuuuccacagguagggcacgugaaugguuucuccccaguguguguucucugaugccugacgagguggucccugcgacugaagcucuucccacauucguugcaucggcagggccucacugaggcguguccucucaagugcuuggcgaacgcugcgcugugggugaagcagcgcccgcacucgcugcagagguagaguuccucagcagcgugcgucuuccggugcgccagguaccgccuguguucacugaaguccucaccacacucuccacacaaguaggguuugccucccagguggauucuuugguguguuguuaacacagauuucuggcugaagcuuuugccacaaauaguacaaaagaaggguuuuucuccaguauguguccucugaugucugacaaggucugaaguccagcggaagugcuuuccgcaaucaucacaucuauaggguuucuccacugauggaguucucucagccugugucacaggggaggucucuuccaaauucuuccgguuuaggggauauuuguaaggcgcguucaucuugugaaccuuuuggugccuggcaagaugugagcuucguguguaacuuuuuccacauuccauacauuuauaggguuucucuccugugugaguccucaggugucuaacaaggugggaguuacaagugaagcucuuuccacacacagaacagucaugaugccucccuaacaggggguggacggguguaguuucccgaagguucacaaaacuauucacuugagaaauauuaguaccaaaucuucuuucauuaagucuaccuggauuguccucaaagacuauuucccaaucuggagucuggugaauuucugguucucccaaaacaggccuguguauauccuccaaacucagaucuuccugcuccagacacucuuccucaucuuuacuccuaucuccuguagaaagggugagaggaaaaagggggucacuguagcggcaacaaugccuucuacacaauggggagauuuuuacaaaggguuuugagauggcaagacuaaauagaaugccuguccugugccaagcacuuucucauauuguuaugcuaucaacaaaccuugguaugcacaaauauaaucuucauuuuacaaaugcagagauugagaaucgaggguuuaagggaauuguacaguaaaugguauagcugcaauuccaaaaguuaacauuuuucuuucacccuuuuguauuacauugcuaucagacaaaugaugggaggagaaaagaggagggcaaugacagaagaaauggcugucagagggagaaagcaguacuggcugacauguuagaagaacugaugagagcggggcccuacagagagagagaagcacugccuagaggaacugcuggcucaggguggguaacaccguuuuugucauuccucaccuguguagguaaaacucaggauuucuggcucuugagucuccugaggcucuuggauaucugggacccaaggcucuuccucucuaaccugggagaucucaucaggucuggggauuggaaaugcugcucaagagagggaaaauaggauaucacgauuggcucaacaauucccuguguuaagagcgguccuuuucuauuugguagguuguggggcaaauacauagcuagcucaggugaugaaaucuuucaucucuuuaguuuguguacuuuuaaccaaggacugcguaucucuugccuuucuugugguuuucaccugcaacuuaauaauuauaccauuguacaccuuauccucuuuucccauauucaagaaagauuaucuccaacucuuacuguuuuaaaacucaugugcuuacuucaaauauuucugcacuaaagcugucauauuacaaguuuguuuuccuauuagagguuuccauuuccauccauuuaucuuuuacuugaaaggacaccauauuuuucaccuaaucccucaauuuuauugguggggaaggcauaagagaaguucacugcauacaaucuaaggucuaagaucccccaaaauuuccagcaggaaaaagaucucugggcuuagaacacucuagaauacuugaaauuccuuacacagagagacaacaauuccacagucuucuuccaagacauauucuccauagaacucuuucuguguuggguccagaucacuccacugguccugggaaaagcauacggccacauccuugaacguuaccagucccugaaaccacauaaggauuucaucaaaacgugaugcuacggguagccucguauuuugucccuguugaaggucauacaauagguggacuccucuaggagaugaaaggagcuugaguggcgggcugcuuaaacucauucucgggggagccauguguccccuguggcacuggcccugcccccuccaacuccaccacuuuuccugaggaccagcuuauguucuucuucuuuaagguauuguuuaaaauuuaggaaaggucuuaaaaaucaucauucagcucccuacuugacacuuuaacgcuauauacauuucugcaaaauucaucuuuucuaguacacuuucccuaaagacucuaaucacuuucaauaguuucuauacucuauagccaaaacaagacuuuuuuccucaguuagauuacaaucuaaaaccauacaugaauucuauuucuuuuucuccagccacauggcuuaguuucagagcuuugaucauggugaauacuuccuaaaugucucagcaguacagucugucauacuuacaaaugacuaucaaauuuauuccuuuaaaaaaaaaaaaaacuaaaaaacccucauuugacaacuucgcaguuguacuggaguguuacaaaauaaucccauuuuguuaguucuucuagucaauggcaaauaaacugguguuggugccuguggauccaauauaagguaugauaauuuaucucauuaucuccuccccuuccagguaccugcagaacugugagcuuaaaacuggcaagaguguaaaugugcauccugcuucaccuguuuaguauggcuuaugcccagugguucuucaaacaaauucucugugguacagagguaacuagggcacaccugugacagagcaguaagaagagcaaccaucucugagucuccagagcuccucucugcaggaaggucuggguccucgggcacugggaccucuaugaagaaaagaaggcaaagaucaguaauaugcagcaugccccaauaaugggcaaaaaucugggcaucccccaccaucuuugguaggaagguggcccuauccuuucuauuaugggaaccaagaaacuggccuaaggguagcucccauaucccaaucccaucaccuaugagacuaucagaaugccaagagaacaagcaacaaucugcugucuaagcuuggcccuguuuaugggggacucuagcuggcgguacugucuccucuugacauccuggauucugugaugucuuuccauacagucuaucuacccagcuuccuugguauaggagaaauguccgagaaaugucccccuccuugccugccuucugccacaauccccccuuucugcugaugcuucccaccgcucuccugcagggucuggagcuccucuuccugguguggacgcugcucugccggugcccccagaucugggcucugugugguuuccucaggagacugcucgggggucgagcuuugcacaggauccugcagcucauuaggugacucaggcuccacuccuaaaugcaccgucuccucugacaggacuuccuggccgugaacauggacagucaccugggaauaauuccaacuuccagucaccauggagucaggaggaaguucuugguugucacgggagcuuauuuuaggagaagaugccuagagaaaacacucccagagggacccagacaaggaggggaaacuccaguuucaauggagcaggcaaggaggagcugaagguuauccuccccaggacaaggcaggggaugcgcaggccugcacugcucucucaccacccccagccugggccccugucacccaagguuccuucccaucuccaccugucccaccugcagcucuccuugcugccugcuucccuagcugaccagccaggaagggggaucugugacuggggaucuaugagaaccuucgaggaagucacaaaauucuccucuccaggaacccacggcucaacauucaaagaagggaaaaccaaagccaugacccuuugguggcugagaccccucagauggucccuauacagguguuccaauauccagaaagucacauucauacacacacaucccccuaauccauggggcucaugguauaugagcaacccaagggcagagcccacuaauaauuuauggggauccugcaagcucuccccgcaaauccagccuuccagcaaauagucccccuccacaucacacagaucaggacucccccuccucacccaccgccuuggucuccuggguuguuucugcaaacccuccaccagcgucacugccuccucgccacuuucuggccguuggccccgcacccagcucuguaguucuccagguaggacgguaagaaauuguuccagcacaagcagcucuaggaucugcuccuuuguccgccucucuggucucagccacuggugacaaaguucucggagucugaugagagcuucucuagggcuugcugccuccugguagcggaagcgucggaaguucuggugggagguuuccagcaccgggucaucccucuguaagacagacucuggccgacaggugaaaucaucuuccaguuucaccaucagaauucccucuucuucccaaagauccugguccucugguuccacggcuguagccauuucuuggcuuugggguggucucacaccaucuagagcucacacugucauuagccccccgccucagccuggacacagcgaggauuuucuuccaagggcccuggauagagaaguaaagacaaacaagaguauaagcaugaaacuauacacaaggacaacagccugaguucaaucauaauccucuacacaaacuucuucaaaugguuaaauccucuuuuccccaaccaccauagccauaaaucaacagauccaguugggagaggauaauuuacaacuaaagguaugguccucuacucccuuuccuaggcaagguucauacucugcaagaaaauacugcauuuccacuucacaaauacugccaauucccccgcuuaagucuccaaaccgguucccuucucuuccuuccuacagacugcuuuaguuugagccuucaucaucuccugccuggacuacugcucuaacuuccuaagaucccugcaguacucaacuauaagcaaaguacaacagaauuaccuguggagauuuugcaaaacauaguaucacacaucauuuuucagacacucugauucagucaauucagguaacuguauguuuagagaugcuacuugcaguucgaauguguauccaugguugagaaacaccaaccaugagggagauguguaagguuaugagcgaaaguucuggagucaagcugccuggguuugaauccuggcucugucgcuuacuagguauuuccagagugggaccauaggcaaguucucauucuccuaaugccaguuucucugucuauagaagggagauaauaaugguuuuuaucuaauaggcuuacuguaaggauuaaauguauuacuaaagccuaugagcauuaaauguauuacuaucuuugcuuagaagagugauggcaccagcuauuaucuuucuaaauuauaguuccaacuauauuacucaguauuuuaaaacaaaaccuuuuucauguuaguaaaaucaguuccaaaauccugggaaugacacgaagcucuuuacaaucagcccccaaucuauuuuucaagcuucagauccuaccuuuucccuguaucaccugguuauaaaaaaugcauugcugaucucccuacaacagggugucuuuucagucuuccaugucuuuuugaagguuguuccuucugcacaggcuacucuccacccuucuccuuuccacgcuacaugguguguucucuuucuuuuuaacgggucuugucuuuauucccacaauuuacagcuuaggucccucucacuucucaucuggaugacugcaacugccuccaaaugugagcuaucugccuccagauuugucaccuucacguacccacuaugaucagaacgagcucucuuggcaaacgugcucaugucccuuuccuaucuaagauccuuccaucacuccccgcugucuuguuaagugaaauacaaacuucaaacauucuacauuagguugacguucaucuuguuauucucuucgcccuccucuccaauccuuucagacacacacgcacacacguguguacaugcaaagcacacaagagucccguguucuuuagcuuuugaauaugcuguuucuucugauucuuuauccuugguuagguuaaacuuuaaauuuuucaagacauaagcucaagcuucaugucuucugagauguuuucuuugaucccauuuccccuacucucagacauaguuagaaaucaccuaaguccucccguagugaccugggcaccucucuaucccaguauuggucauauuacauagccaucgcucaucuuuccugugaaacucuuugaggucagagacuauuuuccaucaaucuccaauaccuauaauaaagugcacaauaaaugcauuuaaaaugaauaaaacucuacuccaaagcuucuuccuaugguaacaggaagaaccauuguuuccuccauuaugcuuuuacuaucucuugauuauucaccauauccuguuaauuccaacuuccaaaaaaugucuuucgaauccauccaucucuucaucucuacugccauuucccgguugagccauuaugacccacuagaagguauucauaggaacuuuaaaaaaaauuacaauauccucugcuccuaaacggcacuggcacguaacaggcacggauacauuggagagaugacuuaguucaaccuccaugacugguuuucuugguccugucccccuccagaccaguguccacaagcagcuuaagggcuccaucauuucucaaccuuuuugugcuauacuacaguugccucacauccacauucaagguuaucgauccacucuuaauagcugugucucaucuauuguugcccaucaaaugaguuuacagucaaugaucacauuaucuucauucuuucucaaaacgcuucuaauucaugcucuuaugacauuuuuuucauuacccucagucacuugcaacauacuuucacagucuaucuuggauagcucccuaauuccuagaucuucauguguaauuuuuccucugcuaucucuaccucauggugauuuauuuuuuucucaaguggcuuguaauuuuuuuauuuuauguccaucuuuuuacuuugggaguccugagagcccuggauuuaaaugugagccccuugaauguaauuucauuuguuucuuccuaagugcuaaugguuucaaugaucuuggacaguuugcuuuuuuaagacucucccucuguugcccaggcuggagugcaguaguacaaucauagcucacuacagccuggaucuccuggccucaagugauuuuccaaccuuggccucccaaagcacuguuaccagaggcugagccaccaugccuggccaaaucaguuuuuauguuaauuucucaggguguuccugaauaaugcuuuuguguauuauuuagaucgaugccuucaaguaauguuuggccuacccaagguucuggagaacccacuuccuugcacuuuuccugggucaguaggacgauuuucaaagguccagguuugcaggcugcuuaauucuguaacuuucacacagcgucagcuucccaaguccuaucucccuguuggaguaccaguauuaaaagcucaaucccuagaaaccuuauuuugguuuggaaucucacugcgccaugguaaagucagcuuauacuuauuuuucuagugguuauuucuuuuuccuucuggaaccuaugcgcuuuccuuuagcuuuugagagagagagacagagagagagagagagacagacacacagggagagacagacacacagggagagacagcaugggcuguccuguuccugacaggaacaggauuuaauaaugggcaggaggcccauccacauuagcuccaccugcaauacuccaaguaggugaguggugaacuuccuaacauacaaaaucugccaauggcuucccagugaccuuagguuaaaauuuaaacuucuuaaaaugugauacacaaagaccuucaaaagcuggucccugcuaccucuccuuccuuccaugacugccacucccauugaaagccacugcaagaauuacuguucuuucuuuucuauacccucccugggcuuuccugaugcuguucaccuugucugaaguacccuucuccacucuucaugugguuaacucuauccaucuuucagagcucaguuuuuccaagaugccuucccugguccucccagaugaugcuuccacaggaacuuguaucucccccuaucacagcaugcacaugugucuauuuuuugugucaucaaaacuguucaucuucuguugaacucacuggacuguaaagcucugagggcagggauaugcugugcccagcucgaugccuggcacacaccaggcacucacuucacauuugaugaaugcagagaaugcuuaguaagguuuuaaaagucuguuuccagaaggauagauaccauguuauauuaacccauauucauccauaagucuagcaaacugugugcuggauaaaggcauacauagggaaaaaaacauuuauuguuuggauugugaguaaaacagaauucucuuagugguucccaagaugauggaaccacaacucaucacaaggaaucuucagguugcaccgggaauaauccaaaugcaagucacacaacacuuggcauuugaaaaaaaaaaaaucauuuuccauugaggauuuaaaucaauuuuaauaagcgcaaaaucagacaucaaauaaauggaacuacaauacuaauuauuuauccagacaaagcuuuccaaaccccaccccaacuccuaccccuggaagacagaauuaauacauagggucuuuuggcuuaauaaaaggacuucuaguaucuuaaaaguuugagaaccgacguccagugaaguagacuuggaauccucauuguuuucacgcagcacuagguacaagagauuccacaguauggauccuacaacguaugcauugacagaagaguuccugcucucucaaagggcuuugcucuccaaagaaaaaagaacauguaacagugccacaccaaacuugccauuuaaaaaugcccuucagaaaucacaagcugagauuucuggugcuuguuuugcauuuacuuuggcagccuaggaagaugaaggaaaacagaucagcaauagaaggaaugaaggaaggagucuuugugggguaagagaugggaaaugaauaggagguacagcagugcugugcacagcaccaaacuggguauccaaagacauaugccccggccccagauccccaagaaacuggagcuucccugaggguuucgugaaguaacguacccaagagcccuuguaaaggauaaagcccucugcagauaaccagucuccuaacucagugauuaucugagauaugagagcuuuaugaacuaaaauguguugugcaaaugucaagauuuaauauuagaggcagaaaacagauguuguguuuuuauucuauaauuaaugggaugugcuaugccauaaguauaccuugcaauuuguugccuuugcuauucuaauaccuuucuucaaugucuguccuuggaagaguuccagaguaagacaaaaacuauagagagaauacaauagagagaauaugaaaccaggccaggauuaaguaagagacuugguuccagaagacacuaaaacaguaucugcaaagauacaaccuagugucuugaguguuccuaggaugcauaggauuggagaggagcuaucaagguaagaccucuguacaauccucaggccagcugucucugccccuuaucugaaggugucacguggcagugaagacccaagcucaauucucuuacaagaacagaaaaccacaggcaaugaaacaauaucuaguucucuaccuuaaaacgcuacuagcuagggugaucuuucuggacccuaaaugacaaagucuguagucauauaccaucaaccuaaaggagagacagugaucugccuauguacuggcaaauaaucuucagaagaaaauagugauuagaacugaaauuauuauauuuagcagauauuuauaucccuuccaguccccauucuuauuuuauaccuuaaugcaggccuauaguuugguaauuuuaauacaacuacuugcuggggcuaaccagggccugucaacagcuccucucaguguucuagaauagaaauuggcuaauaaaaacuguuaaccgcucuuuuccaaugcugcugcuguucuuuaaaacgaaagauuagcccaguacaauccuucuaauggacauauucuuuuauucuugauuguccuauauacaagcgcuuaccuaagcuuuccacauaaugguuaguggccuuggcacgcuggguuugaaucccugaccucgaaucccugaccucgcuuauuagccuuguaacacaauuucccuaagccucagucuuauccucaaaaauguggcuaauacuacuuaucucaugugguuguuuuaaggaguaaaugaaauaaccuauagaaacccuucaguauagagucuggcauaggguaggugcucaauauauuuuauucauuuuccuucaagcuauuugaaaucguuuugggaagaaggcaagauuuaaaugauaaacaagcaaacaguucucuauugcaucauaauuacaaaaaaacagauggcauaaggaaaaucuuggucggucuauuguuauaucaaagaaaccaugcuaaaccaaaaaaaaaauccuugcuuuggaggcacuuaugaaguaggauuaaaugaaaguguuggaauacagaugagaaggaaccuuagacacagguucucccaccgaagaccauaucagcaaugcuucuaauuaccaauauaucaaaguccucuccacucccuguaacuggcaggagacaaucugaggcaaacucaguguaccaagaaguccugugaaaacuuaaccuagacagcacaaugaaugaaagggaaugaauucccuggcuuuuggccuucuaacacgugaccaguaugcuucaaaacauguuuaaaacuguuucuguaaaauauuuuugccaccuaaguuucccccccgccccuucauaaaagugauauuugaguagugaggggagaaauggcucaaaauuuguuacaagagguuccaaagaaagacaauaagguauagagaaagggaagacaggaagaaagagaaagaggucaaguauguaguggauaguacagggaagucacaaguaucuucugucuggaaaugcugcagauuuugugguuagccucaagauauuaggugggaauaaacaugucauugagaguaaauguaaacacaaaaaugaaaaauaaaaauuguaacaauucacuuuauucuaaacuguuuuugaugguuauauauggcaggccuaggaggcaauguuagacaguagauaguugccuucggcggagggugaccuguguucuguccacugcucuacauuguaaagaggugucaucuuggacaagucacggcagcucauguugagucuugggaugauucuuuaucuaaagguagagaacugaaccagcuuuuugauggugaugaggagggguuuugagaggaacaaggauauacagcaucucuauugaauauuugggccauaauguaacagccuaggaugcugagauuuacucaagagcugaggacggcuaggggccaaacacagauuuuuaaguuuugagauaggguuuacucuguugcuaagacuggagugcaguggcaagaucacaacucacugcaaucucugccucccagguucaggccauccucccaccccagccuccuaaguaucugggacuacagcacaugccaccaugcccagcuaauguuuaaauuuuuuauagagaaggggucuugccauguugcccaggcuggucucaaauaccugggcucaagugaucugccagcuuuggccucccaaaguguuaggauuacaggugugagccacugcacccagccucaaauacagauuuuuaagaggccagauuuauacaccuggccaucauggucauguugguuaaccuccaucaugaagcuaggcuuuuuaaccuucaggaaaacuaccccagagcaguuaauggccuaaauaaaggaggucaagcuauaugucucaguuuaaaacagaacaugacaaauuaaccugaagcaggaaaaggaggggacaucaaaccugacacccauccugauaagaguaacugcucucauuugacagccagaguuaaacuagauguaugcaaucucuacaacaaacauagucaaugccaaucagauagucagaggaaccaucauuuaaugggaaauaacgcaauaacauauauaacagagcugaccggagguguugcuauagauaauucauaacagcaguaaauucaaaagucauuuacuauguuuuuagcuuugucauuaacacagccuguguggauacucccuguuucacgucuagaugacuuccuccuggcuuugcucaaggguccuuuagcauuugaggagaugauaagggaugggauccccgccuguugaaccagaggaaucugaggaguaccagguuuccacugaagacuaaaucaugauccagagaaggaaucucagaagucauucuugucgugggcauggcuuaacgucugucuccccacugugggcccugcccucgagagcaagggucuccuuauucauuuuuauauucccagugccuaccacuuuguggagcccuuaguagaaaagguauucaauaaacgcacauugaguuuaagcuuucuauuucuccucccccaacuaguauauauuacagaagcacugaaaauucagaaaucagccagugucagggcuccuggguaauaaaccauucacagggauagcuguaggaauuuggcauaagcauuuauuccaaucucuuggggguaaucaaguggcauaaucaugcccugcuuuacuguguagcauaaggccaguagagaaaaacaucaagaggggaggaggacaagggauggaguucaauacacaaauaucuacugagcgucaauuacgugucccacacuauucaaggugcugggcaaagaaagauaaaaaaagcagaagcucugaccuugaggaacuuaacagguaguuaagaaauugcagaauuuuagcaauacuaggaauucacagcaaaagcccagaauacagguguaauauuuugaucaaaacgugaagccccuaucaagagaauuaagaaaaucaaggggaagaacuuaucaauauuucaccucaaauuuggcauauagcauucaguuguuuuaaguacgcuuucuuaauuuugcgaacaaaauauucagaccuaagugauuaucuauaaaagaucagauuacuaguuuccaacacagaaguacucaaacaaagguauucugaaccucaaccuacugcaauacauauaucacauuuggccaaaagguaguuguucucaaagugaagaacccagaucugcagcaucaguaccugagccuuguuagaaguacaaauucucaagccccagcacagaccuauuaccagaaacucuaggggugggccccagcaauaugcguuuaacuagcccuucaggugcuuauaguaaguuugagaaccaccaccuagcaaaugaaguaaaucugaaguucaugcagaaagccauugcuggccaaacuaaaggguuugcuggugagagaacagcaaaaacaagggguauagaacuguuucacauuuuaaaucugugccaaauuuacugggaaaaaaaaauguaaaccuguaacuuaccucaucuguacaauuugcaauggcugagucccucacauugugguaaaccuuguuguacccuuggaaugauugucuacugcaauauaguauauacacagaguacaaaaaggguauagcuggaggagaaagggugaaagauuaugaaucccaggcguuugguccuaggaggaaaaauuccuguccucucuccaacccugcccacccucuuaugcuagauaguaacagcagaaaguuaucccagacugcuccgcguucacacgcuucccaccaacaaaccuccucccaaggcuaucccacaaccuuucugaaguagcuuccuggaucaagccccacggggcagcuuggaagagaagcugggagggaugaggggcuccacuagcauuccuuguggcuucugaguguagcugcccugggugucaccugcagagcguggauagagaaaaagcaacaguucuaagcccagccucuaauugagagccugggaucuagcgcugcuccccaggaccaagguuguucaagaaaggcugggucuaagagucucccucuggggaggucaguacagauuccaaggcagacaggguuaucaaagcgccuagaagaugagaacauucauuguucagaaaaacaaaaauuagacugacaccuuucugaaggaacacagccuauccauggcacaaaaacaaauuuuuaaucaagacacucaagaaguagguauacuccugcuaaaaguaacgcaggugcugagaagaggugccaaaacuggcuguuaggagugggaggagaggaaaguugcaaguggagacagcagcuacuggcuugaggggaccucagggucugucacaguggcagcugaaaagccucuggccaaauggacgccaaggacuacuaucaucacaggugacaagaucacgggugaguguaucugggugugugcuggggggcugaggggggcuuggugguguaaggagauggggcuagccggggcaaggagcccgcggagaugaucuuaagcaaucugagaggagggguaagaaaaagcugcggaaaauaaaggggccuagaccacuccucccucgguuccggggggacaguuggcgcggaagcguuaggagguacgagguacggacuaacuacauuucugcaggccccaggagggggcggagggcgguggcuggaaaggaaaggaagccgggagcgccauccguguccccggagauacuggcuccggccaccaggaaacacagagaccacaacgucucggcacccucaguacaccgccgccaccccuuccccaggacacggcgauuuccccagacucuggggggcggggucuccggucccucccccuccuccccgcccugcccggcucugcccgaucugguccggcccgguccagcccggcccggcccagcccagcccacucaggacucacggcuccgacagcuccggcggcuccuccccugccccggcuucucucccacccacucccgaccgaaacagcgccgccggauccgagccgcgcggggccuagcgggucggaacacguggggccuuugc

SEQ ID NO: 15940 - RNA, 4471 nt, Homo sapiens
agagucuaacauuauagguuauauuccauuuuuaaaaaucaacuuuuauucuacucaaaauuuuuuuuuuuugagacagagucuugauggagugcaguagcaugaugucggcucacuacaaccucugccucccagguucaagugauucuccugccuuaaccucccgaguagcugggauuauaggcgugugccaccaugcccagauaacuuuuguauuuuuaguagagacgggguuuugccauguuggccaggccggucucgaacuccugaccucaagugauccgcccacgucagccucccaaagugcugggauuacaggccugaggcacugugcccagccaaaaaaauuuucuuacauucccuuuuauaugacuggugggagaagagagauguuagagaaaacagggaagucggcagagccagaggaaugcccaaauguuauccuauuaaggcagacaaaucuucagacaugcuaugauuucucucccagcccaguuuuaccaucugaacccacccagacuuauucacuaaaacauaaccacuugguugcgcgcgguggcucacuccuguaaucccagcacuuugggagaacgaggagggcggaucacgaggucaggaggucaagaccauccuggcuaacacggugaaaccccgucucuacuaaaaauacaaaaaaacuagccgggcgugguggcgggcgucuguagucccagcuacucgggaggcugaggcaggagaauggcgugaauccgggaggcggagcuugcagugagccgagaucgcgucacugcacuccagucugggggacacagcgagacucccucucaaaacaaacaaacaaacaaacaaaaacccuggccacuugcuggcgaagucugugauucaguaacuacaacugcaaauauaucaagaggguuggucauacaauaagagagaguaaugcaguacuacucaggaagauagauauaaagaccuggaggucggcgcgguggcucccgccuguaaucccagcacuuucggaggcugagucugguggaucaccugaggucgggaguuugcgaccagccugaccaacauagagaauaccguuucuacuaaaaauacaaaauuagccgggcgugguggugcacgccugugaucccagcuacucaagagguugaggcaggagaaucacuugaacccaggagguggagguugcgaugagccgagaucaugccacugcaccccagccugggcaacaagagugaaacuccgucucaaaaaaaaaaaaacaaaacaaacaaaccugcaaauacucauucuguccagagcuuauguuuuuugaguuaauaacauauuuccuagcuuacguuugguuuuacuugugcuuuugcuucugagaaaauagauguacaaagcaucggcaugguugcaggagcagugacaggcauaguggcuggagcccugcugauuuuccucuugguguggcugcuaauccgaaggaaagacaaagaaagauaugaggaagaagagagaccuaaugaaauucgguaaaccucccacaucccuacuuuuacggggcuucuguuuuagggccagcacuauagugaccagccaacauaaauguucccaguuuucucuuaaccaugaaucuguuaaaaggauuauccugguagguaggaaguuccagccuagggacagaggguaugguuuaccuggacuuuauugugaaacuaucuuauccucaacaaacacuuaaaaguuaaauuaggcugggcgugguaggucaugccuguaaucccagcacuuugggaggccgaggcgggaggauuacuugaggccaggaguuugaaaccagccuugucaacauaguuagacuccaucuuuacaaaagaaaaauaaauaaauaaauaaccaggcaugguagcccaugccuguagucccagcuacucaggaggcugagacaggaggaugacuuuagcccaggaguuuaagacuacagugagccaugauugcaccucuguacuccagccugggugacagagaaagagcaugucucaaaaaaaaaaaaaaaaaaaguauguacauauguauauacauaaaacaguucaauuuacauuacuucugauucacuucuacccauaaugggcauacaaugaagaauggacauagccuauaggucaugaaaggguuuaugcagacaaacccuaaaucaggaggugugcugucuagaccaucucaaugguaagguccuauccucccaguauaauagaguugaccugugggcuaacaaaauauacauuugugugagccaagcauuaagucuuaagauacgaggaagcaccuaugacccuaaaugguugccuuccgaugguauuaucugagguucacagcuucggaaaccucagaaggaagcaaucauacuggaagcaaucacagaucugccaguguuaaucuuugcuguuuuuucucuucagagaagaugcugaagcuccaaaagcccgucuugugaaacccagcuccucuuccucaggcucucggagcucacgcucugguucuuccuccacucgcuccacagcaaauagugccucacgcagccagcggacacugucaacugacgcagcaccccagccagggcuggccacccaggcauacagccuaguggggccagaggugagagguucugaaccaaagaaaguccaccaugcuaaucugaccaaagcagaaaccacacccagcaugauccccagccagagcagagccuuccaaacggucugaauuacaauggacuugacucccacgcuuuccuaggagucagggucuuuggacucuucucgucauuggagcucaagucaccagccacacaaccagaugagaggucaucuaaguagcagugagcauugcacggaacagauucagaugagcauuuuccuuauacaauaccaaacaagcaaaaggauguaagcugauucaucuguaaaaaggcaucuuauugugccuuuagaccagaguaagggaaagcaggaguccaaaucuauuuguugaccaggaccuguggugagaagguuggggaaaggugaggugaauauaccuaaaacuuuuaaugugggauauuuuguaucagugcuuugauucacaauuuucaagaggaaaugggaugcuguuuguaaauuuucuaugcauuucugcaaacuuauuggauuauuaguuauucagacagucaagcagaacccacagccuuauuacaccugucuacaccauguacugagcuaaccacuucuaagaaacuccaaaaaaggaaacaugugucuucuauucugacuuaacuucauuugucauaagguuuggauauuaauuucaaggggaguugaaauagugggagauggagaagagugaaugaguuucucccacucuauacuaaucucacuauuuguauugagcccaaaauaacuaugaaaggagacaaaaauuugugacaaaggauugugaagagcuuuccaucuucaugauguuaugaggauuguugacaaacauuagaaauauauaauggagcaauuguggauuuccccucaaaucagaugccucuaaggacuuuccugcuagauauuucuggaaggagaaaauacaacaugucauuuaucaacguccuuagaaagaauucuucuagagaaaaagggaucuaggaaugcugaaagauuacccaacauaccauuauagucucuucuuucugagaaaaugugaaaccagaauugcaagacuggguggacuagaaagggagauuagaucaguuuucucuuaauaugucaaggaagguagccgggcauggugccaggcaccuguaggaaaauccagcagguggagguugcagugagccaagauuaugccauugcacuccagccugggugacaaagcaagacuccaucucaaaaaaaaaaaaaaaucaaggaaggauaaaaggaaguucaguauuguaccacacuuggaacuuccuccauuucuuccauuuuagaaggauaugaaccuggaacuuuugaugauucuaagccuuaaacuaucaaaaagaucagggauugccaaugcuucuaauggcacugcaaguauaugccauaaccguucccuccuaaaagugaaaaaugagagaaauucaguauuuucccaggcucagcauccagaagucuagcucugggcuggaagaaaaggguacuaauauuuagggaagagaugagaauaaguaguggguggcaggagagggcugagcuagugccugcuaacauuuuaguuguaucuuggaaagauuuagcaaaaauaacucaccaggauagcugcugaagaguugaugaaugggagaagaaagauguuugagaaauaaagaaaacagcagccugcaauacaauaacuugccuuuuuaauaguuuugauuacucuugauaccuacagcacaaaugcuggaccugaaucagcucuucaaggacccuagcacaaaugucaacug

SEQ ID NO: 15941 - RNA, 1592 nt, Homo sapiens
aucgaucucaauacuggccugggugcuggaagagaggguacgcuuagcacguucacaagcaguacggaggcgucuuacagcucucuuguucucacugauguccuucuuaugcuugcgcuuaaacucagcaauaaaaugguugaccauucgguugucaaaaucuucuccacccaagugggugucuccagcuguagacuugaccucaaagauuccauccucaauagugaggauugacacaucaaaagugccaccucccaggucaaagaugagcacguuucuuucugcuccaaccugccguuaaaaacaaucucauuuaaauuuacgauggaucaaauuaaucuuaaaauaauccgaacuugcaucacaaaugguacauaccuuuuugucuaagccguaagcaauagcagcagcaguuggcucauuaauaauucuaaguacauugagaccagcaauaguuccagcaucuuugguagccugacgcugagagucauuaaaguaagcuggcacugugaccacagcauugguaacagucuaggaauaaggaaaagaccacagauugguaacuauuauacuuacauauaugcaaacuccagcaaauggauuaaugcuggugaaagaacagcuggagcaccccccccaccaaaauguaaauuacuguguaauugucaagauucacugguuucugguguugacagacccaucuaccuagagagccuagggcacuguugggcacguggucuuaacccugagcugagccccaucuguuccccucccucgccaggugccagugcccccgggagucaucgggcuuuuaacuacuccggaaugcaccccauacugaaaaaccaaccucaccuucccaagguaggcuucugcaauuuccuucaucuuugucagaaccauagaagacaccuccucuggauagaagcuuuuggucucucccuuguauucuacuuggaccuugggccugccagcaucauucaccaccauaaagggccaauguuucauaucagacuggacaacagcaucaucaaaucugcguccaaucagacguuuggcaucuguaaaaggugucaaaugaaaacacuuucaauuucauagcucuucugauaaaacucaaguccaugauuacucaaauaccuaacaguucauagguaggugaauucaacuaccauauagguagcaaagguucaaacuucaaccuccuacguuauccagauuucagccugaaagguuucuacaaccuguuuuauaacagacuugauaacaagucucucagcucaguuuuucuaaaaucaaaaaguucccuccucacguuucauaaacuuuugugcuuccuagcccuguuauauuuguucugucauuuaaaauuaggaacucaccaaaaacuguguuggugggguucauugcaacuugauucuuugcggcaucaccgaucaaccguucaguguccguaaaggcgacauagcuuggagugguucgguuucccugaucauuggcaauuaucucgacuuuuccgugcuggaaaacacccacacaagaguagguggugccaagaucaauaccaacugcaggucccuuggacaugguug

SEQ ID NO: 15942 - RNA, 181607 nt, Homo sapiens
cgaaccgagcgggaccuggcggcagcggcggcgggcgcagcggggcggcccggagcggcgcgggcggccuggagccccgggagcggcgcgcgcggucccggcccagcggcucuccuggccucgcgcugcacauucucuccuggcggcggcgccaccugcaguagcguucgcccgaacauggcgacacggagcagcaggagggagucgcgacucccguuccuauucacccuggucgcacugcugccgcccggagcucucugcgaagucuggacgcagaggcugcacggcggcagcgcgcccuugccccaggaccggggcuuccucguggugcagggcgacccgcgcgagcugcggcugugggcgcgcggggaugccaggggggcgagccgcgcggacgagaagccgcuccggaggaaacggagcgcugcccugcagcccgagcccaucaagguguacggacaggugagcaguuuugcaacccgccucccuccaguuuuuuccucucccugcacuuccucacccccgcauccauccguugcagucgccuccuaggugcaggcaccacuggggacuucccggcuugcauuuguuuuuuuccuucacgaguacaaccgucagcacuugaaucgcauugaucuuuccuucuuccugucgauuuaguaaacguauuccagguaacucgccgggugcagugcguauuaccccagggugugugcagagagauguaguuuccggcagguauaggaggggugcagcuucauuuuacaucuggauaaaaaacgggcuuucuuuaguguaucaucaguuggcaguggaggcgagcacccugcaguugcgguacacuuacacagaacagcacgagguggggguuuccacacuuagcauuauuagcacaauaaaagugggcaaaccugaaagcuugucgacuaucucuguacagucagacaagagguguguguaugugugugcguguguaaaggcugaauuuuuaauuuuuaauuuuuggcgagcgugugagaugcucuccauuccuucuuccccacccuucaagaugcugacucucccacccccgucaagauaacuuuauuuuggagaggaauaccccucauggcacuuggagauuugaaaggacugcaggaaauuuggugggcauuauuauucuauaagugauuuauuucuacccaggcaauagguuuauuagaucauaaguaacgugaauuucacuuuuauggucagacuuacugcgaggaauugcagauggaguuuguagguuaggaucagcacuggcaaaauuaauuugaccguguuauugccucaugagacucccaguccugcaguuaagauugacaucagcaaaaguauaaggucggugggggagaaaaaguaggaccagaggaggggguaaauacacuuguuuucuagagucaaauuguuccuuuugaaguagaaauuauuaauaaaagauuacccugaguucugccuuuucucacuaauuucacuuuagccauuucuucaggaaauacagaguuaaauguucaacccuuggauccaggacgaaccuuguaaacauaucacccuauugugucauuuuguuggugaagaaacugaagcguggaauggugaagugacuaguccaaggucauaccgggaagguggccugcucucuaguuuuugucugcauugucucagugaccuuugcuugacugcagucacccugucuuuaugcaaugcugcugaaauaccuccuuucuaaaauaaaauagaucugguauaaagggggaaaggaugguggugacugggugggagcguuggauuucccuccacuauuggucccugggcaagaaugugugccccagggcauguaacuaaugguggccacaggcugcaggaaccugcaugcucaguuccucuugggcccagauccuugucccccuguccccaccccauaugacaaauauguguaugaacaaaaagaagucaucaagguccuugcucuuaacagcgacaccagcauggggcugauggagggugggagaaggaggaggaguggcccacuucuucauugggccuccgcagucagcccagcucugcugugcucuugaaucagcauucugggaacugggaguugggggcuggugggagacaaucccucccagugcucagguccccugaagcuauaguuuagguugaggaaaaaguuuucugguuucaaaaauauguguacaugugccauuucuuucuuggguuugguuuaugaaaagcuccaggggauguggggcagguuggacaugaacucuguucucacugggagugacucccaaacccugggcuuuugaguuucugggccagccagauugaguuugguucagcugaaggauggagaacuagcagucaaacucauaaugaggaauuccuaaccggagggugaggguacaagggugagauuuuucuucucuguggcugccuuccuaugccauuguugccucuugcucugagguuaauaagaaguggaauuaauuugaaucuguaaggauuugagucagauaaaaggaagaacuucccuguacugggcuuucugccacaaguucuaucuggugcagacccuucagaaugcaagcacagguuggugacugaagggguuugaggugccccucuuggaacucuggaguaacuaacaucuauuuggaaugaucuuucuagcaaggaugaccauugccucuguguuucccuggggcagaccugguuucuaaguugucucuggugguuaugaauagcacccccuucacucucaaaagugucaagaugugacaauaaauuauaugguccuacuuuuagccuuaagccaaguuccacuuuguaaucacgacuuuccccuucaacguuuaaaccuaaggaauggugauguuuuccaacaguacugcuugacuugagugugguucuauggaggugcagugagcuggggaauaaaauuucauuccugcuuuuaggaaauuuacaauuuaaggaggagagcaagcagaugcagauacaggcaugucaauguaccaggaugggaaccaggaaacauggucacaagaaaccagccacaacucuacaauggugugauaacgggcugugugacaugcagcgcaugggagauggagagauaagggguggugggcucagacacuguccagcuucuugcccucugaccuuugagugagguuaagaggacacuggcagcacagguuagggcuggaagcagaagcugccugaaggaagcaggccuagaggcgauguuaaggccaccaccuucagggagaagagaagggaaggcuuucuaggggaauacuugcaucugagaaagagcccugugcuggagucaaugucgguccuuuuuccucugcuucgcuaaugucuuggguaaacuaggcuugguuauuuugaccauuuuccuccucaguuucucuaagguggggagaccggcuucugccaugauuacuuaaaggcacauuuaugauacugaaaugugauuguaggggugaaaauaauuugcuggcagauaucaggacuuuucugcccauguucaaggcucacgccuguaaucccagcacugugggaggccgaggcggguggaucacuugaggucaggaguucgaaaccagccugguccacauggggaaaccccgucucuacuaaaacuacaaaaauucacugggcgugguggcagaugccuguaguccuggcuacucaagaggcugaggcaggagaaucgcuugaaccccggaggcggagguugcagugagccgagaucgcgccauugcacuccagccugggggacagagugagacuccaucuaaaaaaaaaaaaaaaaaaggcaaaguuuagaaguugagccccuucuuaaaggccagguccaagaagagggauucccuaauucaugccacacugaauuuccuccugauuucucauaagcucugucugucugcgccaucauaccugcuuuuuccucugccugaaaugaucuuccccaacucuuguccuugccugggaagcucuuauuccauucuuuaacauccaaggaauaccucuugguauucucaggcuauggugggaagaguuucuucugagcuuggaggcagcacuuacugccuuguguuagaauugcucaacugucucaucuuccuguuugcuccuugagggcauggaucaaguucucuuguguuucccuggcacuugggaggcccuuaaugaguauuuguggaccagccacacaccuggaagaagagaggcccagaggguaggaagcacauucacauuauauaaaauguauuuguaaggaggaauacagugaacccacacauggauagugaaaaugagauggcucauucgguagugaggaugcaagcggcauggccuacagauaguggagcccugauuugccugugcuauaugggaguuauuuucaaugaagagcuuggauucuauuuuacagaauccucccuuuuagggcuaucauucugguuuaugcuaaugguauuguuuuggggaaaaauccuuuggaauaaagcacaaagccuaacaggauuuacagguuuauuuuccuuccaacaagcucucucuucauaauuccuacauuuuagaagccagggaguauucaguguccugauuugagacugaaaauaaagugucuauuacagcacaaggcccugggacaaaaggccuccuuuggggguggaauaccguucagcuuuagaucucuuuugaguagauucuuccaugauacacuugcuugggaaagaauuggcugguugauucugaaguuaggauguuugaccugugugcuuccagaauaagaugagaaggcaaagaaugugcugcuucagguuggcuuuuauguagcugaagaguugcucggggccuuggguuggcucaauaagggacgugaccuugaaaagcucuuccugguuccacuuggcgucuuuucuuagggagcucugugcccagucucuggccgcuuuuaguucauaaauagcuugcaugguuagaggcacagaagguggaggcuuugcgagggggaaggaauggaggaaagggguuggugagaagaguaaggaggcggaauuuggagggaugaaauaaaaagcugucugauuagguaaugcacguuuacaaaacaaaauuuguacaaaagcguaugugguaacaaauuuccuucccucucaugcccccuguucacccagagcuccuuuccggguggcauccguuguuaucaauauuuuuguauaucuuuccagaaacagucuaugcauguacaacauguauguacauaaaauuggaaacuugaauuauaaauggcuuccuguuaccuguagucccugguauccugaauaaugagauuaacuuuagcucuaaauuauauuugugauauuaugauggugaauuguuagaaaauuaccugaaguaucauaauauaaaauagaugauuacuuuuuuuccaggccaggugagaaaaaccucauucuccuuucacuucaagcguucuugcagagcaggagagcagccugauguagcccccuuguaacuuggagagaugcuggagcacaguucccuugagauguggaguccaggcuuguaagagcaucagaauacagugaucauggaucuugguuuuaauuuguguucugucugagaauguuuucucuauguucuguaaaaugaaguuaaugguaugcuuaauaaauugcuuugagacuugggauccacgaggcagauccuuauagcaacgaacaucccaaggcaaaagguggauguuguaggaacauuucauugucagauuuuggucuguuccuccuuagagaugacagccaucuucauagugucauuguugaaucccagggcagagauaguuggagccagcuuuguuccacccacuguaauggagggacacagggggcagucuuaucauaaucuggagagcagguaauccaaaaaauaaucgauuugcuuuugcuauguauuuauguagucuuuuuuuuaaagcauucguuuaccuuccuaauuaaguuuugcucaggugaauauuaaaaugaguuugcauucuuugaucuauugauaagggaaauggcuggccuaaauguauucagggaaaggcaguuuggaguuuagaauuugcgacaauaauucagaugcagauaauugagaguugauaaaaauguauuaaauguuuuaaaugaauaaaaauguauuaaaaccugggggcauuacauugaccuuuccuccauuuauuuggauuuaaauaaaugugauggaaaguaaaagagagcucacugcauuuuugguuugaauauucagggauuaguauuucuccagagguggucugggcugugggggugaggcauucucuguugaugagcaugggacuuuccuaugcauuuucuagguaugccagacacuguuggcagaugguauagucagucuagccacguacaugcaaaaaucaauuucccucaauuuaaaaugagccacaguuaauuucgaccuaauuuauuggcuuaucgaccugugaacccugggccuucgaagaaguggcaugggcggccuucaagcgcugaaguggcugaugaagcuaaaauccagaaaaggcagggugggcugcugagcaagaucaagauuugaguuuccuccuguguuauugugagaugcucaguuuuuuuuaacuguaacaugaccaaugcuuugugcauuuuaugguggguuccguaaaaauaggacugcguaacgaucacaaguacacuaguguguuaaaaaauaauuacaaaguucuguuauccacuggguaacuguuuauuauaaugguaacauccaugcccauagcacugcuacuagccaagagcuggaagauccuaucuuccuggccgcguccuggacccuccgauguggcacuguucaauagaucuuucugugauagugauguuuucuaucugugcuguucaccauguucacuagucagaucuggccauugagcaggugaaauguggcaagugugacugaagacuugaagugucuuucauuuaauuuuaacgaauuuaaaguugaaauagccacauguggcucuuggcuacuguguagacagcacaagcuuugacaaggccucuucuucccaccuguaggcaaccucugcuucacccaagagagaaguuccugcaaagaccugcucguguaggcagggcaaacagggcaauaaaagcaagaguggagggcuugggucuagacccuagguauugguggcugcugacugccaaguugagugucaggagacagugguccuucuuuccuagguaggaacucaccagggggaccguggagggccaaguggguccggugguuggcucuagggcaugccucugcacaguugccuccuucugucagucacuuagucaaugaaggcuggcuauucauagggugaaccagaucucuguggcuucacuucucaucuggccuugcgcaaacacugcacuuguaucgggcuuugcuaagguggagcgcagacccugcacguucuguuuagcaaugaaagauguaaacagugccuuaacaguggggccaucucccugcccugcccuuugcuuccugugcuuuuguugacuuaccuugauguagcugggucugucuuucuucccuucaacccuccagauuggcaugaagacaaacacuacaggcguguggucuucaucuuugcauauaaaccucccccacuucuuggcugaccuuuuaacuuagcuugccauugcuguugcugcugcugcaggcucuuagcuuggaaaaucaggacccuucacaaugauuuaucuccaguccccugaauuagauucaaaacacagcuacgaauucucagaaaggcaggcugaugugauuauaucccaaaucugaguggcugacaaggacaauaaaaagauguaccuauaucaaaugcauuugugccguguagagaccaauauguuguuuauuaucucccccccuuucuggggguuuuuuaaaugaagaagguaacugaugugaccucuauuauuuagaagagagacuagccuguugaguagaaacccugggggaagaugacuagggugaaucuuacaugaaauaaaugugggggugaaucaaugggugggcccucaguugggauuuuaauauuuuagggauacugagaugauuuccuucugacuuuggggggcuggugagcugagguguagugucaugaugaauuuuuuuuuuuuuuuuuuuugagacagagucucgcuccgucacccagcuggagugcaguggcucuaucucggcucacugcaaccucugccucccagguucaggcgauucuugugccucagccuccugaguagcugggauuacaggugcgcaccaccacgcccggcuaauuguuuuguauuuuuaguagagaugagguuucaccauauuggccaggcuggucucgaacuccugaccucgugauucacccaccuuggccucccaaaaugcugggauuacaggugugagccaccgugccuggccuuggugaaauuuuuaacucugugcccagaggcauuggaaaggcugguaugaucugguugagccuggagggcccuggguuaagagccaccuguggagaaaggcuagcuuggggacuguggcugggaagacuuuaauagguaccugugagauagcaagcuauaggguuaaggucccagauaguuaaggaccccauuucucuauuagcccaggagacacaugcgagacaguuccaccugucucugccccagggaccuggggagaaaggccagugcugaucugcccaaggaucucagccaaggagcccgagauggcagggaguggggacagagcagaguggggugaguguccugugaaaccagaaguguuuggaaggacuugcaugcuuugaaccugugcucaauuaauugaguaaccugagacucuguaccuaugacuuaccucaucuguguacauuuaguucccugaaauucucucacugagugguuaaaaaaaaaaaaaaucugcaguuaacugugcacaugguuugcugaauuuggcaaggugugcuguugguggugguggugaugggugggcuggagggggacgguuacugcagaaacaaggccuucaaucucuagaggagaaaaaugaagcaguggauguggaaaguugguuagaggugaaagagcuaucuaaacagagcugggggaguuuagcuagcagaccagagccugugggacguccgccuguugccucaccuccugguagcccagagggcaucuccuauuacugagaaauuggccaagccauggguuuaaugcacucccccuucuccauuagucuuguuuauagcugcccucacaggguggugaagaagccacugguaggguauagaggccuucgguucugggauguaauguuuacaugcuuuucucuuggaguuaggaaagugcuagaaaacagugucgccucugggcuggagccuugggaccuggagguuggguuuccccagguuucagaguucggcugggaaucaaggagaaaacugccugugaguuucaguuaggcaggagcuccuagcuugacucaggcgugcaguguuuugucauuuuauauaugucaucgcuugcucuuaggccuuucgcuaauguuaauguucuauguggagccguuuugugaggaauggcuuauuuugguugagaggcauuugguaaugaaaagaaaugauguuuuagugcgucgaaguuuaugaaaugacauccacaggcugcaucucauuugauucuuacgacaaucuugaaaaauggggaagauaagaaugauuauucaucucauuucagagaugaguaucuugaagcuugaaaaggugaagugacuuacccguaguuagacaggugguaaaccggagagaacaagacucaaaccaacccgcuaacuuguuucagauuuaugcaggcauauuugucuauccuaaguaaucuagugaaauuuuugaucucaagcagggauccacagcuuuuuugcaguacuuuuuuuucuccaccuuuaaaaccuggagaucucacauaauuccacuuucuccuggccacacugaucuuguaauuuuucaaacacagcaagucucaaggcccuucuccuuccuggcuucugcucugcccugccuuaggucuggguccauguucucugccucacuuuuccauccccuuuucccuaacuccucccucuucauccuuauggugucaguacauaggucaggucuucagugaagccucacucucuccccgauaugagguuagguccccuguguaacaacaguaauucaaucaucauuccuggaauuaguuguuuaaugcguguuuucccuacuauauucagagcuaugaggcaggaccuagaaucguguuauuuuucuuucuuuuuuauuuuuugagacagggucuagcucugucgcccaggcuggagugcaguggcaugaucauagcucacugcggccucgaucucuugggcacaagcgauccucccaccucagacucccuaguagcugggacuacaggcaugcgccaccaggcccgucuaguuuuuguauuuuuuguagagaugggguugugucauguugucuaggcuggucuugaacuccugggcucgagggauccacccgccuuggccucccaaagugcugggauugcagaugugagucugccauuuuacuaacaccuaguauagcaucugguauauaguuagugcuugauaaauacuuauugacugaacgcggugaggggcuauucauggugaagcugcagagggcaagucuguggucuggaaccauccugaagagcugugagaaaugacuuugggcucacagggaaauccucacguagggcaaguccuggcuuggggugcgcucucuugaggggguauuugcugugcucacucugacuguguuuccugcacauggccguguguuuucaggcagugagaaccaccacauugccuuaaagucugucucugagcuuaaucucauuugcaaaagguggcauuucauuuaauuguucucugagauucuuucuggcuuugauauuuuccucauuuuuuuuuugccaacugguaaauuaaggggugauauuauguucaugagaaagagaguuuuccacaguuucuuuuuaguagggagccccucccaaaacagcaaagcauauucgcucauugacaaaguggguucaccaggacagaguggcacacagagguaaacaguagauagguucucgcugccaaggaucaaucagaaagggaaauaagcucucuaaacugauauuauaaggcagugagauuaugauuaucauccuuuuagcaaagagaaaggaaagggcauauguguauuuuucucuguagaauggucauggcuccagugaaggagauaguagugaaugcuaaguucuaguccaagguuauucucuccuuguuuccucaucuggaaaaugggcagccugaauucaucagcaaaguaguucaggaguucuguaggugaagcaucuugagcaaacucaaaagucaagugagugagcugagauuccaugaacugggccucucuuccgggagugcucguaaacuagauuucagcuuuccuucugaggugagcaguccagggaggauaauaagccugcuaaauauagugagaacacagucuugaaaggggacagugagaggcaauuugcauaccuagcauuuaagccaugcaaagggaugguuugggaaaaccuuguucuccuuggaccucaggaggcugucuuugacuuccucaguuucgucauauaguucaggggagugccuggcuccuucuguccucacaguugaaggacaggauauuuguuuuaugcuauauuguagaauuuuaaaaacgcuucuuuguauuucacugcuagugaagcagagaaaugaaucagacugccuuauuuguccuccuuguacugcguuuugggaggaggcuguguaggaguugugaggacugcaagcugugggagucuaggacauccugauuuuuggguuugaccaauuugaaagagguguagagaggguaccugugacccauucuauucaguggccccaccuccugcauaagccucaacaacuauacagauuucggugguuuuauuggaaacuucucaucauuggcuuagacuugcaacccuaauucccccagaagugcucugugugagcuaacagguaagaaaugauuaaagagccuacagggugccuggcaccuagcagaccucagugccuacuucauccgcaagugaacgcaugaguaaucagucccuucauccaagccauugacuuccuccccucuauuuauaacaacccagaacuugaggacugggugguagcagguccuuccccucacucugaauaauaggaggugaaucauuucaccucuccggguugccagggcacgcagggggcugagggacaacacuuguggggugauauggacuuguucgaugaagaugccgaggcgagucaagguguggguggcauccacuguugugagcuggcgguggaugcuagccuugggccugcggcuguuucuccagcuggggacagggaggccugugcggaugcuguggcucugcagaugccgcugacagcacuuugaaggauugguuuggccagagacccaguccacagccugccuccuguaugacucauucuagcugcauauuuugguagcaugagggcuugagaugagauaaaaggagcacuucuuaagaguggaagcuccuagguucuugauuagcacuugagaaauauaauguucucugcagguccuagaggccuuaaaaaaauuugaguauauuucacauuacauaaaauuagccauuuuaaagugaacaguucagugaacuuaauaucgccgcaauguugugcuaccaugauuuccaaaacauuuccaucgcucugaaauaaaaccccuuacccauuaagcagugauucccuccucuccaaucucccagccccucguaaccacuaaucagcuuucucucccuauggauuuaccuauucgggacauuucauauaaauggugucaugcaaucaugcaauaugugaccuuuuguaucuggcuucuuucacuuagcauauuguuugugagguucagccacauuguagcauauaucaucaguauauccuagaguuuuaaugaccaucccaaauccccaaagacaagcccccccgccaaaaaugguacaucuuucuagcuaccgucauuuaguuccaacuccugccaggaggcaggggaaucaacuagauucauuguuucccaaagaagcugcauuagaaauaccugggguuggggugugucuccuuuuuuuuuuuuugagacggagucucgcucugucgcccaggcuggagugcaguggcaugaucuuggcuuacugcaaccucugccucccagauucaagcaauucuccugccucagcuucccgaguagcugggacuacaggcacgugccaccgugccuggcuaauuuuuuguauuuuuaguagagacgguuuuucacuguguuagccagguuggucuccaucuccugaccucgugaucugccugccuuggccucccaaagugcugggauuacaggcaugaaccaccacgcccggcugggugugucuuuuaaaaaagacugauuccugggcuccaggcagagggcgacagagccgguaggcguggaguggggccucuuaggugauucugaccuucaguggggcaugggaccccccuaggccaggugaucuuugggggguggggugggaggaguuaucuugacucuuaacgaccugccaaugagccagaugcuguuuguuguuuaugaugcaguuucuguguucagagguuucuguggcauguaauuuuucucuguuugccuucugaggggaggcacucggccccucccugcugccuuaacagcuccaauuaauugugucucauuuaucaagcuccagcuaugcccugugagcuagacaggggagagggaagguuguucacaccccgggguugugguuauagcugauugcacgucaagguuauguuccugggaaaaccacccucccacccacucccaggccagugucuucugggugugggaccugugugggggauuggcgauggaaaaaggcuuggggaggaggaaaggggagaucagggggagauccuuggggauggauggaaaaggaaccaaacaaaccggaagccacugauuaaguaaagggaucuagggaccuguggguuguucuugauugcuggggucugcccugggcugcuggugucuuggccacaugccauggagagcuagcaggaaaagccugcuuuguugacuucuuuucuuuccccugggggugaggaugggggcaagguggagacagaggagacaggugaggccagaggguagaaugcaugucuugauaauaaaauuuacuuccugucagccugccugcuggcuccccuguccugcgcgcauccauuccugauuccugcaacuaggucugcuguggggggaugggcacccgggcugccuuggggaucagcugugacucaccagggaguuauucuuaugaccaggaugugccugacaucucgccaagcaaaggagcugagcuguuccugcgagugccugguggcccucguacaagucauuucuugccagggauuuuaucccccuacugggcugccccuuuucagucugcucuuaugaguaaaagggacaucuaauaaaaaaagcuuuccuuaaaaaaaagaagagaaagaaacaaaguaacaaacaaacagguguuuuaccaggcuugccuucuagagguuuucuuuuuuucuuuuuuuuuuuuuuuuugagguggagucucgcucuguugcccaggcuggacugcagugguacaaucuuggcucacugcaagcuccgccucccggguucacgccauucuccugccucagccugccgaguagcugggacuacaggcacccgccaccacgcccggcuaauuuuuuguauuuuuaguagagaccggguuucaccguguuagccaggaugggaguuuuucuuuguagaaaagcccuuggauguuuugaggcuugcccuuggugcucuucucaccuuucaccugccuugggauuggugaggaggucuccuguccucugaguagaucgauuucagcaaguuaucuucagaccuuuugcccacucugaucacugaaagcuuugcaaccuacucaaagcauuaucugaguguuaccugccagagggagcauuuugaugucaucuuugaggaugcccaaguugaauauuugaggacuuuuuaucccagaucccaggggaacaugggugauuuuuuuuuucuagguuccuaguccuuuauuguauugacauuugcauaguuuucuauccccacucugguucaagagugcagauguuuugggaggggaggaaacuuuuagcugggauucccagggcacauguguugugaguuucugaucuccagauggauccaggggauugggcuggagaggaggaaaagggaaggcuucagcgaccggaggagauuccuuuagcugcuuucucuuuguagcauucuggauuaaauaauuuauuuacuucuauuucuuauuugcacuucucuguuagugcuugccuggacuucucuaucugggaaugaggagagacauuuuggaaggacacauauuccuagguccuuuucuuuaaaguaaggucgccuuucaaauguuuuucaaaaagaguuugauccuggaucaaauuaaaugcagguauuuaaaacuccaaguaacgucguuaaggauuagcugcuuuguccuucugccagccaaauauguggcacagguguuucucuuuucccugaugacaucugagagcaccucaaggaguggguggggaaaguucgagugugcuggggggaggaagcgagagaaggagaaaggagcuguggguuuucugccgcagagccuugaugagaagacagcucggagggcagguuggcccaggcuugaacugucaucagucuaggcuuacucgugggugggguggacugugcgggcuggagucccagaagcuugauuuccuuccacgugugccucagacagcugagguugaggaggcugguggaauaggcuucucucagacaucgcucagcaagagaggcagccugugauccugguuucauggcauuguccugcuucugaguguuggaccaccucucagaauuuuuuuuuugagacugagucuugcucugucgcccagauuggagugugguagcucaaccuuggcucacugcaaccucugccuccugagcucaagcgauucuucugccucagccucccgaguagcugggacuacaggugcaugccaccaugccuggcuacuuuuuguauuuuuaguagagaugggguuucaccguauuggccaggcgggucuugaacuccugaccucaggugaucugcccgccuuggccucccaaagugcugggauuacagucgugggccaccgagccugaccagcucucagaauuuuuguuauuccugucaugacuuugcuuuccacagaguggguggaauguaugguucagguguucaaaugccaguccucagacagguguccaucagccaacagugaaauaagaaaauaaaaguaauguaguuuuccauacagugaaacaaugguucuuuauucugagaugauaugcuuccucaguuuucaguguuaacacaucuuugaaaaaaugacaaugacucuagauaguggucauauugcccuguaaggugagcugcguaacagacaaaucccaaaggcucagcguguggcugaguugaggcuccggguuaugagaaguucaggaugagugcuacugguuagcggaggucuuuuccauggggaugcagccuccuuccgucuucggcucugcccuccucuggggcuuuggaguccucugaaugcggccugcggauggggaaagaaaagaggacugcaugggggccaggccgauaguggcccugaugacuucucucacauuacaccugcuggaacucagucccaggccacaccuucugccccacagccuggaccagagucugcgguguccucaggaagcagaggaaagagauugagagaguagcuaguccuguuuuugugauguccuuacuuggcagaauagaaguugccaaccaguccucuguuggccuuccucauuuuuauuuuaucgguuuaccaaaucuaaaagucugagaacuaaaauauuuccuuauuugagaccuuucaaaaauaauuuugaaaagcuucacaaugauacuucucucauuucucauuaccagcugaaagugaaugacaguaccaccaagccagaaaaaacauaguuggaacagaaguuugaaaagcaugugaucuuucuggccuaugaauuuuuuuugaacaagggcaauguuuccaugcuuugguuuaaaaucuuaccagugcaugucauacauagaguaaggaucagaguaaccagagauugguaucauaaaggaugaaaauaaucaaaggaauugguuaugccaaugagagcccaagaagcuuuucuacaaucucuuuacauccaaaauagcaggggacucauuucuuuguggggaaguugagugugacagaauaugcaugaggugggaggggaagaggccaccuuggcccaaaugcuuuagauggcagaaucuucaucauuucugcuugacaaaggaggaaagagucuugauuuagaauguguguggccaucacuuaucguggguccuaauuccuacauugaucucuuucagguuagucugaaugauucccacaaucagaugguggugcacugggcuggagagaaaagcaacgugaucguggccuuggcccgagauagccuggcauuggcgaggcccaagagcagugauguaaguguuguguuggcucugggcacaccuuggugccaucaacaugcccuuuucugguccacugggauuaucauacuggaaaaaguaguggguaauuggaacauggaauggaugaauuguaugacagggaagauaaucuagaaaaugauauaucccuuguuugcugaacacagggaggugcagucaguguugcaaacagauccaugcaaugugugauuaccuuugggaaguaauagcauauggacuggauuguugcaucugcccaagaaaauaccagagugccuuccugggcagagcugccugccugcagcugagcccgauggaaucaaauuggccuuucccauaugcugguuucuucuaacccauuauagugggaugagcuguugaaacugauucucuaauauucuuaauuucuauagcuggguauuugugaucuuuaguaggugagguacuuugaagacucaagaugccaaggguuauaaacucaaaggccugugggaggccgggcagguaaaggacaggagugaagccaccuucaaguuuauaacacucuuuucuauuuuuuuuuugaguuggggucuggcucuguuacccagguugggguacaguggugugaucuuggcucacugcaaccuccgccuccugggcucaagccauccucccacccacucagccuccagaguagcaggaacuacaggugcacaccagcauggcuggcuaauuuuugugcuuauauauauuuuuugguagagaugggguuuugccacguugccuaggcuggucucgaaccccugggcucaaacaauccgccugccucggccucccaaaguguugagacuacaggcuugagccaccacaccuggccauuacaacacucuaccuccucagagaaauaugguuucucccauuuuucuugaagucuguggccuuguuggacaauauaugucauuuccacuuuugauggagaugcacauucaagaaacauucucccauaucuuaauuugaacauacuaauggauacuugguuccuguguuggagagacguggggaaggggaagggccuuuggggaccgggagaagcaugcuuccgaggagcauugacugucagcuccaggcucugguugccgugcaggaugcugggcccaguguugccacaucuucugguuuuccagaggaacccagaggucuggaguuucaugugaaaacugcugagucuuacaaguuggcagccaguguauaguuuuuacagacaccgcgugagccagguaaaacacauguaagggccaaagcucgcccaacggcuggucccaggucugcggccugugcucuggacuccuccuugugggugagaggagcagccccugccucagccuggggucugacacuguggcagcgcgaggcugcagacggaacaccaugcuuuacagcuucggucacccugcauucuggccgggggaaccuucugaugaauuugccagcacuuucacacuagccuuaaggauacauuuauaauucuugaaugcggauuuggucucugugaggucccucucuguauauccacugucuggguuggguguguugagaagcagguguugggaaguugucucagggacuguuuccagggaguugaauuagggcagccacagaagggaagacagaagggcuggcugucaggaugcaugacuuugcccgggguggguucugagccaugcugugugggagaccaccgcuacugauggccagucuggguguagugcucuggggcagggcuagacuuguuuggggcaaugacuuuggcccauuuauaaauaugaucagguuuugcaaguaaaagcuguggccaccacagacagcugugucugaaugccuuugguggccgggugugguggccugcucccauagccccagcuacucagcaggcuaaggcaggaggaucccuugagccaaggaguucaaggcugcggugaccuaucuucgugcuacuguacuucagccugagugacagugagacccucucucuagaaaaaauaaaacaaaaaauagaaaagaaugccuuuggcccugugagacucuucauagacaccuguguguagucccugcccaugggcauaucccuccugggcacaggagauauauauacugugcuauacuguguugagaaauccuucuuggaauuuuuaugcguuuaaaaaaacucuuaauccagacaacauuuuuugugagguagauaaagaccuuaagcauuguuuuauaguuuugcuggacaaacaggagccaagagguguaaagagacuugcaugaggucacucagcaugucagugggaaggucggggcugaugagaaucaaggcccaaucauguacucagugugcgaagaugugguauuagggugaccaacuugucuagguuuuagcacuaaaagccccacauccugggauccucccuuaauucugagugaaccagggugguuugucacccuaaguauugccagucuauugaaacccaacucuugcucucucuguauauuugggugugucuaacuaagagcccauugaacaugugaagugggauacacuauuguggaaugaaaugggagauagagccgaggugggcagaucaccugaggucgggaguuugagaccagccugaccaacauggagaaaccccauuuguacuaaaaaugcaaaauuagcugggugugguggugggugccuguaauuccagcuacucgggaggcugaggcaagagaaucgcuugaacccgggagguggagguugcgaugagcugagaucaugccauugcacuccagccugagcaacaagagagaaaacucugucucaaaaaagaaaaaaaaaaaggagauagauuaaaugggaaggaaacgcaauggccaggguuaauaaauagggauggcagaaauggccuuccucucuauacaaacuguguuaaaggauuggcagaugcaagugagaugccugauguaaaaaguuaaugugaaaagaaaugaugacucagaggcaguaguugggguaauaacaauccaaauucucuuuaaagaagacugagcaugguuuguaaggucccaucagcaguccagaagggaaagaaccuaaacaaaucaggaacuguguggguguuggugagcggccaaagucaugcauauucaguaucuaaaaagggauggcucuggaagcuggaauccagaaagucuugcucucaaacggggaaaaaaugaaucauuuauccacugaugaaguugaagccagugugauuccaugaagagaacggcuccugcaggacucaucuguccugugauaaaucaacaaaagaauuaauagauguuuaucucaccuuuuccuaacucuuuguuucugcucucucaugauguauuuuacaaaguacuagguuuacaaagugcucaggugcaacauaauuggcugaagagcuguccagggguacaguccaccagaagaucagaaucaaccaggggcugggugaggaguggcucaugccuguaauccuagcacuucggaaggccgaggcggguggaucauuugaggccaggaguucaagaccagcccggccaacauggugaaacccugucucuacuaaaaauauaaaaauuagccaggcgugguggcacaagccuguaaucccagcuacucagaaggccaaggcaggagaaucacuugaauccgggaggcggagguugcagugaguugugaucgugccacugcacuccaggcugggugacagagugagacccugucucaaaaaaaaaaagaaaaaaagaaaagaaucaaccagggaagauacugugcaggauaggacuuucugcuuuugucccuagagcagugugacaucaugauuguaccccucaggacugacuggggagcagugucaguucuugcuaacagagggaggccgaugucuggcugagcacaggcucugaaaucagaacaccugggcuggaaucccggaugugccauucauuagcaaucugaccuugggccaggugauguaccuucucuuguccuccucugucacugacauagugcuuguuaaaccuugcuacccaaagugugguuguggucuguggaucagcccuuggggauuuucugggagcugguuagaaaagaaucucaggucccauccggacuucuugaaucagaaccugcacuugaccagugucuugccggggccagggggcagguagggggcggagagggggcagucugugggcauauuacaguuugagaacauugcuguaaaguacuuagaacagugccagauauggggauguuuucuguacauuuuagcugucaucuguuucuccccuuucucucccuccucuuuauuauuacguaguuuugagguacaagggaaagaauuaaaaaucacucacuuucaaggaccaucuuuguagguaaaaaaggaucuaaccagaaaccgugggcaguucaguaacuccuccccugugcuauuuugcuuuuuagggaguagcaucauauugaggucagaggggacuauuuagugcagaaaucccgucuggaugaaaaaccaacuaggagcacaagaugagugaguccgggguguucucucaaauucaccuggagaugguauuggacugugagucagcagcauggugcugccaugaagaaaagacagcuagaaaggaaagcgcaagucgggguggagccaccaauccgcuugagcuaacugcacacuggcagaggccuuuucugggcuguucaaugugggggaagauagauaacugugcaccagcuuuaagcauuguccuuguucuauggagcuuauagucuaugcuaauuaaguagaaauaagaauuaaggacugggugcggaggcucaugcuuguaauccuagcacuuuggaaagcugacgugcguagauugcuugagcuuaggaguuggagaccagccuaggaaaccccaucucuaaaaaaaauacaaaaauuuagcugggcaugguggcgccugccuguaaucccagcuacucaggaggcugaggugggaggaucgcuugaaccugggaagauugcuugaccccgggaggucaaggcugcagugagcugugcuugugccacugugcuccagccugagucauagagcaagagccugucucgucagaaaaaagagaaagaaauaacaauuaugaagguaggauaaaaaugucauguuggaauuuuucaaccuggccaagggaaggaaaguugaugagugguucaugauggccuucaggcauaggacggacucuuacauacuugcuuuucacuucuguuaaguagaagacccaaagagauggauuuuguuuguaggugagaauuagggaagagcucuuugauagugaaggugguuuuaccuccaugugcacgauggcagcggcauggcugagaaucucaggaaggcuuucuacuugguuaaugugggucuuuucucucugcgggccagcacuccuuccagugcuuggccuguagacuugguauaagaccuuccuacuuagcagagaaacguuaagauggagaagagaacauucuccuagagguaacuuguuggaguagagagacaacuggacguggaauuggaggaaacugucauaguuuugucucuuacuagcgguaugacccggagcuagccauucacuucugggaaucuuaguuuuuguuuaucucuuaaauggaaaucucuuagugacucacugauucauucaauucauucuuuucuauucauuuauuuaucacauuuguuuauuugcucuuugguuuauaaugauauuuauucauccuagaaaucuuuguugagcaccugcuaugccccagguacacugaaagagacaaaggugagacuaacuccgguuuuucagaugaagagagagaauguuuguaaaggaguauuacauacugaaaaaugcuaccuuaauguaaacuaucaccuuugugccccugaagauauacgugggggguuaucaaauuaugggaugucagagcuggaagggacuuuaguuuccuuccugagaagccauuauuuugcuccaugugauguuugaaccuaaccgggacacuaauguccauucuuggccggcagaauagaagugagaaagugcuacuucgucauuuuacccacucagauuaucugugaacucucagccugcacaauuucugaagcugcuuuuguggcagcuccuuacuguguaucugguaguugggaacacauacuguguguuccaauagcuucuucaacugugacucagauaaaggcagaggcucugucuuggccucuucuaaccuuaacaucuaguaaguauuaaagacgugcaugugcucucuguucccuuucuacauaccuuguguuuacauagggcauuguuugcagacauuuacauguuuacaugcccaucgugucuaaagacuaugucuuuuauuagucuuugucugucuggugucuagacaauaccuggcucacauggaacccucaaaacauguuugcugaugacucagacaagcaaggauuggaauacacccugcuccacuuugaauucaccugcccuuccuucccucccucccuuccucccucucucccucccuucuccucccucccuucccuucccucccucccacgcuuccucccucccucccucccucccuuccuuccucccuuccucccucccuuccuuccuuccucgcucugucacccaggcuggaguacaauggugugaucauggcucacugcagccggaaacuccugggcuuaagugaucuucacaccucagcuucccaacuaacugagacuacaggcucaaaccaccaagccaggcucauuuuuauauuuucuguagauauagggucucacucuguugcccaggcuggucucaaacuccuggccucaagccauccucucaccucagucuccuaaaguguugggguuacaggcgugagccacugcuccuggccucauuuuucuuuaaugcucauccuaauccccuuuuccaugaaucauuugaaaaauaacuaaguuauuuuaauauauucaccuaucaggcuuguuuuuaaccccgugauuauauuaauuauuucacaucucacagguagguacaucucacaguauugucacgucacucagcaaucuuucauuuccaucuugggcuacgugguggagacccaugagaguuuucuucucuuuuguauggaaugcuguacaaacagaacuucccagaagaagaaugaagaauuagauacguuuugggcaccauucaacagauggcaaaacaaauccuccguuccauuccccucagcuagccacauucucccccuucuggauguaauuuguuaaacacugaacucagccccggugaggagguuauuacuguuucuaucauuugucuccugcuccagggacuugccuuggccucagaaaagaggcuuguguauuccaggcaguggggacugcaggggucccaugcuuucugcccccacaugcuuggggacagacauagaggugcccugccucaccuuuguguguuaucugguaacaucugucauuuccuaucaggcaccuaaugggagccacguucaggauccaggaugggauguuugaaagagaucuuucugcuugggcucgguggcucaugccuguaaucccagcacuuugggaggccaaggcaggcggaucacaaggucaagagauugagaccauccuggccaacauggugaaacccugucucugcuaaaaauacaaaaaaaaauuagcugggcgugguggcaggugccuguaaucccagcuacuugggaggcugaggcaagagaaucgcuugaacccgggaggcagagguugcagugagcugagaucgcaccauggcacugcagcccgggcaaaaagagugaaacucagucucaaaaaaaaaaaaaaaaaaaagaaagaucuuucugccaguuucucaccaacucuuucuuuuucaucuccuuuucucuguauuccagguguacgugucuuacgacuauggaaaaucauucaagaaaauuucagacaaguuaaacuuuggcuugggaaauaggagugaagcuguuaucgcccaguucuaccacagcccugcggacaacaagcggguaaggaaguggccaucccuccugucccgacuucaugggacuggguuuuggaaagauugccgcacuuaagggggugcuaggagauggcgcucucugugaucuuuguagcaugacugguggcuagugaguuuuugugcuaaccugggcauuugugacagacugcuguucucaggguuggucucugcacaaucaggcaggccaaggacuggucaggcaggauuucuagacaaacaaugacagguuaaaccacagaaaaucagccaacucuuguaauaccuugcccgacuugcagauggcaaaaauguuucccagguacacugagaauaaccuugcaaucaaauucauguuuucuaggauacuaucagugugucugcuugcgugcuuaugcgugcuuguaugcgugugugugcauguacgugcuugugugcgugugaguaccugugugcguguggguaccugugugugugugcuugugugcauguggguaacugugugugugcuugugugcgugugaguacuuguguggaugugcaugcuugugugcgcgugaguaccuuugugugugugcuugugugcguguaguuacuugugugcguauggguaccugcgugugugugcuuaugcacauauggguaccugugugugugcuugugugugugugcagauaccugugugcaugcauugguacccacgugcguguguggguaccugcgugcgugcgcaugcuugugugcacguggguacccacgugcgugcgcaugcuugugugcacguggguaccugcgugcguguguuggugcaacccucugucccccggccucugaaccuguaccgauauggaaaagaaaaccaaggcagcagauauugcuaugccuccugcuuuguuuucccagcuggcuggcccugggggcuuuguuucuucaguuaggcaauuugauuugaggaagcguugacccugggcccccagggagguggaggcgggagggcaggaaccgggcagccggcaaggcuuuccugccaguuggguagcucuuagcucggagaguuguauuucguugcuuucuuccccacucuuguguuaccguguuuguuuccaggccagaucuucuacggaaagacccuuaguagaaaaacuaagagaaacauucuaguagcaaaagcuuucugcuccagaaaggaacaagcaagcaagaucuacaggguccucuuuccagucccuaguccuggcuucucagguugcuugaggucuccuagcaggggcugcauucaaaauauuuagcgacugguguggcuugggcacugaccaaucagaacaaauccugucuggaggaggcuggguccuggacguccccugcugggccaugcauuaacuuuugaguugcugaauuucagggagauccuggggaagggaccacgccaugggaaguguugugggguaggcuuaggaagggccacuuaaggguuucagggcagcggcuguugaccaggugguacagagcaguuguuuuuuaacaacuggaauggucauuacugguacauacuuguuaaaauaucagcucugccugaugaucucagaguggaguggcaguuaggagcaaacuucccuuucuuaccuaacuccagggugacagaguaauuuuucccccugagaugaaaagcaaggagaagguguuggagggaauuggccccauagacgggucagccagccuuugugccccuuugccccaccgcacagugugguccccaggacucccagagaggggugggccccgcugcuugccuugccuuuggcuccuccgugaggugaggagcccugaccaggguccagcucauagcugccucuucuguggauggauccauaugcgccccgccucucaagaaucaaauuacaccugcugauguguuguaugcuuggaaaugcagaguggauuuuguguucucacacaaaaauaacuaugagagggaaagcauuuguuaauuagccagauuuaaccauuaaacaauguauguauguuuuuaaacauuauguucuacaugauaaauacauauaauaguaugucuauuuaaauaauuaaauuugaaaaaaacuaaucaaauauuaucauaaguaaugauaaaaaccacaauuucuuuugcagcaaacuaauaacaccuggauuucucaauuuauuaaguuguacuuaccugaugcugaugaugauuacuguauuuacacauugucucagagcucacucuugcggagguuguggccucgaaaaugccuuguugucccucuggaaucugucuuuucagcuucaucuccuccuccucaccuccugcuguggugcacagauaccuauaggcaggcuccaucuccuccuccccagcuccuccccuagugcacagauaccuauaggcaggcuucaucuccuccuccccagcuucuccccuagugcacagauaccuauaggcaggcuccaucuccuccuccccagcuccuccccuagugcacagauaccuauaggcaagcuccaucuccuccuccccagcuccuccccuagugcacagauaccuauaggcaagcuccaucuccuccuccccagcuccuccccuagugcacagauaccuauaggcaggcuccaucucuucuuccccagcuucuuccguagugcacagauaccuauaggcaggcuucaucuccuccuccccagcuccuccccuagugcacagauaccuauaggcaagcuccaucuccuccuccccagcuccuccccuaguacacagauaccuauaggcaggcuucaucuccuccuccccagcuccuccccuagugcacagauaccuauaggcaggcuucaucuccuccuccccagcuccuccccuaguacacagauaccuguaggcagacuccaucucuucuuccccagcuucuuccguagugcacagauaccuauaggcaggcuccaucuccuccuccccagcuccucuccuagugcacagauaccuauaggcaagcuccaucuccuccuccccagcuccuccccuagugcacagauaccuauaggcaggcuccaucuccuccuccccagcuccuccccuagugcacagauaccuauaagcaagcuccaucuccuccuccccagcuucuuccauagugcacagauaccuauaggcaggcuccaucuccuccuccccagcuccucuccuagugcacagauaccuauaggcaggcuucaucuccuccuccccagcuccuccccuagugcacagauaccuauaggcaggcuucaucuccuccuccccagcuccuucccuagugcacagauaccuauaggcaggcuucaucuccuccuccccagcuccuccccuagugcacagauaccuauaggcaggcuucaucuccccagcuccuccccuagugcacagauaccuauaggcagguuccaucuccuccuccccagcuccuccccuagugcacagauaccuauaggcaggcuucaucuccuccuccccagcuccuccccuagugcacagaugucuauaggcaggcuccaucuccuccuccccagcuccuccccuagugcacagauaccuauaggcaggcuucaucuccuccuccccagcuccuccccuaguacacagauaccuauaggcaggcuucaucuccuccuccccagcuccuccccuagugcacagauaccuauaggcaggcuucaucuccuccucccgagcuccuccccuagugcacagauaccuauaggcaggcuccaucucuucuuccccagcuucuuccauaguacacagaugccuauagguggguucugacuuccuuucugcuuguuguggguuguggugaacaacugcuaaggccacaagucugaagagucagaagacaggacagaugauguuuuggacuugaaggaggaggguuagugcaggcagaggacuggggcuuuggaagcacuggaucuggagaaggagcagagcaggggccgugguguuuggggcaagagcaaggggaaacuggagggugauuccaguaagggaguuuaggugcugcacuguggaaugggggugacauguuugcaucccaagugcuguguaccuccgaguggugugucuuagauucucauggguggauauucuuuggaguuggugggguuggagaagucaggagaaaaaaggcugccuucuuggagaauuuguugacaguugggccucaggccuggaacaggcugaguggguuggugggggcagcauucucuguagauaguuucuaauuccccagagaaggcugcuccucaccaccccaccagacucucaggaaggaaaugaugacucuuaacagugcugauugcuucuguuacuuuugccuuuguccccuggaaggcaaauugccccaccagaccuaccacuuccugagaaaaaucacacaaggcuggaugccuugcugucaacagcagggcgcucugccuaggcaaaucacccaggugaaaaugcgagcugccaaggagcauuugaaauggucgaaaugaauguuagcagcugcuuggaaagguuaagaugucaggaaagggcagcguggaugucuaggagcaugagugccuguggaaggggagagaaggugcuagcgcggcauccaguuccaguccgaaggcuuugccuugugauggagauggugcuugugggcccaugugaguuuugggucuauuucugcauuagccagcagucccacuuccuucuuggucuccugugugcugcccugaaccauugugcagugcuggccacauggcaguucugccaacauuguggggccccugagauuggucagacagaauugaaauauguuuggcgcuguuauuugcuuacuuaauaauuuuuaaaaaauagagacaggggucuugcucugccauacauccugggcacaaucauagcucacuguaaccucaaauuccugggcucagguauuccuucugucucagccuuccaaguagcugugacuacgggccagcgccacugcauaucuggggcuuuuuaaaaaaggacacugaauguacaguuaggccucacagccucagccucagcagaagcaagacccaguccugccuuuuuccaggcagagguugguccuagguaaaauuucauucccaccuucuagagggauguuccuucauugccuucucugcccuuccuccucucauuguacucuugguuucuccacuugaaacuggagaaagucacuuaugcuaauagacuguggauacauucuauagcuuaguuuguuuucuuuccagagguauuuguauuuucagaggaaacagcuuuuaaccaaaggaggaagcuccucuggaauauuaaguuacugcaaacaggguuggagagauugggguacacaaaggcacuccugaaauugcauaguuugggaagcaccuuguaggucagcucuuggucagucuguagguuuggccuccaguaaacuugacagccaggcagcacagagacuuaaaagccagggugaaauacugugucuuccuaacauguacauaucugacccuuuguaucacagcaugagguaccaugugcucaagugaugaauguaaccuacaaauaauagagcuaggggaaucaaaugagguuggaucauagaagccaagucuucaugggguacuuaggauuugauaugagcuucaaggauggacaugugaccccaguaaguagaggagagcugucaggagcccucaagcaggagaagggcgucagcagagacugcaaagugccaaaaugugguuucugugcaggacagcgaggagauucacuuuuuggugguggagagcuuguauugagcugcugugcaaugucaaacaggcccgugucugaagauggagauugucuucugcuuugagggcugaacagagcuaggaaagaauauuugaguagggguguaaaugaauaguguccuuuagggaaaugugucuucuggcaauauucuugacuuucccuuuuagcagggaaagauuagggaagagucuagaaagggaacuauuguggcaguguaggcaugaaguugcucaaucaaaccugguaucacccucuaaguauuucauuuaggcccuggaagacaugaggaugaagaagacccauugccugccuccaguuuguuuagucucuagugaagacgugggccaugccaauagcacugagaggaaaaaggaaggcacauauuuugagaaagauuuuaaaggaaaacaaaacagguuugguggcugauagagagugagggccaaagggaaggacuggaguaaaaacccaucucugcuugugaguaguggggcugggagaaggcauagcaggcaggagacuugggacguggggagggagaauuggguuuuguugggaaaguuuugaagaacucaaguuuugcguauaguaaaauaucuuggcccaucaaaaguggagauggugagaagguaaacaaaaauggaaucucuguaagaauugaggguuagacuguagauuugaaagucaugccaugcuucuucuuuuguuuuugagacagggucucacuucaucacccaggcuggagugcaguggugugaugucggcucauugcaaccucugucucccagguucaagcgauucuugcaccucagccuccugaguagcuggaauuauaggugcacaccaccaugcccagcuaauuuuuuguauuuuuaguagagaugggguuuugccauguuggccaggcuggucucgaaccccugaccugaagugaucugcccaccuuggccucccaaaguggugggauuacaggcaugagccaccccgcccggccccaugcuuguucuuaagggcggugguugaagcuuugugaaaggauaagccaaaguuagcagcaaaggauggaagaagaaugagguuauaugagcguagggaguggggaggaccaaggagccagcagaggagaaucaaggcuugagaugaucaggggcuggggauggagaggugaaaugagagggugcuguggauuaggagagaaggcacacaaaugaguuaaaugguacaagguaagaccuaugaaugaaguucaggaaauguugccguuuuguuaaaagagcuguuaaggggugagaugugaacaugugaaccagucagauauugacgucaaugcugccuaguccugcgucaccuugggcaguaaacuacucucagucucaguguccucauuauuaaaagaguguauaacgguaauauccaaagcauugagucacugugaacccugaaugagauagggcaugccaaacuuuuagcucagugccuggcauauaggaagugcucuugaaaacguuuagcuauuaccauggacaauaauacauucuaugacggggugcgugauuuuuggauucuccaaugugagacugcaggaagccauggaacagauuucuggggaaaucuuuucaaauugaggaugcuuccuuccccaauaaccuaggugguuugggagcaggaagauggacuauguuauuucuggggaauacuuuuaugccagaaauuaugaugauccucuuaggaucauaauuguuuuuuauaacauugcauuuuauuguaguuuuugcuuucaaaacauuuacuaccuuuuccaguuugauuuaaugaggcuucugcagaguuuagagauuuaccugagaugcuggggaggaaacgugagagagcgaauccacaaaauaugucccugggaaguuuauggucuggauuuggggagagagugcaaaugaaaaggagugagcacaucugaaagcagcaugagacaagugcaaagugcugguccacaccgaggcuguggcacugaaagguuucagagcuggagauugaucugggucagguggaguccauucgagaaaguguccuugggcuuauccugcaggauugcuugacuucuaggaugucaaugacuggcuguggguagaacuaggucccuguugcucugguuucugauucauaaucuccugagccuuccucauucuuccaggagcagggaccggccuccgggucuugccaggugugcaugcgaggccuuacaucaucugugcuucccagccuuguuuucugguuauuucucucaggcccucaagacugucacugggugcaguggcucaugccuguaaucccaccacuuuaggaggccgaggcagccugauggcuugagcucaggaguuugagaccagccugggcaacauggugagacucuguuucuuucuuucuuuuuuuuuuuuuuuuugagacggagucucacucugucgcccaggcuggaguguaguggcacgcucuuggcucacugcaagcuccgccuccuggguucacgccauucuccugccucagccucccgaguagcugggauuacaggcccccaccaccaugcccggcuaauuuuucguauuuuuaguagagauggguuuucacccuguuagccaggauggucucgaucuccugaccucgugauccccccgccucagccucccaaagugcugggauuacagccgcgagccacugcgcccggcggugagacucuguuucuacaaaaaauacaaaaacuuagcugguugugauggcacacaccuguagucccaacuaccugggaggcugaggugggaugaccuccugagcccggggaggucaaggcugcacugagccaugauugugccacugcacuccagccugggcaacagagcgagaccuugucucaaauaaacaagacucucaucaaacccaugcuauaucucuuuucccccuuugugcccaaacccacacugcccuagacguggaauauucuuucccugugggagucucaccugcccugcgaggcccaccucuuccauggaaucauuucucaucucucagccuggagaggcacucauaggacucuggucauggcuucucauucagccucacuuucucuugacugaugguuagcccuggacaugucugucucccauguuagauuuugagcuacuugagggaaggcaucuuggguuuuuguggcagcuccugagcgucugguccguggugggaaugcagcacacauguguuagguugaauugccuggauccuucuccccagggaauucuuucagccgcagccacuauccagccuaaauuguucagauucacucauccacacagaagcuaaguaggaugaggcccgugcucaccagagcuacuuacugcucugccccagagugagccugccagccacaguggcagccugguccccagagcugccgaucaccuggcauagcagcacgaaggagaagcuuaucuucuuagauggaagugauuuuagugcuuuuccuggaaagccaugucccauagcugcuuggaggaugcagggagacucaaccaucccaucuguguuagccaaucugaaaaguagggcgucugugucccagaugccaguaacuacccucugguugugacugagugacccacuagggagugggaauugcuaauuucauugaaaggaaacaacagaaaggcccacuucauuaccugguuaaacaagcccaccuuguagcuucaucccgguccaucuccaggccuccuuucgcugagccuuguuuggaguaugccagugucuuuuuauugccaagagauggggagaaagccauuguggaagcccuguaaggcuguggugccuuguuggugccagcuggccccugcacauguguguacucguguggacucgcacaugguuuaggggaguguugggcagcucuggacagggccugcucucaacuuaccuguuuucccuugcaguacaucuuugcagacgcuuaugcccaguaccucuggaucacguuugacuucugcaacacucuucaaggcuuuuccaucccauuucgggcagcugaucuccuccuacacaguaaggccuccaaccuucucuugggcuuugacaggucccaccccaacaagcagguaagagggcuuucagaacccaguugcauggggcuccucuaguuuucuccucugccuguguggauuguguguccuuugagugaccucgccuccugccucucccuccuucucucuugggccuagccuuuguagcuacuauuucacuuaccagggcucaagaaaaauaucuccuccuggcacucucaguuggcagcccagccagccaucagcacccagcacuuggcaggcccugugaguuaaacaucaugcccuucuccaugcaguugcaccuuuguuagcccuugggguaaaucgaggcucuggaauuuaaucagagagagagccagguggagaaagcuggaaucugagcucuucagggaccuuuuguugaauuucuguucugcuuucuccauccuccaucuuaaacacugcuuuugccucccauuuauuugaaguuaccacuaacaguaauagucuuccuucgagugcgugcguguguaucauauaaauguguguauuuuccuccuucaacccagguuugaaggaaaucugagagaugaggaaagagccugaguaagacuuauaucucaagguugaagcuugccaagucaaggauauuaguuuggcaaaaaucugugaaacuuguagauccuguaugauuggauuuacagugagccuugaauguuuuugcucagagaaaccuuggaacguuuuuuugcagguuguuuaaccaaaacacagaucuguuuaccuuugcuugccuuagggaguaaccuaaguaugggcugggucaguuuaccagcggagggggaauuauuguuacuuugggucuccugcuucuuaauacaugguugcuagggccggaggaacccucagauuccaucuguggaaguugaggggcuuuggcaaagaucagcagguuaauuccucauugccacagccguguauucaguugguucucuguggggcucuguacuuagcugguguccucugcauucaucuuuaauuaucagggcccauuacuguuguuuucuuccucuuuuuugugcguguuaaaauacucauaacguacaauuugcuguuuugacccuuuuaagcaugcaguguagugauauugaguauauucauauuguuuugcagccaucaccaccauccaucucuagaacacuuuucaucuugcaagacugaaacgcuacacccaugaaauaauaccucucugcccccagccccuggcaaccaccauucuacuuucugucucuaugcuuuugccuacucuagguaccuccuaaguggaauuaauacuauuugucacuuugugauggacuuauuucacuuagcagaauguccuuaagauuaauccauauuguagcaugugucaauuuuuuucuuuuuaaggcugaauaauauuccauuguaugcauagaccacauuuugcuuauuugcuuaucccucauggacacuuggauugcuuccacauuuuagcuguugugaauaaugcugcuaucugugaaagguuuuuaaggacacuguuucuucguugaaaagugcugaguauaaucauccuuugguuuuuaccauuaccuagaggcuagucuugagugaaauauaauuuuugguaauccauaaauggaaggcaaguccuacucauuuuuccuuccaguugcuauugagagaacacauagguacacaguugucuuuccuuucuugcccuuguuugcuuuuggagcaacugagcuggcuuuggcagucucagugccugccuucacagacagcgugucauggaaggugggauuucagcggguguuugauggugaugccauucagguuguauuauacaugccucuugcaucaugaccacuugucuuugcagcuguggaagucagaugacuuuggccagaccuggaucaugauucaggaacaugucaaguccuuuucuugguaaguugugucaucuaagaaaucuugauauauguaaccuccuuucuccaguucuagcuccuucuugguggacaaacugcccuccccugaaauguccagcauuuauucaggaaauacauuuuuccagaucugagaauuagagcugcaaguacaaugaucucacugugggagagaguuggggggaggagaaaguaagguauuuaugagaggagugguagagcuuuugcauuuuucaaucaaucagggaacccaggggaaucuugaggcccuugcauguuuguagaguuucauuuuuagagcaucauauuagaagugggaguuuuucucuauauaaaauucaugcauuucgcugggugcaguggcucacgccuguaaucccagcacuuugggaggcugaggugggcagaucaccugagcucgggaguucaagaccagccuggccaacauggucaaacccugucucuacuaaaaauacaaaaauuagcugagcauggugguaugugccuauaaaucccagcuacuugggaggcugaggcaagaaaacugcuucaaccugggaggcagagguugcagugagccgagaucgcaucacugcacugcagccugggcgauacagugagacucugucucaaaaaaaaaaaaaaaaaaaauuccugcauuuguucauaacauuuucuugaaugucuguuaaauauaaaaccuacuagauucuuaaggguauaagaaauugaauaauuuauggauauaguuauuaaggagagguaaggaaagacauuucagguacguaacacacauugugaaagaggcacagagguaacagacauaguaugagaagcuagagagaggauuuauccuuccagaugggaggaucauaaacagcuguguagaggagguggcccuugauccaggaugugcacaacagguaggaugucccuguguggagguguggaggacaggaauuccaggcagaggaacaaagugacuugccaaaggcacagggaugcgccaauguggugcuuggguagagaacaugaacucuuaauuuuggacaguguauugggugaaguuuugaaagggaaguugguauuagaaucugcaucgcuugauaaaggaauuugggcuacauucugaaagcaaugagguaccccuguaguuuugugagaagaggagugaaauaaacaggcuguacuucaagaaguacuucuagaaguaaauaguaauauacuuaucguaauuuacuauuacagugauaaaguaguauaggaucuugaauuauaugaauuuguacaugugcaggcaaauguguaggacagauuucuaggaguggguaugcugggucaguggguuuaucuaacagcuauccauucacucacauggaugacugauagauauugcaaacuugaccccucgcaaauugacucuugaucuucaccaccccaaaucagcuccaccuauaacuuuucucauuugcucaggccaaaaucuuuggagucaucguugauuucacauuuguuuuaugcuuuacauucauucuaucaggaaauccuauuggcuucaccuucaguauauaucuagaaucuucuacucagguaccacuucuagugccagccuccagugucauugcucauuagucucccaacuagucuuucugcguuuacucuuguuuuucuaucauuaauucucagcauguggucaguuugagucuauucaaauaaauuagaucauuuuguuccucugcuuugaacccuuuaaugcuucaucauuucucucagauuaaaugucagauaccuucuuaccacagggaacaggauauuugcaauugcuguuuucucugccuaaaaugcuguuaccaaagauauacuuacugcuuacucccuuaccucauuccagucuuugcucaaauaacaucuucuaaaugaagcccaccucauuuaugcccaccuuaggauccuauuuaaaauugcaccuggccaagugcgguggcucaugccuguaaucccagcaccuugggaggccgagguggguggaccaucugaggucaggaguucgagaccagccuggccaacaugaugaaaccccaucuccacuaaaaacacaaaaaguagcugggcaugguggcgggugccuguagucccagcuacucgggaggcugaggcaggagaaucgcuugaacccgguagguggagguugcagugagcugagauugcgucacugcacuccagccugugcgacagaccaagacacugucucaauaaauaaauaaauaaauaauaacugucucaaugaaugaaugaaugaaugaauaaaaauaaaauugcaccuacucccccauuacucccaaucuccuguacuguguucuguucuguuuugcagagcacuuuaccacauucuaauauacuauuauuaugcuuauuauuugucuuucucccuucaauagaaugaaagcuucccaagggcaaggacuuuuguaaguuuugugcacugauauauccacagugaauaaauccuuaaaauuguaacuuugguagagagugccagauuugauauagaaagugucaaguuugcacucaucucaacaauauagaauagugucucccuccacagccaauguguuagggaagaaauauuaucucugugguuuaauuugcauuuuccuuauuaugaguuagaacaucuuuuaaucugcuuaagggucauuuuuuuuuuuuuuugagacggagucuugcucuguugcccaggcuggagugcaguggcgugaucuuggcucacugcaaccuccgucuccaggguucaagcaauucucugccucagccuccugaguagcugggauuacaggugccugccaccacgccuggcuaauuuuauuuauuuuuauuuuauauuuuuuagugagagucucacucuguuacccaggcuggagugcagugacacuaucauagcuuacagcagcuucaaacucuugggcucaagugauccucccaccucacccucucaaguagcuaggacuacaggcaugugcagccaucccuagcuaauuuuuacauuuuuuuguagaaaggaggucucccuauguuucccaggcugaucucaaacaccuggccucaagcaauccucccaccuuggccuuccaaagugcugggauuaugguuuguuuuauuuauuuguuuguuugucuguuuaaguaugaccaggcuggaguguaguagcgugaucuuggcucacagcaaccucugccucccggauucaagugauucuccugucucagucucccgagaagcugggauuacaggcacccaccaccaugccuggcuaauuuuuguauuuuuaguagauaugaaguuucaccauguuggccaggcuggucuugaacucccaaccuuaggugauccacccaccuuggccucccaaagugcugagauuacaggugugagccaccgugccugaucucaugccuguuuucuauuugauuauuagucuuuucauuguugguuucaaggagcucuuuauauauucgagauuagcccuuuggcugugauaugagauagaucguauguguguguauuuauauuucuaucuccuaguuuuucauuuguuuuuagacuuuuacuuguaauuuuaguccucauuaaguguaauggucccagaagauguagauacugccuuuguuucuuuuaguucuccauguaaagugaaaugucuuuuaguugguauugcuuccuuaguaauagagguaaagauggagcugguauguugaggagccuuacagcugaccaucaucagacacccauagauucuguuuauguuuccacagaggguagcuguuucugacccuuuuguuauuuuccuugagcaaaaguugugggaucuuagugaaauuauaaccacagucucauccaaggacacccucugcucaaggagaaccauuagaacuuucuucugcuuuauuugaauuuuaaggggaaaaauuguucuuuuaucugcuuaagaaacuauaaauuaagagggcaaaccagcagaauuacuagauaagggaacauacaauuuagaaauuuuaaguucuaaaaucauauuguaccuucugccucuguguagauauacagauauccugggagaaaggacugguuuaucucauugaagcuaaugacaugucgguuaggggauuuuaggcuauuugugggauuucucccccuagguuuccccauaauaagugaaagcguaaucuagucucucagaauaaugauauacauuuguucaacaaugcuuggcgaguugggagcagcaggagugggaaagcuaaaaauuuacaugguccggagcuugagauuggcaagacagaacaguggaagaccuggagggggcugaggggacucaaagauacccuguggagcaucauugagggauuucaggugaggccaggugaggcuggugacugcucagagauagagcaaggauuggaauuucucaaugaggacaaagacaauagaaaguaggugucagugagcguaagacauuggaagucuaagugauugcaaaguaugagaacuuguagguggagcagcuugcagaaaugggagguccaaauauggauuacggaagaaaauugggaugaaagucacaguucuuucuaucucuagguguuggcugcugcuuuuggcuaggaaggaauaauagaggugagcugggucucaaaauagcucaauaaagguuccuuccucucugccguuuuaaaaauaccaagcagccucauuuuaauuugcauauccucuggcuagaggaaguacuuuaaucaguacuucuaauuguggaaaagaagagaacaugccaccacccgcccacacaugcacacagaggaucugauaaugaagaauaguguucucccacacuaggaccaaagcugcugguuucuccguugcccuaagaauccagauuguagggcaaaacucaagucuugcucccauuguaaaaagaagcucuuuuuucuuuguuuuuucaagacaggguauugcucuguugcccaggcuggagugcaguggcacaaucauggcucacccagccucaaacuuccaggcuucaauccacccaccucagccuccugaguagcuggggcuacagguguacgccagcauaccuggcuaauuuuuuuaaauuuauuuuuuguagagguggagucucacuauguugcccaggcuggucuugaacucuuggguucaaauggucccccucccuacccuggccucagccucccaaaguguugggauuacaggugugacccacuacaucuggcaaaagagguucuuguuuuucuguuucuuauuuuccuuuuugggagggguggggggaauaugcucuugacaguauaucucugaaggaauuugacacgauuaccuucauuauucugagagccaucaugcauaugggauuguauaagggcaguuaccuaacugaggccuucugcuuuuccuugagucaucacucuguauucucacuacaagacuaucuucccgacuuuaccauuuauuuuuuccauuugcugaaugguucccauggccuugguguucuugagaauguuaggagaccuggagcagauaaguuguccucugagcugcuguguggggauucuugggggaucacuggcucagaaguucuucuccaagguaguuuggccuggucauucuauguuuucauuuuggauuagcuucuugaauugccccacagauccaaugcagaaaguaucucuucagcuaggaauacuauaggguaaaaugaaaucuaagacauggccuuccgaggcaucuauacugugucuaggaagcucagacaaauacauaauggugaacaauaaaauacagugucuaagaggcauuacugcauaaaggaauaagacugauucuaaaaaaucacccaacuaaagggguuuuauaccuuuguuuggaguucaaacucauguaaaaggcuuggaauuggaugcugcagagggauguuauugcuaguguugggagaagagaggacagcacugaggaaggcuuccuggaagaugaagacuugaacuugaugacagaggagaguaggaauuggauggagggaucagagugcgugcagagggcaucuccucacgagagugugguguuugcaaaagcacagugggagaaaggugcccucccuuucugaaggacaucaaggagaucaguauguuugagaaagaguuuguggaagagccucaugggagacgaaaugcacaggcagcuccagauugccuagauccaugacauugguaggggacagggcagagacagggcagcgucacuuggaaggaucaggcucagagguucauggugugguuucuccaguaauguucuucagaggauguagcaccuugggaaaacucuccuucauuccucugagauucauaacuuuagaccagaaacuugcuuauagcuucaagcagucccuugcuuauuaauuuugaaacauuuuaucuuguacuacuacuuuuugcucuuccuaagcagggcaggguugccuugagcuaaacccaggaugcuuugaaaacaacauaaaacaccuugcaaauggcaauuuguccccucuauccugagucaaggaguaaccaaagggauauguuugaggcacagagaguaugaucugugggucacaccaugguaggccuaaacucuaguugauuaucccauugcaaaacuuccaugccucuaguaauuaaaugugcaaaugauaacaaccuuuuuuuuuuuuucugccaggggaauugaucccuaugacaaaccaaauaccaucuacauugaacgacaugaacccucuggcuacuccacugucuuccgaaguacagauuucuuccagucccgggaaaaccaggaagugauccuugaggaagugagagauuuucagcuucgggacaaguacauguuugcuacaaagguggugguaaguugaauguacuaaagaauaaacuacuuuugaguuuccuuugugaaguuuggcauucugugauuaaacaggugaguuugcauacacaggaauuggaaggaugugcuugggacagauugacugaagggaucucaacauugacaacauugacgaacauuccgaaagggcuuggcaggugcuaggaagucagaggaguggagaggccuaggacaaacacucaaaguggcucuaggcucuaggaauuugguuguuuccugguagccaagcauccuugacaaagacguauuucuuugaaaucccaaugaaaagaacaaagaauggagaggggaggguggcucaguggcuucuuuccuuuaaucccacugccugauuuccuuuaaacuuaugcugauuucuuugagauuuuucaacacaugucaauuuacauggcuaauaggauguguagucauuggcuagugggaguuaaugcucuaagaaaagcaguaauuaagcuuccagcugucaguaaguagcuuaacucucagccuuugggaaaaucuuccccuugauuugauguguuggagccagaugccgaaauggugggcuugcucauucaaaaccagaguugauuacuuaacaggacuugucuugaaauuguauugaguucagucuuuaucacccugguuguaaaggaaaaaaccaggcccagucaagggcagguggggcucuuauuucugggaggcuacuagcuugcuuuccugauggugcccuucccuuguugacucagggucuguugaaggccuuugcuaacugggagguuacucuguugucuuucacuguuaaccuuagagacugaaaucagacguaaucuuuuccuucagauucucauuuacuucuauaauugguagcaggccagguggaaguaggucaaccuucuuaguaggauuuuagggucaagagaggaucuccccagcaggaaaagcagggaguaaggacagaaugagaagagagauguggguggcuaaaggcuagaggcauuuccaguuacauaccuugcaaaauguucugaaaaaccauuagccuauggcaguuuuucuugucaggccauuugcauugacccauagacauugguucagugccuuccugccuugacuguuucuuuaucuuucucuuaaacacacaugcacaaauauguacagcagcccagaaacauaagcauccucgaauggcuuugggcagggauggggugaugggaacacacagauaagaaaucaggcccaagcacuggugccuugugacaucaguuggacagucuugaguuuucaguauggucuaaaaccuugucuucaguucuccaggguuuauaggccuuuucugccuuaaugccuugggccuggaguuauugugugauuuuaauucugaacucuaaaacacauugacugacugccugguuuguccuccuuuuugcuugaaccagggcaggauggauagcuguugugcauuucucuuaaccggguuauuucuaggugucacggucgagaguuuaaguuauaucccagcugggccgggcaugguggcucaugccuguaaucccagcacuuugggagucugagguggguggaucacuugaggucaguaguuugagacgagccuggucaacauggugaaaccccgucucuacuaaaaauacaaaaauuagucuggugugguggcacaugcuuguaaucccagcuacucggaaggccgaggcaggagaauugcuugaauuugggagguggagguugcagugagccaaaaucaugccauugcacuccaaucugagcaacagagcaagacucugucucaaaaaaaaaaaaaaguuauauucuagcuggagcuuucugugcccuccauucuagucuaacagcuaugucuguucuccagauguaucugauuuacagagugccuguggugaguuuuuaauuaaaccuggccagugguaagauuaggggucauguuuguuuugaucucaccgauacaguacccagugccuugcgcuauguuugauacgcagcagaugcgcaauagaguugaaugaaugccauguuugcccaccuaauuuaaaaaguagucaauuuuuagaaauuuggugggagacguauuaaauuuuugguacuuuuauaggcaauucuuaacucucuguauggcuuauuuauuuauaugcuguugguggcaaaauuguaguuaugagcuggcuccuccuucugcacauggaugagccaccagauuccagggucagugguauuagugagaggauguagguaagaugaguuaggccaccacugagagguguuucccaaauuguggucuuaggaguacccacgucagcaucaggcaaggacaguuguuacaagugcagauugcagggcucaaaugcacuuuuccccagaucaucccaagguugucuaacaaucaccaguuugagaaacucugcccugagccuucuacaggcagaugcuucaaaugacagaguuguacuacugucuagggaauauuucucaagggauggauugaugggaaaagaaacacaacuggcuguggauagcacacaaaauaugugcuuuccuccuuuuuauuacaucagacugcuaaacgacaaggauaaacaaaguuggccucggucagauaauccccucccaguaagaguguugaaaccugcaaguguaacuuuuuaucuggggucugccuagcucuaaggcugccugagcuugggaaauuccagcuggcuuuaguguuaaaugaauucaaaucaaauugggaaaaucaaagaacugauuuuaaagcuacagaaagcugguuuugcaugauuaacucuuuugcuuccuuccagcaccaugaaugauuacaguccuuugcaagcuacuguuucagcccccuggcuucuggacuggagcugguguccaggucuucagaaccuccugguacccuguuggccucgcucuggcuuuauaaugugcuuuguauuuuuugcccuuaaguugccuuguuuaauuuuuauuccuugcuuuuugacaugaaguucacuuauuugucuucauaguguacaucaaaaugauagggccauuaaagaaacaaugagguuccucugugauuuguuaauuugguaauauacaacuguuaggcucuuucaguagauaacaguaauugcugaaaagcuugaggugggucaggguuagcuacuccccuacaaccucacaaccucauaaccucacuaccagauuaagauuaucaugcaagccaggcccagauauuucuugcacaaauguguaucaguaagcaaagacaugaucuguggacuugaagucucuucugugaccuuacagaugaugcagccacccacgccuugcaugcugcagacgcuguguucuagaguggaugcuaggaaacuauggcccaccaccuguuuuuguaaaugaaguuuuacugggacacagccaugcucauugcuuauuuguggucuaagguugcuuucaugcccagugguagaguugcauagguaccuauacagaggcaauauggcuccaaaagccuaaaauaucuauuaucuggaccuuuacagauaguugucugacuuccuguaguugcugacuaugcugauaguugucuguuaccccuucaguuggcaucagguaacuggaaucgcaaugucuugacaggucccaggcauuauccagaaaaguauagguuaugggccucucuaaauuguuaugcccuguuaaugacaggaugguaucuuuagaauauuaugcccaauucaaguauuuugaugucacaccagucucccaagugaggguccauguguauuuucaugauucugacuaagcaaccacgaauuucacuauugaaaaccaauuuucaaccuuaagcuaauuugcucucuaauguugaucagagguaacagaacaguuuaguaacugcuacaggguguugugggcuucuagaugagaaaucagcugacaaaacuguguugugaauuauaggauaacugacccaaaccaaacuacuuauaaauuauuuuaacuauguuacuuaaauguauaagcacccaaugcuuauaacucucauacgugaucaauaaaacccagauauuuacagauuaaaaauaaaacuauaacaauacauuuaaaauuaauauuuguuacaacuguguugagauacaauucacauucugcaaaauuuacccuuuuuaagugugcaauuuagugguuuuuaguuuauucauaagguuauacaaugaucaucauuaccuaauuccaaauauuuuuaucaccucagaaagaaaccacauacccauuaccauuacuuccuucuccucccugaugcugguaaccacuaaccuaguaucuuuauggcuuuuucaauuuugggcaauuuguguaauggaaaucauacaauuugugacuuuauuaguccauuuucauacugcuaugaugaaaugcccgacacuggguuauuuauaaagaaaaagagguuuaauagacucacaguuccacauggcuggagaggccucacaaucaaggcggaaggugaaggaggagcaaaggcauggcuuacguggcggcaggcaagagagugugugcaggggaacugcccuuuauaaaaccaucagauuuugugagacuuauucauuaucaugagaacagcacaggaaaacccgcccccaugauucaguuaccucccaccaggucccucccaugacauguggggauuaugggagcuacaauucaagaugagauuuggguggggacacagccaaaccauaucagugaccuuuugugacugguuucuuucacaguauaauguuuucaaguuucauuuauguuguagcauguaucauuacuuuaaccauuuuuaauggcugacuaguauuguaaugaauauaacacauuuuauuuauccaucuauuaguugguggccauuuggcuugugucuacuguuuuacuguuacaaacagugcugcugugaauguucgugugcacguuugugugugaacuuauguuuuaauucuguuaguuuauaccugggaguguaacuacugggucaugugacaauucuuuuuuuuuuuuuuuuuuuuuuuuuuuuugagauggagucucacucugucgcucaggcuggagugcaguggugugaucucggcucacugcaagcuccgccuccuggguucaugccauucuccugucucagccucccgaguagcugggacuacaggugcccgccgccacaccuggcuaauuuuuuguauuuuuuaguagagacaggguuucacuguguuagccaggauggucucgaucucuuaaccucgugauccacccaccucggacucccaaagugcugggauuacaggcgugagccaccaugcccggccgacaauucuauguuuaacuuuucgagaaucggucaagugguuuuccaaaacuauuguaccauuuuauauucccaccagaaauguauuaggguguaguuuucccauauccuugucaacauuugcuacuguuuuuuggaugauagccaucccaguuaagugugaagugguaucuuaugguuuucauuugaauuccugauggcuaaggauguugaacaucuuuucacguggcuguuggccauuuguaugucuuucuuggauggaugucuauucaaguccuuuguccguuuuuaaauuggguucuuuuuuauuguugaguuauaauaguucuuuauucuauauauucuuuauauacaaguuauaugauuugcaaaucuuuucugccauuccgugguuuaucuuuuuacuuuuuucuuuuucagcacugaaguuuuuauuuuuauuuuauuuuuuugaguugggggucuuccucugucacccaggcuggaguacagcggagcgauuguggcucacugcagccgugaucuucgugugcucaagcaauccuccuaucucagccucccaaguagcugggaccacaggcaugugccaccauaccuguuaauuuuuuuauuuuuuguagagacgggguuucaucauguugcccaggcuggucucaaacuccugggcucaagcaguccucccaccuuggccucccaaaguguugggauuguaggcacgagccaccaugcccagccguguuuuuaauuuugaugaaguucaguuuauccauuuuuuuuugcugccugugcuguuguuauauccaagaaacuauugccuaaucugaggucaugaauauauacuucccuuuccuuuaagaguuauguaguuuuaguucuuacagucuaugauucauuuucaauuaauuuuuguaucuagugugaaauaguuauuuaccuucauucuuuugcauguggauaaccaguugucccaccaccauuuguugaaaaggcuauacuuuuuccuuggcaccuugguuggaaauuauuuucucauaaauaugagaauuuauuucuggacuccuucucucuuuuuuuuugagacaguuuugcugucaccuaggcuggaauauaguggcauggucauggcucacugcagcuuugaacucccaggcuuaaagguccuccugccccagccuccugaguagcugcaacugcaggcauucaccacugugccuggcuaaguuuuugaagagacagggucucacuauguugcccaggccacugcaccuggccuguuucuggacucuuaauucuauuccauuaaucuguauaucuaccccuaugccagcaucacacugucuugauuacuguaguucucuaauaaguuuugaauuuggaaaauuugaacucuccaacuuuguucuuuuucaagauuguauuggcuauucuggguuccuugcauuuccauguguauuuuaagaucagcuugucaauuuuuugccaaaacaaaacaaaaaccacagauaggauuuugauagagauugaucuacagauucaacacaauuuggagaguguuaucaucuuaauauaucaugccuuccaaugcauggacaaaggauauucuuccauuuauuuagguuuucuuuaauuucuuucaacuggguuuucugguuuucaguguacaagucccggacuucuuuaguuaaaauuuuuuuccuggcugggcgcgguggcucacgccuguaauaucagcacuuugggaggcugaggugggcggaucacgaggccaggaguucgagaccagccuggccaauauggcgaaaccccgucucuacuaaaaauacaaaaauuagcugggcgugguggagcgcaccuguaguccuagcuacucgggagacugaggccgaagaaucucuugaaccugggagguggagauugcagugagcugagaucgugccacugcacuccagccugggcgacagagcgagacucugucucaaaaaaaaaaauuuccuaaguauucuuuuuggcuccauuguaaaugguucuuuucuaaauuucauuuucagauuguucauugcuaauauauagaacaugauugauuuuuguauuauugaucuuauauucuacaaccuugcugaacuuuauuaguucuaacuuuuuugguguguggauuccuuaggauuuucuguuuacaagaugauguugucugcuaaaagagacaacaucauccuuuaauucuuccuuuucagucuggaggccuuuuauuuauuuauuuuuuugcccaacugccuuggguagaaccucuaguaaaauguugacuaggaguggagagaguaggcauccuugucuuauuccugaucuuaggggaaaugcauucagucuuauuaaguaugauuuuuaacugugagguuuuucuagauguccuuuaucaauuugaggaagguucccuucuauucauggguuguugaguguuuuuaucaugaaaaaaucugggauuuugucagugcuuuuucugugucaguugcaaugaucauauguuucuuuuuuuuccuccuuuagucuauuaacauugaauauuacacugauggaucuuucucauauguuaaaccaaugcacauuuuuggaaugaaucccacaugcucuugguuuauaaucauuuuuauccuuuaauuuguuuggcagaauuuaccaucuuugugggaaguuuucuggauacuaauucaaucuuuucaguuuuuaaaauuucucuuugguucaguuucagcaguuuguaucuuucuaguaauuuguucauuuauucuagguuauuuaauuuuuaauuauucauaguguucacacuaaucuuuuuuuuauuucugugagguuguuaaugauguuucuuauuucuuuccuaauuuuaguaauuugagucuucucuuuuuuucuugguaagucuagcuuguagucuaguuuauuaaauguuguuaaucuuuucaaagaaucaauauauuguuugaguaauuuucuuuauuauuuuucucuucucuauuucauuuauuccuacuguaaucuuuauauuucuuucauucugcuugcuuugggcuuaguuugcccuuauguuucuauguucuuaagguggauagucagguuauugauuugauauuuuucuucuuuuuuuauauaagugauuacagguauacauuuuccucuaaucacugcuuuagcugcauuucauaugcuuauguuuucauuuucauucaucuuaaaguauuuucuaaugauucuugugauuccuuuugacuucauugaugauuuuugaauguguuguuuaauuucaauauauuugugaauuuccuucacuuuuugguuucucauuuuauucuauuaugaucacagaauguacuuuauaugguuucaguucuuuuuaaauguauuggggccuauuuuaauacuuaacaucuguuauccuugagaauguggcugaacauguggaaugaaacaugugcuuugagaagaauguguauucugcuguuauuggguauuauguucuauaaguguuuauuaaaucuacuuggcugauggugauguucaguuuaucuuuuuccuuuucugccuuguucuauauugaaggugggaaaaucuucaacuguugaaaucuuuaaguauuaucaucuugauuauuuauuucucccuucaauucugucaguuuucccucaugugcuuuggaguucuguuguuaggugcauauauguuuaugauuguuaauucuucuagauugacacuuuuaucauuauuaaauguccuuccuugucucuaguaacuauuuuuugucuuaaauucuauuuugccuauuauuauagcuauucuuuucuucuggguacaguaaacaugguguauuaguccguuuucaugcugcugauaaagacauacccaacacugggcaauuuacaaaaaagguuuauaauggacuuacaguuccauguggcugggaagccucacaaucaugguggaaggcaagcaggagcaagucaugucuuacauggauggcagcaggcaaagagagcucaugcagggaaacuccuccuuuuuaaaaccaucagaucucaugagacuuauucacuaucaggagaacagugauaacacuaucauggaaaagaccugcccccaugguucaguuaccucccaccuggucccucccaugacaugugggaauucaagaugagauuuggguggggacacagccaaaccauaucacauggcauaucacuuuuucauccuuguaguuucaaucuauuuguaucuuugaauccuuguaaauagcauaugguugugucaggucuuuuaugcauucuuuuaauuucugccuuuugauuaggauguuuaauuuacuuacauuuaauguaauuacugaaagguagacuacauaucugcuauuuugcucuuugcuuucuauauuccugauaaauuuuuuuuggauccuuuauuacuucauuacugccuuuuuuuguauuaaauacagauuuucuagggugacauuuaaauucccuuguaccuucuuucacuaaauuuuucccagguguuuucuuaaucugugcuuuggggauuacaauaaauaucuuaauuuaugaaaucuaauuuggauuaauaacaauguaacuucaguaguguacaaaaucuuugucauuauauagcuuuauugugucccugcuuuugugcuauuauuguuucaucuuuauacucuuuaagcccaucagcacaguuuuagucuaauugaggacuccuuagaugagucauuuuucuuugcugcuuuccaagguucuuuaucuuuggcuuucagcaguuuuacuguggugugucuggguaugggucucugaguuuauccuuuuaggaauucauugagcugacuggauuuauguuuuuuaucaaauuuggggaguuuugggucauuauuucuucaaauauucuuucuccuuuauucucucaucucgucagugacuuugguaauguguaugucaggacacuugaugguguuuccugggucuuuuaggcuguuuauuuuuaacauucuuuuuuuuguugucagacugagacaucacaauugacaugucuuaaaguucacugcuuuuuuauuuuccugguucaaaucuucuguugaaccccucuacuaaauuuuucuuuuauuauacuuuucaacucccaaauuucuauuugcuuguuuuuaaaaaauauuucuauuucuuuauugauauucucuauuugaugaggcauuguucucauacuguccuuucauacuuuauacaugauuucuuuuaguccuuugaacauauuuauaauagcuuauuuaauuuuuuuuuuuacuuagucuaaugucugagcuuuuaaggacaauuucuacugacuacucuuuuuguuuguguauaggcuauacuuuguuguuucuuugcuuguccugugauuuuuuuuguugaaaacuggacauuuuaaauggugugguaccuccaaaccacugacaccccuuccucaggguuuuguguuguugcuguuuguuguugcuguuuuuguuguuguuguuauuguuguucagggaguuuccuguacugcuaucaaguuuguguucuuuauuguuuuugcuacugaauugucucguaauuuagcuuauuggucagcuaaugauaagacagagauuuucuuaaacucuuugaaccacuaagucucucagccuuugcuaauggccucuggguguguguuaggguauaccuucaaugcuuuugcaggcaguuuacaacucuguccuagccuucacuuccugcuuauguagagcuucaagauuagcuggagguaagagacuagaccccguucauuucuuucuugagcauacucacggcucuuaugugcuugaccuuguagagucccaggaauacucaucuagagcuuauuaaagccuccuaagggcaucuucuuccccauuuuuuccuuuuaagcuuuuuaguuagccucuuuuuaauucccaauugguaauacugucuucagaaguuacagugauaagccuuugcuaauuuuuauucacuauuuucaguaaaugccuuggcuggcuauaaggcugucuauaucaugaaccaagucaggcuauguaaagacaagagcugauaaugcagccuuccugugagcccccagacaggucaggcuuuuugggaacuccagaccuauucuguccucuccaguggcugccaggcugcuguuuuucacagcuauuguagaugugaggcuguggguuuccaaggcuaccacagagcuagagagagggggaugggauuagggcaaaugaaaacaucacaaagcuggcuauuuuugccaagauucagccauuguucuugaguaaaugugccuuggauuuuugcaacccuuuauuucauuugcagaauucugaaaaaguugauuuugaggauuuuugucaguguuuuucuugcuuuuauggauaaguauauuuuuagaguuccuagaaaugcuuccaauuaauauuaacuuuguaaacuuuauuauaggcauuuuccaaccuacacgaaagaacaguuaaugcugauaugaccuccccacgugcccucaccaacuucaauauuacuuaccuacauuugccaaccucuccuuagcuaucuacucacuacuuuuuuuucccccuggaauaucccagaugucagauuuuagcuauguuucauuuaugauuuuuuuuuuuuuuuuguaaacaacauuaagguggaugaggauguuuugcugaaccuuuguugcugcuccaagggaggaugugacccauggcucuggugcuucugaacuaguggcccugugcuuccccaugccuugggagggcuuaguucuuuacccauuuucucuagcugagcugccaugcaacuuucagugggauagcucauugcaguauccuuuggccuuuacuugauaagaauguccuuuauuuaguuccuuuacuccucuuuucuccuugauccuccguuucuuuuugcucuugacacaaucucaaauauaaauggaaauucagguuauucagauaccuagaugaauuuauuuauuuaauuauuuauuuuuuuucugagauggagucuugcucuguugccaggcuggagugcagcggcaugaucucggcucaccgcaaccuccgccuccuggguucaggugauucuccugucucagccucccgaguagcugggauuacaggcauacucuaccaugccuagcuaauuuuucuauuuuuaguagagacgggguuucaccaugucggccaggaugaucuugaucucuugaccucgugaucugcccaccucggccucccaaagugcugggauuacagguaugagccacugcacccagcagaauuuauuuuuaguuaucagaaaugaaaacacaaaauuaaaaaaaaucuucuuauaaauucucagacucuauaagauugaauuagauucaaauauuuaaaucauuucuacuaguugaugaaguuugugcauuuguggauguauuaguugguacaaccuuucaggagggcuauuucaugauagcuaucaaaaauacaaauuuugacuuaauaauucuucuaagacugcauccuaccaaugguauugugcaguucugaaaaaguaauaaauacaugcuuauuuauauguguguguguuuaagaauguuucuggaaauaacuaaagugcccaccaauagcuguuaaguggaaagaugucuaagauacauugccaaugauaaaauuuuaaauugugggacaguaagauacacuguuaauggaaaaaguuaaguaauacaacagcauuuauaucaugauccaaauuauaugugaaaaauuaaauugccucugucaguuuagaacuauauuagguugcugguaauagacuagaaauaaaaauugcuuaaccaagucaggaguuuaguuuucucccccuugcugccuggagguaggcugucuugggcugguauguugguguccugauguucuuggggauccagguuucugucuuaauguucugccauccugacuagugauuuccauucucaagauuaccucaugguucaagacauccauacuagccuucaaguccuuauugcaguuaagaagaauaaggaaagacagcaaguaggaccucuucccaccaauucugucuguuuaggcagccuucucagaaauccagcacgaaacuucuguuuuuaucucauugacuaguacuuagucacgugacuucccauaggugcaaaaaugguagagaagugcagucauuuauucuggguggugucagagucccacugcucaggaggaaagggauaauggguguuggggguagguguagcagugucugucacuauguacauaugcuugcaugugguggcacaguacauuucugaaaggaugcacaagagcuguuagccacugggcacucugcaggguagagugggaggagggauguggagaucagagcagagcuucugcauuuaccuuauacccaucugugcuguuggauauuuuccaugaguaugcuuugcuuuuuaauaauagugauaaaaaacaaaccaacccaaaaccuaugguuuauuaagaaaaaucucagagccuuacaauacaucuuauaaucacuagugugccauaguuuaauuguuaauauauuucuugguggaaguaaaacaauacaguaacucuuuaaaaauccauuaagaaugaaccugaauuguccagguuuaggaauaauucuccaagaagguagugggaucgaugcauuuugagauuuuuuuuuugaugauuguaguauucugugauuuuugcauuuaugagguaagacugaccugugaaauauauucuuaauacucaggccucccagcagcaaucguuaaguauuuuuaacuaaugaugggccugggugucauugagaaaucacucuuuuuaaaguuauacucacaguuggaagucguaaaaaacaaagcauaaaaauguauauuucauugauauguuccucuauauauucacaaaaauguauguguauaggcugacuuaaacuaaucaucugacauagccaugacauuuuaucaacuuaaugaaggcuuuuggaauuuauauguaacaauuuugcugggaacuguuuucuuauucaguuaauaugcuuuuacauuuuuaauagauccaucauuuccuacggcccuauguuuaguacaagcuauuaauaugguuuucagguuuccauuuuggugggcagucuuucguaccucucugccugauuucuuuaaaacaaacuacuuuuaaccauuuguucaguggugauuugaaugucugcugcucaaauggauuaaaaguaacuuugucuuuaucagcuggguccucacaguauuuauggggcauguuugagcacaggguacugaaucguuauauugcagauaaaauaaauggauauguuccuuacucuauaggaaguuaauaucuauaauaaacagcaaccuagucaaggauaagugaagccaaaguaaccccucuggcugggaaucccaacaucucaauauguuuaauagucauuuguaugauuauguccacaugaggguaugccucccugugucuuuccugauagauaugcaacauuugccuucagcuucuggccauguucuuuuagagcuggaagaaaccacacagaguuuuuauaauaguucuuauccuuuuuugagugguggacuuucuugagaaucugauaaaacguacggagccuccauagcaaaauaaaugaguguauauaaaaaaauuugcauauauguuuacaggguugcuggaccauuuaaacccaucuacagggaagucuugauccaaauaagcuucuccuuuuguauaugaauaaacugaaagcuagagagauuucuaucauuuucucaguugguagagcuagcucuuaaucuaugcuuuuauacacauuuccaagauucuugcugugacuuaaaaaucucuaaaaugcaaugugauguggucaacaucauguugaauacucuaccaaugaauauguauucuagcaaaagaccuuccucaaugagauuauucagagauggaaaaccagaaucaaugaagauucucucaagucuuggugcaaauuaaaaccuugugacuggagcauccuuguaaucuaaaaauaggaguagaaagaagaaaagaacauguuuugugugcaugguguguggcugaucucacccuuuagugguuugggggccguaggcuccucccugcguguuucuucagccucaucacacaauccucuuucuaucucuuacucuguugaaguguuggcagccuccaaaaaccuccucuaguccaaguucuaccaucauaccauuuccuuaucuaauauccauggagugucuagugucuguugcaaaccggguaucuaagaugaagcaguacaacccaaacugcccagugauggcagacauugcaaaaacaugaauuugcaaucacagucucuauuuuguguuuccaguagaacuggaagaaucugacucuucuauuuuuauuuuugcugcuuuugaaugacuguaauguggcaccauuaauuuuuuuuucuccucuuccuuggcagcaucucuugggcagugaacagcagucuucuguccagcucugggucuccuuuggccggaagcccaugagagcagcccaguuugucacaagacauccuauuaaugugaguggggucugcuugaggaugggaagaaguaucauugucuuuaugcagaggucagaggaagguuguugcagggauggccugcuggaguggauauuuuauggcgccucccugaagucaggucucuagagagugcagcuaugcuuugggcaucguggucugugguucccacuucacugaagcagagcugaacgagagacuuaguuugcuuuaaguggagcagcacuggcagagagagguucgagccagagucagugccaucugagcaacgugccaguacugaagcaaugggaaguuugugcaugauaggaucuuuuuuuauuaaguaacugcuggauugcuugcaggggaugaauuccagcagaggauaggauuugggucccaccuuuuagaaacaggcuggagagacuaaaaacugaguagcagaagaaaccagacauaagcaaaugcuuaaauaugcagcuuuauaacaugaagauggauaggaaaagucugcaugggaugggucauuagaggagcugccacagggagacggucacagugaaacgucuugacauuggcaggugguuuggugaaagguaaguagcucacuuacuuaccuuccaccaaaugagugggaucauacggagaacagucaugccaguccuuugcuaguuucuauggauucugcuuuccuuuggucaccuuaggaaaaauaaagggaagugcauuaacccguauuguacuuuguacgaaugaaaguucucaugggaaaaugagggagacauuauuaacggaaagagguuuguaggucauuugugcagugcaguggcccauuauuuugugccccauuugccaguaaggggcccgcuaagcugcagaucugccucagguucuccaaagggaaagucgccaaagcuucuuugccaagguuagggagcuucccgugggcuuuaggccaacauucaucgcuagaacauuugaaagucauugcuuccguguguauaguaaaagcccacagggcacauuuguuuuuugacguaucuuuuuugacuuuugauuccaaaggaauauuacaucgcagaugccuccgaggaccagguguuugugugugucagccacaguaacaaccgcaccaauuuauacaucucagaggcagaggggcugaaguucucccuguccuuggagaacgugcucuauuacagcccaggaggggccggcagugacaccuuggugagguaaggagacugugaguccuucuccugccuucuuaggccaacacaaccauuagcuucucucugguucugugguuuucaacauuagcugcccauguggauacacccggggagcuuucggaaacccgaugccuggcucacgugcgcagagaucaccaugggauggguuugggguguggccagguuaugaggaucuuaagaagcgcccuaggugauucuuacgugcagccaagucugagaacuacagcucuagguaacauuuaggguccgagcuacuguguuaaucacuuccuugagcugcuuuuguucaguuuucugguuuugugguuucugagcagugaaaaacagcacuugguaaauaucagucagugagagcuggcauaugcggccaguggaucagguuaauugaugucauuacucuuuuuaagagauaaucggacgguguuuuguaaagaaaggcaccaacgucauugauccuuugucuguaaaucauguguuuagagcuguuuuguaguccagcagugggcggucucggagcaccacacccaucaaggggugguggaggaguuggggguuugggagggaugaauugguucuuaagauccguucagggccauuuauucugauuugucguuugacaaccagacuugugugaccuguguggcugugguuagaguccccucugcucuuggaaagagucucccgugugaagcugacuggucugggguggggucuggcucuccagccaugacaaccaggucugagggcaugccccugugcccacuguuucugggcaauucauuccguugucaguuuauucacagguaugcugcugcucucugccagacaguguucuagguauagccacaaaguaauguaugaagcaauaaaauaucagaacaaagucccucuuccauggaguuuguauucuaguuggggaagauagaauauaagcaaauaugugaucugccugguaacauguugaaaagaagaauaaagcaagaucaggggauggggauuugcaacgguguucuuuuauucuauuggcugcuucaggagggggacauuuaagcaggugccugaauuacaugagggaaggaaccaggcagaccccugggggaguagcgcugcaagcagggcagacaggaagcacagugacucugaggcuggacugcacugguguuuuaggagcagggaggaggccaggguggcuggaagggcugcagagagggagagagaaggaagaaacaggaccuaagagagcagggcucagauccuauagggccuucaggggcuugugaagaacuuuguuuuuuucuuuuuuguuguuuuuguuuguuuguuuguuuuugagauggagucucgcucugucgcccaggcuggagugcaguggugcaaucuugggucacugcaaccgccgcuuccuggguucaagugauucuccugccuuagccucaaaaguagcugggauuacaggugugcaccaccaggccaggcuaauuuuuauauuuuuaguagagacagcaccauguuggccaggcugaucucaaacuccugaccucaagugaucugcccgccuuggacucccaaagugcugggauuacagauaugagccaacacacucaauccugucuuuuccuucgaaaugagauggaagguuuagaccaggagauggacaugaucugauuuaaccuuucaauuuuuuuccguuaaaaucugugaauugcauuauauaaugaaaagaauauaacacauaaauggauaguguucuaaauaauuauaagugagcacucauguggcuuaucuuuuacaggaguuauccucaaugcugugugggaauuugacuacugugacuacuguaggggacaaaggugggaacaggaagacuaguugugaaaguauugcagagauacaggccaguagggauggauguuggcuggacccaggguggucacacuagagacgcuggaaauggucagacccuaaauauauuuugaaaguagagccaaugggauuuguugauagaugggacgagggguacgaaaggaggaggagccaggggacugcuacugcuucacccgagcugccuuuaaagagauggccacacagggagucagggagagcuggggcaggggcaauauuggggggagaucaccagcuugguuugggacuuaccugguuggagaggccuauuggauauccaugugcccagccuucuaccuggccucugacagugcuuuuccacuuccuguuucuucucuuuuggaggugcugucaucuuuuauuccuuuccuccccugacauagacucauggauuaauuauuauuuaauguguuauaaaccauuccugccaugauacauuuugaugcucagcuuguccugguuuggucaguggcggacccuaccuccuucuguuugguucuugucguuuuuuauugaaaaaauuauuuacuggccgggcaugguggcucacgccuguaaacccagcacuuugggaggccaagauggguagaucacgagguuaggagaucgagaccaucuuggcuaauguggugaaagcccaucucuacuaaaaauacaaaaauuagcugggcgugguggcacguaccuauagucccagcuacuugggaggcugaggcaggagaaaugcuugaaccugggagguagaggaugcagugagccaagaucgugcuacugcacuucagccugggcgacagagcgagacucugucucaaaaaaaaaaaauuauuuauugaggugaaauguauauaacaucagcuuaacuguuuuaaagugggcaauucaguggcauucaauacauuuacaauguugugccaccgccaccucuguuuaauuucauggccuucucauuucuccaaaagagaaccccaugcccauuaagccgcuucucuccaccguccccuucucccagccccuggcagccgucagucugauuucugugucuguggauuuuucccuauuuuacaggauguuucauauaaauggaaucauacaauaauaugugaccuucugugucuggcuucuuucacuuagccuaauguuuucaagguucauccgugaguaccauauaucagugccucauucauuuuaaugggugaauaauauucuccuuuuaaaaauaauuaaaauaaugaaucacuaucccucagaccuuucacugacucuuuaauuuuucuuuuuucaccauugaaagccccuggcuguggaauggaaaagucacagcuugcuaaauauuuucucgucuuccucauuugucagauauucagggugaauguuucaugcugggacagaguaugagccagaagccagagcgauggcccuuuacagagucaugaaggccuccccuccuugccugagcgcacaguccagugaagaaacuggaaauagauucacgucaagagucauaggccaacgucccacucaguuuucucauuguucucagauuuuaucugaggacuagagagguuccauuauacucaguugagugauguuuugucaucugcaucucaaucucagccaggugaaaugggauaaaggugaauuagcacaucgugugggcaggcugguuuagaguaaacugcuaugugaaaugagcaagucuuugaacugaauaggaaagaguggugucugggaacugcuucugauuuacucagagacauggagaaagagcucuuucuagggaaugacccuggcccuggugggaugugccaggugggagucucauggaaagcacuagcuagauguuggaugcuuuggaggaacuaaugugcugaggagaugucagccccgugggucaccuuagggaggggcaugggcccaguugguggggguauugccagggcauggauucugcacugaguggggcuauaggggaccuggugagcuuccugguaagccuuggcccagggcacucugggaagaaggggagaagugcccuggggagggccagugaggauaaaauggaagaaaguagacccucagagaaaguacuuaggguggggcagauuguugcagggcaggucaagugggggaaaggaaaggaugggcugggacuucuggugaaggagcaugugagguacaggaagacaggcuucugcuuagaaguaaaagauaaaacuccaggaauccgacucgggaaagaaacagggcucaucuaaaugagagaaacucaggccucccagauaucuagaagaagcccauaaccagugggaugacagguuuaugaugauaacccucagagagguagagcagaggucagcagagaaggaggaaucgagaccuucagcugguuccuaaggaagccccugaaaaauaacugaacuagaccuaaggaaaccacaugucagagaauuuggucucaacuccagcauuucauucggcacucugcucagucccucagccugaagcugcuuugguggggcuccuaguguuccuuuuccugccucagagguuguuguuugggucuuucugucugagguggcagggcagucauccagcugaagagauuguguggagaugguugauggaggacagcguuucucggcuuuauuguguagccgguggcuuagaaccccugaaguaaagggcaagcuuccagucuuuuuucuuuuucuuuuuuuuuuuuuuugaguuggagucucgcucugucaccaggcuggagugcaguggcacgaucucagcucacugcaaccuccgccucccggguucaagcgauucuccugccucagccucccaaguagcugggacuacaggcacgugccaccaugcccagcuaauuuuuguauuauuaauagagaugggguuucacuauguuggccaggauggucucgaucucuugaccuugugaucugcccccuucagccucccaaagugcugggauuacaggugugagccaccaugcccggccaagcuuccagucuuaacagccaccuaugaacccugguuacaauuucucagagauccgcucuauuuguaaugcguguaucauuuuagcgcaaaaccacuucccuguggcuguggcaucaggguauccgcaugguagauaaagccugggaaacccauauucucucucucuuuuuuuuuuuuugagacggagucucgcucugucgcccaggcugguuggagugcaguggcgcgaucucggcucacugcaagcuccgcgucccggguucaugccguccauauucucuuaagaauauaaccccaagcuuucuagagccauccuugcuauauguacaguuucuuuaggaaagaaucgacagguucugcugagcuuccugacagaaaacccugugggcuucuaucugaucaggguguuggauaauuagguuguaaguaccuggagaggggcuguguaacccugagcuagguuccuacagauuggguugaauuuuaagccucagcacuguuauuaaugucuugcaagucugacuuaaugauuucuguuuuugaaggcucacuggaggauuuggagucaauuucguuagugauguaauagaugugacucuuucgucaacuuuuguauguuauauucaucauucuaaacccccuguuaggaauuguuggucagacaagccuuuugacccuaaaaguugaaaagaaacaaauuuuuuaaaauagcagauuaucuggcuggacaugguggcucaugccuguaaucccagcacuuugggaggccaaggcaggugcaucacuugagcugaggaguucaagaccagccucggcaacauggcgaaaccccaucucuaccaaaaaauaaaaaaaauuagcugggcauaguggcacacaccuguagucccagcuacuugggaggcugaggugugaggaucauugaggaucaucugagucugggagguugaggcugcagugagccaugauugcaccacugcacuccugccugggcagcaguaagacugucuccaaaaaaaaaggaaugaaguucuaacaaugugcuauaauguggaugaaccuugaaagcauuaugcuaagugaaaguaaccagauacaaaagaccacauauugcagauuccauuuauaugaaaugucuagauaggccaauucauaaacacauggagcagaugagugguuuccagggcuugggaagggaagaggaaauggagagugacugccaguggguaugagguuuccuuuuggaaugaugaaauguucuggaacuagauaguaaugauaguugcacaacauugugaaugugcuuaaugccacaaaauuguauacuuuuaaauggucaaauuuuauguuauuuacaauaacaagcaaauaccaauucagguucauagcuguuuauuuucauauuguagguauuuugcaaaugaaccauuugcugacuuccaccgaguggaaggauugcaaggagucuacauugcuacucugauuaaugguucuaugaaugaggagaacaugagaucggucaucaccuuugacaaagggggaaccugggaguuucuucaggcuccagccuucacgggauauggagagaaaaucaauugugagguauugaugcuuuaaucuucuuuugcuuuuuaauauaaaggaaagagcccugcucugugguaguuuccuaugucuaguauuuauugaaaaaauacaagaucacaugguauucuauuaauaucacauggagcagacuucuauuuguguugcuacacuugcaguucccaaacucugcuccaaggucuugcuaccacuucugggcagaagcaacucagaaaaaaaaaaaaaaaaguaguauucguuuuuaguacuacuuguuuaguuagaccauuacuuggucuuuuggauuuuugaauuuuguuuguccauggugggcuauguggacacuccccuauauaauguaucuguggcccuugggaaaauucuuuuggagacucuuaccuuagaauuuacuucuugguuuuucuucucuauuuggcaaugggucuuggcuuaccacaucaaaucuaauuuuggaaagaggcagccuauaaauggauauagacaaauaucuggguacuuccucuucccucaauagugucuucuacagcagcuuggugagauccugggauaguuggggcuuggguguuuuugagcgugcugugggggucaggcuuuaguuaaaucgaauuaaugguaucauucaaauucagcuuucuguuucccugacuaaucaguuuauuuaugaacugucguucaucagcuuuagguauagguuucuucuucugaguuuaggugguggaaggaauguauaggaaauggguaagucugauuaccugagguuacagaaacucuucaaugaauagacuuccuugcaggcagagaagcaugagucagaaagaggagugagcaaauaaauauuucuuugagacccagccuaauuuguuccaguuuucauuggucaaacugagacucuagcaagacagauacuuguuagagauccuuuuaugacaaaaauaaguagcaaauaauccagcaaaccuugcuaccauuuuuaccugaccauaaccacauaagcacauaguccuccugugcagaacccuggccacaucugaguaacauugaacaagcucuuucugaccaggagaacugagugugaccauauggcaaaggguguuguccugauugcuugcagagcuaugaaaaucuggacaugagugauggaggccagacugaaucgcuugaagccuugcccuguauaccuacaccuuugugcaaauguaaaauacauaggaaaaaauuuagugcuaauccuuugcuuuuuauaucucauugauacuguacaucaggggagcuuuuccaugagacuuaugacuucugauucuuggucuuucuuaugacagaauugcuggaaucauguuugaaauaugucucugacuuagaaagugaauaugacaaaaucauuucauuucucuuuaguucugagucacuugagaggaucucugagugauaggaugagaugaugacuuucccaucuacuugaguugacacugauuucuaauuguuauucccugagagucucagaaggccuuuuuaaguuguaauuguucucuucuuccacgggacauuuauguggguucagaugauccucucugucugggggguguggggacagcugggcugugagucugguuuccccugggccaggccuccuugccccgugucagcugcacuccccucacacaggccgcaggguuuacagggaacgcuaggcaugguaucaugugcugacacugccugaaacuuugguuguauagcuuucccagggcuguucccuucaucuggcucagcgccucagucagcuccucaaccuccagcuccggagaaugcccauccuguccaaggagucggcuccaggccucaucaucgccacugguaagugugcuugccuguucucaaaagggguucagcugucuggugaugugcaggccaaaugcagagcgaucacccacaccuccagcaguaaccacgcuuugugguuugaaagcauucuuaguugcuagauacuacgcagaauuucuggcugggcaaggugauuaucugacauauucuugaaauuaaaaauaauuauuucucuugcauuuuaggcucagugggaaagaacuuggcuagcaagacaaacguguacaucucuagcagugcuggagccagguggcgagaggucagcccccucccccaaucccguccccuccacccucauucccauuugugugagaauguagacugugccuuggcauuucagggacacaaaugguccauggcagagaccaguaaugccagauaugacuauaaaguaaagaaagguaccugaagccacugauuuauauccacaguuacuuuaaauuaaacacagaccuuugcaaaugugugaauuuuacugaacauucuaagauuaugaguucuaugagggcaaagacaaugucuguuuuacugacuucuuuauccuuaggaccuaagagugccuggcauggagugggggcucagggcauauaugcugcauguaucagcaaauuauagcguagugguauuagcccugaaaugggcugcuauuauuauuauuauuuuguauauuauugaaguugagaugaagccuguccuugcugggcuauguuguauaggcacuuucgucucacucugugcuauggaaguagacucucuuuuugccuuaagguuguauaacuaauaucgaugcugauuauaccaauuccuaagacagggcuaguucccuaguuccaaaaugcuaauucaucuucaucuuugggcauuagagaauuuccaaacuuguaaaaaaaaaaaaaaguuguugccagccucccauugauuaaggccaaggaagugcguuuggucucguucuguagggguugcuuucaggggugacccucuaguuaugccaggagccaccaggguaaaacccaacagaucacuugacaggaugagcaccuugucaucgagcagccccgcaggcugggcagccggaacagcacgucgggagugauguggaguucucagaacagcuagcagacauaguucccauccacguggugcuuuacugggaaugcaccaugcucaccuugauauuugaauagguaauauguaaagcaguaauaaaaauaccaacauucauuuggcaccuugcaguucacagaggccugucacaagccuucucucacuguggcagggcuucccaucccucccgaggagagagaugaggcucagacacuguguacuguauguggugaacgcaaauauguguucagaugaggcagauuguuaaggccauuguagucagagugcaaacaguuugaauggaaauuuucggguuguccuugugcagcucccaagggaagauuaagcagcugcuuuccccuuucguggagcuggacgcucccuuugaaaugggguauccucuucucugcgaauaggccugugguuuguuugugccuucugcuguugguguaaucugggauuugcacaucugcaagugauuuccuucuggguagaaagcagugucuuguuccuccuccagugaagugguaucgucuggugauuaccggggcagcugucagugccucccuccacacgugccuugucccugccaagaagcaaccagugcauaagagaccuuauuuugggacauagcagaaaacuaacuuggggaugaaaagauugugaguuuaucugugugagugggcaucugaguccccaugggcagccuucacuuuagagggacaaucugggcugugugcaggagcaggugguggcagaggaagaggcuguaguggacagaauguugccuggagcacugaugacuguaauugugguuuucuuuuuccuccuaauuaguugugcaaauucucugauccucagaauuccuuuuuuugugcuuuuuucucuuuuuaaauaauuuuuauuucuuuuauuuuuagcuuuuuucuuuaucaacuuuauugaagcagaugaaggcacaguacacugcacauauuuaaaguguacaguuugaucagaauuaauuauggucaccacaauuaagauaacaaacauuuccaucugcaaauucucugauccucagaauuccguuuuugugcuuuuuuucuuuuuaaaauaauuuuuauuucuuuuauuuuuagcuuuuuucuguaacaaauuuauugaagcagauaaggggacaguacacugcacauauuuaaaguguacaguuugaucagaauuaauuauggucgccacaauuaagauaacaaacauuuccaucacccuccccgagguaucuuugugccccucgguaauccaucccacucuccagucuuguccuugucugcuucuguuauucauuggcauuuucuagaauagguuauucauuggcauuuucuagaauuuugauaaguggacucacacaguauauacucuuuuugccuggcuucugucacacaucacgaugauuuuggguuucauccaaguugcuuuguguaucaauuguucauuccuuugcuaguuguaucccauuguagggauauaucauaauuuauuuauucauucaucuguugauaaacauuccaguuuugcugauuacaaauauagcuguuaugaacauucauguacauauuuuauucauuucucuaggguaaauacuuaggaauggaauagcuggguagcaugguggguauauguuuaacuuuuuaaagaacugccaaauuauugucccuuuuacauuuccaccaaacaguaugugagaauuuuaauugcuucacaucuuugccaacacuugguaugauuagucuuuuuaauuuuagacauuuuaauaagcaugugauaauaucucauuguaguuguaauuggcauuugugugauuauuaaugauucuuuucaugugcucauuggccauuuuaaaaucugguugugaaguaucugcccaaaucuuuugccuuuuugaaaaaauuggguugguccagcacaguggcucugccuauaaucccagcacuucggacggcugagguaagaggguugcuggagccaugggcaacauagggaaagcuugucucuacaaaaaauaaaaauagccaggcaugguggugcaugccuguaguccuagcuaguuaggaggcugaggucagaaggucacaugagcccuggugguugaagguguagugagcugugauugugcugcugcauuccagccugggcaauggaaucagagccugucucaauaaauauauaaauaaauuuuaaaaacuaauuuuaauaauugaguugucuaucuucuuugaguuguaggaguuuuuuuaaaaauauauuuuggauucaggucuuuuguaugauauauggguagauacucauuuuuuccauauggagaucuaauugauuuagcaccauuuauugaaaacccuucucucucucccauugaauugccuugguaccuguuugaaaaucaauuggccauauaugggccaauuuuaggccaauugggucuauuucaggucuuuauucugucccauuaaucugucugucuuuucacuaauaccaaauuaucuuaauuuccaaagccuuauaguaaauguugagaucaaguaggguaaguccuucaacuuugauuauuuuaaaaaucuuuuuuuauuauuguaggucguucguauuuccugauacauuucaggaucacuugucaauuucuauggaaucugcugggauuuuuauuauaauugccuugaauuuauagaaucaguuuggaggagaaucgacauguuaauacuauugagucuucugauccaugaauguaguaucuuuuuccauuucuuguucaauuucucucaguacuuuguaguuuccaauguagagguccuguacaucuuuuauuagcuuuauuccuagguauuuuaauuuuuugugguauuacuguaaauggaauuuuauuuucuaauuuuugcucuaguauauaaaaauacaacugauuuuuuauauauucaucuuguauucugugaccuugcuaagguaauucauuaguucuaguagguuuuuagauucuauguaagcaaucauaccauuugcaaagagugacaguuuuauuucuuccuuucugaucuuaaugucuuuuauguauucucucauucuucucuucuuccuuuuucucuucuuucuuguccuucuuucuucucuuucccuccuuuccuccauuuucucccuucugauuucuuucauucuucuuaucacaauggcuaggaccucuauacaguauugaauagaaguagugaaagugggcauucuugccuuguucucucucugggggaaacaauucaaccuuuuuaccauuaacuaugguguuagcaguagauuucuuuaucaacauuugggaagcucccuauuaucacuaguuguugaguauuuuuuuuuuuaucauaaucagauacuggauuuugugaaaugcuauuuuuacauuuauuaaaaugauuuuuuucuauuacuaugaugauuaaauauuacauuaauuaauucuugaauauuagaacaaccuggaauuacuaggacaaacucuacuuggucauaaugcauuauucuuuuuaugugcagcuagguuugauuugcuaauauuuuguuaaagauuuuugcauuauuugugagagauacuugucuuuaauuuguuuuuuuuuguaaaaucuuucuaaaguuuugauauuaguguuuggcuaguaucauaaaacaagcagagggguaaaccccucuuccucuuuuuuaggacaaaguuugguguuauuuuuucuugaguaauucccuaaugaaacuguccaggcauugaguuuucuuuuugggaauauuuuuugauaagagauuuaauuucucugguugauacaaggcuauucagauuuucuucuuuuuguuucaauuuugaugaguuguguguuucaagaaauuugucccuucauguaaguugugacauuuguuggccuuauguuaucaaugauauauucucuuuaucuuuuuaaugucuguaggaucuuuggugaugauuucauucuugauauuggugauauguguauuuucucuauuuuucguucguuuagguguuucaauacuguugaucuuuccaaagaaucugcuuuuggcucuuguugauuuucuauugucuguuuucuguuuuguugcuuuuuuucuuuauuauuauuuuuucccuuauuuguuuuguuguucuuuuuguagcuuauuaagauauaaccuuggguuauugauuuuauaucuucuuuucuaauguaagcauuuaaagcuguaaguuuuccuuuaaguacuaauuuagcuauaugccacauauuuagauauguuuuuaguguuuuuaaguucagaguauauuuaaugucccccuuuaaaacugagauauaggcugcacacaguggcucauaccuguaaucccagcacuuaggaagaccaaggcaggaggaucacuugagaccaggaguucaagaccagcccaggcaccauagcaaaacuuugucucuacaaaaaauaaaaaaauuaacugggcauaccugugaucccaguuacucugggggcugaggugggaggcucacuugagcccaggaggucaagguugcagugagcugugauugugucagugcacuccagccugggugacagagcaagaccgggucucaaaaaaauaaaaaaacagauaaaauugagauguaauucacauauuauaaaguucaccauuuuaaaguguacaguucauauguuuuuaguauuauucagucaucaucauuaucugauuccagaacauuuucaucaauccauaaauaucucuugauuuuuaucuucgaaugauaaguuacuuagcaaaguguuauuuaauuugcagguauuuggggguuucauagauaucuuguuauugauuucuaauuuaauuuccuauagucagagaagacacuuuguaugauuucagucccuuuagauuuguugagauuuauuuugagauccagccuguggucuauauuguugaauauaucacgugcacugggaaggaauauguauuaagcaguuguuugagguaguguucuguagauauuauuuauaugaaggugguugauaauguuguucagaucuuuuguguucauauugauuuuuggggguucuaguucucuaaauuccuaagagaggaaugguaagaucuccuacuaugauucugaaauugccucuugcuccuuuaaauucuaucaauuuuugcuuuauuuugguaugcauuuugagucucuguuguuaaguguauucacauuuauaauaauauuuucucaugaauugucccuuuuaucauuaugaacuaucucucuuuaucuauuguaaugccaugugucuuaaaaucuauuuuaucugauauuaaaauaguuacuguagccuucuucuguuuacuauuuggauauuacaucuuuuuuugaguuggugucuuacucugucacccaggcuggagugcaaugguaugaucucggcucacugagaccucgaccuccuggguucaagugauucuccugccucagccucccgaguagcugggauuucaggcgcucaccaccacacccggcuaauuuuuguauuucuaauagagacgggguuucgccauguugguuagguuggucuugaacuccugaccucaagugauccacccaccuuggccucccaaagugcugggguuacaggugugagauaccacgcccagcccuggauaguacaucuuuuaacauccauucgcuuucaaccuauauaugucuuuauauuuaaaguguuuuuuuuuucucuuuuuugaaguugggucuuguguguuguccaggcuggucuuaaacuccuggguucaagugauccugccaaauaguuggacuuaaaggcacaugccaccaugcccaguucuuugaaguguuucuucuagacaacauauaguagggucuugcuuuuuuacucauucugccaagcucugcuuuuuaacugaaaugcuuaggccauuaacauuuaauauaauuauugauguauuugaauuuaggccuaauauuucauuuauuuucuuuucauuucuccuauuuauuauuccucuguuccuucuguccucucuccuuuuguauuaucuagauacauuaaguauucuacuuuuauuuagauuuuuuggggggcuuaucuauguguauuucuagugacuucucuaaggauuacaacauacauaucuaaucuuuuauagucuucuuugaguugauaauugcacuuaacguaaaauuuagaacccuuucaaccauacaagucccuuuucuccucccccaccuauauguuauuuucauauuuaucacaucaacacacauuacaaaacccacaaagcaguguuuguuuuugcuucaaauuaucauaugaauuucaaagaacuuaaauauuuacccagauauuuaccauuucucuugcuugcucuucguucuggaaaaaucucuguuuacccaugggaaauuucccuauagccuaaagaaauuccuauagcauuuccuguagcgagaucuguuggcugugaauucucuuguuuuucccucuuuugaaauuucuguuuuauuuaccuucauuccugaaggauauguuuauuggauagagaauucuggguugacaguaauuuucuuccaguacuuuaaagaugucuacuguuuucuuguuuccguggguucugaugagaaaccucucuucacuuuagcuaucauucuccuguguguaacaugccauuuuucucuagaugcuuuggagauuuuuuuuucauugguuuucagcaguuuugguaugaugugucuaggagggcuuuucuuugaguuuauucucuauguagaugcugauuuugaaucuauauuuauaucuuucaacaaauuugggaaauuuucagccauuauuucuucaaauauuuuuuuucugcucccaucccuuucuccuguucuucucggacuccaguuacauauuagaccuacuguuauuguuccuuguguccuuggcaaucuuucuuucuuugaaauccuuuuuccccuguauguucucuagaacacacagauagaucuguaauuucuacagaucuauauuuauuuugaaguucacuaauuccuuugucauugcuuuucugauguugagcccaucaguaaauuucuuauuucggacauuauauuuuucuguuauaaaauuuguuugguuucuuuuuaaaaauuguuuccacuucucugggagaauucuuuucucucauucauuucacguguauuuuucuuucccucaugggacaugguuauaauagcuauuuuaaaauuccagccagguaugguggcucaugccuauaaucccagcacuuugggaggccgaggcagguggaagcacuugaggucaggagcucgagaccagccugaccaacauggugaaacccugucuguacuaaaauuauaaaaaugagcugggcgugguggugcaugccuguaaucccagcuacuugggagguugaagcaggagaaucacuugaacccaggaggcagagguugcagugagcugagauugcaccacugcacuccagccugggcaacagagugagaauuugucucaaaaaauaaaaaauuaaaaaaauauuccaauauaugggucacuugggauuggcaccuuuugacuaucuuuuccuuugagaauuggacacaucuuauggauauguuuguaugcuguauguuaaguaauuuugguuuguauucugcacauaugaaugaaauucaugaaauuaagccuucuggaggauauugauauuuuugucucagcauguaaucagccuguuuagguucugacccugaguucugucuugcuuucuguaggugguaguuuaacucucaguucaguaugcuaagccuuuguuacacugguuugugucuguuucaugcacguacacuucagggguuaggcugcgacuugcguaaguucauauacaaaauuaggggauuuacuuuuuugacacucucugcuaugggauuccauccacacuuuaccuacccuauaggggcuccuuucucugguuccuuugggggaaauaauaucuauugcaguuuuagcugugacugagacugaggugcaccccaugacugggacuuuuccuucgggcaaagcuuuaccaggauauucaugacuuguguguguagcuucucuagguuuuaaaucuccacaagcggcuugcuuucguuuacuuuucagcauccacugguaguuguuuuuuguccagaguuuucagcuguaauuagcaggaaggaugggcuauagagggcuaauacugucauaguagaacugaaaccccaguuacuuaauuuuuaaucaaggguuggugggagucauagauuuggauuugaguccuaccucugcuguucacagucuaccauuuuaauauuaagcccguguuucuucauuugggaaaaaaauugagauacuagaacuugcuccaccugucccuaggauuguguggaacagaugagauaauggaugucaaugucuucuguaaacggaaaaauuguuuucaagugguugucauugcuguuaugucuaugugcacgugugugcaugccugugggcauguguacaugguuucugcacaauuaccuccacagcaguggugucaccauggauuuuuccucuucaggcacuuccuggaccucacuacuacacauggggagaccacggcggaaucaucacggcuauugcccagggcauggaaaccaacgagcuaaaguaagugucucugaugaggccuuuuaacaucaaacuuucucccagaaauuuacgucugugauuauaauuggauuaucucucuauagcacuauguuguugacagcacaauuugugaucucuggauaugaguuaaacuuuuuuuuuuuuuuuugagauggagucuugcucucucccccaggcaggaauacaauggugcgaucucagcucacugcaaccuccaccuccuggguugaagcgauucuccugccucagccuccugagucugggauuacaggcaccugccaccacguccggcuaauuuuuguaauuuuaguagagacacgguuuuaccauguugaucaggcuagucucgaaccccugaccucaggugauccaccugcuucggccucccaaaaugcuuggauuacaggugugagccacugugcccaccccgauuuaaacucuuuaucucccaaaugggaauauaagaaccuguccuuucuaucacaaagggagauugugagcaagagggcaauuaauaauaauggccaaauaauuaaguggaggcucuuuaauuuguccuucuuugcuuugugucuuuauuacauagaaagacuaauaauaaauagcaauaauaauaauaauaauacaucaguaacaauuacagaaugcauacaacuugauagccauugacuuuuggugcguuagguugguggggggucucauggagcuggaagggguguuuaggguuaacugcaucauuucacagaugagaaaacaggcucagcaaggcaaaguaacuugcccagggucauucccuuuguuagugacagagacaggauuagcacuuggguuuuucgauugcguccuacauucuuugcaauauauuguucugaaaagcaaaacugucaagaguuuguaaccucuacacccuuauguucugauuuuaucagaaccaguccucugauuaccuuuggcucguuucugaaugguucauguuaggucaaguucaugcuggaccacacuucucccuguuuuugagcugaacccauuagauggauuggugaaggaucuggagagggcuucuguaacucucuuguuuauugcaaggacaaagcuuucuuuuucuuugcuccuuuuagaaacggggccagcaguaagugagaggugggugguuuggaaaaagagaucuuagcagcuguuuuuuuuucccugugguuaauuugacaugugcugagcagccuggccucagagaaggagagagaagcaaaguacugguguuuggcauuccaccuggcuguucucuguucuguguagcacugguuagcuauuucuuuagaggugauacuccgaagagguccuguuugugugcaacacucuguauucauauucagauugguguuugcucagacaacgaccaucacagagcacaguacuucccacauuugugcuaucauuuauauacccauuaauuuaauuuucauuucacauguucaccaagcaccgauugugccagaugcuguguaucuguagaugaauaggaugccugccacccuguaguugaaaggugggcgacgaaacaauuguaguguuugguauacugcuauguguguaauacgcacguaggggacauaguuuggcuuccuaggaauacauuucauucuuuguauggcuuucagauuucagagucaguucucgauuugccuuguuuaacuucucugaaaauuaaauuugcauuccaaacuggcuccucugaaggaguuagugugauucuaguccucuuacaccaucugucggugcauaugugcucagggaacgcagcgucauucugcacgagcuggagcaaaacaugaucaggaaaauaaacuugcugccagaaaaucauaaagccuuccccagacauuuugaaaugacuuggggguuguagacuuugggggauuauggucacuguagcauuccucuauuuguauagguuucauuuggaggugucuguuugaauaguucaaauaaagcauuugaaaauacgaaaauacauacaagccuccuauugacaggugcaugugucccacauaacaaccugagcuuggccuaaaucuguguagccaccuggcauuuacucaguguguuguucacagagguauuuugcuucuuccccugcugcucugaaaagcaagaaauaauauucaaguuaguugauauucucagacuacaauggugauuuacugugacacccaugcacaaggacagguggcuucugacaagacuggauaucuguugcugggcuagggccucaggccccuucuaaguuuggccuccccagucacagagaucucuuuuccuuuaugacucguagcauguauaggcugucccauucauuuggcauugaucauauucugacuccuuauguuaguuaccuuuacaugaugcgccugaauucugcaacucguuaguaaggucuuuguagguaaauauuucugcucgauguagguuaccaggcacuuagcaaauauuugauugaaauaggucaugcauacuuaaucauccaagauugcuuaugguuuuuuuuuuuuuaacugauuuauaaaacuagaggagaccgagcuagugugccaauugcacagcuccaaggggaccacugccacugugcuccaugucaaugacaaccccuagagcacagaugugaguggaggcucccuggaugugugcaacccgguaguacccaagagacaccagagaugaccuaaucuacuuuccuuaguuuucacaugagggaauaagagauuagucaggaguuaaugcccacacuggaacuugagcauauuucuguuaggaaucauuucagguccauuacacagacaacugucgaacaucuacaaugaagcggaugcugugcuggauaccaaggaugcaaaggcaaguggggcacugaucgggagcugccugugcccacuguggcucugugauguuucugagccagaugcagagagagaggcugggaggaggggguuguuugaaagagggcuuucugcucugauuuuacucaucuuuagggagggaagccaaguaaaguagcauuaguaacucaaauagguuguaguggggacagcaauugaagcauugcucaaaguaaacauuaggguuuuuuuuuuuuuuggucgauguucuuuuaaguuaugcaugucuuucucucccugauuagcacagauaucuaggaguugacuguuauuuguuucagcuucugccuugagucuccucugagacuguuaccuuuguuauuguuaauugaaauugagagcaagaaguggaacacuuuguuuugcucuugugucuacaugucugaaauggguaaauaagaaccugcacuggggauccacuuauucguucauucagcccgcugcuccugugaaccugcucacgggaggcauaggagcaguggcuuuuucgucagagaaggggcuguugcauuuuugcacccugaccgaagaagauucaaacacguuugucagcuugaucacggaagagaagaucaauuucuguuucuucgcugcgguuugcuugucagcaugaugauauuuuucguagucaguaauaauauuuugaacuugccccaaagcaucuuuuuuuucuaagacauccaauuucauaggggcuucucucuggaaauccugaaaagccccugaaaagacuccacgcagcagagcagcugucuuuucuggaccugggcucuggaagcagccccacaguuccagaaugugggaggcagugguuaaugucuucacuugcuugcagcgccucucaaugguacaguugucgggagagccaccccuacuuuauccuaaccccugugguuuuucugccccuugagguauagagaagcagguguucuuaucacuguguuuuuuuuuuuuuuuuuuucuggaguucaguggugcgaucucggcucacugcaaccuccucuucccagacucaagcgguccucccaucucagccucccaguagcugggaccacgggcaggagccaccaugccuggcuaauuuuuauaucuuuuuuuuuuuuugguagagacagguuucgccauguugcccagguuguucucauuugaacuccugaguucaaagugauccaccugccuuccuaaguguugggauuacaggugucagccaccaagcuuggucuuuaucaccuuuuaacuguuaagaaaccgagaaacggaguugcagugcaguuucuuuaacuuccuucaacaagcguuuaugaauaaugcccuuucugugugcuaggaaagauucgaggugccaggggcagaaaaguaagaggucuuauuccugaugaacggcaauccaguagaaaacacucgcaaaaucaagucacugaaauacagugagguauaagauuauggagagcgcugggugcggugggagccagaaugagggccaggugaugcuaucugggggacaaaggaggacuucugagagaggaaaccccagcugaaccuaaaaggauacaaagcaaggucggaaugcuuuuccaggucuagagagaccuugagcaagggccaaagcaugaucaguggggaaugugcacggcucuugaguauuaauagaaugcaaauuuccaggugggaaguagugagaaacgaggcuggaggaagguaucuauguagaggccagguccugggggaccucaccugugccuuacuaaagagauuaaaguuugcuuugaggugauagggucccuuugaaggauuuuaguaggggaaugacauggcuagacuugcauuauagaaugauggaucuggcagaauggagaggauggauucaguggagagagacuggaggugagagcugaugcugggguguguuugaggacuaagucugcagggcaugguuucugauucaccugggaugaugggagaagugauuauaccgcucauagaaaggcagagguaaaggaguaggcuugcagggcuguauauuaaaugcagacauggacagguugaauugaagccucuguuguggguccaaggggcgauguccagcaggaaucuggacauauuacaauaucuggugcagccuuccgccacccuuugcaagaauuuucuccgugccaucugugauagacaaucuuuuguucuauacuugaacauuucuauuaauggggaauuugccauaucaaaaggugcuuccauuuuacuuugggacaguuugcuguucauuuguucacuaauucauuugugaauuaaaguucucugguaagggagagcccagauucuccucccuccagcuucuauucguggacuuuguucugcucccuggagaugcacaguagauacuuccuuuugcaugaaagccuuucaaguauuuaaggacccugucauguucuccugagugucugccauuucaugaugaauauccucgguuccuuuccucauauucuauagauccucaaucucuaucuucuagguucucccuuaggucugccucacgaugucagugccuuaaaaugugguaccuggaucuggccccaauagccugaaacaugcagaagauguugagauuuugucuucaugauucugaacacucuguaucuauuaauaaaaaccucugacaguguuuccauuuuuaacagccaucucaaacugguggcuccuauuuuuuuuuuuuugagaggagguaucauuugcauaccacaggaugcucagauauugacuacaccauuuaaucaguucugaagggugcaugucaagauguagaguauuuccaucaguccagaaaauacucacgugccccuuuccagucagugcucuccacccccaaaccccugccccaauuacaggcaaccacugguauguuuaucacuguagcugccuauuccagaauuucauguuuguauguuuuguauuuggcuucuuuuacucagcauaaugauuuugagauuuaucaaucuuuuaacugguaucaguaggcugaguucacuuuaacuaaaauaccugagauccuucuuucuuauggaucuuauuauacaaucaaucaaucaacaggacggauguuccccguccuguauuugagcaaacagguuuuugaaacuacauguggagcuuuauuuuuauuuuugcuuauuuuuuuuugguuugaauuguauuuuuggcauuuauuuauuuuuuugagacagagucucacucugucgcuuaggcuggagcacaguggugccaucuuggcucacugcaaccuccgccucccagguucaagcgauucuccugccucagccucccgaguagcugggauuacaggcaugcaccaccacgcccagcuaauuuuuauauuuuuaguagaggcgggguuucaccuuguuggucaggcuggucucgauuucuugaccuugugacccgcccgccucagccucccaaagugcugggauuacaggcgugagccucugugccuggccccggcauuuauuauauuauuuauacaauuagccuuuuacccuuugcaaauuuggcagauucgccuuccagaucccuauccagaucauugacagauguguugagcucugugagaacuagaagucuuaucuuggguugagaucaaaccauacgucagcacucuugggaugugcuuauuuuaccaucagugaauuuuaucugacugcgugguccacaaagaucuucaugaaaaaaagaauguucugugucauuguccuguuuuucaaaucaagaauuaccacgaggaaaggaaauggaguuagucuguugugacuugugugugaaaccauuuggguucuuagccuugaccuccuuuucgucugagugcucucaaauaaacuguuucauaauccauucuugaaaccaccuuuucuucauuaaggaaauaaaaguauuuucccuauucuaguuuuugagaucuuuguucuucauaauucuccuagagauuauugaaaaggaugcuauaaucauccuaucuuuaagucuuucaguuccuuagaauuuauuuuguacugauuuuccuuuaacuuaaaugguuuuucuuguccaauuugaagauuauuuuccuugauaaagauaaaagcaaaauagaauuuuuuuucuauuuuuuuuagacccagcuuuacuacuauguuguuauucaaagauuuuuuucuuuuuuuuuacuaacgaagucuuuauuucuuuuguuuucagcuuuccaaucagccagaaaacauaaaguauuuucaauucaaaguucuaguaaagauaggaagaacugggugaugguuuucauaaaugaaugaaugaaugaacgaauggaugaauguguaucaagugcucuguuuuuuuaaauugauacauaugauuaugucugcuauuauuuauucuauuggccaucagagcaaugauccuauuccuuucuaauucuuuauagaacuugccagauaaccaauccacugacccaccagucugccaauuauuuugguaauuugaaacauaaaccuugauucauuuugaacuuaucuugcuacuauuccaacagacuacuggcuaugagaauuacagcuggaauuagcuagcaguaacugaauuuguugcucuugguuauaugaccuuuuuucccaucuugaauauguucuuuagaaaccugaacucaucaggaacuuuucuggguagcugccugcuagaguccuaaguuggguaucuaccacacuucuuccuuuuagaguaucugugguuauauuauguuuuauuauuauauuaucugaccuucccaucuucuugagaguuuuuggcccugggauuaugucuauauuuuuaucugaacaguuugauuucuucauuccuaaaggcuagugcccuauauccucuuucauaacuuaagaaugcaaagaugggccagacgcgguggcucacgccuguaaucccagcacucugggaggcugagguggguggaucauuugaugucaggaguuugagaccagccuggccaacaaggugaaauccuaucucuacuaaaaauacaaaaaaaaaaaaaagaaugcaaagaugacuuuguuucuucacaagguucuugucacuuacuuuuaccaauacaaguucuccuuugggggucagaauucaguccaaaaugcguguucucuuaacuguugcuguugauaagacaagagccuuuuccccaaaauucugaagagcaccauuuucuaaaugagcaguguauuuucagauacaagcuaugcuuggucauguaccugcuuguuauuucauuaaugaguuauugucagaguccucugggaacucucaagaaauggggugauucauuuccugagguuauguuggguucgaggagcucuuaaagagaauuaacuuggcaacguacacauagauagacuuuagcauuaccacugagugggcagauggcugccaucaugucuggauaauagguugacucuguugguucaguuugcuuuaaaaguaauauaaaccuuuagcuucacacugguuacaagaaggagacugaaugaguuaauuuauccaaauaucuguuucaaaauuuucuuaaaccaaaagcauaucugccaggugagauuucuccccuugugagagauuuguagggggagauuacuuagucucccauugacauuuauuauucugccuuguaacccuaccaguugguuuaaccccuagccuuuuuguagcaguaucuuuuuuuuuuuuuuuuaaggcagggucucgcucugucauccaggugggacugcaguggugcagucauggcacacugcagccucacacucuuggacucaagcaauccucacaccucagccuccagagaaguagcugggaccacagggggcaccaccacacgugacuaauuuuuuaaaaaaauuuucuguagagaugugguucucauuauguuucucaggcuggucucaaacuccuggccucaaaagauccuucugccuuggccucccaaagugcugggauuacaggcaugugccaccacgccuagccaaaucgauuuuaauaaucucaauaugagaugaaguguuuggauagaaugaugucacgaaaagauuucugucaaggauuagaaucccaaagguguaaaacuaaaaucucaaaaacaugagaaaggugaaagaaaaaguuuugcauauaauuuggauuuaagaaggacccagaagcccugugauucuaaagaaggcuugaauugagugauuucucaugucaagcgucucaccagcucacugggugauaaaacaaguguugggcagauuuucuuccuugccucccucuccgucccucuucuccuucuucgacaccaaagauaauguaaaaucagugcaguuacucaaaugcugcuuaguuuuucaagggcuggcuuccugcuucuguuauagucugucuuggagacuuuccucaguauauacuuuccuucaacuuuuuacuuuuuaauuucuaagaccacgggaaaguuggaaaaaccguauaacgaacacccaugaaaccuucaccuagagucacaaauuguuagcauuugccgguuugcucuacuucuaucauuggucuauuuaucuauccuguguauccauccauuauuuuuuagcugaaucauuuuaaagaaaguugcagacaucaugcucccucacagcuacuuaaauguguaucuccaauaaauaagggcauuuuccuauauaaucacaaugccauucucacaccuaagaaaauuaacaugaacucgguaugacuuauagacuauauuuucucaguugucucaaauuauuuauggccacuuuuccccuucaauccgggauuuagccaguccugaacuaaauccuggauuggauuuacacauugcaaauuuguuuagucauugcauuuggcuuuuauacuccuuuagucuuuuaaaaucuauaacacauuaucugccuuuuuucuuuauuuauuugguuuuuguggccuugauuuuuuuuugaagaaucuggagcaguuaucguguagaauaucccacauuuuggauuuguccaauuguauagaauaguacacagaggauguguuauucucaaugcuuuauucaggaggcaccuaauaucaaguuguccugcuauugaugauguuuaguuaagauugugacucucugaucauucauuguaagauuauguuuuguaaaauuuuauuuccccauuuguagugaaugauuugucuguucagaucaucugaacauccuggccccaacacuuucaccgaaugguuuuagcauccagugaugauccuugugugauuuaguuauugcaguggggauaauuuuucuguaauuauauuauauuauauuauaauauauauauuguuguguccaacccuuauuaagugccauucuaauauaagaaaaaaauugggggccagacacgguggcucaugacuguaaucccagcacuuugggaggccgaggcaggcggaucacgaggucaggaggucgagaucauccuggcuaacauggugaaaccccgucuuuacuacaaauacaaauacaaaaaaaaaaaaaauuagccgggugugguggcgggcaccuauagucccagcuacucgggaggcugaggcaggagaauggcgugaacccaggaggcagagcuuguagugagccgagaucaugccacugcacuccagccugggugacagagugagacuccaucucaaaaaaaaagaaaaaaaaaaagaaaaaaauuucucuuuugcuccucugucuuuuaguaucauuagagacccauguccuauuuucauucaauguguaaucuguuaccaucauuuuucuuuuuuauguuugaauucuccuaaauucggccaguuggagccccaucaggcugguuccuguguucuuuugagaugacugcauuuauuucugagcauuuccuuaaacuuucccugccuuagcccaggaucagccauuucuccaaggagcccugguuccuguuccuggugaauguuauauggaaaccaagccuuugccuuagagacuuucacugcaaggauucucuuacuugcauuugggcagauacaguaccaaugaaggggagaccuggaaaacauucaucuucucugagaagccaguguuuguguauggccuccucacagaaccuggggagaagagcacugucuucaccaucuuuggcucgaacaaagagaauguccacagcuggcugauccuccaggucaaugccacggaugccuuggguaagcugcugccuccuuggaccuuuucacauggauaugcguggacuuccuguuaugugcaaagcaccagcuuagauacuguguacucagaagagccugacauucauugggggagaugggcccauaagaguuagcaaaaagcauagggagguaauugaaggccugcucaauucuucuuaguaagacugggugcuauucuuuguaucuuaguuuccucaugcaguuccuggcacauaagaaguuuaaauauaugucugcugaauauguagauaaaugcaugaaugaaaaacauauuuccaaaucagcagugccaauuggacguauucagugagugugccugacugucuguaagucagugugccaagcgacacaggguccucucaaagccaucuaggaucuaguugugaucugcuaaucuagauacaggaugcauaaguaugcagggagaagugaaacucuucagcauccucucccugcuuccccaucuuaucuuacccuuuccuaccucucagccuuggcuaaccugauucuagcugcccggagugcccuguuucuucucauuuccacccguucagccuccccuacucgaaauccuuuucauaucucaggauccaacacauuuguggcugauaucccaaccagaagacgucucccuucuucucuauguccagaacauaaguguaugcauaacuuugugucugucacucgguguguuucaccuuccauugacuagauuauaaagcccuuaaagauaagaacuugcccugugcauauuuguauuguaccuacuggaaagccugauagccuaacagucuguaggaguuuaauaaguuuacugauuugcauggcauugagucaaagguuguguaucagcuucggguaguaucuaaucugacugaagacacauauauaagagacacaaagugccaacauagacauaggcauacuuuggaaugcuuguagaaagcacccuacuuagacauuucgaugaacguggcagauggagugauggugcaagguaucuuagcauuuuccagccucuuuccauggagauccuguaccuucaaguagggccagcgagcccuccauugccuucgggccacacuaccagaugugcccucacugccugaggaagcaggccaggaacauuaacccccaaugguauugcucaucaaggauucagcuguucccuaguucucuaggagagaaacacuucugaguacucauuucuaaagggcacugcugacucuucuguaauguuucggaaauuuggauagugccuaaagguggcuugcuucuuuccaacuuuuccaggcagaugccugcguuucagguauccuuuucauuggcauagggcugcccagcuucaaaacaagcugauuggagggucugugugcuugcgggguggcaacagauagacaggaaguggggguugaggccaggcaccuugaggcauagcaggaaacccuacaugggccugccucuaaugcuucgugcuguguuccuuuuucuuuaggaguucccugcacagagaaugacuacaagcuguggucaccaucugaugagcgggggaaugaguguuugcugggacacaagacuguuuucaaacggcggaccccccaugccacaugcuucaauggagaggacuuugacaggccgguggucguguccaacugcuccugcacccgggaggacuaugaguggucaguucuucuuugauggcuggggacugaguuguguuuuauucacucagcaguguugggggaagagauuaggcauggucccuuucccugagcaaaggaagggaauagaaggaaacaaguauuugugaagcaucuuuuaugugccaggaacugugcuaagcauguuucauguaaguuguuuucuuuaguucuuauagccagguaaugcgguagaggugucuaggagagcugcagcuauuucuacaggaauagauagcucugggauuuauuucuauuaggguaacccaaaaauaugcugaagguuucauuguuuuuaauccuucuccuuaggacccuauucuagaggggauuuauuucuuuaucugaaacgaggggauguuaguguguguauauguguguguguuugcaucauuuauuauuccuuaagcaaaauauccaaggcacugcugcgaaugcuaaaaguaggagaagugauuugugcauggcuaauuggcacaggagauagaagagagcaagugccucagaggaggaacugguacuuuuauugugacuauugaaaggaaggagagggcuguggauugcuguuggagaaugaggagauuuuuggaagaagugcuguuugagcugggcucucagggagcaucaauauuugcagacagcaguguuuugagaccaugugucugcaacagucagguguagaggcagcagggugugguugggaguugaauugggaugccuuguuggguguaugacauggggaugacaauuggagaugaggcugaaaagauagaauacaguaggggagaaagaccuuagaggggaugaaccuuauucuauaauuaggaggaggccuucagcggcuuuugaggagaguugaugaugagaacagagcuuagcuguaggagcuuuugaggagaguugaugaugagaacagagcuuagcuguaggaagaggauucuaguggcagaguacagaggaucucagagcuccuggacagucacuguagucuguaauucagcaugaaaucauuguaguuuagucaggagcaccaagagagccauggguauuuaauauaaauacacaacucauauuucagugguugcugaggcacagaggaacuagauuuugcuuugggcagcuguacuugucuugacuaaagccagaaaccucugauguauucuagaccagagguuggaacauggucauauaguaaauguuuuagacuuuguaggccauaugguuucuaugaucuguguuacaacuccucacuuugcccauggcagugcccaugggugaaugaaagcagcucuagaggaaugaacguggcugugauccaguaaaucucuauuuacaaaaauggccaaccagguuuggccacuucuguucucaaccagugcuucugaaacuuuaaggugcauaugaaucacuugcagauucugccuuggucacaugcagauucugccucaggaguucuggggcucugcguuuccaucaagcucccaagagauguggaugcugcuuaucugcacauucgcccuuugagcagcaaggcuuagaacagagaagacagucauuuccuuagaaaggugugugcucccaagguaacgacacagacucuuuaacagcaaaagcacagggcuggcugauguucuuggugacuucaguuccaugcuguuugccuucugcucuuucuuacacacuuuugcauuauagucuaaucuaaucugagagcuuuguuggcuccagguaguccuccccagaccagcuugagacuggagagguccuaaucccugaaaagaucauagugcccucucucuccccucuuccuauccccaauauguacuucaaaauaaaauuaagacuaaguaaaaaauagguaagaaagucuaacaaaucuuugggguuuuuuuuuuuuucaugacauuuaggcuuaaaaacaaauaacauuaaaauuuucucucuugcccuacauuuccccaacccucaccaaaaaaaaaaaaaaaaaaaaaaaaaaaaucacacacacaagaaaagaaauggagcuuggugugcccuccuggguaaacuggccugggaccugcuggucuaccaugcccaccccaucugccuugcuggaaccugcuguaugcucacccugcuuguauguggaguguuuuuauuguagaccaguaaaaccaccugcucugccccuuguggaguuggguugcaggccaaaugagaucguggggugaugacccucugaaaugguaagggguauauggaugucagcuguuccccgcuccaccccucccaauuguuucucugcuugcuguagcugcuggaaggcagccagcccaacuauauggcucuuggagauguuugauggcauuggacuauggcacugagaaggaaaauggucccaagauggacgucaggaaaugagaugagaaugagcaagcuuauaguaucuuuccauuaguucagguacugguugacaacuguguuugaacaccagguuauuucugauaguccuuuuagaccacacugggaagcccagcuauuggcccauguuuccugauuuccaugguagauucuuuuauguucuuauauuucucgacauugccaagucauacagcuuucacauucuugacugcaaccccuaguaaauaauacauuuucucuuaugacccuguacuuacauauguacguguagauacauacacacauauaauuaaaacacaaguuuuaggagacaacauugacuuuuaaauguaugauggggccuuuugcaaucuuuugcacuuuuuugggaggggaagaaucuagucuugggccucccaaguacucucagaguccacuaggucaugaccuauggucaaagaaagcugcccaggaagagugcuuugcuauuggaggcaaauaaguaauuagcuaaugcuuuaucugguuccuaaaaagauuuaaaguggccguucaguaauaacgaacugagguaaugaaagaggcacauuugauacagugacaaaacugcugccuuuugaacaauucuuacaaacuauuaaauguggauuaugauauaaugcacacaaaucacucucuguguaucuguuaauacuuuuugugucagaaauguuuaaugaauauuuggaguuuuucuuuuuguuuuuuguuuuucugagacagagucucacucugucacccaugcuggagugcaguggugcaaucuuggcucacugcaaccucugccucccaaguucaagccauucucuugccucagccuccagaguagcugggauuacaggugcgugccaccaugcccaacugauuuuuguauuuuuaguagagacgggguuuugccauguugcccaggcuggucuagaacuccugaccucaagugagccacccgccucagccucccaaaaugcugggauuacaggcgugagcuaccaugccggaccuaaauauuuguugaauugaauagagcaaauaaauguguucugguagagcacaugaacguggaauauauguucuguucuauaauucuuugaauauauucuguaauucauugaauuauagaauuuacagguuuggaagggccuuagaacauucauaguacagucaccucguuuuagaaucgucuucgacugaggccuccugcuuccuacuccaggaugcugcccuucaagcugggagguuuggcagaugugacuccagaucacaagaggucucaugaaccuaacuacuguaucucaaaguacagggugacuuagcuaguauguggauauacucuuaaauaacauugaaccccuagucaaauuuuuucuuuuuuucugagacaggggcuugcucuguugcccaggcuggagugcaguggcgcaaucacggcucacuacagccuugaccuccugggcucaaaugauucucccaccucagccucccaaguagcugggaccacaggugugcagcaccauaccuggcuauuuuuuuuuauucuuuuuuguagagacagggucuuaccauguugcccauguuggucuggagcuccugggcuuaaacaauaugucugccuuggccucccaaaguguugggauuacaggcgugaaccaccaugcccggccccaaauaauuuuuuaaaaagguuauucuuuuaaaauuccucuuuuacuucuucagauucugucaaaaagaacgucucauugguugcuaguaacuguaacauuugccuaaucccuuuuaacagagagggcagguccagagucuuaaauugggaacuggaucuggcuaaaauuuaauacuguuuugauuuggcaugaugauuuuuuuuuuuuuuggucuauuuauggcaugugauuguguuuuuccaacugugguucugauauaaaucuucuuuugaagauguauuuuauauaaaaaguaaauauucuuuaaagggacauguuaaauaacuuauaauaaaagugaaaaguaguaagguaaagucagcagaauugguacaggaaugccugaaauguauaaaaccguggccuuaacaaagcccaauugccuuuuuagugacuucgguuucaagaugagugaagauuugucauuagagguuuguguuccagauccggaauuuucuggaaagucauacuccccuccugugccuugcccuguggguucuacuuacaggagaacgagaggguauguaucacagagguugcccugucagguucucagcgguccgcacauggagcgagagagcauagaggaccgucuggauugcucuacacucgaaauucuagaauuccaaguuaacagccugcaaguaguuugggcaacauuauaaauuaugguauuuguaaacucuccuaccuccacauugcaagucuguaagcaucccugaaacucuaggaauaucuuaagucaucaacuucagcagggaaacaucuucagaggaauguauucaagagauauauuuaaaaaucuuggccaggacagugcccuaaauugucugggccugccuagucuaauuauaaggagaacugacucagaacuacgaacauccucuuucuaguucuaaagagaaaugaguggauggacucuacuggccguggguaguaaguguauucccagcugggaugccuuuguggcuauucuuccauguuucugaccucuugcucuugggguggggugacagcuaccggaagauuucuggggacacuuguagcggaggagauguugaagcgcgacuggaaggagagcugguccccuguccccuggcagguaagagaggugguuucuucccuuucauuucuugagacaugguugaagcaguaucacgaucucacccaaguccgggcuuguggcuccuuuaauugaguggagaaaaacaauggccgucacaagcaucacagggcuuccucuuuucccuaagguugguuuccacacugaacuuguacauagccauacccguuuuuaggaauggaaaguacuuugugucagcucaguuucuuugagggaaaucccuuuguuaauugaaaaauauuuauucagcauccacugggguagaaagauccccacaggcuuuuguguguuccuuaaucuguuugucaaaguugaguauaaagaggugugugacuucuuaggaaguagcuaaguagucuauguuaauuuuauaauaaaacuaacuguaacuaaaauuuuaauggaauuuuauagauuucaguguacuuuuuauguguugccaguuuaacccuuuuaacaacucagggaagcagauauuaucaauuuuguuuuuuacuuuuucacgaggaagcauguucagaggagguuaaauggcuuaaggucacacaucuaguaagugacaaaguugaaauucagacucuaagccccaugcucuucauuggacauugcccaaauggcaaauaaauaucauucucacuauuuuagauaaucauuaugcaugcuaauuaagaaaaacuucucugaaaugauucacaugcuauaaagguauaguguguucuaaaacacguuucugcuagauuuaguggugauguaacauggggucuuuaccacagagacaugaaauuaugauacuuugaaaaauaaucucuuaguugcuuuucuucacucuguuuccaguucuuauucauuuaaagcuucuuuauucccucugugcccucuuuccugcccauuaccucuuggugaagguaaauggcuggaguuaacuuccgucuguggugggugguggugucuuacguggacagccauaagcaccgaaugaaucaugaaagaaguguguggucuccacaggcagggcagggcagcccucucuuuugcucacugccgccagcuugcccugguguuuuucaugcuaaguucguuagucccuuaauuuaaucuuucaucauuaccagaguaauuaacauaccucacuauggaggcuugaaaagaaccaccacuucagcaaauuccaacaaaugagcagauaauauucaaauauuucccucacaagagcuguuauugaugagggcguggguuaguaggguuugagugauugcucuugaggggcuggagugccuacuuuuguaauaaauauuucugaagauaauucagcaagggacaaaacaguuuguuuaaagccaucuaaacuggcaggaaagcuauuuucucuucuacuggaagauagaacagggaacgaaguggagaaaucucauuccauugugggccaccuccuauguaaaagagagaaaaaaaaaggcauggaauaggaggcagggauauaccaggaaagaaaaagaugcuuucacaggacuaaugggggccguaauaucuuugcaaagaugagguaaucugggcaucuggaaggauuuuuuaaaugcaagaauuuuucuuccuuuacaauuacuaugaaaacacacauuccuuggccaggaccagccaagaauuccauuccuuuuccagguuaagcauugcgcgcuggaaugccgcaugcugcucugaacauaauccuaaaacacguauuucuggauucagguucuacuuuauggguauuaguuucuuagaggaaaaaaaagcccagagugacagaaugagguuuauagaugcuggagagagauguggggcaaaagccuugcugcugcaaauguagcuuucaugucccuauaccuuagcuggcccccucccugggaaugacagcgggaagguuuccuugacaaccaaaaggggagguagguuaccaugugaugguaacauagauacuucuaaagugaccuggaaccaaaggaaaagaaggaaaacuuaccuuauuaaaaauuguagguagauuuauuuuuugaugcauuaucuauauuacagcuuuuauaaagaaggugagugguacauguuaagucacugaguguauggaaucaggaagugggcaggaauggcuaacccaggcaugcagcaaaagaauuccgauuugcaucuuggucccauaugcaacacacugucaagaugcacacuuuagacacagaugcuggugugcugcuuguguccacuccuggggaagaaucuggauguuucccaagccguucccuaaguggacaagacaguguacugggucuuccuauuuccaguugucugacauuagguaaguaucuucagcacucaggaccuucauuucuacaucuuaaaaaucauccacgguagcgucuguaucauaacaggcagcacaguguagugguuaaagcauagacucuggauccagagugccuggguuccaaucuugguucugccacuugcuaguugugugaccuugggugaguuacuuaaccucucuggucucaguuuucucauuuguaaaauuugguuaacaagaguucuaccaucaggcaguuguugugggucuuaaacaauacccgauacguaguaagcacauuauacacaauauguacacaauuuauauuuguugaguagaaacagaauuuuuguggugauuauguuguggaacauuuuguaaauagccaagaacaaaugcauuauuaguauuauuuuggagaucuaagagguucauagaauugccauaugguguugugaacaauaugaauaagugagcaaauugauuagagagcuuaguuacaaagcuucagugacuaauggucucucgucaacaagaugaugaugcuguggugauacagucacgugaggagggagaacagggcgauugguguaauuagguuggcaagugugacuugaagacuggcaggcuuagcccagaaguaugguuguugaagcaugcauauugggagauuuagaauaaagaaaaacauaacaaguaaaacacuugcagaugaagaaacagauucacuggaguuuaaguaacuugccugaggcagaaaugugauuccauuacacaccuccugagucuugauuucugugcucuucacuugguccacaccacaugccaaugaauuugagguuuguguaugagaaacaaauaggucagaugugcuaggaccucuucagcauccccuggguccaaccucccacgugucuugugugucuggcagaagagaacgaguucauucuguaugcugugaggaaauccaucuaccgcuaugaccuggccucgggagccaccgagcaguugccucucaccgggcuacgggcagcaguggcccuggacuuugacuaugagcacaacuguuuguauugguccgaccuggccuuggacgucauccaggugagucagcgcuuggucugacugugggagcugugcaucgugacugcccuguccugauaagcugcaugcagaauggccuauggaaaugggcaguuagaaguuuguaaguguuacucaucucagggcugacaggugaaaguuuccagucuucuguguuaguauuuuucuuucucugucuucaucuguucauauaggaaggauaaagaaagcccuaaauccacagaccugcuugaaagugaggucuugcuuuuccugcugggaagguguugggacuaguaauguaggaugauuaguugccccccuauugugccaacugccucuugagcaucuuucuucccaagccaugauacaguaacacuugacuuacccauagcucacauaauuauccacuucagcuguucugaacacagguaagaaccaggaaguaagcauuaaagagcccuggacaggccagguggauagccauacgcucacacccaugcauuuaaaggagagcucuuugaucuuuauucauugucuacuuaauccuuuuagaaaagcaauuccaacaaauuuuuaucuagauuccaacccaacagaaauuucacagugccuggguauuugaggggcuuggggugggggauggcggugaugcugaauggagcuguccaacaauagcacuugauggcuaagagccucacagggaagaaagaguauaaaagcagacacaagaacugaaauguaacagcagucugguuucacuuauuuuaaaagcaaacagacucauacaaucucaguaaucucugacuuuauuauugccauacagcauaauuuaguaaccaguguucauaaugauaaugcagaguaauauauaugauuaaauucucuuuauucugcuuuaaaaaacaaaaauguaguauauuuuagaaaugcuuucaugaaaaccuggcuucaugugucuggaaaguuuacuaacguaaaacaucucaucccuugccaguccugccaguugaauaaaggguuacccuucaugggacugacuuggcagggggucguuugaacaguuccuagcauuuauuauuacuuuucucucuuaagcgccucuguuugaauggaagcacagggcaagaggugaucaucaauucuggccuggagacaguagaagcuuuggcuuuugaaccccucagccagcugcuuuacuggguagaugcaggcuucaaaaagauugagguauguguauuuucgugcuguucuuaauuaagggagcaggcggggcaccugggcuuugagccacauuugacacagaggcaagggccagugugucagauuacucaggaaauuuacugcgaguuuccagagaauggaccagcugagccucuggagaggagagaaaaggggguaaguaccugugaguugaucuuuuggcuagcagaagcuuagcuaauaacaauaaaugguaauauuuuuauuuuauuuauauauguacuuacuuauuuuauuuauauauuauuuuuguuuuauuuuacuacuuuuauuaaacaugauggcaaaaacuacaaucacuuuugcaucagccuaauaucaugguauuauuauaaugcuauaacaauaaucgucuaguauuauuuuauucgauuagagugauagcaacaauaucaucaucaucaucaucauugccacuguuauuaauccccauuucucugcaacuuagcuaccuaguaaccugucccaccuuauauacccaaggcaaggaugaugagugaccucuaaacugccaaaucuuugucugggggaauguagugugcucagcucacugccucagcaccucuuuauacugacucugcauggagagacggcaugugggugaagugggaagugcaguagaagcagggagaugcagagggcuaagaggaguugcaagacgaaagacacagacucgagagauagacccagauguaggcuugacuccacuagcucagcgacauggggcaaggugcuuaugcuuucuaaacuucaguugcuucaugcguuagauggagauucauauauucgcacaaccauuugacagggguucucugcaugauacaugugguuuagguucugaugauaaagcagugggcaggacacacacguucuuguuccaguagagcuuagauuuuaguggaggaagcaaaauaauaaaucaguucuguuggugguacaugcugcaaagacucugaagcagugcagugugauugcgcuuuuggagaguggggcaacauuagaauaggcagacagagcaggcaacuugagguugaugucuuagcugagcccuggcugagaagaggaugaucuuuuguccaccuccuggggaugcugauagaagugaacuggcaucuacugaaugcugccucggugguuauguuauugcucuuucucuccuuucuuuaauugcguguggucagcacuuggcuaggggcuaaaagaaugcaggugaugcacaagcacccaccuuuucacaggcuguggggcgaccacugcacaacucaaauacuguuggugcaaaauggugucagaugagccaaggugcagagcuacugaugcuuauugguccaggugggucagaagaguuaggaaaguaggcaggccuggcagugagguuugaaggagaguuaugccuugauuagauuaagcaguggggcagguaggcccaggaugggauguggcaagagcagacagcagugaguccgcaucaggcuuggagaagcaagagaugaccagccuggcugacgggaaggagcaagaauaugagucccaccuguggacucuucauugcaaggcugugacauugagaauuuguuuuaugggaguguggagucaucgauugccuuggaacguggagugacacgggauggugaaauaaguaaaugcucauuugcuuauuuacuuauuugaguaauuuacuuauugauacugcuuuguccagaucaucaugcccuggaaacuggggcuuacaugguucuagcuccucuuucagaccacuugaaaauugucccaugagucagaggaaggaacagcgcauugugacuagaaguuggggcagguuucgcagaugggucaggucagggaaauaggcaggcauggagggggcaugucuguagcagaagcugaguagccaucuuuggcaaugggggucuuuaaggagcuccgauccaucucagccucuuuucccccuguuuuugucagguagcuaauccagauggcgacuuccgacucacaaucgucaauuccucugugcuugaucgucccagggcucugguccucgugccccaagagggguaaguguugccccaaaaggaaaucagucuugcguccaaugcuacacuaauagauucucauggaaacacagacugcgggacaaaaacucuguuucucaugauggugguugaaauggucuauuaacugagaaguuugagaccacagcuuagucaucguggucagguaacuccguucgcuuuuuguuagccagugucagagucucuuuaggcauccagaugucuugcaucuguggguuguuucucuagaaaaguugauguuaaaagagagcuucuguagacauagacaggccugcuuggauauugugagaacuuucucuugaguuucaugcaugguacaaacauuuaauucauuccaucuuuccccugccuucccagcauguguagguuuucuuacguacaaucagugugcacuuggggaaggcaaaggugcuuuuuauuaacucauuaacugaaggaaacauaauuaagagggaaauucuggauuugacauucuggcuuuuccucucucguagcauuuaugauagagaauuggcacaauuuuuuucaaggaaaauucuaagaguaauguauguacuugguugacaauauuuagagagaacagcacuuuaugaaaaaaauuugcauucuuccuuuucauucuuaacccuuuacccucacacuuccuagugguaaucauuguuaauaaugucuuguguaucuuucaugauugcuuuuacuuauguacaaguauuaucuuuaaaacacacacauauacacacacaugcacgccaaauaggauuguaguguaguuacuauucuguaccuuuuuaaacaaacuuaauauguauugaaaauaguucugugugagcauauauagauuuuuagguuucacaguauucuauuauauguaccauaaugugucacuuccucugcugauuaacauuuaguuuaauauacauacauauacauuucuuuguauauuaucuuugcauaauuugauuuuaucuauagauaaauucuaguaaaggaauuuccaggugaaggaauuuaaguaguuucagguguugucauuacauauuguuauaauaaugcugaaauaaccagccggaucauucgaaaggaguuucugaccuuuucuggaguaguauuugagcucccauuucucuaguauugaugagguauguguucuguccccauuuucgcuagggugauguucuggacagacuggggagaccugaagccugggauuuaucggagcaauauggaugguucugcugccuaucaccuggugucugaggaugugaaguggcccaauggcaucucuguggacgaccaguggauuuacuggacggaugccuaccuggagugcauagagcggaucacguucaguggccagcagcgcucugucauucuggacaaccucccgcaccccuaugccauugcugucuuuaaggugaguccauuuguugcugccggacagucugcuagagcgggugaggagcauaugagaucaggagccugcaucccugggcuuugcagagaagcuguuuaacuucuuaaagguugccuuuuuuccaaauuugagauaacuuauuuucagccuauggagggaugccaggcagaggcgccaaggguccaggcuccccugcuguucacauuucaaaagguuaaaagugaaggcucuucccaugaacauucccaguuugccccucagugucaguagccucauuucaggguggugucuucauuuuuugugcgcuuugcucacuuuauucucugaugacuuccggugagcucugcaccaccuauagugccuugcaguucuuuuucgacucuggagagcaacauggcucuucccaacucugggaaacagauuucaaacugaggggguuggguuugugucauaaacuugaaugcuuaucagauaguuucuuuugggcaguuucuucugugggguuauauggugagguuuggauaaaauugcuguccuuugcauuuaaguagaaucuugaucaggcuagucauucagccaauaaauguuaguugucuccugccugggggaacucuuacccuuagagagaaccagaauaaagaacgaaagagcuggacuaaugggcaaagguuuucuuuuuagaaugaaaucuacugggaugacuggucacagcucagcauauuccgagcuuccaaauacagugggucccagauggagauucuggcaaaccagcucacggggcucauggacaugaagauuuucuacaaggggaagaacacugguaagccagagucucuucuuuugucucuguagaguugaucucaagaaaggggcugcguguggccaaucucugcucagaguaggagcuggcagccugcaucuuuguugucacgacaacaugcacauuauuuaauuucuuccuaaugacaucuuaauuucuuuucuaaugauacacaaacagcuggaagacagcaugcuuuugccugccuagaguguuggugcuugguggguaauuacacccuccuccugcccuuggccccugacugauugguggcgcggcuucuguugcagcugggagaguccuaacaugugcuuaaucccuguuuggcaugcuugcaggaagagacucugugcugggugcucagauaguuguugcuuccugacagggccucuugcuuguucucugguugcccagaugaccuauugcucauugaccguaccuaccucugcuggaauggcacuguguaguuagguguuguuuuaauuaacuuuucccaccaugaaacccuaaaccccaugaagaaagagauggucuuuuuuauuccccgauaguuuuaccagugucuagcacuuuguaggugcucaauucauauuuguugaaagaauaagggaugaaaagggaggggaagaauugcagugggugcagacaguagcugucuuagagaucuacugggugaggcuucaagaacugcuaugaggcuuugaccugcuaguccuggagucugagacuauucaguggaaagccuuuaucauuucaugacugcucuuugauuuugcuuaucucccagccauacuauugauucuagaggagaaagaucagaggauuaccaggaagaauagucccuuuaagaauuucccucuuuaucucagcaggauuaaauggcauccuggguuugcugauucuccuuuauugacaaacugcuaaguuuucuguucuuaacuggaauguugauauuguuuuaugguucuuggcugacccuauacuaggagaaaauugacaggggaaauaauacuguuauagauaucauuguuauccucuugggauugugaagauagcaugagaacacccugggaaaacuauaaagugucuuacaaauguaagacgauauuauuuguuaugucuucaccacugaccugugagguagggaaggcugguauuaugauccaugguuuauagauuagggaauuaaaucucagauaugaauuagcuuucccaaaauauccucacuaguuuaggggcuggccuuuuguugcaauucugccgcuaaauggagaagucacauucuuucuuagaggaggcaccuguuuuagaaucaggagaguugaaggaaucuugcuucucagcuccagugacugaaaucuucagaccuuuguuuaauggaggacauccaccccuacugaucugacuugcuagcuagcagaguggauuuuuaguauuucuccaaguggauuuuuagcauuucuccauguuaccacuuaguccagaagagugggucuucauuuuuacaagugcuuguaugcaugugcuuguuugauuugcacacaggagcuucugaaacacugugugcagaugaagccaguggcuacccggucacaacuuacuucccagucuugacuguccacuucaucccaagaacuugggcacagcugacaugcagucacaccugugacugaggagcagugcgggaggagagaguuuguggucucagcacaugcaaacguggugucuuggugccagucagacaggucugcaauccucaccuuagguguaguuucccuuucaugccucaaagagucaucuucauuuaaguuagccagagucauuuuggggcccagagugaggucuggauagaugacaggcugguuuaaaagggagauauguauuagcagggcauaguggcacaugccuguagucucagcuccucaggaggcggaggugggagcaucaccugagcucgggagguugaggcugcaguuagccaaggucgugcugcugcacuccauccugggugacagagugagacccugucaccgaaaaaaaaaaaaaaaaaggcugggggagaucuguguuggugaguagaacacagaccuggaccugugcaugggcggcugugacugucccuuuggccauggccaguugucgccucucugcuccuuucuguuugccuuugggauuuucucuugcuguccuuugguugugagcaggauacuuccaggagaccuacugccuccaaacacagggcuggagaaagacguuuuugucuuucucugcagcccaguuugggucaaaucaaagcuuuugcaguggugucuggcugucagcacugucuaugagcacuccgcaccucuuggccuugaacuuguuugcucuaaccugcuugcuuuuuuuggacacugauaggacacuugcuuuuuuggacauuguauuacagauccacgguguguguuggaucuagcacuuggagaaaugcuaaaaauccacucugcuagcuagcaagucagaucaguagggguggauguccuccaucaagcaagggccugaauauuucagucacuggagcugagaagcaagauuccuucaacucuccuuauuuuaaaacaggugacuccucuaagaaagaaugugacuccuguccaucuuuauuauuuuuguugucuccuccuaacacauucgggacuuucuacaguagucuccugcuuauuugccauuuugcuuucugugauuucagcuaccugcggucaaccacuguccaaaaauauauauggaagauuccagaaauaaacaauguauaagauuuaaauugcuugcuguucugaauagugugaugaaaucuuguacugucuccucccugucccaccugggaugugaauccucccuuuguccagcgucucaugcuguugaugcugccggcucauuagucccuuuaggagccggcuggguuaucagggugucaaaguacugcaguucuuguacgcaaggaacccuuauuuuacuucaugaugacccuacaccucaagaguagugauuccaguaauuuggauaugccaaagggagguuguaaagugcuuccuuuagggaaagggugaaaguucuagacuuaauaagggaggaaaaaaaaucuuacaccgaguuugcuaagaucugcuguaagaacgaaccuucuaucucugaaauuguaaagaaagaaaaagaaauucaugcacaguauagguuugguccuaucugcaguuucaggugucagcuaggggucuuggaauuggggguuuuggaauaagaggggacuacuauauuaaccaaguguuaaauaauaauaauugauaguaacuacauguauugagggguugcuguguuauaaguaccacaguaaugugcuuugugggcuuguauaaccucacuucgucuucccaaagacuucuauauguacuaucaauauuuccauuuuauaggugagaauaugaaagucugguuuaguaacuuguguaggucacacuuuuaguaagugguaagaauuugcacuguggcccguugacuucaaagccugaacuucgauaaaaccacccggcucugcucccucugucauguguugcuagaauagcagugcccugguaguaugacagcaguucagaaguacuguucuagauuuugauugaugaugguucauaauaaaaauguuguucaguugcaacauuuaucaauuugaaauauuugguccuuuauagcuagcugguuuuuauuuuuuauuuguuuaguuuuuuggagacagagucucguucuguuaccccggcuggagugcagugaugugaucuuggcucacugcaaccucugccuccuggguucaagcaauucucaugccucagccuccuaaguagcugggacuaaaggcaugugccaccaugccuggcuaauuuuuuguauuuuaguagagauuggguuucaccauguugcccaggcuggucuugaacuccugagcucaggcaaucugcacgccccggccucccaaagugcuaggauuuacaggugugagccacugugucuggccacuagcugguuuuuaaaugguauaacuggaauuuauucuuuguaaaguguguuuuuucuuuaaagagguuacuuuacaagauuguugauguauucaguugcuccugcgauggcucuuggagcuuuggaauucuuuugcaguuuuggaauucuccuuuagagccugcaguaaguaugugcuuuuaaguaucuauaaugagggcacauauuuauuauuugagguagauuugauuuugauaauugccaaguguauagauacuugagaugaugacauuuuuggcuccuaaaguauuccuggaggaauuuuccaaacaggaaaugugaaaauguucugaacaugcccagugaagacaucacggggcuauguguuugaucuucuaagggaaugucuuugaagaugauuguccacucuucacauugagauaacgguuuucauauugccugguccacucaagacaauugucauccuguauaaagggucuguggcugugguagaacugccaucauaggaguuggugaauuacccuuccaucuucuuccagcuucucucugaugcagcucucccauuuuccauucucuggcuucagacuagccuagacauuccugccccugccuaccucuuaggaucagugacuugguuagcuuguuuugcaguuugccccugguuacugccucagaguacaguuucauacauuucugccuagaucagccuccugaaauaugauaccccauuuugaguucucuacucuuagcucuucuugcuuguuuggauaggaauauuugcucugcauaugaaaagguuagugaaaugauuuuacagacaugaucccugugaaaaaaaucauccuguaauagaguaguuuuuuuuauuuguucguuuuguuuguuuguuuguuuuugagacaggcucuggcucuguuacccaggcuggagugcaguggcgccaucucagcuaacugcagccucugucuccugggcuuaagcaaucuucccacuucagccucugaaguggcugggaucacagauguguacccggcuaauuuugcuuauuuuuuuuuuguggaggcggucuucacuauguugcucaggguggucucgaacuccugggcucgagugauccucccaccucggccucccaaacugcugggauuacagaugugagccacugcacccagccgguaauagaguauuuuaaaauaacaucauauuccauuauuguucaggaucuuggaacauugagugauauauuguucuuugaauacaaaacacauguucccacauccuuguuugaguuguuucucaugagugguggcucuaugucaauucugcauucccucuuguagccaguggccuguaccuuugaacuaaaggagccaucugugcccacuaauggaucagagugaagggaugucugggacuucugcucuagucagcugguuagucugcuaugguaauuaagcuguuaugauugauuauuuacugaaccuuuuggacuguuucaucauguggacuucccuuccucuggagguguauguuuucucucuauuuacugaaucuuuuggaauguuucaucauaugaaccucccuuccucuggauguguguguuuucucuuugguaauaccucuuacucuuuuccuuggcaucauaauaacguuguugccauagcauugugauuuuuauuuuuauuuguaauguaaauuaaccaaugaugugcccacacacccaaagcuacugcguauauuauccauaucgacacugauuaucauucaugaacuucgucuaaccuguaggccaggauaggcauggcuuagaugaaugcuuggcuggguggcaacagaugauuuggauauggugcugaagugugggagggcaucucuguccaugacauagcacgaaugaagaauuagcaauugaguuuuaucuaaguuuuuauguucauuuuucccauuuucaugauuaauaauugcagucaaaagaaaaaacaugauuucauaguuucugugaccccauaguuguaucauguuucagauuguuauaaaaugguuuaugcaucuucuuaccugccauccccggaacgauguaggggauaggauggcacuuuugccauccucguucauccacaaaggcuccuucucaagagugcagugguggauuuuacgaacucucuccggugcugccuuuaguaagcugaaccagagaaaagauuggcaggagugggcuagaucagcaugaacuaguccuuaccugaacacauugcacagcaguggcugaugaguacugugguuggcuccuccuuuagcucuugaggggcacucuggcacaaaggaauugagaaggggaggccuggauuuuuguccugggcccaccauuaaccagguguauguucuaauuaaggccuuuggggcccuaaggagcagaaacccacucaagcuagcucaagugaaugguuuuauggaaugaauaaaggagcccaaagaugaaagucuaggagagccucauggggacuggagcuguucuuucucuuucccucucauuaggccucuucucucuguaagccucuuucuuuuuaaaaaaaaaauuauucggaauuuugaaggcaauguucaacuauauuauagccacuaguguuguaauugagaaguccaaagacauucugguucuuuuuuaaauuaaaaaaaaaaauuuuuuuuaagggauaggaucuugcuauauugcccaggcuggauucgagcuaccaggcucaagugauccuccugccucagccuccugaguagcuggggcuacaggugcgugcugccaugccuggccuccuuaagucucuuuuagucuccugacggucugcagacugagcuuaucugcauacccagaguuuugacuuccacacgguuuuggcuugccaugugccacuucaacacccaugcucugugacccuuucccuggcuccagcuccuugguugcuuucuugucuuucagugacccaauuacaaauucccaggaggaacccugcugccuggcuuggcucuggggcagucugaucuggcugaagacaggaugcaagucacugguuauacugagcagaaguuuucagcacaguaggcgccccaaagcuugccacuugacccuugagagcuucucgcuguccuuuccguaagacgaggagguugcagugggucuccuucuuguauucaguaccucccucaugguguguauuaaccuaccugcugcuguuugucuucccuccaggaagcaaugccugugugcccaggccaugcagccugcugugccugcccaaggccaacaacaguagaagcugcagguguccagaggauguguccagcagugugcuuccaucaggggaccugaugugugacugcccucagggcuaucagcucaagaacaauaccugugucaaacaagguacuucccuuuuucuuuuuugccugucauccuccuuccuuuguuuccugcuccccgccaggggagggagggauagcucucuguuuccuaaccuuuucguguuauuggaaaaaguccaagguaaaaaucaaaccuaccagauacucauaagaauacugguuuggguucuaaguccugguaagggucaaagaggcccuucaguccucacucagaacaggccuaugcuguaccuuucuaaguaguagcugugguuuuugguuucaugucagauggcacaggcuuucuucagggucucccuuuuuauucuuuugcuucuuccucuccucacccaucccucacauccagguuucuuaccugcuccuguuuugcauaaguuggaccaaccugauugggaaaaauaaccagugugacuccuuccgcguuuacucucaccuaacgguuguccauccucucaccguagccuagcccaguguguccugaacuuucagaccaauguuugcaaagcacuuugagucuagaccuuaugccaugaccaagcagcaagagcagccuuacacccacucccccucugaauuugaauauagagauuuaacauuucuuuccuccgaaauuuaaaaaguuuuuccuuccuguguaauuuuuacugucaccacuucccccgccuccagcaucacguuucugugagugaggugaaccccugcaagggcaccuugccaugaagugcauggauugauggccagaauuucugcuuuuccuuaucugugauucuauuugccuuuuuuuuuauauauauuuuaaagagacaagaaagagacagggucuugcuguauugcccaggcuggcacauucacggcucacugcagcuucaacucaaacuccugggcucaagggauccuccugucucagcuucccaugaagcuaggacuacaggcacgagcccagcuaauuucuuuuauagggacgaggucucacuuuguugcccagucuggucuugaacaucugggcucaagggauccucccuccucugccucccaaggagcugggaucacaggcaugagccacugugccuacucuauuugcuuuguaauccuaacccugcuucucacagcggcccaaguccaaggcagugaaacacacaauacaagccuuuuagucaaucuuccuuaagaaauauaaacagaaaaaagaugagccuuucuuucuuagaaacaagagacuuucuuucaggcuauggauacaaucuuaaaacuguuuggaaagaaauagaaucaacacuaaauuccaagagaaggggaagaaagcuacuccauauuucccauuagaaugccuuugauuauccaaauaugagaccaaucaucgcauguccuugaugcaguuugccaaacuauacauuuuuuuucuguaaggaauuuuaauugcuugcuuuaaaguagucauggggcagaaaaauuucucagaguauugagaaaaucuucauaacucauuugcuugauagauagaauauauauggauauauauaacuauguauauaaaaacauaccuauagauauauugaaucuguauguuuuaauucuguguagacacaguccauuaaggaguucuguguguaauuaguauuuuauaauguugauguacuguauucacuacccaauagacucaacugguauugugguuauccuucuuaaagcauuguaucugcuucuaaauauuucuuccagccuccuccucucuuuugauuuuaacuaaaagaggaaagcaagaggcuaguaugggacauuuccuucccuguagacacgugugcuuggcauuccuccucccccuuuaccaucauguuacuuguugugggaaguccgggaccccgaacggagggaccagcugaagccauggcagaagaacguggauugugaagauuuuauggacauuuauuaguuccccaaauuaauacuuuuauaauuucuuaugccugucuuuacugcagucucugaacauaaauugugaagauuucacggacacuuaucacuuccccaaucaauacccuugugauuuccuaugccugucuuuacuuuaaucucuuaaucccgucaucuucguaagcugaggaggauguaugucgccucaggacccugugaugauugcauuaacugcacaaauuguagagcauguguguuugaacaauaugaaaucugggcaccuugaaaaaagaacaggauaacagcaauguucagggaacaagacagauaaccuuaaacucugacugccggugagccgggcggaacagagccacauuucucuucuuucaaaaggaaaugggagaaauaucgcugaauucuuuuucccagcaaggaacaucccugagaaagagaaugcgucccugaggguaggcuucuaaaauggccgcuucgaggggcggccaucuuuuauggucgaagcuguagggaugaaauaaaccccagucuccuguagugcuccuaggcuuauuaggaugaggaaauuccugccuaauaaauuuuggucagacugguugucugcucucaaacucugucuccugauaagauguuaucagugacaaugcgugcccaaaacuucauuagcaauuuuaauuucgccccguccugugguccugugaucuugcccugccuccauuugccuugugauauucuauuaccuugugaagcacaugaucucugugacccacaccuuauucguacacucccuccccuuuugaaaucacuaauaaaaacuuggugguuuuacggcucagggggcaucacggaaccugccgacaugugaugucuccccagacacccagcuuuaaaauuucucucuuuuuuuacgcugucccuuuauuucucagaccggccgacacuuagggaaaauagaaaagaaccuaugugaaauaucgggggugaauuucacccgauaucuggcugaauuucccccgauaguuacuaaagggagggaaacucaaaagagaaagaccugugguccagcaguaagaauaauauugguuucauuuccuccccugccgcacucugauggguagagaacaccugucuucgcaaccaguaucgcugcagcaacgggaacuguaucaacagcauuugguggugugacuuugacaacgacuguggagacaugagcgaugagagaaacugccgugagucuucuggauuggacguuaagcacuuaccauuacucagaagccugguuggcucuucccaggcugagggccuaaggucuagggcgagggccacccaugauuggugaugcccaucuaaguugauggggcuuagaugacagagaaaacauauuuccauacacagguagauauuagauauauaggauuaauauuauauacauaauauuuuuuuaaccaccccagaaguaccacucguuacaagagauuuauaaauaaacgucacauggcugaaacugaauugauuuggcaaucugggcucuaaucuuggcuguggcucuguaauaaagcuggugacuuggggcgaguaaacaggugauauucuuugauuuggaaauucaauauucagccuuuuuagggaugggaaaugaguauuuacuccaguugguugauguuggcuaccuaccaggcucaagagagauuguuuucauugguuaguaaugcauagcuuggccuacaguguggggccauugguguacaugccauguaagugucaucuuuaggcuguauaauuuuuaagaucugacuucuaaaguauaagacugugguuagcagaaguuaaaaccaaacaaccacaaauaacagauaguuuauuaaccaugaauuuucacuaucuuuucuucacuuaauuuuuaauagcuucgacauuaucuuauaaggagaugauuugcccuuuugucagucaugcacucacucaacaagcaguugcuauacacccuguguuccaggcucugugcugggccugcauauauauugccgaucaaggcagaaacggaguucacagucugaaguaggagucagaaaaauaggcaguuacaguagagugacgggcacugcgaugcggaagugucauaugcauguaggaugggcacccaaagcaaacuugggcaggcccuagcaaagagcucuggagagugucuggggugaaccaagcagagguggagggaaucaauucacaggcaagggagcagcauguggggaagcuggcauggccaggaaacugguuugaguuauggagaaugggcaugggcacaggggccaaggugaaguuagaugagugggcagcgcccaggacagcaagggcuuuguggacuuuaucggagaagcaguugggaaccacugaugucaugugaugaaaguucaucuuuggaaggauaaguagugggcagaaugcguuugauggagagagaccagaagcaggaaccaagucagaggcuucucuuuuauauauuuuaccuuuggcaacccaggggcucauuuacccauuuguacuguaagaacagauuaaugggaagcucuagauacucauuuagccagucauccguggggccugugcccggcuccccugccacuucacccagaaagcaacuugugaaauauccagcucauuaaacacaucugggcccugcaauccuauagacucccccuuuuggcugauagaggguuauuuacaaagccuuuccuuaaucguuuucccuuggauucagagggugccuuucacaccgagggaguagagcuuauuugcugaauggcagauuugggaaagcacuagccucucugugucuuuucugcaaaaaauaaggccuauaaagccuccuuuaucagaguugcaggaaggugugauauuugugggggaauagccaaagcucuuuaaaaacauuaaugcuuauuaacagcauugaagcagauaauggaaaggaguuuauuacauaucugggugggauagaagaugcuucuuagaauuaacaaguuacaaggaaauugcccagacauaauuaggcacaguggaagcagggagauacaaaccagaugaccucauauccaagagugagggacacagguggcagagcauuccuccuugugcccuugggcuugguuucuacuaaauggacaagcugaaucuuguauuggcuccgaguuuugagaggaaugaagaccugcaucuuuugggaggcaccugcugccuccaauggcuuccucccacccagccccugagcucuguugcagacugcacaguugugcaugaaggauggagcuggcccugcccuccucccagcuuggcgugaaugucagcugggauucacuuuccagagaccccgagaccuacuuucugcuccgucgucucccuguuucaccuggcucaggucuacacaugucagauggagcugaggcguggagaggaggaaccagaaggauuuaaaacucagagacugggagucaagagagaggggcuuaucugugccugcaugugugucucccucaucaaggagguugcguguggaggagagagguucccuguuucuaagcagggcugcaggagcuggaccgcagugacugaguacugccauguggggaguuaagugaggcacccugccagcugccagggagcaguggaggaggggggacaccgggaugcaggaggguguugucaguggguuucccucccucuuacacagauuccucuagcugggugacugucaggcacucaggguuuugacgcgaaucccugcagucuugucauuuugcauucauccccugccucccaccacgagcucaauuacagagaagaaauggagccucaaauaagagcugccaggaugucuaacggcagcauugcuauuuggcauuucgugcacgacaaccccucccccgugccagcauucuguucugccacauuuuaccuccugggucagccuuucacucuccugagagcagccugccuuccccucgccuuuccuggaggguguuucacggggugccagggauugugcuuaagcacaggaaauaucuacuuaggagaggaagaaaaaucuaauucuguauccauucuaaugccagaaggacaugaggaaugaugaggaagagaagugacauuuguuuagagcccauuauauuuacauccuauuuaauaggcucugguuccaaacuuguucccugguuuaucuucauaauaaugcuaccaaguaaaggcagguuaaguaaguuguagguugcagacucaauucaaaucuagucuuucuggcugggcgugguggcucaugccuguaauccuagcacuuugggaggcugaggcaggcagaucacuugaggccaggaguucaagaccauccuggccaacauggcaaaaccccaucuguacuaaaaauacaaaaauuaacuggggcugguggugggugccuguaaucccagcuacucaggaggcugaggcuggagaaaucgcuugaaccugggaggcggagguugcagugagccgagauugcgccacugcacuccagccugggcaacagagcgagacuccaucucaaaaaacagaaaaacaaaucuagucucucugacugugaucucaagcacuaggacacauuaucuuacccaguuuuacuguugagaaaacagccguagggagauuaaaauuaauuuccccaggaagagguagagccacgauuugguacccagucuugacugacugcagacagagccuauguuccuacuguagaauucuaccuccaugcugccuuuaccaucuguacaaugaagugcuaacuucuugugugaaauugagcuucucuaaucguaguuucauagauaaagguauuucugucacuuauuuaggaagacacuuuucgcgucugaagggaucuuaggaggucaccuagccugucacucucucucgccaacagaugacaguuucucacuuuuccccguccuguuccgaucuggaagcuguccacagaaagauaugcccuuaucucucuugguuguaaauuucaagcucucauguaauuuaugucuucuguaagucuagguuuaauuucuguugcuacaauuaauaccugcuuucuucuauuuuuuaauugguuuuccaguaggauguuuacauuugugggaaaucaauuguaccuaaggaauauguugucuuucuaucccauuuuagcuaccaccaucugugaccuggacacccaguuucguugccaggagucugggacuuguaucccacuguccuauaaaugugaccuugaggaugacuguggagacaacagugaugaaagucauugugguaaggggacaucacauccugaaacccugcucuggagaggggggucauugugcucccucacagggcuguacugguauguacugguuuucugauagccgucucaggauuuaugauauucuagcugaauggcuuucuccauccacauggugggguugagucauuucucuguccauucuuaaagaguuuguuugcugcuuuucacgaggauucaguucgcuggagacacuugcgaacugggacccuagauucccauuaacucuggaugggacccuagauucccauuaacucuggaucaagugucuccagcagaacugaauccucaugauucauggucagaaaagauggagccuggacucagcuccugucacuuacucuuagauuagccuuuguuuucuagucugaaaaauggggaaauggacccugcuuugccuuggagagaugcuauaaggaugaaaggugaugguaaggaaguaaauuucugaaugaauucaggggguuauuaacagcucuacaggcuuggcccacaugucucagugggugugagauuagccugcugaagacacaaaucugcaccucugugaacuguucuuuuuuuuuuaaccaauuuaauucauucaacucuguuauuauuagaaguuagcagaugguauaggcauugagugagcaucuguuuucugaauggacauuuuuauauuuagaaaaacaguggguuacaauuccaaggaaugauagagauucucugguccaauccuuuuaauuucuacuuucuaaagugacugaggucuguagaggucagggggcuuauucaaggugacacaauuaguuugugucagaauggggaacuggaauccaugucucccauuuucuaauccuccacuauuucuguugcacaguaccuccuugucaguuucaugagacccaucuuaguuaacagucccuggucccagacucauaguugcugaccuccgaaggagacauuaugcaaucagcauggugugccagauugaggcaugagagggaagugagaguggaggucagacgcugacccagacguggugaugaguuggcggggcccuacugugcccucucucccuguccacggggggcagguccagccacgcugugcuuacgcacauggacacagccugcuugauuaugagcaggugguuugacucacagcagcugaaauaaggggagcaagggcagcuuguaaaucaucucaaugcaaguuaaccagcagagcagagccuaggccauuuccacacagaaaauaccccuagccuggcucuuggaagguuuuuaaaaaauucccaguuuuccuucuucaagugccugaaaacauguccuuggaaugugcaacuauuuccccuucaucccugccauuuccuucccagcacucuuagaagguugaaauguguagcuaguuuugcccuaguaagaaggaaacuucacgugguucccucuuucugguaucauugagcucacguacuggguacauguuugacugugaagcaguuucagcccccugauccucuguucauggcucauucuuacuaguuuguccugaauucaucccagggucccgguuagccccuuccucugaugcagguccucuucguaaguuuccacacucuuccucaaaaauaucugauuuacuagcuuugccaucaacaagccucuuggcgagaaugacugagacggcugccuugggccccacgcuuggcugcuccuguuuucugacgcucuguaaacuccaugugaaaguucuaugccacagucuauuugggcugugauaacaaaauacuuaguguagguaauuuauaaacaauaguauuuuguuucucacaguacuggagacugggagguccaagacugaggugccagcagacuuauugucuagugagggccuguuccucauagaugguaccuucacugcagcgucagauggcaccucugcuucuggaaggacugcagggaaaugcuucuaucuguacgcaagcguggcagaaggagugaacagcucccucccaccucuuucuuaaggacacuaauccuauucaugagggcucugcccccaugacuuaauuaccucacaggggucccaucucuuaauaauaucacauuggugauuaaguuucaacauacaaauuugaaguuucaacauaugaaguauaaacauuugaauuuuccuagccuccagaaccgagagaaauaaauugcuauuguuuauaagcucagccuauagcauucugucuucaugaucuccccaggagcuuugaaggcuauugccagggcagccuccuuccccuucuuggucaagcucugcugguugguucuuaccaggcccccacccuucuagagacagcgcauccacccgugucccuggagcucugcccacagaaagucccgaguuauguuuccuccguuuugggagcucagcacugauuuuacucucucugacugagcaucucacggugaucagcucaugcagaccucucggcacuccuuuucucaaaccacaggcugugucuguaggaguccucuguuucuugaaaguucuacuuccuggccuccucuaucacugcuuccuaaccuucuucccaucauagcaagcauagaaaauaauauauguggagagcacugggaugaauggacaaggaugcuguugucaagaggcaagcagcucuaagggucugagggucucagaaucucagcccaccuguaacccauuugcagcacacugacuggaagcuguuaaaugaccuuuugucccugguaaaagucucuucguucauggucucuguggaucauuggugaucacggguccaucuccauccuuuaugagagcuuugacaccagagacaaaauucugaacaagcuuuuguccucaccucucuguuuauggucucaccugcagaaaugcaccagugccggagugacgaguacaacugcaguuccggcaugugcauccgcuccuccuggguaugugacggggacaacgacugcagggacuggucugaugaagccaacuguaccggucaguacuuccuggacucaguugacagcacucauccguucaugcagugguuaacauuauagcuuuaaacgaucggaaaaucuaggcucugagaauuagcuuggaccuuagaaaucagcgaguuucaugcuucucaaagagcuggucuuugaugagauaaggaaccugugccagaauguaaaucaacacccugcuuucaacugauuaaacaguguucugagugauaucguugauuuauguucuggcucaagcuucuuauucauucaggaccaguguuaaacaguuuucagaccagccccucggcugggguccauacuuugaguaagcacugaacuagcucauguuuuuuaaaauggagcaucaggggguuccccagacaaggaaaauguaaacuguguuuguacccguuuuggguaagauuuuauuaaaaguaaagauggaaacaacaugaaugugcuaggugcuauaagguagggguaguguucucauucuuuuguuggguucgcuuauguucauuacauuauuuuuaugaaugaguggaugaaugguggccagauauauuaugauggggcagggcagacugggggugauaggcaguggguagugcaaggaguugagaagcuuguggagaaaugaaaacaaauuccauuuuauaaucaucacuuuguaccccauuguaauuuguccaaaaaacaaaaauuaaggaauuuuuguuccagauuuuauuacucauugaguaaauuugcucuacagccuccuugagaagcuguuauucaguucugucuugaaccccucuagugauuuuggacuagggagauaaagauguuuccuuuaaacauuucaugguaaggacagaucuguuuuuacacucggauaauucagacuucauuguguaauucauuguugagucaucuucucaauuaucugaagccagcuauuaaucuugugaauuauuggacuuuuaaaucucaugucuuaaccuccucugcccccagaguaucccagcacuuccuacacugcccggcaucuggcggcucaaagcacgccuacuaauugguaaaaggaaauacaaagaagguacaucuguuauaucucagaccuaaggauaaauaacugugcauuaugcucuggcuuagacuugcuuccccacggagagagaugaccucuucuuuuacucuuuuguauucucugcaguguccagcacauaauagaguaugugcucagagaaccuuuguggauugaguaauuuuaugcaacugcuucccuccauuccuuuuaguuuggaggugaccucauauggccuuaagggagugaauagaucucuucaaaugccauauacaucacaugggauauucugugguguuaccaaauccuguucgcuuguaaaguccacccauguucuuucuggcgcagccucugugucugcaccucugcuucugaaaagacugcaggaaaaugcuucucucuguauauuaaagcauggucugcagaaggaggaagaaccgaggcccauaaaggagcugccguuggcacaggaaacacgugaaugcuguuuggaagcuuuggguuuggauggauacuuaguuaauagauuagaagggugcacuuggacauugcaguuuguaaauugcaguaugauugaacaucuuguuaacacaacugccuuacucaaauuugcauuucagcagcaugugccggucuuacagaaugaauugauuacuucauuucuauaggcaagcuuguauaaacuccugguuuuuucucugauuuucuuccggcaaggcaaacuggagaaaacuuaagaguccuugcugcucagcugcagccuuguuccaagggcuguucuuccaaaccuuucaaggaugauccaccuucucugucaucucaaaauaguuggaggucagaugugagcucauggugauguguggcaugacaccucauuuucagaccuacuaaauuaagcugcguacagugccaaaagaaauaggucaagguagcugaccuccuguuggcaucagcuuggaugcgcacucugcugugcguccucuuugcuuuucuuuucgccacuuuuacuuuccacgaggcuguuucuuuauucaccucaacccaccgcuauuguuuuuaaacguguacaucugauuucuguguguuuuuuuaggacaauuaccuguagacauuuuauuuguauucuuaacaucuuuccucucuccuagauauauggggacuuuagaauuugauccaaaucucugccuacaguuccaguacuaaaauaccuaguauuuuaaacacuaaauauuuaguauuuuaguuuuauauuaaaaaauccuaaacuucacuguuacucuuuuuaaauaaccacacuucugcauaggcacacagguauuaccaacuaccucugugucuuguugcuaaugccucccaccaauguacauccuucagggguuuugcagcaggagucuaugaguggcaaacucuuucaagguuuuguuauuauagacauauauuuaauccucaaucuugaauucaaaugggucuggguuucuaggcuuuuaguaauuuuccguauuuucauagaauucuuccauuucuuccuggccucuuuuguguugauuugaauucugcucuuaguugucuguucaaauaauaacagacacucuuuucuuucuaauuaccuuuagguuauauugcucuuaguuuuaccuaccuagguguggaauuauuuuuacuuauccugcuugagacuuuguuuguuuuaagaucugagaauuuuucgaaagacaacucugggaaguuacagcuacuaacucuucaacuauaccuguuggcuacuuucucuggucuugucuucagcaguuacucuaagccauucguuggacugccucauucuguuguucucuucccuccuguuuuuauauuugcugucucuuuaugacucugugcuagaaucugagcgacuucucuagauuuaucuuccaguucaacaauucucuuuucagcuaacucuaaucugcuguuucacauauacauggagcuguuuuuuuuauuuccaugaguauacguuuuguaucuagaauuucuguuugguucuuuuucaaaucugccuuuuauuuuucaguguucuuuuuuuaauacuuuauguuuuuucuucucugucauuaaucauucaaauugugaugauagucauuuuuuuccucaugcacuuacuuuuuuuuuuuuuuuuuugagacaggguuuugucuugucucccaggcuggaggguaguggcgcgaugacagcucacuguagccuugaccuccugggcucaauccaucuucccgccuuagccucuugaguagcuggggcuacagacaugugccaucaugccuggcuaauuuuuguauguuuuguagagaugggguuuugccauauugcccaggcuggucucgaacuccugggugcaagugauccucuuaccuuguccucucaaagugcugggauuacagguaugagcuacugcaccugguccccuucucauacacuuuuuuuuuuuuuuuugagacggggucucugucgcccaggcuagaguacaguggugcgaucuuggcuuacugcauccucugucucccagguucaagcaauucuccugccucagccucacgaguagcugggacuacagaugugugccagcaggccuggcuaguuuuguguuuuuaguagagaugaguuuuuaccauguuggccaagcuugucucuaacuccugaucucaaagugauccacccuccucggccucccaaagugcugggauuacagguaugagcuaccacgccucaugcguuucuuuauagucuagcgcuuuguaagaaauaaggcaguacuuucccuguuauacuacuuauuucauccauucuacucugcucauguuugguuaaugcuuuuaaucaggcauuccagcaggucuugaugaaucaggaaaguucugccugagucaaagauuaaguuguaggauauugaccuauauuagaaacugauguuagauuuccacgauuguuuaccacacgaacuucaccauucuuauaguuacaaugaauccuaccaugcagaggauucuuuuucuucccuaaauucuucagucuggauuaaaguccaucucuuccauccuuguaauuaaaaaaaaaauauguauuaagcaugcaguauuuaccgggcacucaaaaucagagcucauaaguuacuaagaagauagaaaaaucuagaaaaagauaaugcguuauguauuccagccauaccuggccacuugaaugcaaacugauuacucuuucugagcucagcuucugugauagaaucuggagaucucagccaugccucccagaauugucauuuggaaacuucacuagcacucugaaaugguuuucaauuaaaaaugaaaugcagaggcugaauaauaacuagauuaguauggcaauugguuuaggcaacuuuauauuuuaugaaugugagcaaggugucggugagggauguuuugaaaggcugucagacuugugacacgaauaaaucaaaaguauuccaggcgauggcuguuacuggggcagaaacucauguaacaugcaugauacauuuauuccucuuaucagaaauaaguauaguuuuuaaagauguuuaauggauucugagugccaaagguuguaaauauugaaacuucuuauaguuguauauacaugcugccaaauacagccuugguccuuggagagaugggaagacauagauaaugagcuaccacuuguuuuaaagugguuugaaaaaucagguucuuuggauuucugaccauugcaaaaaauagccucaaaugcaguaaaauuccugaggacaucauaaaccaauuuucccaguccuugggcagcuuacugccaacugucucaguugaauagaaaacuauaguuugcucucagcaacccacuucuguguguuuuguuucuuuccguuguggugucauccucuccacacaguuaaacuaacagagaguccgucuaucuagguucuauuaucuuaugcugguuguaaacaaggccaguccuggcuugcauucagcaaugaacagacacaaacagcuuucuguuucagaggaggaagaggaaaucagauggagaggaccguuaggaguguugguuggguuggaggcacauauuacgcauuugaacuaguguuugacugaguuuuugaggugguucuaaaugacuuccagguggccucagcccaugugugcagaggaggcuguucauguuuaacagugacucucuuucacuagcuucuuuuuugcuucuagugauuauaguggacaccacauauuauuggcugguagauguuccucucaacucuacagaaagacaauuucaaguucuuaggccugcuuucuuugugauuuuggaugacucuuuuauauuccucuggccugagguuuuucacacuugaaauuggauuuuuuuuuuaaagaauuguaauguauggccuuccagaacuuagcagggcccuuagguuucacuguaaggauggugaauuugagaucaccacacaguggcugcaccagguccaggacuccgucuccugagcacaggcugccgcuccuuauuucucagcaucuggaugaguaagaggacuuaggugagaaggcaaacuaccaggguauagcagaagaagugcaggcuugggccuuggacugccuugguguuacuacuuaaugaucucuaauuuuccuauucucucuaagccuguucucauuugugaaaggggaauaauccuuaccuuguagguugucgugaagagcaagugauuuuuuaacgugugcaucugucccugggcaauggccugggucauguuuauaaauccauaggcucaaguccaccgagggagcugcccaaggucagcccaagugcccaauucucagccaaggagaaacccagaugcucccacaguucagaccuuauuccuaccucaugcaaaccucuuuucagcccacccccuuggacaguuggugggggauggagaugaggggugugcgacugugucucucuucucuguuacagccaucuaucacaccugugaggccuccaacuuccagugccgaaacgggcacugcaucccccagcggugggcgugugacggggauacggacugccaggaugguuccgaugaggauccagucaacugugguaaaugcaaauuccccagcucccucccugagccuccccagugucugcuguucaggaagagaggccacagagagccaggggaugaaaugcuguucuccuaugccuguauuuacacucugaaaccaaauaagcccaucuacuuucuauguuauauugccauaugauguaucagauuauauuauauagucuuaagaguugcaggcaagcaguuugccccacacacaaacuauauaaaaugcugccacguaaacaaaauauauaaaauguuuuuugaaaccaaauauguuuaagguucucuauccuuuugccaaacauuccaaguuuucaggggauguuaguugucuacauguuguuauacauucuacuccuuaaguaaagauguuuaugcaacucuguuuuuguguaguaagcauuuucauggaggaugcauauucacuuuaugcuaccauaaccuaguuuacaugguugcuuccugguuggguguuugagguuuuuagauuuauacuguuaugcuaguaccacuauucgugucuuuggaaauggccugauuuuucuuugagauauuuucugagaggcguucuucaguauggaguuguaaggugaaagguucugaccaguuuuugagucucucuguuaccaaauuggguuuccaagggauuacaucaaaugugucucuaccaguaaaacguugcauguuuccccaagucuccuugauauuagauuuguaucuuuuuaguugcuuccacuaauguaauauguguguuugccucauguaguuuugauuuauaccucuuuuaaaauacuuuuucuaccuagugacauuaaccauuucuccaaauaguggugcuuguuuacuguuucuguuugauauccuuuggcuaauuucccagaaaugauuacuuuuuacaggauuaaaacacauuuucauacuuauaccuaauccucaaggaacuauucuacacagagcucaguuugcaaaggcuaucuaugacugccucauuagaagugauuuucuuuuuuuuuuuugagauagggucucacucugucacccaggcuggaguauaguaguaugauuguggcucacugcagcuuugaccuccugggcgcaaggcaucuuccuacuucagccuccugaguagcugggaccacagggguuggccaccacgcccagcuaauuuuuguauuuuuuuguagagaugagguuuucgccauguggcucaggcuggucucaaacuccuggguucaagugaucugcccaccuuggccucccaaagugcugcgauuauaggcacgagccacugcgccuggccagaacugauuuucaaguccaaugccuggcaauaacuuuuugcucaggagaaagggugaccuaguacuaaagauucugaucaagauaccuuaguuguaguuuaauuuccccuggaacuguugugaaaccucaggcucuuagcauuucuaggcaaacuuucuccaaaacaacuuugcuuuagaauuccuccagaauuaagguggugagugauuuaaauagcuuuauaaaacuaggauuucauacucaagauucauauugugcuuuuucuauucauugaagcuuuucuuuuucuucuaaaaaauauacuuagaucagguaugguggcucacgccuguaaucccagcacuuuaggaggcugaggcgggaggauggcuugagcccaggaauuugagaucagccugggcaacauagcaagaccccaucucuacaaaaauacaaaaauuagccaggcacaguggcgcacgccuguggucccagcuacucaggaggcugagguggcaggauugcuugagcacgggagguggaggcugcagugaacugugaucacgccgcugcacuccagguugggugacagagcaagacucugccuuaaaaaaaaaaauguauauacacacacacacacacacacacacacacacacacacacuuaucaaaauggaaauguucaaaauagaaaagauacaaaaagauauaaucucucagguguagguugaucuccucaccugcccaguucccacuuuuuccuaauaggaaaccaaguuguauauuuuuucagaauauuuuugugcauauauaaacaaauuuaaguauacucuguauuauuguccuauuucauacccauaauguuuaacuuugcguauuguuuugcaccuuguuuuuuucacagaacuguuuaucuagggcauaauuuuuauagagcacuucuugcaucucuuuauagcugucuguguuccaguguacaguaauuuauuaaacagucuguuauugauggacuguuuucaaucuauuacacaguuuugcaaugcaacacuuguacuugugggcgguuuucaaccuguuacaaacaguguuguaaugcaacccuuguacuuauauuaagua[450 bp omitted]cugaguugaucccugaguacuuggcuaggacuccuggaggcugaucguggcagagagacaggguuugguuaaaggagagcaggaaggaagaaagcaggguugggggcgauggugggauuagaucgaacuucagugaaaguuauuguuuaguugaaauauguucuauuaauugaccaguuguuuugaaucggccacuuauuucuacuugauugguuuuguuaguguugcugaguaucacuggggguagagugggggggggggcggggggggggcauuuuuaggccagaugacccuuuuuaucuucaguuuucuuuagccccagaaagauugccuugggucacuggugcucauccuugauuauauauuggaaucaccuggggagcuuuaaaaccaccuggugccuggaccuuacccccagagauucugauuuaauuagcguagguguggcugggacuugggacauuuauggugcuccuggugauucuacugugcaguccggguugagagcuaauguuaucagugcagggaguggcaaacuagccugugggcaaaauccagucccuaaccugcucuauuaaaugaaguuugauuugcauacaguaacuacuauuuguuuacauauuguauauggcugcucucaugcuguagugguggacuugagcaguugugacagagucuguaugaccugaaaacccugcaauaguugcuuucuaguuguguuaguugggguuaguugggguucuccagaggaauaggaccaauaggauaugcauauguauauauauagauuuacuuuaaggaaccaucaugcaauuuuggaggcuggcaagucccaaauuugcuaggugagccagcaggcuggagacccagggacacacugaggcuauauaguucaaguccaaaggcugucaggcugcaaaccuuggagagagccaguugcaguucaaguacgaaggucuugcuguguccucacauggcccuuucucugugugggcauuccuggugucucucucuucucaaaggacacgaauucuuuugaguuuaggccccauucuuaugguuucauuuaaccuccauuaccuuuuuaaaggcccuaucuccaaauacagucaaauuggggaucagggcuucaacauacaaauuuugggggaacacagugcauuccauaauauuaguuccuuacagaaaaauuugccuacccccguauuagagagucaguaucuauuaaucaugcuugagauuggggguuugaugccagacagcucuggauuucacuuuuggcuucaucuucaucagcuguguacucuuggcaaaauacuuaaugcuacugcccuuguuuucucauuuugaauuagcgacaauaaaaucucuccuaauguugucuugaggguuuaaugaugcacuuuaugucaaaugcuuuagcucuaggcuuggcagaaaacaagugcucaauaaauuguggcuuuuacuguugcuuccugaagccacaucuguacucgugugcacuugcccagggcuagagggcccagccagccgcagugcucauggccucuucccuucucuggaucccuuacagagccccucuguacgcacuucauggacuuuguguguaagaaccgccagcagugccuguuccacuccauggucugugacggaaucauccagugccgcgacggguccgaugaggaugcggcguuugcaggaugcugugaguuggggcaggcaggggaggugacucacggucacuaaagaacuugcauggggguuuggccacccugggguugugucucuauuuaauaacugacaggucuugguugagugucgaggguuugaccacccuggaguugcaccucuauuuagcuuacaugucuagguugagcauccaagcuugccuuuucugagaaagacuuucuuuuguugcuuaaggaauccugcuuuucaguuguggguguauguauaaggggcaggauggcgagugaccagggucuuggcucaagggucgcugaaagugagaggccuuucuugccaguacuguaucagauggcacucccagcgugccguagccccuuacccugcuucgaugauccugucacaacuugccccaauuuggaccugucuguucauuuugcugccugagcuuuacaggagcaggggcuuguuuugugcauugcuauggcccucuccuaaaauagugcccuucuuggagcagcucuuauauuuguuuccugggacugcuguagcagaguaccacagaccagauggcucaaacaacagaaauuuauuucuugcaagccuggaagcuagcaguccaagaucaaggugucggcaggguuggguuccuccgaggccucucucccuggccucauagacggcugccuggcugccuucucccuggcucuucacacggucuuuccucuguacacaucugugucuaaauuuccucuucuguaaggacaccaggccuauuagauucgggccacccagaucaccucauucuaacguuuccucuuucaagcccuuaucucuaaauacaguccuguuucugagagacuagagguugggacuuaaacacaugauuuuugggaggauaaacucagcucauaacacgacucgguaaagauucauggaauggauuaauuaacaaagugugugcucuguuuagauuagguuuggcuuuugcuuucaaggcaugguuuagccagacaguccuuugccagaacucacugcuguucccccuugcuucugggcaccacugcugcuucgaccccucagcauggaaguuccuggacuucauggauguuuguucccucuguagcccaagauccugaguuccacaagguaugugaugaguucgguuuccagugucagaauggagugugcaucaguuugauuuggaagugcgacgggauggaugauugcggcgauuauucugaugaagccaacugcgguaagauguccagucugccuccucacauccuaauccucuaguuaacagugaugccugcaguuacagggacacucaccggcaaccccacugcagacuuggccuucccguaacucagcagcaguugcugccaguuccugaauacucauacgaguugagucuugaagggggcagcuggcacccagcaggugcuagggaaaaguuuauuugaucuccuuuccuuucugugguugggaagaccacauuauguauaaggaaggugguagauaaggaauuaugguaaauauuauggagugaccucccccuaaaagugacaggccacaauguaauaguuauugucaugauuggauuaccaucaauaguuguuuuauuccuuugguaaaaugucagaauuaaaauucaggugauuguucucaggauauuguaguauagaucagaggaacauggguuaggggcugggaagaugggguuuuguuuaguuuguagguguauuuuuuguuccccauuggguccaugaagcugccuuaucucuuuaugggugggaaguguggguugcccuggaacuugggucuggaggaggaugccuagaguuggagcccuguguucacacugaugcagggaaagcaacugaugaugugguugaucucugcagaaaaccccacagaagccccaaacugcucccgcuacuuccaguuucggugugagaauggccacugcauccccaacagauggaaaugugacagggagaacgacuguggggacuggucugaugagaaggauuguggagguaagaggccccuggggccuggguuagccccauaaccaagacacaccagaauaguuccaccagcuaugcaggaugugccuggcugauuccguguuuuggggggcauauuuuugugagaggagugacucaaauuuuuucuguuccucuuucucauuuugaaauaagugugguugguuucuccuauuuucaggcuauuuauuccguauuugcagggcagagugagaagucuagagccuuccuacucaaaguaugguuugcaaccaguagcaucugcaucuccuuggaacuuguuagaaauguagaaucucugaccucaccccagaccuacagagucagaaucugcaugcuaauaagcccccagguccugugugcuccacaaugcauuugaggagcacucauguggaaugcagacuugccccuuuccuuucuggcauucucaucucugaaccaggucguggaguaguugcgguugaauuaacuagaacacaaugcuuugccucaguaggaauucucuuagccacccugugccuccucagccaccuguuucuuucaccagccccugcaaaagcaaacuuaucugaauauuaaccgaaaucaaauauaguaagggaaaucuacuccccaaaagggaaaagaauauugccucuucugacaacccauuauacaugauuucuagauuagccgcugcucagagcugugccagucacuggccucccucagcagguacagcuaaaacugggacauccgcacuagguuugggacauauuuggucuaagaucaagcugcuucuaauguuuuggguuuccgugcuugguguuuuucucagauucacauauucuucccuucucgacuccugggcccuccacgugucugcccaauuacuaccgcugcagcagugggaccugcgugauggacaccugggugugcgacggguaccgagauugugcagauggcucugacgaggaagccugccccuugcuuggugaguucuggcccagguccucuccugugguaccugcuauuguggagaggaccuucugggggugugcucugggcacaauccaaccgggccccaugcccugcugucugggacucugcuguguggccagguugccuguuacuaaugguguaccuccagggaaggcugauuucuagcauuuuuuccuggaucauagaugcauaggaaauuggaaugggagcaucucauccucuauaacuggccucugaccuuccugcaagaugccagccacccugauuuccacccaggcuaugguuaugccaccuuugcugccuucuuagugggaaaguacaaauuggaauuaauguggaacuuuuuguguguguauuaaacucuggggagagagcccaauucagcuugcuaguuggccggccuguccaacuaaaagaaggguaagcacugccaucuaguggcuaaacucaaagaggcagcugaaggucuguagucaccauauuguuggaggugggguagaacuugaaaucccauuucgugugugcuccuaacagcaggcggaacagaggugaggauccuguguucuuuccuaagcaggagucuacuucaaacucaguuauaauaggagaacaaauaauuuuuugcaugcuuugcaugaucuuuucccuucuucugugagcauguucuuuccauugcuuccuuguuuaaaaacaucaaaaucccaaacuuuagugaaccuaaagcauguagggaucuccuggguuccacccagaaauucugauucuauguuuuuuauaaaacauuauaaaaaugauguuuuuacuaggguggucuuuuugccauauugaguuuccucuuguucuccugucuagaagaucaauuuuugacaauuucuauuuuccaggcccucugugagcugauuccuccuugccucccuggauuccuuacaucagccaagcuagauuccugaucuucuucagauagacuugcuucuuuccugccugugcaccugcagcaagguuuugcccucagcaggaacuccuguacccucaaccuugucuuccuacuuuccuuaucacugaaacccaccauccaucagugcaaacagaagcauggauuuuauagcaaaagagaccuugauauauucauaucaucagaacuucucaaaaugugaugcaaagaccacccuaauggaaucgccugggguguuuauaaaaaaauguagaaucagaauuucuggguggagcccaggagauccccauaugauucuuagguucacaaaaguuugggauuucugcuuugaacaaguaggguauuauucuccuuucaagcuccaccucuguggcgcuuucacugauuccuuuaaaugauuuccaucucuuuuccagucucauuaaacuuacccauugaccuuuugauucuuaacuaugaucugccauauauugcuuccuaauuauuucaugcguguugaucuuugcuuccauagccauuguguggacuuccuguuugggaaucaugcugucuacuacuuugaguccugcucugugucuccuacaauaauaggcaaauagucaguauccccuaaaaugcuucucaaauuaaaaugaauuguaaaagagaaaacaaaacuuugugucuguccuuucuccucaaggccuacauauuuauugaauaacuugauuauccucuucaaguuguuuuugcuuauugaaacucugaccaggacauuaauagacucuagcaaauucugacuaauccagugaucagaucucuguuuauauauccuguucagcuuuuguacuuucuuuuuugugcgcagugcugggacaaauuuaaacucauuguuaucuguagcucguggaucuucuuuguuuaguguagaagucuucuaacuggcuuauuaaccucauauuucucccccuuucaguuuuucuucugauaaggcccauacugaugaaugcucauguccuccccaguauuggagcccucugaugccucccuuauuguccagggcaugauuugccuuggccuggcauucucccccuuuuuauuuuuuaucaccugucuccauguaccuuguguuucugcagagugguucugagauauagggaaagccccuuugaaaauccaaugaaaacuauagaauaugcacaauauccugaaguuaauaauugcuuuuuucauuuguuugcuuagguuguuuuguaccauuugccaaugcuuucugccuuucagucgccacucaggauaacuuuccacaggucaacauguccagggauuuaucaaguccaguuuuucucuuggagauacuccuucuaacaacguggauucuccuuucgggacagauuguucucuaguccugcugugugccuguuacccagggacuuucacugccuccuuggaauucucuuugccuuucucccaguuuagauuccuuguuuccuggaucuuguguguugcuuuuucuugguuuacucccuuguuuggguggagugcauccuucaguagccuugucaggugaauaugaugacgcaguggccaaggacacugugaugacagcucucagguguuugucucuugaauuuugcugcucugguuuguauugguugcccuguauaccuggggcacaacugccuuuuaggacguugcaccaucaucaucuucaggauuuccuuuaccuccaucuccuguuggaacuccuguuuucugugucccaguuuuucucuuuuuaguuuaaucccauguuucaguagagcacguuuucuggaaaaugccugagaaaauguaugugggaggccugugugaggucuugcuugucuuaaaguguuuuaauucugucuucagacuuaauugauaguugggcuggguuuggcgugcuagauuguaaguaauuuuccuucagaguuuugaagguuuuguuccacugccuucaagcagcuuuucggaaauccaaaagccauuuugauucugauuuuuuuuuuuuuguauguaaccuguuuuuaauccucuagaagcuuguagaaucuucccuuuggcaccaguguuuuaaaauuucacaaugaugugcuuugcucugagacccuuuccauccaacauagcggacacuugcaugcuuuuugauauggaaguuuauauauuuuaguucaaggaauuuuucuugaaguuuuuauuaaugauauuucccucucuguuuucucuuauuuccuggaacucuugucauucauauauugucuccugaucuggucuucuuccuuauuuuuuuguuuaaucuuuuauaguuuugaaaauucccuucccccacccccccaauuuucuaggagauuuacucaacuuuauauuucaacucuuugcugaguuuuucaucuuuguugucaugguuuuaacuuuaagagcuucuccauuuuuaccacugucccuuuuuaugguauccuguuuucuuuuuuucuuggauaaauaauauauucuuucuuucugaacguauuaaggauauuuguuuuugaaguuuucuucuugcaaagccucuauuuccuccaaauggccuuuuuggggguuagggcucuguuuggcuuucugccuuucaugucaaagccuuuucucagauaguucuugguugcugcuuguauuuaaggcuggggacuaaagugcugguaaguaauucugagcacaugggugggcuugucaacuucgagguucauggcugggaaccaugggggaacucugaaucuugguuacuucaggguuagucucugaagcuggucauuuuccccagagaagauuauuagaucuccugccuagacaauaauuaccuuauugcuaggauccucggagaagaggacugggacuuccauauguagguuuaaucccccuuuuaucaguaggauauacuugcugucaacuacgccuaucuaaacaacucucuguuuuuacuuucuccaaauaacaacccuccauucuucuauuggggugacguauggguugguugccucgugggacugauaggaggggauauaaggaauguagcugcgucuuaaacaucauucagucaguucccuuauuuuaacuccuucuucacuuccaguuagaugccaguuucugaacuuuuggaggacuguguguuguugaucugauugguucugagcuuucuccugugacggcuuaggguaggacgcagccuucgcuggccucuuuagucacauaccgcuaucugucuucuuuccagcucccaaaucucauuauccauguccucguggauuuaggucuuugaaaacaaucucuugacuguggcuuuagugggauccuguggggaagcaacauuagaugucuguaucuacucugcucucuauccggaacucgcauuugucuucagguucccauuguaauuucuaaagcaccguaaucuccuagcauauugauugguugcuguuauuggccagcucccucaauauuaaaaaguaaauuuuaaaaaucuuuuauuuuagcaaacgucacugcugccuccacucccacccaacuugggcgaugugaccgauuugaguucgaaugccaccaaccgaagacguguauucccaacuggaagcgcugugacggccaccaagauugccaggauggccgggacgaggccaauugccgugaguagucagagagcccuucacccccugggcacguuucugcagagagcacaguucuggugcuucugcuucauuucuggaucagcacacgccugugugugagucuguguacuugcguaaccaugcucuuacugcauucuccacaagcgcuuugccacgugcacccauaccauugcguuagucaccuucuuuuuaauaaguugacugcguuuuaaauaccaggagcguguccaauaaaaauacuuucugaaugacuaagauaaauauuuuaaauagguuucauaagcauguuuaacucuuuaaaaacgcccuuggggaaagccacaacucuucuguauguacauucauucuucuggaaguauuuagugagcacuuacugggcguagaagcuguguuauuagaggguuugccucuagcaccccauuaagaaaauucauucucaguccuuaggguaauuaugguuggugagauagugugccgagccacauggggaauaaucacagggccaucugagcccagugugaggugaugcaugcauucucuacggguuuggaguugguggguccugguguuugguccucugaugaacccagggaggaucuuugcagugagugauggagggagacacuggcuucugcaagcguuuauccucaugugaccagucagcgcuuuucagucccuggcugcacgcuaaugccgccguuggcuggucuguccuacuguagcagacuugggagggcauggcuggacggugcuuaugcagccccccaccggccugccucucugacgguugggugcugcucuggcucggggaucccugcuuugcgggccuccccuccauccagucuccugcuggcugcagacagcagacguccuagccagucacacucccuuccuugccaggauaagggcuucguccgugcuugccugauuccuguccuggugaauguagaagacgccccucucacucucugcugagagccucccugccgccaagcccuaacccuaagcagcaaacgccucaguuccuccacuuugaucccuguucuggucccauuuuuuuuuuaaucuuaaaauaaugacuuccucaaccaaugaaaaacugagccucacuuggaauccuaccaagucuuaccauuuagagauggaauagaaucugagguggagguuagucaucucuuaauuccucuaauucaguauuuacaaaauuuaugggacuuagcaggaucauguggaagugcuuauaagagaugugaauuuggugaucucaccucagaccacugaaucaagagcaaugguggaggagaugcucgggaacccaagccuuuucagaggugcccugucugauucuuagcaucagacaagauuggcaaauacugcucuguccuaaauaguucacccaguaaggcucagggggaaagggaagagggagucggccgucccuucucugucuguagcguuguucuccacagggugcccgacugggcucucccuggagaggcuugguuaagaggaaggaguguggauccaguaacaucuucaguuugguuggacaaauuuuuguugaucaugcacagcguggcaggcauugaucagguuucuggcaauacaaauucuuuguguuuuuuuucuggcaggcauugaucagguuucuggcaauacaaauucuuuguguguuuguuuguuuuuuuuuuuuuucuuuugagaugucaucucgcucuguugcccaggcuggagugcaggggcgggugggaucucagcucacugcagcuuccgccuuucgagcucaagugauucucuugccucagccucccgaguagcugggacgacaggcaugcggcaccaugccuggcuaauuuuauguuuucaguacagacagguuuugccauguuggccaggcuggucucgaacuccugaccucaagugaucugcccaccuuggccucccaaagugcugggauuacaggccugagccaccacgcccggugacuggcaauacagauucuagugggagggacaucaagucagcagcuauccuacagugugguguaggcaguagcagaaguuauccaaggaacuggcauaguuugcaggugggcuagcuuccuggagagguggggacaggccaggagaggcagccccauugauggugccuggacaacggugggacaagguggcagaugaugggcauucuagacacaagggacagcauguauauuccaaggcucagaggcauaagaaaacagaccuguagaguggcugugggugggacaaaggugagugcagagagguaggcaugagguagauagggcgaccccugugcuuggaguuuauuuuucugguccuaaggagcccuugaagauuucagagaugggguguuuauaucuuagaucacuuggacuucaucauggggggaauggguuauagaagaaggcugaggugagauuggaagccaggugcccauuaggaggcuaauuugaugggacugugaagaugaaaaaggaagagugaccucuuuguauauuggagguacuauuaacagcauccagugaguuuuuuuggcugugguaauaaggaaaaaggaagaaugaggguuuuccccaggaugacagugaaagcugaugcuaccagcuauguggggguuacugaggaugaggagucgcagcuuucccuggguggggcuagcacgaugguggguucauugauugacaucagcaucugagguagugcaagucauccuggaagaaacugaaaaggggaggucagaaaccggggcauucuugucuuccuuuucauuuuacugcauuaauuguccaugcaagugaucuucgcuugccuguugcaaugagucuuugccaguuuucacacuuuuguuguuccuugugaugaucucuacggugauggacuucuggagacgaauuucauucuaggccuugaugugcucugacuugagagaaaaaucaucuuggccaaguccuuaacuugaaauaugaaacuaauuuauuuccaccaugcauagguuuuucuccuaacacuuggcuuuucggaggggucccaggacccccaucguugaugcguccuuuccucuccaggaaugucacuuuugcuuuuguuucggcugccugaagggucuuuucuuugacuaaaagucaaggaauuggauaaguugcuaccuagaggucuuuuuuucaagaaacacccuuugagucuuuccaauucuucaauuuccaagguagggugauuucuuuuuguuuuguuuauuuauuuguuuguuuauuuuaguuuaggaaaaucauaaggaaucuuucauuacuaaacuauuccuguuggaacucagauccauuuugggguuggauuucucucuguccagaacaugccacuuguuaucuggaacccaagaaccaaaaagauuaagauaauuugauaucucuugauacuuguguauaaauccauauaaauaaauaaaugaaucuauauaaauaaaccaaauaggccaggcgcgguggcucacaccuguaaucccagcacuuugggaggccaaggcggguggaucaccugaggucgggaguuugagaccagccugaccaauauggagaaaccccaucucuacuaaaaauguaaaauuagcugggcauggcggcgcaugccuguaauccuagcuauuugggaggcugaggcaggagaauugcuugaacccgggaggcggagguugcagugagcugagaucgggccauugcacuccagccugggcaacaagagcgaaacugucaaauaaauaaaaaaauaaaccaaauaaauucagauggugggggauauuuuaaucuccuugguuaacauuuccauauuacaucucuuucucauuucuuugucaugucuuucaguuguaagguugagcuuugucauuuacuuucaaaguuaaugcaaguuugcacaaauaaguguuuggauuugcugauggaguuugucuucaauauaauuaauucuccugcuguguacuuuuuuuuuuuugaaguucuucgguguuuagcaggaugcggcagccuuugauaaaccuuaaaagauucuuauuucucuuucugucgccuuaugccuguuugcuuuccugcauuuuggcuguuuuguuuuucacuuugcuuuaucauaaguggucuuuuucaggcugcuucugcuuuacucuuucuauuugcugugguaauauuuucugaugcuuuuuaaaguggcccuaucuucuuuacaaagucauuaaugaccagaugaaaacuuggaaggcaugccugucauacuugcaaguaauacagaguuacccagauagcuuauuuucuggcaaaacacucaggauuuacaaagggaagcuaaacuuuggugguggguuuuaaugugcuauucauuauucucaagcaaaucauguauucguuucacuuaauucucaaaauaacugcgauuuuggucuuaucuccuuuguggagauaggagaauuaaggucccaagaggaucaccuagccaguaccagauuggguuauuuauuuagguugaaagccauguugaaaguucucaucagggaagaauacaccaaaacuaacacagaugaacugaguagggauuaguguacaguucuacacuuacauuaaaggaaugaacaaaguagacuccuagaguguuaaaccaacagggacagguugaucccacacucaccaaaaugacaguaggaacaucugaggcgaauaagcaaccacauaauaagaugaacauuggagauaauuaagaaagagaaaagaaaugggaccucccuccugggugauauuaauucauuaauuggcauucuuuaaaucaguguuuucagccuguuuccaaucuggcuuauucacagggauguugccugguaaagggucuuaaaaucaagauguguuauauccacgguuuuuuuccaacauuaauuugauaaccuuaucuaaaaaugaaaugagauuaguguggugcgauucuuuuuagagaaccuguccccugaaggcgacuaaguucuauucuaagugccuguuaaucaucgguuaauuaucaguuuaagaauuuucagaguuaaugacaacuuuauucccagauucuauuguuuuuuuguuuuaauuuaaggcucuuuuuuuuuauuauacuuuaaguuuuaggguacaugugcacauugugcacguuaguuacauauguauacaugugccaugcuagugugcugcacccacuaacucgucaucuaacauuagguauaucucccagugcuaucccuccccccuccccccaccccacaacaguccccagagugugauauuccccuuccuguguccaugugaucucauuguucaguucccaccuaugagugagaauaugugguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuuccaguuccagaucccugaggaaucgccacacugacuuccacaaugguugaacuaguuuacagucccaccaacaguguaaaaguguuccuauuucuccaccuccucuccagcaccuguuguuuccugacuuuuuaaugauuguuuuuuuuuuuuuuuuuaagaaacagggucugguuauguuacccaggcuggucucagacuccuggacucaagcaauccagccucagccucccaaguagcugggauuacaggugcacacuaccgcacccagcuuacuuccagagucuaaagcccaugcuuuuuugcucuuaaaauuuugagacauacuuuauaaagaaaccuccaacguccucagcucuacugcuuagcuguuguuugauuauauuugaccacauuguuacccaguagaauacuucugugauggggguuuugguauuuuucaaaauaauccccucugggcauagucucucccuggcaauccuauauaaaauggcauaaccugaucagauuaauguacuuguuugcaguuucucucaauagaagauaacucccugaggacagguccuucaucuguuuuacauauccccauauuuuuaacaucuggagcagugcccgagucaugguaggaccuccaugaauguucacagaauuccaucuugggcuucugagacuauuacaguagugguucucaaaccuuucucuaauucuugaauacacguuuauuugucaugagcuuccccccaccauggcaaaccaauuucagcucaguauauaauagaauucugaaaugcaaugaucuuccuggagaaugggggauuauaguuugugaaaagccucauaagugguuuugauaguucccuucuauugacaauuuuuuaucaggauuguuuuugaauaaguagugaacugaagucuguaccuccauccuagagacucgugcaaagaagucuuaauucuucuuucucaugaaaacucaucaguggagaacacuugucagaguggucugcaugucuucucaccaccucccccauccuuguaucuuuucaccucuaggaaaauaucccuggauccuuuauccauuccucuugaccauccugguugcucucaugggaacauuauccaguuucucuaccuauaucucaaagugugguuguuuauguuaggaggaaggagaagagggagggggucgaggucaagaggugacccaugaccacaugccugggucugaaguggggcguaugaagcuuccuugcucaggucacaaugcucauaucaccuuuaacauaacuuuguuacuuguguguacacucucuuuauuuccucagggcuuaguuucaggaagggacuauuaucauccuugcuuuaaaauuaaacuauaaacaaaauuccuuccauaguuagcuuggccuacgugcagagauaggcagaggccguuaaccuacaagaugucaccaugggcagggggcagggugcggggagcagaauggagccacucauguucagccuccuuuugucuguuauaauuuccccauuuucaaagccagugauguugcaugucucucaccugucuucuguauucucucugucucucaccacaaccagaaaagggucucugcuuuuaaggacccaugucauuagacagagcccaccuggauaauccaggcugaacucuccuaccuauggguccuuaaucuaaucacaccugcaaaguugcuuuguuacauaagguaacauauuacagguuccagggauuaggauguggacgucuuugacuuggaggagcaagauugauuuuagacccucaucacuggugggauuggauuucugauguagcccuuccuuguccaggacugggcaggcaggugugaaucuguauaaggaaggccucaaguuacuguuccugggcucaaccagcuacauagcagauuuguaccacccagguacacagccugcauagcagauuugcugucuacagccauucucaccuuuucucuuuucaggagcauuugcaauuauacggucauugcuuucuuuuuggagccucccgugcaguuuuaaucuacuuucagaacuggagagcacaucacauuuuggucaauagccuagacauacaguugcauaacccuuaacuuaccagugcucauuauuugcauuauuucauuuucuguucaaguacuuugaaaagccaaacaacuuuaaauacuacauaaaguaugcaugccucuuaauauuguugggauucaucucauuguuauuucuguuacucaaaccagaaaucagcuccucuuucuagauugcaaacuaauaauaguagcagaauaauuaauaguacuauagaguaauagcuacaguuuguugaugccggccaggagccaggcaguguuccaggugugugaucucauuagauccuugcagacaugauagugauggaauuguuacuuccauuuuuuauagggcaacugaacucaggugauauuaagcuguuugcucaagcucaugcagaucuaggauuuaaacucuaguuuguuugacuccaaagugcucacucuucccgaaugcagauuccaguuguuaauguuagaugagauggcaccuuagugccgguauagauuccaccacuggucauuccagagguguguuuugaagcagaagccaauuaguacuuugccuaaaugggaauaaacuugggcccagccuuuaguaccauacggccccuccccguggacuuaagaagccucucuguguuucagccacacacagcaccuugacuugcaugagcagggaguuccagugcgaggacggggaggccugcauugugcucucggagcgcugcgacggcuuccuggacugcucggacgagagcgaugaaaaggccugcaguggugagugccgguccacgggcugggcugggcugggcugggcugggaggcucgcuuaccccagggccccuccuguguagaccuugagcuaggacccuuuugaacuguugcucaaucuaaggauaaaacagauuugugccuaguuuuggagccccaagugaggugagccuuggccagacucugauacaacaugcagcugucuccucccuguuagugaaaugcuagucuuggauuuuuuuuuuuuuauggacuucccaccucaugcccauacaccauggcucucacagucucaaucugcuggugggauuaacucaguucuuaucucuggagugucuaguaauggacccuaugacaugguccuuggacuuguagcauucucuauggagaaauaggcuuaaauugucauaggcaggaggaagaugaaauucgagggaaaauaucacgaccggaaaaguaggagacccuaggagggauuguauagggagguuucaacuacauuuucugagauuucuuuucagauaaugauuauggccuccugauaaucuagaucaugguaguucuguuuaaaagcaggaguccuuugaaaucuaaggauuuguaagauguaacuuuuuuuuuuuuguauuuuuaguagagacgggguuuagccacauugcccaggccagucucgaacuccugagcucaggcaauuugcccgccucggccucccaaagugcuaggauuacaggcgugagccaccacgcccagccaagauguaacuuuguuugucuuuuucuccuuuaucucucuagaugaguugacuguguacaaaguacagaaucuucaguggacagcugacuucucuggggaugugacuuugaccuggaugaggcccaaaaaaaugcccucugcuucuuguguauauaaugucuacuacagguaggucccaucuuugucaugggagaugaaaaugaugucuucauugccccaggauguucuguaaacucucuaguggcaugcaccaugcuauuaacggagucagacaucucagccccccaugcugcuccagugugacaauaucuuuauuuuuuuuugggccagggugguuggagagagcauauggaagacucuggagacccacagcaauaagacaaacacuguauuaaaagucuugaaaccagauaccacguaucagguuaaaguacagguucagugucucagcaaggcacacaacaccaaugacuuugugacccugaggaccccagagggauguaaguguuucaguuaauuuuuauggcauggguaagaccucaggucgggguuugugagggucuuucugaguauucucaggaaugugggaacauaugugugccucacauguacagaaguaugguggcuaagcuuuauagucuugccagaguugucaaacaucuguucuucuuacugcaucagagacuguucuuguaccuuaaguuaauuuaagauucucuccaccauugcccucuugcauuuuuugucuaguuucuaccucuacguuccuccucuagauauuuccuaguacuugguacuuaggaggaggucaucgucauuaaaauaugaggcauaucagcaauuuuguggcuaaguuuuuuucuuuuuggagacaaggucucacucugacacccacacuggagugcaguggaggcgcaaucacugcucaccaccucagucuucccaggcucaggugguccucccgccucagccucucgcauagcugagacuauaggugugugccaccaugcucagcuagcuuuuuguauuuuuguacagaaaggguuuugccguguuaccuaggcuggucuugagcuacugagcucaagcaauccaccuacuucagccucccaaaauguugggauuacaggugugagccacugcaccuggcuuuguggcuaaguuuuuaagaaauuuaccaaauuuaugugucuaagagaguuccucgccuccucccuacuucaaaguaguugacaugagcaacugucugcuugaaugucaucuuuuuucauugccuaaaguauccugaauaugcuagcgcuaaacucauuaaggagccugcuuugaagaugaucaaauucauuuggauauagaaauucugugauguuacaaaauuagucuuauuuuuugguagucaugcccacaguacaguuuuuguuguacaagaagcagaggcagcaggugcugucauugacaauuaagaucucagcauggaagucucagggucaguggugacucagccugcccaagugauucuauccugcagcccuuaugagccacaaauuuaccacacacucaacugagccaugaugugauguguggacggcacaccuugcuuuuuggaagaagaggaaaagugucuuuucaaugugacgaccaagcuagcagccuuucuaguggauagucucaaugccggcuguggagucguucuuguccuuguucuaagcccaggaaaauuccucugguuggcugcuaugcagauggguuuuaaccuugaguugacucuuuuucuagugccagaugccccucgaaaucuccagcugucacuccccagggaagcagaaggugugauuguaggccacugggcuccucccauccacacccauggccucauccgugaguacauuguaaguaccuuccaugaguuggcuguauguguguugggggugcuaggagauuucuggguauucuguaugacgaggggguugauuugguuuagcuuuguaggugaugacccauccgucagaacauuuugcuccucaccaucuuuucucuccuccagccuccuugcaagauauuaggaugcccuggaccuuugguucccuuuacucacauuuuuuuucuucucccuuuagguagaauacagcaggagugguuccaagaugugggccucccagagggcugcuaguaacuuuacagaaaucaagaacuuauuggucaacacucuauacaccgucagagugagugucgucauccauuccagccauccaugcagucuuagaacugagcgaaauugcugcuguuuugugagaacucucuacucaccuuugugagaugcauauuaguaaucugcaaaauacccaacuucuugcccugggacgggggagcucagaguuucuuucagucucuuaaauggacaccacaaagagcuugacaucagaguuucuguagauaaccgggcguuuaugggaaugccgcuuucccugcuuuuaacuccgguauucugcuagcuuuccagcuccuauacuuuugcagucagcucuuuccugcuuaucuuuagcugcaggaugaugcagagcuaugauaaguagucuuucuaaacugauuuuaugagguucuuaugaaauauauuuuuaguauuuuuagcagaaagagauagauuuugugaacaacauguuugcugagaccauuaagugugcacauucaugacucucacacugauaauuuugucaguacccuuuuuguauauguguguauuuaugaacacacccccccauacaccugcccuuuagaagaaccuugauauuuguggaucaauagaaauuuucugaucucaggacugucauaaugcccuuuacccaagcuccuucccuuggcuuuuuugcccucuuauuucagaugcuggggccucugaauauucuggaucacucuguauaaaauuuuuccagccucacugccaaaaucucaccccuuuagcucauucaguauucuuacuguaugguguaugguguauugccuuuauuucauauuaauucacccucugauuugaaaagguggcugcggugacuagucguggaauaggaaacuggagcgauucuaaauccauuaccaccauaaaaggaaaagguaaaugaucccagcauuugcagauuuagagaaaauauuauacaaacccuuucaaaugacuuucaguaugaccggaaaauggagaaacguaguuuagaaaaacaucacacaacuuucuucuccccaacacacgcacauuuuugggugucucuguagugcuuuagauagagucuuuuuggggugacugagugucuuuuuccuccuaguauugagcauuucuucuaaugcagacauacaaagggauuuccaaaggccaucaugcgcagcccuuugugaguagucaaaauaucuaaaauagaaggaguccuuccuucucaccaaagcugaagaugauuuugugcauguucacuuacgggguuuuaaagaaagcaccaugcugacucuuguuauucucccaguggcacuggcaaacuguguguaggugguuuuuuaucuuguacuagagcugauauuaguaauaacugauggcuugccaagggcaggacacucuagaguguucacugcuuugcguacaucagcucaucuaauugaacagucagaacaacuacaagaaaggauaaggaacuggaaugagguuaugucacuugucccaggccacacaaucaguaagugacagagcuggcccuggaaccugaucugccugacuccaaagccugugcucuuaaccacugugcuccacgcuucucucugggcugagacacaugcggccuacuggaccgcccugcuugccggggguggcgggcucagcaucuugcacgagugccucaugagggcagagaucuggucuguuuuucucuacucuaucacgggcaucuaguagagacuaaggaaauaauugaugauugagugaaucgaagcaguuaaaugaaggguucuggcauacuuugggagauggacuacaacucauuuuccagagugguuuuccugaccuuagccuugacacuggggacuugcauuucuggacuuccagguauuaaaaccagauggacacuguggcaugcaauaggacuggaagauuuuacuuuaaccuaagccugugaggaauaggcucugggucauggagagucacuaucuaguccccucuaaaaucuggagccuuugagaucagggcccaaggcggccaaacguagugccaccagauggucuuuggagcugaaugcuugcagguauuagagaaagccugcugaauucacacucuccuagaauuuuuauuguuguaucucuucucucuacaaagucuguuucaaaacacugaccacacauaccaagaagggauguuggaagagcaaccaaauacauguaccuugaauuccgaaggcacaagucacaacugcauuugaaaaucucaguggaugguugguucucuuuaacuucuuuucugugauuuugaugaaucucagcugcuugcauauauuugggcuaggauuuguacagaaggcagcugugugccacauccaaaaaguguuuguuguaaaauaucugugacauaguaucauaauaacguuuuaagauaaaggacaaagacagcagaggcaucagccagacgcgccagguuaauuggugaauguaguggauuaguaaugacaaugagaaaagccaccauucccugagcacuucuuauacacuaagcaccaugcuauuguugcucgugaauggaucccuuauuaauccuuaugaauccuaugagauaaguauccuuauccucauuguguagcugaggaaauggguuuggaguggauugugacuugucccugguugccaugauuauaauucaagucagcuuuaccauaugcagcacucgcacuguuuugcucuguguuggccgccugaagcuuccaauauccuuucuucuuccgguuauugcauuuuccugaagccuaguuuuauuacaugauugaucaucuggacagaccucuucagacuuugacacaucucuuuugccaccaaaucuuaucugcuccuuugagucucucuugcccagucuauagaaggggcauauguguggagagucuaauaugcaaguuguuguuuaaauaauauuuucugauaauauugauccauugagcucuuuuagaucaugcugggccaagcacugucagccaucuggugggaagaccuuccagaugacaagcauggcgcucauugguugaacugagaggggucuuuuccuuggccacuucuccuugcccccucgacucuuagcuugagcuccagucuuuuugagagcaccagugguuucuaguuguuuaguuggccauaugugacgcuauauuggaaaggaagagaaagagaguaucaguugagugcuaggcaucacacauacauuauuuuaguuaaccuucccagcucugugaaaugcagauaacaucucuaggcuccaggaagaucaguaacuugccuagguuacacagaugccagaacaggaauucgaacucaaguuugccagcuuccagaggccacauucuuuccauuuugccacacgcacguuuaccauuuacgauuuacuccauugucagccuuccgaaaggacuugagauuggugggacuuuguuagugccaaucaagaugccacucgcagugaaugaucccuguuccuuuaagaaccaggcugaagcugggcuguuuugggaccuuuacaaaauggaacuuuucugccugaccuaauugccaggauagccgacugagccaagauaguuuuguguucaccaagcaacuguggaccaaccuuagcuucaggaaaacagugguaaaaaaagaucgaugaggaacacugccaaagaaauacccuuucuuccccgacugaaagauggcuuuguccguugaguugaaaacuauuaaguccugccuuccucacuuuucaucacguggcuucuguuuuugaauuccuuuuuguuuucagugaucccaccaccagauauccacauugacagcuauggugaaaauuaucuaagcuucacccugaccauggagagugauaucaagguaaugugggaauuucaagccagcagcuggauggggcuuuauuuuguaugggaacugaaaggacauagcacaguaagacuggaaaaaaacaaaaaacaaaaaacaaaaaaaacgaacggcuagaucuagugaagcuaaaauaccaggacuagggugguuccuucccccaugaagaacaacuugagucuucacauguaauuauucugccucagccuggugccuuuuuauccuuaaccauauaauuaaaugguucacagcuacagugcaaauaaagaguugguguuaacagaauauguaugcccuguaauuuucagcuuuauuggauuuccuggugcuaagcgcuaaugcugaggcgcucacaguggaagaacaaccuucuugugggagaguuggauaccuuggaaacauauucacuuuccauccaccuaagaucuuccucuuccagcaccgccauccccucuacuggcccucugcauagccgacuucaucauuguuaccugugcccaugugguuccucaagcugagauccgcuuuccauaguguuccuucuuaucugucccuccucacagccucuccauugaugaauuuguguugggacaaguugggacaagcaaccuucagagucuuucugccauuuacuuaacugccauuuagugucaugaccuuggcuucagaauggguugauauaagaaauggccucggccgggcaugguggcucacgccuguaaucccagcacuuugggaggcugagauggguggaucaccugaggucgggaguucgagaccagccuggccaacauggugaaaccccgucucuacuaaaaauacaaaaauuagccaggugugguggugcaugccuguaaucccagcuacuuggaggcuggggcaggagaaucgcuugaaccugggacgcagaggcuacagugagucaagaucaugccacugcaguccagccugggcaacagagugagacucugucucaaaaaaaagaaaaaaagaaaagaaagaaaaaagaagugggcuuauaugcuucuugucuuguagucuuugaucuugaaaauauuuuuguucguugucccauauuuaacgaucuucagaucaaaucuuuuuaugagcucaggacuuggaaaagguagucuuuccugauggguggauguauuuucuguaguuagacaaugagaucuaaccagccuguuuuguauggauugucuucuuggccuugacugcaaggauuuauccuuaauuuccauggccuaauuaucuuuccaguguuuccucuuucuaccuuuauuaauugguucucguccuuuuauucuucauucacuuuuuuguuucauugaaucuauaaauuaaauauggucucguuuguuuuuagaaguagguggaguacaacuaaauauuagcuaaugguagcacaaguagaaccuguuuaaaauuuuuaaaaaacaaccuguucacuguaagaaugagauacccaaggaaagaacaggaaagagguguauuuuuaauccugccuuuuguauuuagugugccccaugacuagcuguucaucuaacaugcuucuugguucucggcaggugaauggcuauguggugaaccuuuucugggcauuugacacccacaagcaagagaggagaacuuugaacuuccgaggaagcauauugucacacaaagguaacacuuuggugcuggucagugugugugcaggaagggguaaggcuggaccaaugcuuucccgcuguagagcuugacugggggugccagggaaggggagguauucucuggaagcuguucuguguugacagguucuugugcauugaggauccuauaagugugcugcugauucuaggcagagggauucacucaguggccccucgagcccuccuccaaccucaugacccuuaguggaaguugggggccauaaggaggaaaauuggacagaggcaagacuaauucucugcagaugaguuuugauuuccaaaagaaagaguucuuagauauagacaguuaccugucuguccuuucuagucugguucacucucccguugcuaaugagagacagcagaaggccuuaugcauaacugguguucaguaaauacauguugacuggagaaauggacaacaaacuaagggaggagugguccagucccuguuacguauguaccagcagcaagucucagcuaaaauuccucuaucuaagcacgugcuaaaggauggauuuuaauuuauuucuaaguggcgaaagcugccuguaacuguugagaaugacuugggagcuucuuccugucuccuccuucuaggcugugaagcacuuucagucauguuuuuauugaguccuugucauagccuuauaaaguagagacuacaaauguucuauuguuacuuuuuuuuuuuaacugaaagucuacaaggugcccgaggaggcuguuauuuugacuuuugcacauugagcaccuaccauguacaggcauuuacacaggcauucuacgcauauuauuuacauaaccccaaguauaauuccgugagauaugcccgcuuuacagaggcaaaacugaaguugaaagaauaagucauacgcucagacgguggcagagccaggauuggaacccacaucuuucuaacuccacagccuaugaucucauugccuuaguguugccccaguagaaacuggcagagucaggagcagaagccuuaacuagcuguuguuugaaaucuauuagggcuagugcgaugcuaggcauuaugccaagcacuuccuaagcauuuucuuuuuuucucccugccagccagcagcugcuguaagugcuguuauuuuuuucuccaucuuacaaacaaggaaauagagaguuuaaauacuuuacccaagguuauacaaccacaaaguauagagucaggccuuaaaccccaguccuucugauuccaaaggcuaucuuguuagcguaaccucccccuucucacuuuucuuuuucuuaguuuuaauagcauuuccucugaucagaaaggggauacauauuuguuucagaaaauugagagaacaaaaagaguguaaugaaaauuaaaauugccuauaauuucacuuuuacauuucagauaucuucuaauauauuuuuccauggauugaucucuuuauaucuuuuuucuaaaaucagaauaaugccauagguaguauuguauccugcccuuuucacuucacauaaaauugugagaauuuuccagugucaucaaauauuuuugaaacaaccuuuagugccugcacaguaguugauggaaugcacauuauuuaauuauuauccuguuacuagacaaucaaauuacauucaguuuuuuccugcuguaacacugugauggggauccuuguuaaacacacuuuugagucuuucucugacuucaugggauaacuggauugaaggguaugauuuccaagguucuuguuauacaaggccaaauggcuuccaggagcguuguaccaacuccuauccgcggaugggcagcuuuaaagaaauuacccagugcuugugcaguguguuacguaccgucaucaucaguacauaaacguugaaugaauuugucaucuaaugacaguccuacagcacaugggacucauuuaagucaagagauuacuauuuuuuuuuaaaaaagugcauguaccaagacacguucuugacuaacacccccaacuuccuccuggaaucuccuuuuccuguuuucacaguuggcaaucugacagcucauacauccuaugagauuucugccugggccaagacugacuugggggauagcccucuggcauuugagcauguuaugaccagagggguucgcccaccugcaccuagccucaaggccaaagccaucaaccagacugcaguggaauguaccuggaccggcccccggaauguggugagucagccagaaugaccaucacaaagugaguguggacuguccccuaaugcuacgccaccacacaacuccagggcuuuucucucuuuugcaaauguuccggugccccugcugcucuuggauauaggccuuucuuuuuccuuuguuuucauacgugcauuaugauucacuaugaucagaucugugcuccuuuuugagucuacuguuuuacuuuccacuccuccccaguguguccccuuugcuuuuagaucaaccgucccaaggcucuuggcacauucgucccccucuugccucuguacuuggcuuaugcccuuucuccuccuugguguccuucccuccucuugcuaugcaagaaaauccucccuucuauaguugaucucucucccuaugaacuccuaauauauuuauaguugguuccauauagcaugauauuucauugaauacagcuuuacccuauuugauaauuuuugucuguuacucuuaccuuccuaacuaguuuguaaguuccuugaagggaaggauuguuuucuggauuuucucaauggaaaagcauacagaaguaaauuuauaauaaggaauuaguaaauccuuagugaugagcggaggaacuagccuaggucuggucuucugaggauaucuucagcgugcauuugucacagggcugagucauagggaaauaaccaaaguuugcaaguagcugucuguaaaaucagugaagaagaaggaagaaguaagauuuacugagcagccaguaagugccaggaacaauauaaaauccgauaaaccccuguucccccuuauuccuuucauugguucuguggguaaauauucccauuuugccagcaaggaaacuaaggcucagugaggcgaaguaacuugccagaguuaaagcucucacaagcaguagacugaguuucagcucaggucuggcuaauuuaacagccucugcucuuuugugugucccagcaccugacgcugaggcagggacagugaugagaagcccugaccuauccccggagcucucuuuuaccuggaaguugagucuacucauaaagaacccuuucuuuccauuuauauaccuggcagcacaugaccgccucaucacccccaacuaucucuccagaguagggcaauugcacagaacacugaagccugacuugauuuagggucuccaauugugcaugaaguuggaggaggcuuccugcaccucaucucagcucaugcacuggucacacuaaagguggcuuucagaggugagagcgcaaaugagaucaccuguaggaagcucucugcuucugccccucuuuaguucauugaggacccuggcagcucucaugauuuuccugucuacugugagaagugccauugucacugugcauguggggaaccucucaucccuuggcucccguggcucuguggaccccuuuccucuccagagacaccccaucccuggcggucaccagccuuguccucggugaugucauccucccucuguacucuaagccccgacuuggccuacucccaucucaugcuuugcagcuccaccugcauuugcuuugggaccccuuugagucccucagcgcuucucuuuccuacauccucccaggcgaucacccccuucggggcuucccuuccuguuucucugucuguguucucccaucugucuguccuuucucaucugucaacaaaaagagucaaacucuguaaaauauaugaaaagauuuauucugagccaaauaggagugaccauggcccgugacacagcccucaggagguccugagaacaugugcccaagguggccgggaugcagcuugguuuuauacauuuuagggaggcaugagacauccaucaaauacauuuaggaaauacacugguuugguccagaaaggcaggacaacucaaagugggcauggggaagcagggguuuccaggcuauagggaaauuuaaacauuuucugguugucaauugguugaguuugucuaaagaccugagauugacggaaaggagauguucagguuaagauaaaagauuguggagaccaagguucuuuugacgucuuuuaguggcugccuuuaggggaaauagaugacagauguuuccuauccagaucuuuaaaaggugcaagacuuuuagcuaaugucuuuaggauugggagggccuggaagaaaaagaucuagcuauguuaauagagauucuuuacagaugcgaagguucccccacaaaggacagcuuuucagggccauuucaagauaugacaaagaaacauguuuuaggguaaaauauuuugauuuucuuccuugucucauaauguuaugccagagucaacuuggaaaguaagucacgauauauaggauuaaauaaaacccaucugaugagaauuuaugguuuguaggacaugacuccccagaccccuuagauagggauuugggcaagauuuaaaaaaucagagcuuaguccucacagcugcugagcagugcuggagaaagucacccuguugccugggacuuggaaaucccuuuguggauccccgcucaguuccugcucaucccauggauccugcagcuccuacaguccucgucaagcccaugucuuacaugugcacauaacucuuggagaaaaugcucuuugauugugccuuacaaagaaagcuuccucagcucccacccuccaguuauaaacucccucggcuuccacuuucugcuguaaacuucaucccauucccacuucccugcuugaaacucccucaguuuccaacguuuaccaguuaggacuaagcagggaugcauagagcagaggaagugacaguaacaguggcuucgaacaguuuauuuccucuuguaauuaaaacaaguuuagaguugagcagugcagggcuucugucguggcagcacgauuugauugggcaccugagcccugucaucuccagccuguggcaugugucuucaagcucaccucaugguacaagaggccuccugggccugcagucaugaucuguauuccaggcgaccagagggcaggaagaagggcuccucccucuguuguaaugagcccuccuaaagcuuuuccugcgacacuucugcaucucaauggcuggaagcucuuugucuagccucuucuagcuuagggagguucgcaguuuagacuuuuuccaggcagcaauucucaaucagaaccagaguucugaggaagaaagggaggauggguaccuguuggacagccagccgugucugcucuccuucccucccuccacauacuuccugggguguucgcauccacugugcaagcucccauggcuuuccuucccacucagcacauccccuuggagcccacgucugugcugccaaugguagaaugacacccccucuuuaauaaccccccguucccuggcucaucauguggguuucugguguagcaucuaacacucuauguuugccacuuguuauuuauaauuauguauguuuuucuucucugcccgccucuccuccagaaggagcgcuuugaggacagagaccacaucauauuuauuuuuguagcucuacauacagugccuggcccaagugccuucucuguaaaugcuguaaauguaauaaauguugaaugaagacuucucugugagcucuuuugaagcaguuccagggucuuaaauuggggauuucaaggaaaugagaucaucggcccaugagcugauguccucuuccauucucugcuuuuaccagguuuaugguauuuucuaugccacguccuuucuugaccucuaucgcaacccgaagagcuugacuacuucacuccacaacaagacggucauugucaguaaggaugagcaguauuuguuucugguaaguuucccauaccguuucaguuuuuuaagggaugucuuaaguccugggcucuggucucaacccaggaccuggggagcuugcauaccuggacuccaggauugaugugugugacgagaggcaacuuccucuucuucauaagcaucaucagguucuugcuugaaauacagaaugaacggccacuuucaccaacugcagcuccguuauggaggacugauaacuuggcagaugaucacaaguauagauaaaucaaaaauuuuuaucagguuccacuucuaggaauuuagccuacauacuuuuaugugugugccaagauauauggagaaagauacaugguacguuauuauucuuaugauagcaaaagaugugaagcaacuuaaaugucuaugaagagaggacugguuaaacauaucaugguuuauucaugcaauggaaugcaggacagccguucauaagaaguaugacaacucuaaauguacugauauggaaaaaucucuacgcuauauuauuauauaaaagaagccaagagcauaauaugugugccauuuucucaguuguauaaaaaauauuugaggaagauaggcuucauauacacgugcauauauguguaaggauacacguacauacauauccuuccuuauauaugcauaggggauuucuggaaggaagcacaaaaacucuuaccagugguaccucuuggaaaaugauuugggguaggugggaaauuauuuuauauuuuaugguuuuuuguacuaacugaauuuuaauuguugucauuauuuuguugaaaaaauacuuuaauaaagauugcauaaggccaugauguauuuuuuuuccuacgugugugcuugggcuucagguccguguagugguacccuaccaggggccauccucugacuacguuguagugaagaugaucccggacagcaggcuuccaccccgucaccugcaugugguucauacgggcaaaaccuccguggucaucaagugggaaucaccguaugacucuccugaccaggacuuggugaguggguugggcuuccaggccucuuuguuuauuccuggccugguuaggguggggugggauggaaggggauccucuaauggggcaagaaacacaggccugguuucuggcgcucagcaggaggucucucucccauuucagucugaccaaagaugggguccguacagggaccucuucuuaguuggcacuucuccauuauuccuagcuaccauuuugguuugucccucuuucuccuccgcugcugauauuuccuucccugacccucucacacagggauuagcaaacaaaggccugcaggccaaacacagcccauugccuauuuuuuuaaaauaaaguuuuauuggaaccaagucaugccuauuuguuuauauauuauaucugaccacuuucaugcaaugaucagcagaguuguugugguggagacuaucuggcccucaacaccuacaguauuacuguguguggacccuuacaaaaaguuucugaccccucuuuaaaaggagcauugauccuaaacaaaacaaaaaaacugccauuuuuuccuugcucuggguugcucuucccucucuccucucuccacuccccuucauccagcggugguugguuuaaaaugcuugguugcuaauacuccucucaacucuccacuuccuugucaugauugaauuuccugugcuuacuauaugcccuguuauuuuccccuugccccccuauacccagaagcagccugggagaaaguaaguagagccuugcccuuuagagccaggauugaacacuuugguucauucucucuccaccaacaacauccaugaacuauugcagugguggagauguggaaguugaguacugaguuuggaugugcuugcuuguuccaaccuaccugcugaugucacgauaaauguggcccucccuagaggguuaaaaaaauuuuaguugauaacucuaugugcaauucuaugagugaauaguuauuuuaagauuggaucuggucacuccaaaggccuuccaaagaauggagucagauuucgggacucaaacucuuguugcugugggucccagcuauuaauauacuacauuguccaccauugaacuacaaagagugaaaaaugucaacuuucugauuaucauucacuuguucuuuuuugguccuaguuguaugcaguugcagucaaagaucucauaagaaagacugacaggagcuacaaaguaaaaucccguaacagcacuguggaauacacccuuaacaaguuggagccuggcgggaaauaccacaucauuguccaacuggggaacaugagcaaagauuccagcauaaaaauuaccacagguaagcaggagagagguuagaggucuucucacacagccugcccucagugcugugccgcuagaccuccagagacagacuuuucauuaggcguuuguuucacagggagugcaaacgcugcccuucaauauuccuacaggggcagaguagugcagaggcuccagggucugagccguggcgugguggccagggcacagugggcuggggaguggcuaucguuuucuuuauuuucuaagucuuuuuaacuccccucgcugguuuugauauuacuaaaggaaaagaggagggaugcccaagagaggaaauaaaacugaauaguugccacuaagaccaagugcuguaucugagaaucuggaugacagguucucagugguccauuguggcaaucugacauguugaaauggagggagacccacagcugggcaguagaucaaagggcagucaggcucaaguucagagagcugguaguaagcuccguugcucagacagcagcagguauuauugggaguuuugauauuggguaauggaggcccagccccauuuaugcugguggcgugcagugggccugggccaugugccauugucacuccaguguccugucuucagauggaacuccuuaucccaucccauuccuuccucaccacccuucuacccaaccccauuuguuuuuguacacacuugguuacaagggcuauuaaguacuguccaaauuucuuggcuaaagauguuauaacaacaauaaaagagaugccaauaaagaauaucuaccaugugcuagguucuguacucagcaaucuauguguuuuauuuuuucuguaacccagcccuccaaggcuagcauuauuuaaucucucuuugauagacaagaaaauagaguuucaaauguauauccacuaaccgcaucccaucucaucuuuaauuuucaguuucauuaucagcaccugaugccuuaaaaaucauaacagaaaaugaucauguucuucuguuuuggaaaagccuggcuuuaaaggaaaagcauuuuaaugaaagcaggguaaguuccucccucauucucaaugacuuuggaaauuuaauugaaaugcuguuucagagaugagcuuguugacagcaugcuggcauagauaguguaaaaaaaaagaaagaaaaagaauaggacauggacaugaacuugagaauuaaaggaccauuuucagugggauugcuaauuagcgaaaugcuuauacugcccguuaaagaugagaaucucugcacuaagcacuuuucaauccugacuugucuuccccugaagaaagacaaaugggcuggaggccaugcugugcuucccgcagaagcugcagcugggcuggggcucaggguguuaaaccaggagccuauuccacacucgcugagggugggacuguggcuucaguaccaggaguugagcugcacucucagccuggcaucucagcacucucuucccagauaaauuacagggagcaggaggcacuugaagauacugugcuaacuuaugaagaacaccuugauuuuguuugguuuugcuauugguaggccaauaugguauucacagcaaaagacaggggaagaggagugagaccugggaguagauuuaccacccaaggguggacagauucuugaguaaagcuggguuggccccagagacagcaaagccuuugcuaaauaggaaugugaugaaucaacuauggcuaccuggagaugcagcauaggcaaagagccauggguucuaaauagucaccgugcaauaccaaagcaaagugaaauuaaaauuggaaaauucucaccacacacucugugagaauucucauaacucuuguaacuaugacaucuaaauggcuaauauccuuaaauagaaggaaagcuuucaaguaaguucaaaauggaaauauucuaauuuugaagaagggacauguaacaaagcggaaaauuccagcagcaguaagcaaaaggagaaaaguucaaccucaccgguaaucuaaauaacaaagagguaacccucucauguuaaauugguaaagauuugcagggaagaguauaacugguaugaauaguaguuggggaaguaaacguucugggaauaugaauugguucaaacucaaguaagguucuuggguaauaccuaucaaaaacguugaaaguguucacacccauugauccagcaguuguaggauuuuacucuaaagcagcaacgugcaugaagaauuuguguguaguauuuaugacagcaagaaagaggaaacagccgagaugccgaacagaagaggauggguuaaauaacguaugggugguugauguuguguaaucucaauuauuuucuuuauaaccuuuguguauuuuacaaaugaucgacaccagauaucuauuagguggaagguaauaacugcuggcuuauaggaaagaaugcggggaugagauuccaggcagguauugggaaucccaguucggcagccagucgccauuaggggauccuuccuggguggcuggagcccggcucuuagguuaagauucuagguuaguauuucguuccuaguggagggucuggcauaggcauagcauguccuucuucccuuccccugacaaggaguucaaagaauuguauuaguccguuuccacagugccaauaaagacauacccaagccuggguaauuuauaaaggaaggagguuuaauugacucacaguuccacauggcugcggaggccucuccaucaugguggaaggcaaagaggagcaaagccacaucuuacauggcggcagacaaagagagaaugagagccaagugaaaggggaaacuucuuauaaaaccaucagaucuugugagacuauucacuaccaugagaacaguauaggggaagccgcacccaugauccagugaucucucaccgggucccucccacagcacaggagaauuauaggagcuagaauucaagaugagauuuggguggggacacagccaaaccacaucaagaauagaugggucagugguauugggaucaagagacugugauuaugcaagggggcccaauauguggcuagagaaaagugauggagucuuuucagggggaugguggagagugucaguagcuuugacacuggaauaguuggggaucagcagagaagucagguugucagcccucaucccagcuaguauccugggccagggcuguccccaggauggcuuuuuccagcaccagaguccagggcuguaacuaggaagacauuucauccucuccuccagugaacaggggccugagcuggcuucagugcuucugauuucaaggccagguuguuggggggcugagaucggcucagaaggagcuagagagcagggagacaggaagugagccgacaaggucauuccuacauauuguucuggggacaaaugucuugucuuuucuaauugcaaguucuccuuucucaccccauugcuggaguccacugcgaccuggauuuauuauuagucaaauuccauuauggcaaacuguucagauucuugguggcauuuaauauugcuugagacaggcagacugcugagcaaaucucugaguguggcuuugguaaaaugacuuuccugagggccacaguuuucauuuccacgauauagcuuguugugggggggugguguggcaguuauuugagauauuggagaugagaaaaauuuucauuuucugaauccaguaucucagugguaauguaaaaagaacaaggagaaacccagggcgcuuucgcgucuguagcagcccacagugaggagcucacauaaagauggaaccaguaauagaggcugucaguuuccauauucgacuuccugagcaaucucuuguguuuguuuucagggcuaugagauacacauguuugauagugccaugaauaucacagcuuaccuugggaauacuacugacaauuucuuuaaaauuuccaaccugaagaugggucauaauuacacguucaccguccaagcaagaugccuuuuuggcaaccagaucuguggggagccugccauccugcuguacgaugagcuggggucuggugaguugcgauugcugcccguuucugucuucaguucuagggaaauagcaagaaugucauaugguuucaugaccaugugucuuucuaaaacacauggaagauauucucagcuuaaaagaaaaucauuuauauaucaguuuggucagguagugauguauuuaacaaauacuuccugagcugaacaugguacaggaagcugagauuacagggggaccggauucugaacauaaagugcaagaaaggcaaggcuuuguuuaaaaagggaaacucuagguucacaagaguuucauuuguuuuuugugggacuucucagcaccucuaacaugcuaauauauccuguggaucuccaagccaguagaucaucuccuugucauggauuuuacauguaaaaucauauaacugauuuuacagugcacaccucugccccgccccggcuucaucuuagcucucagcauaagcuuaggacuggaauuuguccugggaucucugucuuaugucuuaugcugggccaugcuagugauggaagagaggacccuuccguucauacagaaagucugcuuacauuauaguaguuuggccaggauuucaacaaauguuuugccacuggucuuuuuuaguuccauuuacucucagccaagaacuaaccagugcucaagccaaaaucuuguguuagaguuguuaaauguuccgucucauaguguuucucagggugagaucuugugcaauauuuauccuuggcaccccccacuaagagagggaaacacugccugccacuucccuugggagaaucuuaacauauuagagguucuaagaagguccuacaaaaaccagcccaacucuuguugaccuaguauuuccucaacagagccccauuuuuaggcaaaacuaauuggcaaccugugaaauaugcuuugggaaaaauuccugugcagaccccucccggccaccuuuauggaaccaagguugucaggcagaagggcucuuggccaacaucuugccccuucacguucaccuuccccuuggaaguggggugggggagggagggcacuccuuccuggagcucccagccuucauugugccgacuuccucuucacugcuccagccgcacacacccccuucauuaaccacugcacaguuggaauagguuggaacauauuaaauaagauguugcuagaguuuuuuuuuuuuucuggcaaggaaauaaugaaagaaauguaaauacagacacgaauauugaauuguuagauuagguuugcaagaaacaauuguucucuggcccaucuugaugaauacccugucagggugaaugccuggggagugacagagcuuucuagugaagcagagaccuggccugcgccaccucucccgacaccagggagcaacccugagccuguugaggcuccucauggagaccuagacugagggaaguccagucuguuuccuuugccaaaaacugauuccuagguuucauuuucaaguucagacuuacccugggauuuuuaacaugaaaagucuaccguuuucaaggagacuggccccuaccccagcaggaugggacguggggcauggcuuugcccuagagcccuggugguacaaaucuauuagugaaucaucacagagccuguuuguuuaagucaauaggaaggggccauguuuguuagguuauaaaugccgaaacggcuuugcaaauaacuuuaaaaaauguuaaauguauauggaaaguuguuuuucucccucacucucuuuuucacuuaagugaaaaaccucauaaaacuucaugagcuguuaagucuguauugugguguaggaaucucguuuguaucacuuaauggagcuucagguaauugcaguucagagugacuuuggugccaaguagggggaaauaauugcaaucucguuaauuaguggucugauuucacauccucuuauguaaggcaagcaaguggucuuaaguaauaaugcuaaugaaaucaauguugauaccccaacaaaggucucccuuccaagagauuaucuaaauaaccaacaaggcagugauuaggagucuaauguaauuaccauauuugcaugcacaaggcccuuggucuaucagcucauggcaaguaguggggaagcaaucaggcaucacgcacaugcagaaacgucucacaccagacaggcaguuuguguagcuguggcuaucgcccagcuuuuuuugguggguggggccuugaggagucaucuggucuguucuccugcccucaggugggcuuauuggugggaacuuugccuuggcaggugcagaugcaucugcaacgcaggcugccagaucuacggauguugcugcugugguggugcccaucuuauuccugauacugcugagccugggggugggguuugccauccuguacacgaagcaccggaggcugcagagcagcuucaccgccuucgccaacagccacuacagcuccaggcugggguccgcaaucuucuccucuggggaugaccuggguaaguggggcagggagagucgguucuuccucccagggcugacccccacgcagccaaugacuugauuaggaaacacccaccuucagcuccucuuuugacccuggaggagcucuucaucagccagcgauuugauuccaugaguuuugguuaaaccauucagagcccucacuuuuuaacuuuuaaguuaaauuaaaauguuguauucucuuugauuguguaguucuggccugaaacagggagcuugccccaggccuugagacucccaaaguaucggaaaauccucaagaauaucugaccccugucucauccuucacugagcuggaggucugacaucucuggagauccuaacucaagauaaaaaauaaugcuuucccaaucagcuucuaucaaaggagacccuuuccaucuugcuguuucucuuucugguugcuaguguaaccucaccagccauucuuuuauguaccuuaacacagugguccccaaccuuuuuugcaccagggaccaguuuuguggaagauaauucuuuuuucacuggaccagcgguggagggggaaggguugggggaugauuucaggaugagacuguuccaccucagaucagcaggcauuagauucucauagggagcgcucagucuggaucccuugcacgcucaguucacgauaggguuugugcuccugugagaaucuaaugcugcccugaucugacaggaggcgaggcucaggcuguaaugcucugacucaccacucacagccugcugugcggccccccauuccuaacaggccauguacugguacugauggcccucggcccgggcauuggggaucccugucuuaacacauagcaagggaaaaaguaagaaguuucccguuuugaaaucuuugcacaaugaaaacccuaaaugcuaauagagauaguaagauaguaauauaauaaaguggguguguuacgaggcuuccccaaacuuagacuaaucacugugaauguacaaguuuauuucuuuccguuaacuaguuacaauuauauaucuauguuuauaaagacauuuguauauuccccuucacugaucauaugauguuagcucuguucccuuuccuugucaguuuccuuucuugccuaauaagccggcaccuggacugccuugugugaauggggcggcuucuuugcuucugccguuggaggcaacaggaguggacccaucagcauacccugcgauagucacugagugucgguccacacuuggugacacaggauuauaccgggcgucacaaggggacagcuguuagucugggaagcuguccucaaaaugcuuaaacuccucccagauccuuuuccucagagcacuuuggguucagaagagaaagcagacacugaaguucacugugcuaguguaggguauagauaacucaaacuggggaacccaaacuacccacuuagcuuuugaguagguaauaagagucuucuccugagaagcuuuguuuuccuaauuuggcuacguucaaacgaccacuaaaauaaaugugaggauccaucgauggguagaagguggccaggagggacagugggaagcugggcuagguuucacagcugauuaugguggcugccuggcuauggcauugaccuucucagcuagaggguugugguaggguugagggguggguagaguggugggauauggggucaggugaaaauguguuggaacucaccaaggccugacuguuuugucucuaggggaagaugaugaagaugccccuaugauaacuggauuuucagaugacguccccauggugauagccugaaagagcuuuccucacuagaaaccaaaugguguaaauauuuuauuugauaaagauaguugaugguuuauuuuaaaagaugcacuuugaguugcaauauguuauuuuuauaugggccaaaaacaaaaaacaaaaaaaaaaaaaaggaaagaaaggaaugaauaaacuuuguaguaaucaacugugaacuucaaaccagguugauuuuaguaacccaauugcuuugauuugacauuaauguagucuuacagggcugugcuugcugggcaugcuuuuacgucugugagauaauuucgguucaguaaauuggccaaucuuuuuauuuuucuaagacacagaaauguauuuaauaaaaaccucgagagagugauggguggaaccccuucuccuugaaaguguguacagauauuccauuuuguuuggauauaguuuauaggaaaguguguggauguauuauggcggaagguuucuuuauguuauuuuguuaauuuauugggacucuguguaaggccaggcuuuaguggucauuagacaccacauguguuaugagccccuuacccauaggguugggggugggaagagaagcauauuuuuuugccauuccggaagcaauccauuuuuauucacuugugugucauguaauggucuuuggcaggagagagcacugagucauugcuggaguucaguucaacagagcugcagcuugggaagcccuguaagcccacagcuuccucucuuauauuaauugauggaauuuuacuguaugugccucuguacaagauguagcuuugagagcuacaaaaugauaacacugcuuuauuacacacugguuucauugucauugcaaaaacuuacccugguugugggggagaguucuagaucugugccaugauccauacacuggcuaauagaguacauaauuuuuccauuuuccauuuuuuguuuuuacuuacuacugaaggaucucagauguaaaauuauguauuugguuugagauggccacuuauuguccuuaaaaauccauacugauauaugcagucauuuugaauuggacagugccuucucuuuuuuuuucuccucuucuuccaucucccucacccaugcccccacccaaucuaaagagacagugcuguacauucucauagagauagagaagaucuaaaaaguugagacuacucaauccaguuaacaacagcaggagcacuagaguuuguucauuuauucucucuguaaaacaagcugugcuuuuuuucuucugccuuuaaaaugccacccguguauucaaaccauggccacuugauacuuauguagaauccaucgugggcugaugcaagcccuuuauuuaggcuuaguguugugggcaccaaugucgagcaucguugugacuugugcuguaugauucucacugaagaauuuccuuucagccaagaagcagugaggucugggaauauuccaaagucaugucucugaauauguguccuugacgugcaagcuuuguaaaaccccauccccgcuuaggugcgaggcaucaccuucucacaaguguuuaguuucuuuuaaccacaaguaucauucuugggugauaauauaguuucauucuacuuagggauuguuuagaaaacaaagaaagagccaauuaaauuuuuuaguuuuugaaauuuuuauuuauauguauacuuagaugaguauuuuaagcugucgaccuuuaguuugccauacggguaggacuguauuucauguuaacaacuggugguaaugauaagccuucuucuagcguauuuucucuucuuuccugucacuuuccuaaguuuuuuuuuuuaaagacuggaauuuuuuuuggcuuuaucuugucuuaccguagagauuuguucaaaacucuaagcccuaccaccuccccuuuaauaagcucuuuaaauaguugaaucauuaacaaccuggugggaggcaagucauuuaauugaaccacuaggaaguguauuuucuuuucuuuuucugccaacuuuuugguggcauuuguaaaagcugauauaaaaggcucugagauguuauuuucaguuauuccauaggcaagccuuuuuacagagcauaugucuccaguuggcagcuugagauauuuccgagcauccgguucuagcuaccagugccucccaaugcuuagugcacaguacuguagacuggccaucaccccucuccuuggaaaaugccacugugcuguuugaaaaaaagcagccuuuuagggcuagaguauuuuauauaaacagaagagcuaaguuccugaagacuaagcuagauagcugcagcuauauguaaauuguauauuuuuaugaacuuuugaagcacacacuccuguuucccucuguguagcuuuguggggauuucauguauauaugcugucugaaagaauccagagguuggagugccaauagaaaaugaaaacaaaugccuuguacuacaggcagccucugaaggugaccacauaacugucuucacugugaccaaucggagucccugcuugcuugugaagaaggggcuuuuguaccuuguuggagaugccaccucagaaguucacacugugcaggaaaaagguuuuauucucuccuggcauacauuagaaugucagaugcuugcauccauguggaccacgaugggccucuaaaaauuggugggcaggggguuugcuuaugaguuuucucuggaaaccgauuuuacuccuggauguauugaaugccccuugagcuuuaugagauacgaguccacauggauaaaauguuagagaguggaguucuacagaggauuccaggaagaggccaugucugugcaguccuaguuccagacaggugagaagcuccaggaacuacuggcuaccuugacaagcuggguaaauaguuaucauucuggguaacugguugaaacucugacuuuuggacaaguaauuccugggguucugucuuugguagcaucaccagggauauuugggugggacagacagaagacacacagcugccuguucucuccugcccaucauguuuggcccacuagaugaagcuguacucagcaauuuagggaauguaacccuucucagaacuggccauuuucaggggaagcuugggagagcaauaguauggugagccccuuagagaugagcgccuacuccuucuuggcgaaugcugccuucagaugcuuaccaaguggucacugcaucuaguaagauuauauuuccaguacacuuccuuagggcagaaacaccauccuaucagguuuggucagucccuucuucaugaagggagucauggggaauuccugaaaauuuucuuccuucugcagacaguuggaugagucccuuagagaaggcauccagagacauaacuaaacugaauaucaucccauauugauuuuaggaauugacucuaaaacucugugcagaaucuuguguugggauuguaucuugacauuccuguuguguuauuuuucuuaacuggagugugugcugccuuucagguacaauuuuuguguaauaaaagccagugcauuaaguuuauauagacuacuuucuaugcaagacugagauauggaauagauaggaagagauauguacugcuggguacauggacaguaaguguguuuucagauggaguaccagcaccgaaaauggguugagggaggauggguuguauguauguuucugcccacuaauuuugagcagccauauuaugaauuaaaucgucacagccaaguaauaacccaagaaugguaugaguuucauguguaauagcucaaauggaauaagcaugaaugcuggaguggaccauuauccucaaauauucuaugucacuucucauuuaaagacucuuguuaugaacuauuagaaacuuuaggcaaaaucaaaaguauuugcggcaaaauaaaggccuauucuacucuuauuuaaagugaaacacuguauacuuguuucucuccaaagcgaaauuaaguauuuauaauuucaauugccucgauaaguuuccaagucacugaaaucugcugaagguuuuacuguauuguugcacaacuuuaagauaauuuuugucucaaugucaacuuuuuucacugaauaaaaauuuaacugggucaagaaaacaccucuuugaaaauccacugucucugugugucucgagcuguucuuuagagcgcaauaaagauggcugacgcagucuccaaaccc

SEQ ID NO: 15943 - RNA, 19882 nt, Homo sapiens
aaaaauaauguauacugacaucccuguguuacagcagaguagauuuggaggugguguaagugaagaaaacaagaccucaguacauagaguuuccaaacuggaaaguuuguggcagcucgguacuuuuagaggaaacccucuggaaguuauuugucuuuauaucacuaucauuuuuuaaaguuucuaaugauugauaccuaguaaauaauaacugauccuugaucauuuacagagugcuuuuccauucguuauguaauguaauuaauuagcauggggugguacucagaaucccucaucugcauauaaaacaucuugagagauaacauaacgugguagcaaagagaaagguuguggaauguacaucccagcugguuuuuucuguuauuguugcuugcuacugaacaaguuauuuaaauacucugaccucaguuucccuaucuauaaaguggggagcauagaaguaccuaucucauagagguauagggauuagaugagguuauacaaaaauaauaccugguucucaauaaauauuagcuaucauuuucuauacuuuuaaaguagggcaaaaagauaaugguagacugaguuguucuaagccuaauauuguuauuauaacugaguuuuaagaagaaguuucuuuaauucugcaaggacaaaguauuuaaguuucuguuugaagcagugguacuuaauuuaggguccuugggaccccuaacuucagggcuuauaaccccuuaaaauuauaugagcuuguagaggcacugaacauuuuuaaaaauucaggaguugacgacuugaaguaguggugaagaggcuauagaacuuggcagaaguucacguacuuugcaacuagauuguguguauuugaauccuagcuccagcauuuauuuacucuuaugacccuaugcaaguuacuuaaaauuucugugcccagcuucuucaucuauaaaauaauacuaguaccuaccuuugaggcuucuugaaagggaaaauuaguuaauauauuuaaaauauuuauauuaccuaguauauauuaaauauuacuaucaacuacugucaguuauuuuucaaacaaaaaucaaguggcaccuauuuuaucuucuauugaaguaauuuugacgcauuuuugacggccuuaacagugauaaucauauagaugcuauuuuauugaguaccuuucuugggucaaaugucaaaagucuacuuagucucuaaaccucacagcaaucaaacauguuuguguucuuuuugguugcacgauacuauucuagguauuguauugaaguagggccacauggcacuguggggaacauguagauuggcucaucagcuguuaccaaccuuuagugauauagcaauauccuuuucaauuauuaaauguuuauguuaucugauauuacguaguacccugucccugcuacaccaccucccuuggcagucuucaccccuauaacuucaacuacuaccuguauacuaaccaggcucgcuuuugaacuucacauuuauauuuacauguggccuauugcuuauaucuaagauagaagaugagccacagauaauuagguuuuaagaucuacauugaacccguuuugaaccccagauaucugagacaggucucagucaauuuaggaaguuuauuuugccaagguuaaggauucacccgugacacagccucaggaagcccugacaauaugugcccaagguggucggggacacaguuugcuuuuauacauuuuagggagacaugagacaucaaucaauauguguaagaaguacauugguugggucugguaaggcgggacaacucacagugggggcuuccagguuagaagcagauaagagacaaagguugcauuauuuugaguccuugauuagccuuccacugaaugcacacauuucgucuggcucagugaaucugcauguuuacauaaacaauagggcagaggaagcaaucagaaauccauuugugucaggugagccucagagggaugacuuugaguccugucuguccuuuauccacaaaggaauuuucugagggcaaauugugagggagggauguagcuucucauccuuguagcugucuuauuuaggaauaaagcgggaggcagguuugccuaacauaguucccagccugacuuuucucuuagcuuagugauuuuggagucccaagauuuauuuucuguucacaccaucauuccuuacccacccccuauuccuacccuacccaaaucugcuagcucugccaguauucccuauuucaauuacaaugacaucaccaucuacuuagaccagcuaaagucucacagucauccuagauuucucucucuuucacuucccagcaaacguggguuauccaaauccuguggguguuuuuacuugcgcgaaaucucugcuggcuagucuuaacagccacugcccgaggucaggcuaucauuuucucuggguuauucuaccacaggaacaaccaaacuagucucccugcuucucaccgauaacccauauuucuuuucuuuccuuuuuuauagugacggagucuugccguguugcccaggcuggucucgaacuccuggcuucaagcgguccuccuaccucagccucccaaagugcugggaauaagcauuagccacuucaccuagccuaguaguccagauuucuaauggaaugguuuuuaugaaaugugggucugauuguaucuuuuuccuaccuagaaaucuuuagugucuccucauagcgugugagagaaaguccaaauuccucagcaggacagcagaucccuccaugcguagucuaacaaaucuccuuuacaaguccauccccuaacauguuuuucccucugcuccaccccaucacccugucuaacacccaccaaccacacgcagugagccaugaaugcaucaugcucuucucuugcuuugcaguugugacuucucuuuggaauggcuaucccuaaccuuuucuuucuggugauguccuucaaaguccaaaucuaauaucauauucacuaggaagccuuuuaccauaagcugagguaguuguguugucuuuucugaucucauagaauuugcauauauaucuguauugcagcacguguccuauugcuagaauuguuuuuguaguugcccuaccuuuaagacugauuuagacugugucuguuuaauguuuguaugcucauuaccuaguguggugcuuaacaauaaguucuuauuugaaugaauuaacaauggcauguaugaugaggaauauauguuaauaucuggcauuuggugcuaauuaaauuuuucuuuuccugacaaagugaggaaauguucauaauucauaucauaaacaaagggccaaacucccuaauauauaaggagcuucuagaauuugacuuuuauaaagauacuaaaaacucagugggaaaacgggcaaaggauaaaaacagauaaacacagaaaaaaauauaaauuauucuaaauauauggaaugaugcucaacuuuacucauaauaagguaaaugcaaauuaaguauacccgagauagcccuucuuucuugaugaauaugugaaaguuugaugauauccccugcuaguaagauugcagagaaauagguaagguacuguccuacaucguuugaggacuacaaaguaguuaaacucuuauggagagcgauguagcaauaucuaccaaaguuaugaguguauaacucuuucgcucagcucuucuuuuagaaaucugccuaaugagggccugucauuguagcauuauuuguaauagcaaaaaauggaaccuauccaaauaucuagauauguguuaaguaaacaccuauauaacagugaauuagacauaauucaguugaacucacagaaauggacacagguccauagucccuagucacaauuuggaacucuggaaagcccuguaaaaccaaaaaguuguuuucuuuuugcuuuaaguucggcucucaaaaucauuugaugacaaauucucacuccaucugaccgaggugcccauugugucuuggcacaccuaccagguauuccugguguuuuuuauuguuuuguuaauuuggguuuaacguggcagugugggaacuaccaccacaugugacuuaaagaauagaaaaacagaucguggacguuuuauagugguaguaaggacuaagaauugaugaaaaauagggagacauugcagaggacugaaaaugaagauucuaaccauguuucgguuaaguggauuucacaauaggaaguaaacagaugccacucauugcuuuguugaugauggaaaaagcuggcauauaugaagaccugcuacugaaggauguauuuaguauuaacaaggaagaauucagaaacuuaggaagcaguguggugaaaaauaucuaaaaguaugacaagaguuaauugaaaauuuacuuucuagacagcucuuuuaugcauucuccucaacuguagguuauaguuuuuaaucauuuacuuuuacuucacugugaccagaauacagccuuuuucuuugggucuugcucuguugcccaggcuggaguucaguggcacgaauauggcucacgguagccuugaacuccuuaagcaauccucccaccuuagccuccugaggguagcugggaccacagggcugugcaccacgcccggcuaauuuuuguauauuuuguagagaugggauuucaguauauugcccaggcuguucuccaaccucugagcucaaggaauaagccugccucccaaagcgcugguauuacagucaugagccaccaugccugaccagaauacaaucuuuuucuccaaggagugcuacacucugggaaaaagcaaguauauugcuugcacaguuaagggaggccuaggaaucaaaacuuccuuuaagaguucaguuguaaagauccuguugucaaaauuacuuaaugcuugaaaugauguugauaaaucagcaauaauaaauguuuaacauuuuagcugacaaugagguuugaaaaugaaccuguagauauuuuggaagauuuucuaucacuaaugaggugaugauaccuaaucucuuuaauuauaccauacauuuaauggcccaaaccauaaauacgucaggagaagcugauguugaagaaaugcugaacauuaauccugaugcuucuguucggcacuuuuugggugauggggacauugcugaaagguuucuaaaugcacauaauugucacgcacguccaugugaagagaccaccaaacagccuuugugugagcaauaaagcuuuuuuaaucaccuggaugcagucaggcugaguccgaaaagagagucagcaaaaggaguuagggguggggcaguuuugaaggauuugaguagguaguggaaaauuauagucaaagggaguuguucucuugcgggucacaaggugcucaguaggggagcuucugagccaggagaaggaauguuacaagguaaugucaucaguuaaggcaggaaccggccauuuucacuucuuuuguaauucuucaguugcuucaggccaucuggauguauacgugcagacuugggcucagaggccugacaauagcgggaagauaguaauaacuacaugaaugauuaaaugaugacuauauugugaacacagaugggaagaucacugaaggcauuauguaaauaaucauugcuuaagcagaaauauauuaauaagacagaugacauugguagaaaucuuuugaaaagguuaucuuggauauuguugcuuuaucacuugagaauccugauccuggcccaugaccaaugucuaauuccaaccugauaggcccuucucuuuaagauucucaagcaaucagauguaaugaacauuuauugcguguauguauacauauacaugcacaaguauuuaacuuugauuuuauauauauuugaaaguuuacugaauuuuucuuuuaaaaagagaauacauuguuuauugucuguaccagucuauuuuccauuugucauuuguuacuccauacauaauuacauaaauuguuaauauacaaaugaauuauaauaccauuuacaguauguacuuaucccacuuaaugugaauauucacauuuucuaaacaaauauuugauaugagcuggucauggugacucaugccuguaauccuagcacuuugggaggcugagguggguggauugcuugaguccaggaguuugagaccagccugggcaauauaaugagcccuuguccauacaaaaaaauuuuuucuuaauugacugggcaugguggugcccaccuguaguaccagcuccucaggaggcugagucagaaggaucacuugagcccgggaggcagagguugcagugagcugagauuacacuacugcacuccagccugaaugacagagcaagaccuugucucuaaaugaauaaauaaauaauaaaaaagaaccaaaacccccaaauauuugauuuauuuaaugacagggagaaguuuugaccuuugcaaaauguauuuauaggaauuuugaauuccgaaauaacaucugaugccaaauguuuuaaguaagaaugguaguagaccuguauuauaaaaaaggagauggugacuuccaaaacagcagaguaagaaucucugaaaaucucuucuuuauaaaaagcaacaaaacacugacagaaguugucagaaucagcuuuuuuagagcucuaggaauuaaaacuuuaugaguuaaagcuuuacaauaaucuuagcagccuuuauuugagaaaaguaguugaaucucaguaagaacaaugagcuuuggacauuuuccguccuuuaccaucucccuuuugcugacuucaugguagccuugaaaacuaagccuuacaacacaguaacuaugaaaaacagcagccuggauggaagguacagaauagguuugcagccucaccaaaggccacaacccagaaaaucaucaccacuugaucucucuggcaauucucaaggcuuguguuuauaugaccugucuuagagcuuguucaauaucauccugucccaggguguuuugucaaggagagucauuauuuacacauaacaggucuuagaggcacuauuaucagcuggcacuaacaaaagccugaccaaaaauacuuaaaagggaauacugagaaaugagauaucccuagggggcuuugaaaagcucuguuuuccugagaaucuagaaugauucccaugagcagggcuguugcacauacccaagaaaggggagaaggcccuaauuuccccuuuggcugaccuugaggguuuacgcaagcaguaaguucaggccagucaauuuuagagugacaacuaaaguauugaaagcauggcccaacacagcaccuuggcaaaggcugggggacuuaacugguucaaagcacuuaagaaaaucacuccagucauuaguaagagacuuguagcugcacacaacaaauaaaacagguauguaauuaguucagagaauuacuuaacgcacagcaacaacaaaagcaacuuaaagcccuggggcagggugggcgguggugcauacaaucugauuucaagaguuaccccaucauauuacuuaaaauaucccauuuuccauaaaaaauuaaaaaacacaaacaggaaaguauggccuguacacacaaaaaggcaaucagucaguagaaacucucucucagaaagcccagauguuggacuuacaaggcaaagacucuaaaucagcuacuacaaauauaaaagaacuaaggaacaccacguuuaacuaacuaaaaggaaguauuagaacaguuucuucccaaguagagaauaucaauaaagugauaaaaguuuuuuuuuuuuuuuuuuaaagaaccaaauggaaacgcagguguugaaaaguacagugacugaaacugucuugcuuaacagcagauuugagccaacagagcacagaacuggaagauaggucaauugagauuaaacagcugggaagagaaagaaaaugaagaaauacaaacagagacuuggggacacugucaugcauuuccacauaagcauaaugagaguccuaaaaggagaagagagaaagucauagaaaguuuaagaaagaguggccccagacucaccaaauuugaugaaaaacuuuacacauccuagaaguucaacaguauaggguugggguuuauuuuuggggugcugaaaauguucugaaacuugauagugguaaugauugcauagcucugagaaugcuaaaaaacuagucaaucauauacuuuagugaauuuuaugguaugugaauuauaucucaauaaaccuguuucuuuaaaaacaaaaaaaggaggagcaugauauuuauguagggauggaaagaucuccaagauauauauucaauuaagaaaaaggaacuucaugguguauauaguaugccauguuuuguaaggagggagagaaaaauuugucaucauuccaucuuacauuaacaaacaccguaaggauucucaggaaacuaauagauauggucacccagagagguggaaaugaaaugacggugugguuuacagugacauggauggaagcaaggcuuugcauuguaugucuuuuccugucaguuucucauuuucuuaaaucccugugggaauuuaguggagaaaucucauagggaaucuagugaaggaaauaggcuacaaagaaguaaauaaguauuuucagaauuuuccuuaccugugggcuauuuuguuucaugaauugauguuuauuaacguggcccaauauguaggagauaaaggccguuugaacaccugaaaucuauuguggguaggcaauuugcagauuggcuucuuguucaaaaauuucaguucaagugagagacauuuuagaugcugaacacguuuucuugugcgaacaaugcaaugagggaugagugagucgaucauaaaugauagauuccauagucagaucacaaaagcugaccacaauaucaccgaacuguauuguaacaggaccaugaguauagaauggacuuaaauauguacugaacugacuaauguuuuuuagaguuuaagcaucugaaacaggaguuggcaaacuaucuguaaauggccagguaguaaaugccuucgguucaacgggccauacugucucuguugcagugauacuauaagcccaccuuuguagcagaaaagcagccacagacaguauguaaacaucugggugucgcuguguuccauaaagauuuuuacaaagcaggcucugaguuuggcccgugggcugcaauuuaccaacucccgaucuggaauauugauuagagguagagaaauaaauguauuccaguucuuaacaccaagaauacaucuuccuuuguucugucaaugggagugucagaagaacagauagucccaauucuaugguugugguggcagcauggauaucuuuuagggaauuuaucuuaggugucagugcugaagcaaaaaucucugaaguaugaauccuugaaggagagagaugagcugaaacuuguagcugaaagaggaaacuauuugucugaguaccuaguccccugcauucccaucuuuaccacuugccaugcugccauaggacgcgguagggaaugacacugaaauggaauuccaucugggcuugugccacuuagcagcuugaugaccuuuccugggccucaguuucucuaacugagcuuuagcauccccauacauaguaugaagagauuggacuagagaugauaucuaagaucccuucuggcucuaaagauggcauguaggggauucugauagcagcagauguacugcauaugacuguucuuaaaucaggaacuugagauauaguguuucugaaaaauuuuugccuggaaaaauagagacaugguaacuaauugucacacaugcuuauuuuuuaggggcuaagugauggaucuuguacuccguguugcagauuacuauuuuuuuacaccauacguguauccagccacauggccagaagaugacaucuuccgacaagcuauuagucuucugauuguaacaaauguuggugcuuacauccuuuauuucuucugugcaacacugagcuauuauuuugucuucgaucaugcauuaaugaaacauccacaauuuuuaaagguaagaaauguuuuuaccuauuuucuaacgauuaaaguaaaaauaacaauaugauauauuucugagauuuuuagauuaagcugauuauauguaaccauuaaauaaaauuuuggagaccaaccacaaauggguuagauauuuucaugaggguuaaucccugcucuccuucccuuaguuuaagcaaaucuaacuuuuuaauaaaacuauaagucuaguaucguaucuugcuagaugcauauuggagcauuuuuaugcugauauugaugaguaaauaaaugcauacauuuauguaauuauuuuaauauaugauuuucacaaacugaaauguguuuuuuuaccauguuuuguuuuuuggcuagauaggggauucaaacucaguaguuuuaaaguuguuuacaaucauuuuuaaauuucgguuguuuguacuugucagugacuccaaggacugaacagcaaaaagaaaaaauagagaggauuggggauggaaguuaauuaggaaagaaaugguuauuccauaaauagaaguuuagaaugcagauuuuggaggaaggaaaaaagguuucagaauuugaaauacuuauugcauuuucucaguacaaaaggaaugauuuucuuacauaccuauuuuuauguauuuaaaauuuuaauagaaacaguuuggagguaagccccuucauguaaaagagauuuuaaaaauccaguccagaacaguuuuaugcuaguuuuguuuaacauggauuuugugauuuuuaaguauuggaaauuucacuuucagaaucaaguccgucgagagauuaaguuuacuguccaggcauugccauggauaaguauucuuacuguugcacuguucuugcuggagauaagagguuacagcaaauuacaugaugaccuaggagaguuuccauaugguaaguaaauaacacgagugucaggaagagaguagucuaagcacagguuaguuuccuuaaaaaaacaagucugcccuuuuuuuuuucaucuuuuaaaauaauuacaaauuauucaguuguuuuuuaauguucuauuuucauguguucaugucuugccacaugugcauuucuuuaguuuuucuaucaaucugaaagucugcuguagaugagauugugucuggcggaagauuggagugaucagagauggguccuugcauuuguuuucuauuaauuauugaauucaaccuucuaaaaaaaacuugaguagcuuaugucauugcugaaaguuaaaaacagauuuuuaaaaugcauuauucugcuucuuagaaacuguaacucuucuggcauacaaccacccacuuuucugugccuguauacuucauuguuuacauuacacaaaugaaguccugaggugcauagugguuugggcucugaauuuuguuucucuuagcaacuuacaugguuguauuuucaugucaaaaaaaucuugagauuauguaauauauuagucauaguacugugcggauauucauaaguuauguaaaugauaccuaauuguuagaccuucagauuguuacucuuuuuuguauuauaaacagcccuguagugaguaaacuuuugugaaauucugaaacuuuuucaagauacauuucuaggaucuaguauguaaaaagcaagaaucauaguauuuauugaaggcugauaugugucagugacaguucucagcucuucacaagaaucaguccauuguuuuccuacaauucuaugagauagguacuaucacugugcuccuuuuauaggugagucaaugagguguacagagaguuucaguaacgaguuggugguagaucugagacuuggacucaggcuugcaggcaccagcacccccacacuuuaaguaagaaguuaguuauugccgggcgcgguggcucaauccuguaaucccagcacuuugggagaccgagguaggaggaucacgaggucaggaguaugagaccauccuggccaacauggugaaaccccaucucuacuaaaauacaaaaaauuagcggggugugguggugcacaccuguagucccagcuacucaggagggugaggcaggagaaucccuugaaccugggaggcagagauugcgccacugcacuccagccugggcgacagagcgagacuccgucucaaaaaaaaaaaagaaaaaaaaagucaguuauucagaagaaggaacaaaaaauuauauacuagaguaaugaauuggcugggcuuugaaaaauggauaugauuaugaguuaaaauaaagggagagaggacauuuuagguucuugaaccccuaugaugaaagauacagagguaaaacuuccaagacagugggaggacauugaguaaaccugccugguuagaguagaaauacaggagugaugagguuggaaagauccgaaagggguggaguauggaauaaaugcuaaauuuaaaguauuuaguggaaaguauauuuuaagcagggagauaauguguaaagauggguuuuaggaagauuaauaugaaggaagugaugauucccagagauuuaaauaauaaagaugucuuaggaguauccugucucacaaauaucuuuauaguuuaauuaagaaguacuuuagguagaacauuucaaguacuuaugcgagggaaaugaggaaaugaccagauuccaagaagccaagagagauuaguuuauaauauacugaauuagccagaacagaucauuuauaauguuugagucuaggaucccauuuugcacucagauggacaugugaaaagugaacucuaaucccaggagcugaguuuugauucuucuguuucccguuuucuuuucuaggauuguuugaacuugucguuaguauaauaucuuuccucuuuuucacugacauguucaucuacuggauucacagaggccuucaucauagacugguauauaagguaaagucauuuguggugaaaagagaaaaaagguuacacauuucagcaauguaugauuauaaauucuguucucuauuuccaagaauuuccucuacccauauuaaaugucuaaguagccauaaucauaacagguacagggugcauuuuguucauauucuucuuuaugggucuaaggggcugucuuaaaauucgucuguuccgguaacagguacacauggacuuacagagggaacaauagacauuagagacuccagaaggugggaggaugggagaggagugagggaugagacgcucccuauuggguacaaugugcacucuucaggugcuagguacacuaaaagccagacuucaccacugugcaguauauccauggaacaccacugcacuuguacucauaaauccauauaaaauuauacuguuuuagggcgaagaaggacauuuuauagaauaaauaauuuugcugaucucuacaggauuuguuagguuguuuccaacaugagugugagaagcuaaguugaauguugcacgggguaaaguuugcagugcuaauuguguccuuuucuccugcagcgccuacauaaaccucaccauauuuggaagauuccuacuccauuugcaagucaugcuuuucacccuauugauggcuuucuucagagucuaccuuaccauauauacccuuuuaucuuuccauuacacaaggugguuuauuuaagucuguacaucuugguuaauaucuggacaauuuccauucaugacggugauuuucgugucccccaaaucuuacagccauuuauuaauggcucagcucaucauacagaccaccauauguucuuugacuauaauuauggacaauauuucacuuugugggauaggauuggcggcucauucaaaaauccuucauccuuugaggggaagggaccgcucaguuaugugaaggagaugacagagggaaagcgcagcagccauucaggaaauggcuguaagaaugaaaaauuauucaauggagaguuuacaaagacugaauagauuauugcccaguuauucuuaaguaaggacaaagaaggaaauaucaucguauuucuuuuuuuuaauaaggaaaaaauaauauccauacagucaagauacauaguaaaugguaucauuuggaaaucagcaucgugggcacugcugaggaaugauccuagugguaggucagaagaagaugcugugaacaccaggacuuuaaucuuaugcuuaaaaugccagauguuguucgggggacaacuuguaucuuucuagcagcagaucuguaguuuguauagccucaacaacaauuuuaaauaagauggagaauaaauuauugaggggacuaggcuauaugcauuugccuucauccacccauguuuauuaagaaucauugugcuuaauaauaccaagacuaagcaccauaaccaagaaauacuaauguaaagauuguuucuuguuucaggaaugguuaauucuucaacguugguaugauaaugauaacuuguuuugacuugaauaaaguacuacaucaguguggaaaaaaauucugauacauuagcagcuauguaaaugaccuaauugauagcagguguaauaagacuaucgucuuccuacacauaggaggcucauucucuggacacacuaucaccuauuacauuuuacugauuaacaaauaaauuggaauuuaaaaauaucgauaucaccaugauuuaauccagaucugggauuauguagcuaaacauugugaugauuauuauuuaaaaccauuauuuaauaagaguaaaaauaugugaaucuggauauauuuaaaaaaagaaauuugaugcccagauaauauauuaggcacuacugauuuuuuaguuaaauugaugcacuacacuuuugauguuugaaguuacaaaccuguaauuuuuuuguaaaggaaauaauugccaaauaccuaggcccauugcugacgauuaguucuaaaaucuuauuccuccucuucuccccucacuuuucccuacuuccucugcaaaaagauuuaacaaauacauucauaaggaaauguguguuguaacaaauauauugcaaaaacauaguuuguaaaggcauucuauaagcuauuuauguaaaaucaauaaaaguugaucauaauuaaacuguaucaguugaguauuauagcagcacaaaguauucuuuguacagauuuugugccaauuugaagccacagaaaugauguggauuguuaauuguguuuuagaacauccccggacacucagugucacagggggaaagaaguggguaccacauucuguuuauauuucacauuuuaacuagauuugaguguuuuuagcaagaaaucagucuuaaaaucuaaugucugggauccagaagaaaaugucuuuaaucugugaguuauugucacaaugucaucuuauuuaaauguaccaauuagcauuuuguaauaggcaaaugucauuuagugcuuuucaccaaucccacucacccccggugcuccgccuugccuaagaaaaagaaauuaaggagaaguaaacuuuauuuccuaauauaaugucagcugauauuuauugagcuuuuccucuuugcccagagacuaggacccaaagaaguuaaguaacuauucccagguuuauuucucucucauaugaugucccauguggauguuuguggucaguggacagcuuuccaccuagucuuucugcgacccaggcuccuuccucuuggggcucugccuuucucucaguccauagagcccucuuuguugaaagagcacauaggaaaagaaggaaaagucuguguggaaaauguuucugggucaggccuggaaguggugcauaucucuuccgcccauguuccuuuggacagaacuccgucacauggcccaccuagagagauuuugggaaauguguccagcugugugccugggaggaagggggcaccauuuucuugagcagcuagacaguuugccguauuugugguguucuccucuuguugauguugaaauggugaaugagccauaaaguauuucagguuauccacacacuaaucaucucagugucuuuaauucuuaacuccaauaugaauguuuaaagcuuccucuagauucuuauuccuauauaacuaauagagaagaaaggacagcuuccuauggggaagacagaggcuuccucauagauguuaggaauaaucaaacuugccccugcccuuucacccgucucaaauucuggucuuuuaaagcagcguuauguuaaguaguccuaacauuguaauauacaguacugccacauucuccuacuuucuauuagaggaagucagagaauauuuauggaagugaggacccaaauuaccuucuacagaugacuuuuauaguuacaggacagaaagugaaaaucaagguuacguuuucuacuuuugugguagaaauugagaaguggguggauaugguucgagaagaccuuucagaaacacagagacugagucuuugucuuccaugcugucucugcaguacugagugaauuuccuuauacccuuguaucauguuuuccucccaucuucuagaagcuggggacagauuuggaagagaauuacacaaguucaguuuuuugauacauggauuuuacagugcaugcagguuauuuauguagagaggaggucugggagaaagauggaaacuagggagaugacugagaacaaagauauuugggauuaacacagauagaagaaaaguuugaaaccaugagauugucacagcaugaaaaaagauauucaaagacacuaaccaacuugaggggugcaguggucugaauguguccuccaaaauucaaauguggaaauguauuugccagugagauaguauguagagguggggccuugaggaagugauuaagucaugagggcucugggauuaaugacuuaaaaagaggugugaggcagcuguucagcccuucugucuccugucccuuuuuuuuuuuuuuuuuuugagauggagucuugcucuguugccccaggcuggagugcaguggcgugaucuugguucacugcaagcuccaccucccggguucacgccauucuccugccucagccucccgaguagcugggacuacaggugcccgccaccaccacgcccggcuaauuuuuuauauuuuuaguagagaugggguuucaccguguuagccaggauggucuugaucuccugaccucaugaucugccugccucggccucccaaagugcugggauuauaggugugagccaccaugcccagccccuucugucccuucuaacgugaggacccagcaacaagguaccaucuugaaagcagcaacuggggacucagcagacaccaaaccaacuggugcuuaaccgugacuucccagccuccagagcuguaagaaaauaaauuucuauuauuuauagauuacccaguugaagauacuuuguuaaggcaguacaaauggacuaagacaagggggaagaaauuugcauuccugaucuucccaacuucuucaaauucacaacacuugaaugacagucuuauuucagcacuuacugcuaucaccuauuacuuuuaugugugucuuaccuauuugagaugccagauuccuuggaaguagagaccgugucugaaucaucauuguauuaaaccacucauccuuaacaaaugcccaagccaugguuaaaguucaauaaauacuuuguugaauuuauuaauaaaauggcagaaaugucauucucuuccauauauguuuaauaaaucccugauaggugcuaagcacugcacuagguaaaaauucucuucugaugcugucuuuuuggccaaccauuuuuuuaucauuuauucauuagcugacauuugcuaagugcuuuggaggggucaaaaggggaaguaaugagaaaucaaagauggucccuacaucaaggauaaacuaucuuuuuuuagucacucaaagucauaacccuuuggaaacaaaacccaccaguaccccagauuuugaccacagaugaaucaguacuacaaggacugguuagaggguugaaugaaucuguauacucagcacuuaacacagcacucuggguaaaagaaaaaagauccucaaagauauuaguugguuacaucaagaaaggacaaacuuagguuaaucuauaacuucaucucagaggaacaggaacuuuggagauaaacagggcucugccacuugcaaguugcaccaucccugguuucuccaucuguaaauugauuaaaacacugccuaucuaauaagauuaaauaaguuagaagcauucaguuaaaugucaacugaaacuauuguucauguaaauugugcuugaugcuuuuucuuucuagauucaaugauuauugucauuuuaccuccauaggcccucaauagaaaucaguugcagagggcagaagccuagauauuuucaccuuaaaauuggagggugaaagacauugaggugaaguagagauagaggguacacagaaaaaucguauaaguaaaacuaacaucguuaacauuauuuacuguaaguuaucuuuguaagagugguaaaauacauuguguuguuaaauaauuucauuuaaaaaaugcaucacuuuguguguuuuuauauugcuaaaaccauaaggccagucuacaagguuuguagauaaaauagaaacauaccuuccuugaaaagcagaauaaauuuuuuaaaggcaggaaggaaguguuugaaccaugugucaacaagcuuuacugucaaagcaggcuuuugguaugggaagaaaaauacuuauaaauacuuguuuuaauauuugcuuuauuaaaauacauuuaaaauacagcauuuuuaaaucucuaagcucaacuugaagauauaagaacaguaaauuugauaaaaaugagaaauuacauucccauuucuuuaacaauuuguaaauuccaauuauccugaacauuuaauaccauuuacauauuuuauuaaucacauuuucuuaaacauuugauaagagauuuaauauuuugauccaacuaccaaaaaagcagacuuguguacuugacagauuuuucuaaacacuucacaacucacgauucaaacaaagacaaaauagcauaucaaaaguuaaucacucaguuggaaagcacucauaccauaggcuuuuauucauuucuugaauaauuuuguuauaucuuccucuuuuaggcugcaaugagcuauaauugcacuacugcacuccacgcugggugacagagcaagacccuaucucuaaaaauaaaaaaguauauauauauaaaaauaucuuccucuauuauaauuuaacucauuaagccauuuauuuagauguaaacuugccccccugacaugugguaugaaacaaauagaaaccuagaaauuuagugcauauucaaauauuaagacagacacugguguggugacuuuugucugucgcuucauugggacguuuuuucuuucugaucaacuuaaugaaauuauaauuuacuauaauuaaguguagccauuuuuacuguagaguucaaugaucuuugaugaacguguacacccauguaaccaccacccccaaucaaaguaaagaacauuuucuuaccagaauaaauuuccucuccguuugcagucauucuccccagcccuaggucaccacugauccaccuucuguuacuggaagguuaguuuucuucccugauuuagaauuucauauaaauuaaaucagauaguauauacucuuguguuuaguuucuuuagcuuaacauguuuagagauauuugcuguugccugugucuguagcuuuuuguuuucauugcugaauaguauuucauuguaauauaccacaguugguuuauguauuugcugaugaauauuuguguuauuuccagcgugggauuauuaugaauaaaguugcuacaaacauuuguauacaagu

SEQ ID NO: 15944 - RNA, 19270 nt, Homo sapiens
ggccgcgaggugcgcggucucuuuaaggcggguccuggugguuucuguuuucugaaggaagugacggggggugggauugaaugaaaagugcaaaacacaggcucgcagcgcuggagcccggggccgcggagccgggccggggcagcgccgucuccgccucggggccgccgggggcgcccugcugagcgcuacccacgugcguccgcgccaccucgcgggcgaccccgcggccaaggcccccggcggagcggcucccgggcgccccgaacuagcccccaacuuugggcgaaguuugccugcgccucuccccgcccccacgcggcgcgccggggccgcggacggcagcggcccccggggaugcgccuucccgggguaccccuggcgcgcccugcgcugcugcugcugcugccgcugcucgcgccgcugcugggaacgggugcgccggccgagcugcggguccgcgugcggcugccggacggccaggugaccgaggagagccugcaggcggacagcgacgcggacagcaucagccucgagcugcgcaagcccgacggcacccucgucuccuucaccgccgacuucaagaaggugaggcgcccucacucgccgggguggcaccuucaagccugagccccccgggaucccaggcgcucucuugccugcagacggaaagacgggcccaggagggagacgcagcuggcccaaggucacgccgggcucuucucuacaccucuuugcccacuccccagggcccaccccuucauucucuccaaagaaccccucugcuucccuuucucacucccuccuccagcgcucccagagccccccaggugcuaacccuccuccagaacuccuacuaacgacuggacucccuucuuggagucauuccccugugcucuagugggaaaguccuaggcgaaguguucucgcugugggcucucacuguggguucucccugugugaucuagagcaagcaagccucuuuccuccuaugggccuggcuucucaccccuguacagggcacugaggggucugcgaggccucccagcccugacauuuuggagucccucugucaccucucccucuguuucacuuuucuggggagagcugguugccccuggucccucucaagccgggagaagcccugucuccucuuuggucuggaaggcuggggcgcuugcagcaggaggauccuggagagagaccccagcugaggcccccucccucugggagaagugcugcccuucacucugccuggcagagaagcgagccaaccccccuauuuuggcccagauuaggguuagggaguuagagaccagcccggugggugggugggugggugggugugggugugugggugugugucccagauuacgguuugggaguuagagaccagcccgcucuuggugugugugugucuguguuggagggaauaagaagggccuugcacccagggggcugggggauuaucaggaaaugggccuggauggugagugacuaacagugacccagcagcaggaaagcuggaggaaaagaggguggguaagucuuagguauucaaaaggagcguucugucuccuucccccagcuaaagagaggcccugugaggcucugucccugggggagugcaggggugaagccgauuagauagcugggggagcccggggccccggggacccuugcugaagcugccugucuuuccucccucguagagacagggcgcuuuagaggagagguggcggaguuugggaagucaguuagggacccagccagauugccauaguuagcaggggugagggguuaggcuugaccgcuagaggugggugggguuggggggugaggcuugaccgcugauugccccagggccacggaguuggcacugacauuggacauaagcaggcagauggggggugggguagugagcguucacaaaugggaagacuuuguagcccauccuuacuccgcaggccuaagcuaggcacccugccuccccaccuaaacccuaggagaauuuuaucaaguguguucuguuccugaaaaaucuauguuaguggcuggauccaucaggaaucggggaucuaaucuucuguccaagcccuuuguccuugaaaguuagccuuaggccaggcugugaggcucccaacccccugcccacuggaugucaucuuguggcugcacuagaauccugcagagagacuucccuggcuguggccaggacagugaaaggcaauggguagggcugagcuuuuauagccuuuagcuacaucuggaagguuuuuauugcugugaucugaagggagaggcuaagaaguacccagguagcugugaugugcuggcaguaguggcugauggcggggguggggugcuggggauuggagugaggguaugcuggucaucugacugcccaguuagaaaaugcaucuggagauugugagcaccucauuugaaucucuacagugguucagaccuccacccagguuucuaaagucugauuuucagguuagccucugacccagaagcuaccauuucauacccaccucuggcaucuccaauuucaucagcaagggagggaauugggaguggaagacaccgaaaggaaaccagcuuucccaagucccuuuaacuccagguuucuccauuggccuaggacgggguggaguuggagagugcagugugggggagaauagccuuacccucacccaggccacucacucacugccugcacuggccacagcagcuucuauguccagauccuucuagggugggucaccucucaguucucaaggccccaugccucauaguguuugucagauuuccauaagaaaguuuggucuagaaggaaugauuuuuccuauaagaaaaagacuucggcucggugugguggcucacaucuguaaucccaggauuuggggaggcugaggcaggcuuaucgcuugaaaccaggaauaugaaaucuucaggccaaacgagaccccugucucuacaaaaaauuuaaaaauuagcggagcacgcuggugugugccuuguagucccagcuauucaaggaggcugaggcaggaaaaccacuugagcccaggagcugaggcugcacugagcugcaauuguacuacugcacuccagccugggaagucacgcuuuuuguguuucuuguaccaaacucauuugcagugauuugggaaaaguccucaucuacuugggaagagccuuguuugccauuugaucacguuggggagaacaguccagacugaaugagacagacuugguuuaccacuuauuagcagguucacccugggcaagcuacuugaucucuccagaccuucauuucuucaucuauaaaauggggauaauaauagcacauaucccacaguuaguagugccuaugacauccuuacucuguauuagauacuguguuaagggcucaagacauaggagcuguuagcuuugcaauuguggcucacacagcauuucagcaaggauccucucugcuaaacuuggacucaaagacauugaacaacggacccaaggucaugcagaaaagucaguacugagccuggaggauccuugagcucuucaucuuaaccuucuccuugaagugccaaaauugcuggccagccccucagagcaggagcagccauccuuguccugacaguccacccagggcagcagugagccucccugugugggaugggaccaaggcuucugucugauucccaacccuauccagcccccucucuccagcccuucccaccuguuugccucuacccgcgucagaguucugacagucuaacucucucccacacuacugcucuggaccuugacgcagcaaagcagucacagucgucaacccacuggaggacacauagccuggagcccaggugaggcuugcagacucaguagcuuggagcuaucagauggccauccugcauuacugcaagcccugcccagaggcugagugaaggccaucaggcugaccgagccacagcucugaaagaaugccgcagcucaguggcucccagcuuugccgcaccucacaaucaccuggggagcuuugaaaauucccacugccugggcugcacacccuaccagugaaaucagaauaucucagggugggagucaggcagcagucguuuugguuuuguuuuuucuuuuaaagaacccaggugauguaaucccagcacuuugggaggcugaggcaggcggaucacaaggucagcaguucgagaccagccuggccaauauggcgaaaccccgucucuacuaaaaaauaaaaaauaaaaaaaaauuagcugggcaugguggcaugcaccuguagucccagccacucaggaggcugaggcaggagaaucgcuugaauccaggaagcggagguugcagugagccuggaucgcgccacugcacuccagucugggugacaaaagaacccaggugauuccagugugcagcaaaguuugggaaccacuggcgcaguugcucuaggggaggggaggggaccuggagaaggagccagcucagguuaaaugaggguagggcccaaacucagucacauauuugaaaccugucaucuuacccacacuaauccuaauguguuuugagcagcacauauacuucgggccuaaugcugugugcccucaguacacaaacuaauucacagcgcgcccuuggugggcaacacucuccuuuauacuccacauccuauggguguaauuagcccuggauguacauaaucacuggcauaucuaaucauaggugugucaccauccccucucccuaaacuggcuauuugacagcccuucuggucuaccuccuggaagcugguauucuugccaguuucucuuucaccucuguccccuaguccgaguggccaaaagcugggaagaggaugagucacgcuccaggcugccugccuuggggcugaccggauggggagggugauacugacagauaugaagaaggucaugugugauggcaucacgguggugggcggugggggucccuuuccccucccagcaucagggaggauagggagacacagacuccaaaaguguggaaggaggggauccugaaggcccacagcuggagcccuggagggaauaagcaagauaaggggaacuguacagcugugugggucagcucagggccgcuucgaagggacaaggacccauggaggauggaagcuugagcccuguccugggcacugaugagugagugggagccagaggaagggauaguccaaagaaugcuagggccccugugccggggggccuggucugugggugggggagcaacaugggaagccuugaggugcagucaguaaagauguggaaugugcaauguccacguugccaccuaagaacguguaucccaaggagauaucacagcacauagaugugggaccgagaagcuuucagggcccagucugccccuacccugucuguguuagcacccuuaagauuuggcguggaagcaucugauggauggaaagucuccuuggggaggaaaaggcaguggaggugcuuucgggagaggcccagacuuuucuggagcucagagcauuuccucacagguauuuacaagaagucgccagauggaaugaccaggcucacugacauggggcuccugggucuaauaucugucccuccucugcgugugaggaauuccuccucagaucaggauggccagcccugccugaggguucagacccccucccgggagcuuggccagcaucucccaccccugaaugcuauguccagguggaguccuagcaaaagaucccgguaggccaugaagacugccaccugggauaauggaggauccugcugggaagcugguggggagagugaguuaguucccucccaggcuucccaaggcacagagaggugguggagauaaacuuaggacagacuccuguuccgcuggcggagggcccagccuugaagugaggauugcauagggucuggagaucacccauugagcagucccucaugucacacaugcucuuaucugaucgccuggagcucucaagugaggcugacaagaugaagcagcugaugaucccagauuaggacccaggguuccuuccaguauauccugacugccugucugccaugguaccaugagugggcuccuuccaguaggcuaaagaacccuggggagggagguggaggggagaaggaggcuggaaaaaaccuuggugcagaggaacaaauccacagagacccucguuuguacagacuugggcuggaccacuucccccacgcucuuaccuccaguggauggaguguuggcuacuuggccaugccugcaacuccucucuccccugcauggccucuuggggagcugggugagggggaugaguuuggaaaauaucucaccaaggccaggugugguggcucaugccuauaaucccagcauuuugggaggccgaggcaggcggauuacuugaggccaggaguucgagaccagccugaucaacauggugaaacccugucccuacugaaaauacaaaaauuagccaggcaugguggugugugccuauaauuucagcuacucuggaggcugaggcgggagaaucacuugaaccggggaggcagagguugcagugagccgagaucacgccguugcacuccagccugggcaacagagugagacuccaucucaaaaaaaaagaaaagaaaauaucucacagacacuagugagcaaucacuauguacguuuuuuccugccacuuacccacugugugacuuggcaagucacuuaaccucucugagccccaggcuccuugccgguacaccagagacaacagugugaugcuugggguucagugugcgcagugacuaagaggcccuucgcagaacagaggcccgcgugggcaugugaggagugaggugccagugcccgcuuggauguccgucuaccccaccguuaagcauguugcugcagcugcugcuuuucugcuguagggaccaaagcaucaugaggagcuaacauccuugaaguuggcaaguguugaaguggcugccacuagggauucagauaaagggcagggagaggcaucagggcugggagugcgggugagagggaagcauggagacccgucucaggagcacugagucagcagcacaguggggcgcaguugauccacauaaagccucacauuguuccugcagcagucaggacaguggugaccuuugggauucggcugacagagcacugcucuggggaggggcugggggcaggagcacugcucuggggaggggcugggggcaggagcacugcucugggugagugguugugcuaaugccccaagacaagcagccucuguccaggccuagcccugaggggaugcuggcaucucaucauggggcggccuaggucccugggcacuggccucgggaugugcguggccuggcucuggguggaauccauccacccccguuccugcucgagaagccugggcagagcagccagggugcuuccagcuuugccguggggcuaggaaggcacugcuuccuggcuggcucugcaggcuaaacccccucuccccuccccagcccagcgaagccagccacuucucuagccauaaagcagccccagccaggagcagaggaauaaauauuuagauuggcucagccugggccccagaaucaugcucucuggugugacaggaaggagaccaagauggcagaggacacucccaggagagagcgccagcuguccaggagcaagaggguuggaagaaugggagggggccaaguggcuuguguggcccuagagcgaugaccugcagccugggccaugaccagcacuggacagugguggcuggaagcaggguguggagggaaggggcagucugcugcccuggcccccuuugcuuuccauucuccugcaggcgggccuccccccaaaccccagggcuuucuggggaggggcugaggaagagcgccuggagaguggggccagcuagggaccgugaugggaaggcagggugccagaggagaccgggcaggcuggagcaaggugaugacaugcgguaagagugugugccugcacaugcacgcauguacacguguguguguguguguacacacguuaugagaaguggcaucgggaggaggcgugugaggagaaucgagcaagugaggagggugaugcggggugugcccugacgcugggcaugagauggggaauucacagggggggugggcguggggacugcggagaggggugugaugagacgguggggagccgccucugccggcaacagggagacugagggaggagacaggcccagaugcaccccuguggagggaaugggaauguggaacaggagccacugggagaccuugcgggaaggagacugagacccagcuugucugugaaagaggacggugugcgcgaauggggaagccgugugagccugugcaucaguugagauuaggcucagccgugagcaacauaaacccccaggaacagcggcugaggccguggcaaaacagccuguuucauucuucccaguguuaucugagucuggaagccagucagggcuggugugacagccccgcuauccccugggauccaggggcucccuccccacccucagugcugagcacaggaugucugcccaggggugcucugccgucucucagcgcauucccccagugcagcugaaccagagcagccuucccucuggagacacagguggaucccagucagacagcauggcugggaugggcacagggaggaauugaguaucuggacaagggcuacggaggggagccaggacaagcaugaagaucacuggacucagagucaggaggucuaggcuucuggcccuggcucugccacugugugacucaugaagguuacuucccugcuggaaccucacugggccaugaacuagaugauccccuaaaccuucuagaugccaaaauagcagcuguagcacuaucagccugcaggagcccagcugcaggcaaggccgagaagaaagagugucugcacauuggaggccaguggguugauggaggcccuagagcauucauucguuccuccagcuacuaagcauugagccccagcugugcgacagaccccagggucaccaugugaauaggcuagagucgcugcucuugagccagaggcaggucacagagggcuuggaugacuaacugccugggcagaaggugcuccaugaggacagagaccaucugacuggggcacugagauccaaggcacucucacaaccucaggcagagucugauucagcuccaaaccacaggucccucaugucaccccaggcucaaacccaccagugacuuccagagaggcacaagaggaagccucccacuccucagccugguucagacccugcguccugcuuguguccugaccccuugccagccucaucagcacucacgacccuuccccuccuccccuaguacauucccaccgcuuuucucagagaacucuuccaugcuguuguucauucacccuucauguauuccuuaucagauguuuauugagcaccugcuguguuccagggggcagggaugcacuucaagcaagccacuuuuccuggcucaagaaguugagucuggaaagaaagacaaguaaagaggucagcaaaaacacagugggaguaaacagugggauuugugcucuagaggcagcgacugggauuggccaacucugcagaagggcuggugagggcagcacugggagggcagucagaggagggucguuugugagcugugcccugcacacaaggcacagcugagacagcugagcacagggcaucccggcagaagaaccugcucacagaaaggccuaggggugacacagcaucgcucauucugggaacuacaagcucuccgguucagugcaugggaagugcaacaguugcugugagcagggaccugggaugccaggcucugggguuaggcuuucuggugaggacaaagggagcccuugaagggcauucggccacucgggugauaguagcauggagggaugauugggugggggcacugggagacucaugccuggcugucuucuguaaaugccucauugcuggaaagcccuccauccuuuaacugucaagggccaaugaggagucccucacugugcgaagucuucccucccucaugccacccccagccccaaccuuaaggggacaacgagcacucccucauccacccuuuaccuccauugcacuuggaguaaaccucaauccuaggccuauuguuugcugacuugaguugucagaagucagccuccuccaccauccccuggaaaacaggaaucugugucuuggccaaggccacuccccugcccagguguuugugaaggcccugccccauguccugcuaaucagugcucucccacugauuggcugauuacuugcaagccccagaggagucaccugaccugucuaggccauagguacaucuagaagagaacaaucucaacuccugggucuucaggaguggaguagauuucagguggagcaaggcagacauagagccaggaauugcagccacaagagagaaacugaaaguucagcccacuguguucugaaaccuuucacucauuuauucccugcaacagucccuugagguagauacuaucauuuuauucagcuugccaauguggaaacuaugguacagagagguuaaguaaaucccuucaagguuauguggccagcagaggcaaagccaggaucugaacauggguaacacuggcuccagagccuuuguucuuaaauucugugcuauccuagagccuaccuacuccuuacuuaaaacuacagacgaggacccuagcaaacacuauuuccccaggguacuugccacacccucugcguggcccagauccuggcccuggauguaguaugcuccaguucuuccagguaggcuggagauuccuggaagcuugugggagaaggagccuuauaacaaccucccgucuuggggacccuauccuggguccugagccucaggagccugccugcagucccuguuguaggcucuuccccagcuaagcaucugcuuuagguguuaggccacaugaaguacgucaucccaacagauuccugggcaaggaggaaggcugggagucaggcuuccaucuggccugggcuuagcaucugaggggacuuucacccuucccugugaagguuggaagaagagggggccccagaaccuugccagggagucugaggugcaaggaguggaaagcgggagggacacuggucaggaugauggaguccuguuaccaaauagacccagaaaguagggcugcccacuccuucucagggaucagcaaguggaaugugcuuuucuggggaaauaggacgaaagggccgggcgcaguggcucacaccuguaaucccagcacuuugggaggccaaggcaggcggaucaccugaggucaggaguucgauaccagccugggcaaccuggugaaacccagucuuuacaaaauacaaaaauuagccgggcaugguggcacaugccuguaaucccagcuacuccagaggcugaggccggagaauugcuugagccugggaggcggaaguugcagugagccgagauugcaccacugcacuccagccugggugacggaauaagacucggucuccaaaagaaaaaaaaaaaaacaaccaugcacacaaaggagagaccggagaauuuguaguuuaaaaaguccuggcagaggccgggugcaguggcucacgccuguaaucccaacacuuugggaggccgaggcaggcagaucacaagcuuaggagaucaagaccauccuggccaacauggagaaacccugucucuacuaaaaauacaaaaauuagcugggugugguggcccaugccuguagucccagcuacucaggaggcugaggcaggagaaucgcuugaacccgguagguggagguugcagugagccgagaucgcgccauugcacuccacccuggugacagagugagacucugucucaaaaaacaaaacaaaacaaaaaacaaaaaaagaaguccuggcagggcaggcaggcggguuagaaggguauuccugccuccucuucucuuauuugugucaugcuguuugguaguugcaggaaccacgagccagagccgccacauucgaaggcaggugugcugacuuaaggcaggcugccgccagaugggcaugauggggagcggguccuaaucccaccucugcugcuggccagcucaggcaucaagggcagaccgcacaaccucugugugcccgaguuccagcuucuuuagcugagcaucaaggagaugagacuagcugauccaggaggcaauuauggauucugguuaagagagcucaggcuuugaagucagacugucuggauuaagauccuggcuauguuuccucuuaguccaugacguugaacagguuaccuaauccaagcucgguaacaaucauagcuccuaccgccuguuguaaggauuuuaaaaaggaucauacauccuuuugacccauggaaacaauguuuuuucucuucuaguuacaaauuucaguaacucuuuuuccuauacaaauaggagauacagaggaaauccucucagugagaaauuaucauucccuuccugcacccccugucaguucccauuuugacagcauuuuguuauugucauugaugacauuauuaauauagaagcaggaaaaaagcucaaauagauuucuuucauccucuagucuggucugaaaguucaaauaccuucuuuugccaacgguagucaggugaugucaccaagcaaagagaccccugagcagcccugagacuuccggauauuuccugcaccugcgguauuggagaagaugcugugaauauccagauaggcuucucuccaaagagucagagcugaaaauaccagggaagugguuuuuggauccuuccugggggauccugccagggacauggccuggcucaagcucuagcaggggaagucugguaucaagucucaccuggcaggaauugagcccagaauggaauaugcuacaggcagagcagccucccaucucuccucagccgaccugagugaggggaagaucagauagcccaggcuggcaggacaaggagauugcagcaccaugaccaagaagggauuuccuguugagaggaagcagggguuggcugagcucugaucaccuucuucacaaaucucugggaucauaaggaaccuaauggaaccuuccucaacagcugagccucaguuucccuuucuggaaaaccucccccuauacuuccauaccucaucguuccagagaugauuuacaauaauggcaaguaagagaaacucuguagaguuaaaggacugcagaaauacaugggcauuuaugagaugacaugcacucguuuguugcagaccaccuacgaugcuugcuggucaccuacaagaguaaucccagcuagcgcugaccccaugugagaaucuucagauaacuuacuuaguccucaccacaacccugucacauaacugggaucauccccauuuuacacaucagagaaauuaggggaaagccuggaggacucacuaauacauugcagcuucggggcggagcugugagucccuugccgcauguauuggacuccaagggggccacucagagccuguugcugagacacuucuguucucgcggguguacagcaaguacucagugacugugugguggggggagcuggggcccgggcauuaauagaugauccacagagcugucauucuaagucucagugcagagccauagggguucccagcagagaauggucacugaggucagggugccuccaccacaggaggggccuugacagauguagaccacuucugacugggacccacuaacuucucacugggagcagaguuaaucaagucacagagauggguaagaaggcaaggggccacuucucauguggugagcgguacaggugagcagagcacagggcuccagcagccggauagggaagggggccccagcccacccuacagcucuacucccuccauccugcugcagaccccccauucacacagugagucaguaacaggaaggagcccuuggacugcggcaaugccauuagcgaccccaugggggaaaggggaaguggggagggaaaggaagaggcgaggcauccuagcucccucaggccggaaggcugcaacagcugcagccagccucccacucugcccucaccccgucccggccccaccacuccacucacucaguggucgguggccaggagccuggccaaucagaagcaccaagggcaucuugagaccucuccccagaucuacugaauaagaaugucuaagauuucuagccauuacaacuacaaagaaaaaaaaaaaagaggaacucuggaaucgguacuggaaaaguccagcccuccuccaugaugcccugaucaggugccuguagaggcccugacccacccugaucagggugacguuaagggguucugccgagaggaaucaucagcugggaaaaacucuagugguucacuuugucaguuuuccaggaucuuuggaacaucugggguguguucuuucuuucaagucacggguuuaaacggaaaagauaaaaauuccuagaccagcaggagggaggugucuguugcccggcaguguccaggcauccuguucaggggccaagcugagcacccggugggccagugggaaggucccacacccuccagccguucccauccuccugcccuucuucaggaugugaaggucuuccgggcccugauccugggggagcuggagaaggggcagagucaguuccaggcccucugcuuugucacccagcugcagcacaaugagaucauccccagugaggccauggccaagcuccggcagguaagugccccaccaggccugccuggcccagguccugacccgcagcagacccggcccagaucccaucccgcagacccggcccagauccugaccugcagacccgaccccugcagccagccuagcucuaagcucugauuccccaaccuuagccucccacccagcuccucaucuucacgcuguuccuggacccacugcccuugaccugcccucaucccugguaccccauucacccuagaguccugagccccugauuuugccccaggccaaaccugacccuagagcugcagaucacuaacugaaccccaacucucagauuucucccaucugguuccagcaccuccccgugugugacaggcuaggggcuugggcucugaggucagaucagacaucacaucuccuccgucacucauuaguugggugacauuggacaaguuaccuucaaagccacaauuuucucacugaaacuggguuaugggggaauucagugagcaaacauaugugaaguguucaagacccucaaagcugccggccugcuccugcugucuucuuagacccagggccuugccccagccucaucugaguucccuggccugcccagcagagccugcccugggggccuccucgccccugcgcuuugccugcuuucccaaagggacuugguucccuggauguuggaaaguacgugauuccagaggucauaugcccuggcacagcuugccuggcccacccaccuccaccucccauccacaccucagcauucuccaucaagccccagaggucagcccaguggccagcacauaguuugggaagcauccauucuggauagaggcugaaaaggcucgacuguacucuaggcaucagcuucacugccaguuggagagggguggggcugccacccugcagauggccccagcguucuaaaggcagucagcuugggcucgccugacucuggagggucaggggaagauggacagggagcauucugaagccagguaggagugacuucucucccacacacagaaaaauccccgggcagugcggcaggcggaggagguucggggucuggagcaucugcacauggaugucgcugucaacuucagccagggggcccugcugagcccccaucuccacaacgugugugccgaggccguggaugccaucuacacccgccaggaggauguccgguucuggcuggagcaaggucagcugggagcugggcacugcccgcugcugggcggagggaaggggacagggagacagcacagagcaguggaggagggcaggggcaucauuaguugagucucaucauuagccaagucucaucauuagccuuuccuuuguucaggagacauuuacugaacaccuacagagauguacuggcgcaggaaucagagauguagacacucaguuccugucccccagcaggguagaucugcacagaguuaagugugauagaauaccaugauagcuacaggcguucagggagggacccccaaaccaggcuacaguuggucugggaaggcuuccuggaggaaauggagccugugugauuauucagcgagaagauucagccagaggaaagggcccugcuccaggcagggcacacagacucugcuaggcccuguggagggagauucccagguacuuccccuugucccugcccuuagugaggacacagagauggggccuucugucauggguguggggcacaaggacacccugccccccuccacugacaccucucagauaucagcuucaggcccucccuggugccagcaucucugccccaagauccuuggaagcuccucuccauacugcauggucccugccuuccugaccucugugacuucagcgcugaccccucucuggguaccuuuuccaggaccgcccucagguccccuguguggaggggagagggaaauggcgccauuccaacucugagccccugugccuucugccagccaacugagcacuggugaaaugccugcuccucccagggcaggcccagauuuagaaauacccaaccaagcuguggucuugccccccacacacauacacccucccccauggccugcaccccagacuaugccgcaagcuugacauaaguguccuccagaagcuggccccucccauacagccccugagccuaaucaggccgguaccuuccgucuccuccagcgccccaauaugcacacuuucccauuugauccaagcccuggccacccugaccugaccugccccacugugggugugcuuugcuggcccuucucugccuagcccuacucagaugucacuuuuuuuuuuuugagauaaagucucacuguugucccccaggcuggagugcaauggcacgaucucggcucacugcaaccuccgccacccggguuccagcaauucuccugccucagccuccaggauagcugagauuauaggugcccgccacugugcccagcuaauuuuugugcuuuuaguagaaacaagguuucaccguguuggccaggcuggucucaaacuccuggccucaggugauccaccugccucagacuccuaaagugggauuacaggcaugagccacugugcccggccagaugucaccuuuuuuaagaagccuuccuugacuuccaaccuugucuccccacgccucuaucucagcacacuccgguauggugauuuuuuaaagcauuggguggcaguguggucuaguggaggccuugaaaccuuggccagaucauuaaacucugggucgauguucucaucacuaaaacagggaugacgauacuuagcccauggggugacugauggagguacuguaaguagagcccguagcacacaguugaugccauagaggagggugauuccuauuuaaucuguuucucccacgagcccagcaaggaggagccuaguaaccaggucuuaccucugugucccauggcaagcuuggaaauggaggugucuguaaaugccugugggaugacagaggagaccaaguggggaauggcagcggccucugacuaggggagcuccuucccucccucccucccucccucccugauccuugccucucucccccagguguggacaguucuguguucgaggcucugcccaaggccucagagcaggcggagcugccucgcugcaggcaggugggggaccacgggaagcccugcgucugccgcuauggccugagccuggccugguaccccugcaugcucaaguacugccacagccgcgaccggcccacgcccuacaaguguggcauccgcagcugccagaagagcuacagcuucgacuucuacgugccccagaggcagcugugucucugggaugaggaucccuacccaggcuagggugggagcaaccuggcggguggcugcucugggcccacugcucuucaccagccacuagaggggguggcaacccccaccugaggccuuauuucccucccuccccacuccccuggcccuagagccugggccccucuggccccaucucacaugacugugaaggggguguggcauggcagggggucucaugaaggcacccccauucccacccugugccuuccuugcgggcagagagggagagaagggcuccccagaucuacaccccucccuccugcaucuccccuggaguguucacuugcaagcugccaaaacaugauggccucugguuguucuguugaacuccuugaacguuuagacccuaaaaggagucuauaccuggacacccaccuccccagacacaacucccuuccccaugcacacaucuggaaggagcuggccccucagucccuuccuacuccccaacaaggggcucacuauccccaaagaaggagcuguuggggacccacgacgcagccccuguacuggauuacagcauauucucaucucuggccccgaggcugccuguggggcgaguggagaccucccaucacugagacagaucacagaccacgagugccuuucccggaccuggacguugccuccagagcaggcaccagcucuuucccucucuacacagaaauauuuuuguaagguucuggggcagggagggagcaugaaguacgaggaaaacuugaauuccagauuuuuagugcaaaguauuuaucauuucuaccagaaauaaacguuuuaaguuuuuacuugacuaaugagacccagaguuuggagaaaacuuuuggccaaugcugccaccugaugucagaaaguguccccacacccuagcaguggccuaucuuggaacaagaacuucgaaagcaccuacugugugcucagccauuugaggaaggaaggaggagaaggaagauguuacuagggaaggaugagauaaaacuucugcacccaagacaaugagacagacauagcugcaaccguaguaagccagucagaaauagcca

SEQ ID NO: 15945 - RNA, 2745 nt, Homo sapiens
ucaaauucuaaucucuccaaacccaaagacgggaauauccccaugaaccaagcuuuagagggcacuuuuuuccucuucuccauuuagcaucugcugggaaauggaagggaaccugggaagaacuugcaauaacugggaagaagcagacgaagugccacuccugccugaugaugccagcagcccugcaggguccuccuuuauccacucagccccacaccaagaagaauuucagaaggccagugguggcuccagacacacagcucgggccuggauuuaauuuguuuuggugaaaggacccuggacuaagaacaaggacacgaagaggauggggcagcccugagacagguuucucauccucucucugcugggcaggaccuuccagaggcauccagggcagcucuccacccccaaugccagaugcaguaucaggugcacagagcaccagaauaggaguccagagaccucagcugugggcccagcuccucaguuggugcuaugugaccuuggucaauucacuggaugacugagccuauuuucuuccucugugaaaaugaguguagugaaacgugacugccugccagaaacagaugaggaggggugugaaaaugccuugccaaguccuuuggaaaggugagcuauuagggguacuuaucuuagacgauguuucuggcaaucuuauuuauaaaucuuuucagggcaaaggauccuguagcucccccaguaacagcugcccuugucucauaacuguuugggaaguccuucccaguauccaaccugaauuguuucugaaacaacuuguccugcaugucggaagugaaccugagugugugugagacaguugaauuguucuugguguguugcgugugugcacacacacucugugcacaccccacuguaggagaauguucuuggugaggaagaggaaggucagugugggagauucucacaucugaggccucgaccugcagaacuuugagcagugcaccacugccacugcccaacaagucacaguaaggugggagugcugggagggugucccccuuaccucauaagaagaaagcaaucugagcagcuuugacuguuuuucaaaucaauggguaugaaaauccacccagaacucggguuaugaaaugugucauuuucaugugugaaauuugcacccgcugaccucauauccucccugaaaaugggggacuuucucaccuccuaccucgaauuuaaucugcgucugauaugcuggcagaccucagacccaucugcaucucuuggagcuguuucuuuccacuucggaguaaaugaugguuccaaggagcuaggcugaugggaacaacgcccacaccauguggaugccucucuucucucucgccuuuuuggggccucgucuagcaaacacggaggcuccagcgccacagagauuugcagucugucucugucugcacccacaauucaaucacacaacccugagugggcauaaaagcugauuuucuguccuaaugacucccuuaaccgagcugacagcugccaucccucagggaccugugggugagagugcuggagaccaaugauccccuugcuucucugccccucugcccccugccccaccuccugugugucuuugaggcugaggugccuagaugaccacugugugaaugugcccagagcuggcaagaggagagagugggcuaagagacagaaggugggcugcgugcucccauagggcucucccucuccugccagcuccaucuugaguccauuaaccucgcucugugugugcuguguuaaugggcugggaaggacagaucgccccucucgccugcugacaggagggggcugccacuuguugccaaccucagaggaggcacaaggugcuuggagggcaggaccagagcccaggcaggcccuggcuuauggccuggcuuccccacugccugucagagggaggaagcagcuccccuggggugacaagaugggcagcuggcaagaaaaucccucaugcucacuuuccucuccauugauccucagaucuccuccucagcagcuaaggagacucaauaaugcacacuuccuaagugcaguagaaggaccugugaauaacaaucucuucuauuggauuaacucuuccgcaucugcuguguggauccccuaccucgcugaugugcuuggaaggcagaggaggcugcauggugaggcccugcuggagcacagggagaggccacuuggcagagugcagcaucacagccgugggcgccugagacccaaccccaccagugccuccauggcuguaccauguucccaugcuucaucaugcugucucucagggugggaccaggcauggucuuauucaccgaggcaggauucuaaacuccuguuuagaacccuaugacuggcuggacagggggugggcaccugagccaugggcagccaacucauaggcugaccagaggccugauaaaugacucagugcaggaggcaauucacucaacugcaguuauuugagccaaucaggcucucucucaauggaaacaggaaauaauaaagcagcuggugggaguaagagaagugaacggagacucccugacagcagaugaguccggcugguggcagagucuggaaggaagagccacaaacucuggcugcuguaagaccucagaaagccaugcccugagagcuccacuggauccugaccuccccgccucacccagucucccagcccgagccucaugagggccuccccgugccguagcu

SEQ ID NO: 15946 - RNA, 4173 nt, Homo sapiens
gagggagguauuaguacccuccuugcccagacagagaaacugagguuauucagugauaucaagaagauuguaaagaccagagguccuugccuuucccccgacgaccacauccgcuuagagcacugguucucgagcugggaagaugccaauaacucugaugcuugggucccaccccagacgcucugcuuuaauggauuuggguguggccugggccuagcccugucauagguaagcaccacuaaugcacagccaagguugagagugacugauuuagaugcuauuaggaguguguguguguguguauaaaaguaccuuccagauugacaugggcagagggguaggaaggagaucccagggugggagaagauggugcaggggucaugccaccgugggggugggguuugcuaagaagcuagacaacacacucccacacugucuuugggaugucauuggcauuucugugaccucuaucaugucccagugagucauaggucacaaucugugcagcagaauauugcaucagaugguuaguauccauguuagcaucuuagcacccuucucccuggaaauucauaaagacaguaaguuccaugacgucagagaaucugucuuucuuggucauuguuagccuugggagucugaagugugguggcagcucuggaagugccaguggaauguugaguggaugaagcccaauagcugaagaacuugcuuagcccuguguuacagacagggacacggaucuggagaggggagagucauaaaguaauguuaguaauaaucguuaccauuuacggaguaauucacaugggucaggcacaauaugaggugcuaaaccuuuguuaacucuaaucuuccaacagcccugugcauaggcaucaugagcucccauuuugcagaugagaaaacugaggcucagggaagucaaaauuuugccagguuacauagcaagucagugaucagucuacacugucccaugcugcccuagagcuauagcaagcuggaaacccagaggguucuggcucuccuccuucuucgcacucaggcacgcuggcuaccagaugaguuuacauucucuuuuuuccccucuucaccagcuuuuggaugauuaauaaauuucaaagcaaaucaugcagggaucagcacagacuucucauuucuaucaacagugucuucuccaagaaacaguggagaauggucuucagggaggcagccaccuggacuggaggaauaaagggaaagucuauuaccgagaagaacgugcacuuggccccauggggaugggcugccucugaccucagcguccuuuuucaucucuaauuucugugauucugggauucaacauaaaccucauuccucaugcagcgccccgaguggcaguggaguugaacuuucguuaaagaaugucaagguguuccaucacgcccgcggugauuaggaagaagggugaaacggcugaucucugaguugcugcucucccaguugcaggggcugaagacagauauguagcugggucuugcucgccgucccagccacucacagccagaggccaggucuggcccucucuuggccacacagagcaucggcugaccuggcccaggugccaggggaggagcugaccaucaagcagagggccccugcucucagaaacucuguuuuuugcucccugcuuucucuaggugcccgcuuuuucuuaggcucugacucauuucucauaggucaaagguuaauggauccagauucagagugggauucaaaugaauuucgcagauagggggaaguugauggagcuggauuuagguuggauucagggcuguguggccggaguguggcauuucuguaaucugggaccccaauggggcugacuagucaagcuucuaagcugggccaggaggcggugcugggccugcugacccagcaggagggcuccugacuugaguucaaggcuggucaugacuuuggugacccuggggaaaugacucagccccucugauccucaguuuaauuacccauaaaguggacgccauaauaauaaccaccucaucuaauuaacaugggaaccaccuagcacuaggugugugacagcauuuugccaagugaaaaauacuacacaaauguuaguuuggcuuugugcuuuuaaaaugccucccugauuaagaaaaaaaaaauuccuucuccuaaagccugaggcaaacacauuccccacgcaggguuccuucuacuuuugccaugaccuucguccacuguguguucaggcaguguggggcaccagagaggcuguggcugaaguucucagaucgucacauccugugaccuugagucaugcccuuuauccugguagacgagacaggagccaucugagaagcucugaaagaaaggaggauccacagcagggagcuauggggucccaaccccugcuuagcccaugacccaguccagcagagguccuagcucaaagguuagcacccugccggcugcagguccaggacagaaggccgucuccagcaagguaauuccuggaccuugugcaucucuucgaguacaucucacucaugaaguuauaccugggccauugccuuuugaggggccccaacaggucugaauggauccugaugggcaaguggccaagggcaucugaguagagggggggggauucagcugacuugagaaacuugcucucuuugcucuauuccuaggugccagcuacauacugguaccaggcugggcucuugggugaaaggaugcccuggaccuuaggcccaauccugggcccuccuggcuggguuuccacccauaaguggccuccuucguggcagcuccugagaaacacuggaagaggugcaaguguggugugaaacgcugagcuaugaaugacuccagaggcugcaauuagcugguucucagcugcuguauuuuuagacacaaauauugucaccagacgcuuugcagccaccgagaagccuacuccucucaggaggccccucuucuuuggcaggcaggaacuuccucuucucagguagagcugggauuccagaacuaccugggccuuggagcaggugcucccucuuuagcacugaaaaacucaagggaggcugaggaggggcauggagcugggaaccuggguacuggcuggcaugucuggcccucccacagccucacuuggugacuggagauuccugaagcccagaaacagcgcagaugagcuccuuucuccuugugccuuuaugccuaucaugugagugaaccgagaaagggcacgccuagagggggaauucuaggugguguguucaucucuuaggcacagagugauauuucaugaggcagagaagcagaagaaucuuugaugauccauugacucuauugccuaacuuugcagaugggaaaauucaggcugagagagcacuggcuugucuaaaguuuugcagcuagucauggaggaaccaggaaacagacucagggccuugugugaagggccuguuuuccuggcacucuggaucauuccagcgggggaauagaguggcccuguagucaugccaggcucagggcauucuggagcuucuucaggucuagagagauguccagcuucauagagauuuaugcaaguguucugguuuucgacugcugcauaaucucucugcccccgacccccuccaaacaaaugaauaaacaccaaguggcuuaaagcaacaauuuacuauuaucuuccauagcucuguguguugacuaggcucagcugugugguuuucauugggguccucauacaguuacagucacagaagcuggaugggacaggacauccaugaugguuucuuugcucaugggucuggugccucaguuaggguggcaggaauaacuggggacuagcugggcuucucccucagucuaugcagcuucuccacauagcuagcugggcauccuaacaacacggcggucucagggcaguuaugcuccuuacaugcugguuggcuucccccagagugagcccuccacgaggucuagaaagacuguccaaggcugcuuguaacucagcuucaaaagucacacagcaucacuuccaccaccauccaauggccaaaagcaaauuauggggcuagcucagauucauggaaagggcagcacacaagggcaugguuacuggauggcauuuuuggagauggcuacugcaauuaaaaa

SEQ ID NO: 15947 - RNA, 20778 nt, Homo sapiens
cuccccaguccaaugauccacuguguugaagugcugccaggaugguuaacagacaccagccucucccuugugggccauggugucccagcgaucugcauggcuuuuggggcugagcucugagaggugauaggaaggcccaaguuccaucuugaaccaucuaacucuccagaaagaagggaaauuguucuaugccuugugucuggucagaaggcccucaguauacuucugugaaucaugacgucccaaauccuaaagaauucugguugugaguagaggcggcacuccugauuagggaugggagcacuuaaaacucaacggugauacugagaagaggguuucauccaggauccgcauagaccggagagcuuaggucaugaagaugggaagggacggaguggagcuucuguguggagcaugccuuauguagaaagaugaaagggaaaagggcuuugagaaaggaagauacucaaccucccacccacacuuuccucccuuugaugaugcucuuauauccagggauggguguuauggucaggauaauuaucaggauggacuacuugucuagaggaaccagauuuuucuugcaaguuaugugaaaaccaagaaauagaagguauuguuagggaagagcagaguuccuggaucagcccaaccccagcagaaaaagcucaugguugaugccugccugggaguggggagguaaggcucgggcuguggagcugugggucuugacucuuuggucucagaccuuuucgggaucugaugagcgcugugucccugaaaacugcacauacgcacaaggacaguguuugcauggcaaccugcugaagcccagcuggggccuugaguuaggaaucccugcugaagaaggagugcuuugggaaggaggcagcccugagcccagacucccugugaucugggcuaaugacugaugcuaaugacauggagaaccccaaaugaggaaaguccaacccagacccuucuauaauaugaagugaaaagaacaaguauuauccauagacugcauuauaauucuguaaaaauauacacuuauaaagagaaaaaugugaaggugacauggagaaaugaaaauaauuugugggugaagaguuuuuauuuuauuuaaaauuuacuuuaauaucauuaugaggcuacuuuaauaauagauuuaauuuuauuucucuauuauguaaagugcuuuuccugaagaaaugagcuuucaaauuauauuugauuuagguuaauauuaaugcccuguacauccugaguacauguuuccagaaagaggugauccaggaggcugccaaguggccugcaggugacauccagagggcagaaaaugcccaugcagguaacugaauucugaggaacaugagaccacaugcuaccaaggaggcagccaagggagaggaugcuguguucuggaguuagguuugaguccuggaccugccauuuacuaaccgugaaaccuggaguuuaccuggggcugaggagggggugguucccaggacacgggacuuucagugcuaaaauugggaagguccuaggcaaagugggacaaguuggucacccuauuaauaagcuauuaauaccucugucagccucagucuccucacuuguaagaugacacugacgacucccaggaucuuuguaaaggcauuuuguaugccaucuucauaccuguuggggaugaugauuaucauugguggggugggauggaggaagagaguggggaaaggggugcuucuccccagccuugagaucugagagaccaagagccugucuggauggguaucaugauuuguauauggagagcuuaagacaacuggucucucacaacuggcuuuuaacaauaauucguucaagaaauguguauggaccaccuacaaucagaucugugcuaggcauuuggauauuccgugaauggcugcaacaugcugucuuccuuccugggaccaaagucuaaugggggaggcaaggauccauaaggaaguggacagcagggaaagcuagggacuucaggaaugucaggugugcagggacccuucccuagucuagggggucaggaagggucagggcauguuccugcagagaugaguagagcucccuugagggaugaggacuggcuggccagggaugucauguuguagagaaaucaggcacaggagaagacagcaagaaggcccagaggcugggugcuccgaaggacugagaguaguucauucagucuggcuggugcggugcaagaggugaguguuagagaggggccuggggagucacgugcccaugucaugagggccuuugugcugcauuauggaguuuggacuucauccugagggucacagggagccgugcaugguagggcuguagcccagcaagcguguuuuauaccuggccacucagcagccccaacccguauugugcucagauggcauuccugguccaggcucugguuugccuguuaggcccagguccucugggcucugucugucuugcucuaaggcucugagccuagcccaucuguggagcacuucugcagcuccaaaccugguguagucaaucuggacauuccccuggcaggggucugcugccuggcacagacugugacuccagagagcagaguggcacucccucccaagcaugcugcugucaccacagugugucuguguggguuugauggcugcguggcaauggcgcucagggcaugccgggggcucacacagcccaggcagcugaugauuaacaaacaauuauacuaaucggccuaggaacaggaaggcaggugugcaccccuaugcaugugaaugcacacacaugcaugcgcacacacauucagauucacugacauuuaugcccauccuuucauugaaacucaggcgagcacauggagagauucccugcuaccuggaugagaugaauaggcauuguauuaguuuacaugccauuaccuucaucagagacaugcccuuucaccacugacacauggaugucacaaaugcuguauacacagccucacauagaugcccgcacaccuacacuggcccagaccccuucucaugccuuuacaaacacauuacaagaauuaaaaaggagcauccauaucaagugucuagcacaaugccuggcccauaggaccauuauauucuauuuuaauaugcuauuauuauauuaagacacuuuaauaugugcacauguacugauacacucauagaugcacacacauugccccauacauucuuuuaaacccaggugcacacacaagagcucgacucuuccgcaaacugacacauacacuuccguguacacaaacaagcucacucucaaagacgugcagguugccauaauguguuuucccauuugcaccuacacacaaucaccaccgcaauaauaauaauagcaaaaccaggguggaugauugcuucauauuuuucaaagggcuuucaggccuguaaucucauuugauccucgcagcagcccugugagacggguggguggagcaggcauuauuaccccagguuuaugguugaagaaacagaagcuagaggggugaaguucgccaucugggaggcggccugaaacucagaucugacuucuugguagugagcuucccaugccuauuugacaacuuccagcccucacuacagaaagcagcagccagggcaggggccugcuagauucuugauuccuggucaaaacauuucccugagucaaccccagcugagaagugggaauuggaggcugauaaagggaaaccgccaucauuagaaaucccauaaauucucauuuacaacucccugccagaugaaaggagcaauugacugcguuggagggaaaagcaaauaccgauuuccuuuaggacugcccagccucagacagcugguccuggaagguccugaggguggggggauccuguuccaucagggcuguccucaacucugugcacuuucucuccccucugucuagguccacguguggguccuuaagccccuugaggaaaagggaggagaaaaggacaaagaaggcucucccuuucccuuggauccccuucuacucccacaugccuagugggagccucccucuucugcuugagccuucaggacagguucaggacccugucuccuaccuggcugggccagaaaugaggaacauguugcaagccuuccuccaccugacuugccaaguccauacaggcuggggccuuagauccaacaacuuagaaagguaaugagggcagcuuccuucaaagggccauguucaguggggagguugccugaugaugaauggagaaguggagugauggccccuuaaucuacuucugaugcugcugcuucacucugguuucaucauuauuuuguggcuuaguuucucuaucugcaaaaugggaauaguaacaccaaacuuauagugcuacugugagguguguaaaguccacggcacaaugccugguacaaugcugggccccacagggucaggcccuguugccugccugggcagcuucuggaggaaugccucggcugccagggcuggaggggugguguggcaagagaugccuccccagccuccugggugugccagcucuggcugggagggaggggcagggaggggacaucuguuugacacucuuaucagcauccauuaccugguguguauuuucccaggagcugauuacauuacagcauguguugauaaacauuuggagucggaguacagaggaaacugagcagaauguuaagcggguggugcuuuggucaggagaugcagagaaagggcuggcugugaugagcugggaguggugaugagggccccaaucuggaggcuucuucaccugcccagccccuuucucuuucugaucucccuccacccuacugcucuggcccuagcagggcauccagacgugguccuagaggcaggcuguuauagcagaagagguaugggacuugggccugaggcgguuaugggguccagucccagcucugucauaaacuggcucuuggcacucugggccagucucuuacuucccugggccucaauguccugcucuguaaaguaggcuuaacauccgcuccacaggguggaccgaagauuaaaggaguaaccaugcaccaugccccgcacauagaauuaagcgcuuugucuccaggcucuuuuccugugguccccaguuuacccccgaaaaauggucagucuugccuugacugugccucagauguuagacuacugcuuuuauuucaauuuugaacuaagaggaagugauuuauguucuucauaaggcaaacaccccuacuuccaacccuaguuagggcuggagcagguaacccagggcgaggguugacucuucuccccuuuuucuacaccugugcacgugcaagacagcuguagcuagggaauuauuuguguaguuaucugccugaugucuuucccccacuaguccauaaacucccugaggacaggucacaauugagugucugaaguccagcccagggccuggcacuggcgggaaugaaugacucucccccaucugauuggucuggcgcagaauggucaagauaacccaucucgggguucugugcugucgaauuccacgguuguuucugaacuuagcgcaccggguauaccucucgcuuggccuuugccauagaugaccuuggauucacuuuuccugugggguaucucucuagucucucugagguuugggcauuuagaccuucaagagaaggaugugcaccugucccucuguccgacuguccaauuuagugggcauggacaaaugcacgaaugaaugagacugcgggaaugcugcccccaccuccucuccgccuccccaccucgccuccagguacccugggcgccugggacccugcggggccuccuggaggcgggacgggcacggcgccaccuagcggucgugggccgcggagagagcgucccuguccuuccccgugugggaccugcaaccgccccauagcgcagaguccgggaggcuccagccaccgccucugucggccccauucucuagguccacagaggguagagacacucgggggaacguacuuuuacugggguacggggagcccugccccacggcugucagcucgggucgggcgcgccgggugcccaggaggcagccucccacccucccccgcacacgucguuccagucccuccgccacaaagagaccauugauugggaagagcggccggguugugguaggaaggcugguggggacacgcacgcacacacacgcgcgcacacagaggcauacacacacacagaggcacacacgcacacacagaggcacacgcacacacaggcacacacacacagaggcacacacaggcacacacacacagaggcacacacacacacagaggcacacacaggcauacacacacagaggcauacaggcacacacacccagaggcacacacaugcgcacacacagaggugcacacacccagaagcacaagcacacauauacagaggcacacacacacagaggcacacacacgcacagaggcacacacagaggcgcacacacacacacagaggcacacacaggcacacgcgcacacacacacagaggcacacacacaugcacacgcgcacacacacacagaggcacacacaggcacacgcgcacacacagguacacacagagguacacgcacacauauacagaggcacgcgcacacgcacaugcacacacagaggcacacacagguacaccccgccuccugccgcgccugacacuccgcagggcccgggggugggugggcaggggugcgagggggcguggggcugggcgcgccggccuggggggaaagccccgccucccggaugucgucucuucgcccccuacuagcucuugucuccuccccaaccccucgccccacccccugccuaauuuuugccaguggaucaucggccuuuggaugaauccgcagcaaauggcucauucggggcgggcccgccuccccauccccccagugugcggucuccucuccccagcaaagauguucgguggcacuuacggccccuuuuuaacaccaggcgaagccaauauuguuaggaaggaagaacugcuguggcagcugcugcaaagacaaaucauaugcaguaaugcaucacgggcugagggagggucugagugugcggcagggcagcgcgggcuuaucagcgcggaauggcuaaugggggcgcggcucccagcggaaggagggcuggaaacugugcgcggugcggcgaggagaggagaaggccagggcaggagaguuuaggcagcaaggauuuucgcaaucucucuucuuauccuaccccuaaaaggaagcugcuuggaccugaagguggagcugaauuugagccuuugcuggagguggggugcccggcccuucuacaaacgccugcuugauucccuccgugaugggcaaaggccuucccucccacaacaccugaauucugggcacccugaucuuuggaggccaggacuuuccuagguucccuaucaguccacgcacaucagaaguagaacgaacacccuacuaucuaacccguuccuggcuccugcccccagcccugccucguagcuggccuguggugggugggguguggcuggcaguugguacccguuaaaagagagcuaggagugauaucuacuugguaccucccucaaagcucccgcucgccaccuggaugccuguaugcacacaggaauuggcugggggccggggagagcaugggugggggugcugguuugcuugguuuauaacacuucuucuugcuccucaaugccagggcagagagugugccccuguacaugcauccuuauuugugggcaaggcuccguccaugcaggugccuggagauguggguuuacucacacauucccaggcucucaggguuggaagggacuuuggaagaggccuucccccuccucccucaccuguucugccauauccaugccaaaugcucaucuggauucugcuugaucacucccagugacuggaagcucacuucuuccccaggcagcccaucucugcugacugcuggaauacugagcuggaaacugugccagcaaccuggacaauuccccacccccuaucccaucugcaugaaaacgggaccaggacaagaugccaaaaacacagcacccuaagauaguuacagcucaugcuuacagaauaccuccuuagccaggcacuguacuaagugcuuuacguaucuugacucucauaaucuucaugaaacucuaugaggucauguuuguuguuauccccauuguguugaaaagaaaaccgaggcacagagaaguuaagacacuugucugaagucccacagcgaggagguggcaacgccuguuauacaaucaggaagccuggcucugccugaguuuaaucaccacauuauauugcaggcacugccgagagagagagagagagagagagagagagagcgagagagagagagagagagagagagagagagagagagagagagagagagagagagagagagagagagagagagagagagagagagagagagagagagagagagagagaaagacacagagagagcaaguaagaaugcucaggcaugaguguguaucuucaccaccauuucugggaagcagagcucacugguguuagaggcaacugggaagacuggauaugaaauuaagacaucaggaauugccuuucuucuuccuccuccccaccuuuuccuuccccucccauccccuuucuucuucaucaccacugcccucaccuucaucugaauuaaaagccaucuucucagcacuaguguguucagggguuccuugcaagcuggaaacuccaucugggugcuuccaggccaagcagauacauuggccuagacagacauacgggccauacucacaaugaaguagcaugagauuaaugugguugguagauggguaauaaauagggaagaucuguauuuacauuccacaccagccaaggguuaggugguacacgguucagaaaguuuuauguucaauuuuaugucuagacagagcuugagaugagguuaucauuucucuucuaauuagugcaagaaggcuuccccaggcgcugcuuucauggguucugcugucuuggcuuugccauuuguucccaagagugagacauagguggaguggggagagggaaugagcacuggauugggagucauuauaccuggaucuucaaccuugacugugccaccagcuugccaugauaccauggauaaauuagcccacucuccugggucuccauggcugggcugucuaucaaggcccuucagugggugcacucccugagucugucaaacggggcugcugugugcagguggcuagguugugcacugugcagggacaccuggccaagaaagaguugggggcugaaauccagccuaugcuuuucucaucaggccugcauccaccuggagaaagaggcaucuuuucuaauuugcacaaaguuaucacagggacuagcagugguccuaugauuagaguuggaguugagguggagaugggaaggggaguuucuuuagcagaaagugagauugugaguucggggauggaggauaagggcuauggagggaggaucagggagaagugcugugguuggugaacguggagguggggcagagagcagugggaaugugucaagggagguugguggugagaagggcggguucaugcugacaguggccccuuuagcugcguucaggguaccccugggaguggugguucuccugccccccagccuugcucacuccugugguguaagcaguggccucuuuggaguggcuccuucugccaaguuccccucuugggagaaauggcaagggguuagguuuucuccagggcccucucugagaggcugcaggcucuguaguggguguugccuuacuaccgugggccuacuagagaggcauggacccugcccucagggaacuugccaucgaagggagcuuuugugcacaggucuaaugccaguggcccuugucuccuggggcagggucuguggguauugcagacagucugguuucuguguugggcucagucuggucugaggcgaaggcucuuacccuaggaccaaggacuaugaggagucacaaaacugggccucgcuggcccuucagagguagaagaucuguuggggacagauuucugaggacccccaguagccagggaggaugugggagccacugaggaggaaaacucgggacgaaaggcuucugcaaggaugaaggggaggugggcaggcuggagguucugugggagcaaagccucccuuucccuuggucgggggguggcagagugaggggacuguaggagugggcauugggaggggcuugcucugugugggggacccacaacccaucaaggacuggaccucuggagaccguuuugucugccuggccccacugccagcccgccgcuguucagaagcagcccuucccauucucuuggaucuucugaggaaucccacguuccuucugucugacucgaaguccuuccuacuguaggccuugcucauccccccauaguccagcuggcacaacguuuggauggcaaaccauuuaaauggccaagccugccccggccacucugucuccuugguagucccaguugugugaggaugggguagggugcaauuaagcccuggggcuguccucucugcacugacagcuguaggaaugucaucaugccuaugccagguacucccacugcuuucuuccagggugcccacacuccuguucuuuagaagaaagggacggcaggagucugaucaucuguccgaugcccacacaguggcugugcugagugacguguuguuuugaggaugucccuacccccuggucuugccgucggucuccaguacccagcgaagcaagcugugggcucugaggagcucacaccagggaggagcugcccuggaguggagcaacagcauguccucuccccugugugacugcagugcuauaauaauaauaacagaaagcuggcauuucuugagcucuuacugugugccagagacaccgcucuaagugcuuacacauauguauucguuuucuguaguugcuguaacaaauuaucacaaacuuuaaacauugaacuuauggcauaaagcaacacaaauguauuaucguguagcucugugguagguuaggagucugacacaagucucacugggcuaacaauccagauguuggggccaggcgcgguggcucacgccuguaaucccagcacuuugagaggccaaggguggggggggggggggguggaucacaaggucaggaguucgagaccagccuggccaacaucgugaaaccccaucucuacuaaaaauacaaaacauuagccgggugugguggugggcaccuguaauuccagcuacuugggaggcugaggcaggagaaucgcuugaacgcaggaggggaggcggagguugcagugagccaagauugugccauugcacuccggccugggcgacaagagugaaacucugucucaaaaacaaaaacaaacaaacaaagauccagauguuggaagggcuguguuccuuucaggaggcuccaggggugauuucacuuccuugccuuuucugauuucuggaggccaccaucuuccuugguuugugacuccccuccccacuccauuuucaaagccagcaaauaaugcaucucucucucagaugcuucuucuguuaucaccugucucucuaacccagccaggauggggucuuuguuuuaaggacucauaugauuaggucggggauaccuagagcauccaggauccucucuccauaucaagggucauucucuaaacacauccacaaagucccuuagccacgcagggcaacguauucacaggucccagggauuagggugcugacagcuuugagguccauuauucugccuaccacaacauacuugaaguuuuucacacaaaagauggauguaagguggguaauguuauuacccccauuuuaaagauaaagacacugaggcaccgagaagcuaagcaacuugcccaaguuuacuuugacagcagcauauucaggauucagauagaggcagccugacuccacaguuguaccucagucacugucacaaggaaauguccaaauuucacaugguauaaggccaaguccccuguaggucagcggagcaguggaggaucauguauuuauugagcaccuacuaugugccaggcccuaggaggggcucccagagguacaugacagagcuccaaccugaacccaggucccaagcgcaucaucuguccucauucuauuauugugugaaaggccgcgggacccuccugcaaaggugaaacgggagaaaggacggagcuucagugggggcuuguggcccaggguucuggauugggcccaggaagaggaggagagaggugggugcccuauaccuugcaggacccagccgggccaagucagagccugcaggggcugacucaacaggcugacugugccugcccguccaucacaauggggaaugggcccuccaugagccugagaccugcaaaucauagaaauuaagagcaauuagagagggaaccggcagccccuggcagcacuuccggccacagaggcaguucggcaacuuuaugggauguuuccucccauuuugugguccagcugggaggcagaaacaagccagcucagcacaaggccuccucaaggugcuuuagugcaacuugaaggugggacccacagccccuccacaaccugccucccgcccugccuucccauccuggggcccugucccagccucgcccugaggguuucuuuuugucugugcaucggcucuguccucugcacuagaccucuggagagcugugucuggggaccugcaagagaaagagaaacagucagggucaccuugacgggcuguggcacgugcugccuccgcuccuguguucucucccucugcucuaccucaccuggcccagcuggaggggucuuuccacuuccuggccaggggcagcucuugaacaaaccuuccucuuauuccccuugcccccuagggaagagguggcucagcuuguggaaagcaugcaggccaaagugguggagaccccauggguuucagguggcggcaccaggauggugccauuggcuaaaggcaaaagcuagaggaauucucuaguuucccaaguacuuugcugccuuuaauccuugccucuugccuguguccuucaccccaugcccuuuccuaagcuguggugagaaggacagagaagggccugugcuccugggagagggacuggcucugagaagggcagaggugucucuggaguagguggaggugggagaggaagugggguaucugggacaaggaagagucguggucuguauccuucucuggguggaagcuaugauauugcaagggcacccuuugccccccucuggggcccguuuuuuuaggauaggcccacugugcugggucaaggucaccuggagagagagacccgaguggaggggcuccucugcugcucuccaccacccuuccugaggccucugagcuggccaugagcugacccuucuccuucaccucuuccaucacuguggguggggcagccuuggacucggccauaccugacuccacagccgaggggugucucuugaugggggcaauagggcugggugaagaagagauacggagugggacaaggcagugcccugcccucacuagugugggcaaacugaagggggagggaagggcagacuccaagggcaaccuagaccccugcauccuuggagacagaugggucagagaggcagccuguggagcagcaggcgccaccaggggugcaggguugcaggguugcuccaccacagccucaagucugucccguccucccccugggccucugacugagggcugcuaaggccguucccagcgccaccauucucugacucuccucauggugacucugccuuaugccccaucuaacuggccuugggcagguggcuuagccucuccgugccucaguuuccucaccuguaaaaugagaauaacaauagcaucuaccucauagguuuauuaugaggauuaaaugauuuaaauauauaaaguuuauaggcugauaccugucauguagaaagugcuauagaaggauugucuauuauuauagucacucauguuauuucaaagaucauaaucaagcagaccuggguuggagugcuagcuguucuacuuaaaagcucugugaccuugggaaaguggcuuaucuuuucugagucuguuuccucaccuguaaaauagguauaauaauaauaaucacaacagugacugcaugaaguuguggugauagaaugagacaccuggaaacauuugcugagcaaacaguaaagcaccucggacaauccauugcuucaucuuccuggcuugggaucagauugaggacagucucuacggaagguaguaggacuccugagggggagcugggaccuucaagguggccaaauuuugccaggaaaucccacaggaagagugccuguucuugacuggacaaugugaggacucgaagcaggaauccugguucuguucccaggccaccuugggacccagaaguggggugguggcagguggcagguagcauguuaggaacguuggugcugccugggcuucucacacugagggugugagcagacacaugcuguggccaggccugugaagggcacaggcugggcuuuguccccacugggugccugcugacgcugauggcacccucaggauagucagacauggcagggacaugcgucacccccaagagcuccucucugaccugcaaaucucaguuagugcccuacagguccucagggcgcugcguccuuggucuuuguagcucucgucacguuauauacggacauuuuuacaggauuagugaaaguuugucucucccaugaaacuguaagcuccaugagagcagaggcugcaucuggauggcucauuaugggaucuggagccuggaaccgacccugacauaugugcucaauaauuucuugaugaccgaguaugugacaauagcagcuagcacaagcuuaguuuuuauuacaugucagccauuauucuaagcacuggacauacacauauacaccucgcaauacuccugugaggcagcuauugauaguugcuauuuuacagaugaggaaacugagcuacagagagguuaaguaaauugcccaaggcaacacagccauuaguugguggagcugggauucaagccagacaguuuggcuccagaguccaugcuuuuagcuguugugcucuacuaccuccuuagaggaaugaaggaaugaaugaaacacuuuauuuauuuauuuauuuugagauggagucucacucugucacccaggcuggagugcaguggugcaaucucggcuuacugcaacuuccaccuccugaguuuaagugauccuccugccucagccuccugaguaaccgggauuacaggugcaugccaccacaccuggcuaauuuuuguauuuuuaguagagccaggguuucaucauguuggccaggcuggucuugaacuccugaccucaagugauccacccgccucagccucccaaagugcugggauuacaggcgugagccacugcacccagcccacauuacauauuuauaauguaugccgcuuuugacaaaugaguuuuggggaggagugaauggugcagcuccucugcauuagaucacauggugcugaugagcaggacaccccuggcuccugaucaucugcacagggaaaggaagcccaugaagagcccuuuggagaaagccuccuucccauucccgucuccuccccagucaggugcugaggaguaugggcugacugugcccucagauaugucuaacuugggggugguucuuggcucccucuuuuuggaauuaaggaagugcaaggagaccgggcaugagcacaccaaccccugaauucccuuccugaccucugccuccucccaggccuccugugucccuggaggcgcugcugauggggcagggguuucuuggucacugcgggaggagacugaggaggugagucuacucaucuggucccugauuccugucauaucggcccccagcggugccugcuuccugccugcuuccuucucugcaucccccuccacauuucucuuccuagcugcuugauuccuggaccuucaggauuucaagaagaugccgcuaccugggaagccccugggacuuuuuaacagaaacuuacccgauuggagcaugacuuaaagagaccagaaagggaaguaccuacuuuaugguuggcacaaugccaggggcuucacauucguuaacucauuagcucauuugauccucacaagaacccuauucuucuucuucauuaacagaagaaaugggggcuugagaaggccuaagcaacuugcucaaggucgugugguauaagaggcagaggugaacuuugauaucaggauuguaggacucaaggucuguacuggauccgcuguuuggagacagaaacaggugaggugggguuggggucuaggguuggagcuguaccaacugggaugccauccauuguccccaaagcagagauuauuguccuagggcugggacugucauauucuggugacauuaacuccuggggaggaagaaggaaacucccuagcagaggggcaggguggcaagccugggaggcaagggcaggagaggaccuggguaguagcuggggguaggggggcuguuagaaaagaucccaggaaagggacaguggggaagccuggccccagaagugugggagcaugcuuuuggggguguccaguccugugggcuguugaaugcaagggugcccauggucuucuugcccuccagauuacuggggcaugcacccacacugcacacaugcacagacaugcuccguuguccucugucauagccugucaucacagacaaaaacaggccugcaccgggcucacucuuacagcccuucaccgccuggugcuccccuuggcucuucuguucccagccuuauccacauccagucucuguguguguguguguguguguguauuuguguguguguguguguaugugugugcgugugugucucuucuuccuaagccugcauaauuuucuacugucuguuggccucucuuagguuugcacaaacacauguacauagucugauaacucuguugugugucacacacacacgcccaggcauacacaugcacacacaacccucagucugucccucccucugcuucuuagcugcuuaucuucuggucuuucacuccaauccaugcacagcucuggggccuggagaaccccacugaucuuuaaagggucugggcuauuucuucuucuguuucuuuccccacugccuagugcccucugccuuccugugagcucugacuguugagggggcucuaccaggccugcuacugaccucucagucuguguagccuuuuggguccccuucccagccuccaugcaggcucucccagcuggguacagagcugggcaggcccccuccuggaaguggcagccguaggagcagcuggccagggaauggcuacguggguggggacaagcagggcuggaaagggauuaguuugccuuggauucuuuucugugaaaauuuuuguccauuugccaugauccauugauuucagcugaugucauucugguacgugggagaggcuuugacauccaucuagaucagggggccagagccugcacccaggagucagaaacccugguucuugcuccagaggaaccucaguuucuucaucagauguaucaguuuggaauuaaaggucuuuaguuuaaauuuugagcaucuaggagacuucuacuuuauuuagagucuagcugcacccugaucauuccaaucaaaaucucccucucugugacuuauuuguuuauacagaccacagaugugcagacaugcggacacacacaugcacaugcagaugcagcuuuagcuacucuggguuuuccaggaacuuccccaacucaggugggaccucgccuccuucucaggaugggggcugccugcagugugugcucacuccacuacacucuauggcacaucucuggauugaaaugugccuacugaugacagugaccuaggacaaugacccaccucuccauccguccccacacccccuccccuaagauuaaagacccgaauccugagucuugcucuugcugcacccccuucuuggcugugagaaagaaaagggaaguaggaacagcccaggagggguguggagugaucaugggacccugaaaugucagcgcucgaagggaccacccugacuccuagccuagucagcagguuuccaaacauuucacuucauguguggaacgucggcucugaccaugcuuaccuggacaugcaaacaaacaaaacugauuaaagccaaaaugccugcguuaaggugggugggagcucugcccagcacccucacccccaugaccacuucugcaugccccugagugagcaagcauccugcagcccuuuuuaacucugacaaaugaggcuuaaaauccagccagccagcccacugguuccuggugugguccccgagaccagaagcaucagcaucaccugaagacaucuucaaaaugcagauucuuagguuuugccgagucaauaaucuggggguaggcccagugacucauguucaagaggcucucuggguuacucagacgcacaccccaguuugagaacuguuggucuaguacaacccccuugccuuacagaugaggaguugaagcccagagagaggugugccuuacccaaggucacagaaaguacgucacugucagguuaugacucugggccagacugccuaucuguggaugucuuuguggugaagccauggauuuuuucacuuguccuuccccuuagcuggcguaaauacucagggaucagggauccagaagccagagguaagagagccugggaaaugcacaaaacaggacagggaacagcaggcaguggaucugggagccacagcagaugaucagcacgcuuguucaaccuuucacucccucacucauucauuacauuucuggagcacccaggugcuggggagaaaaugacaagaauucugggucccguccucgccaagcuuaaagcccagcacugcccauccccuuggccaggggcacucgcucacuucaucuguggguaagggggagaccuuuucccucagggaggcuaugccgaguggugaccagcgagggaccccugggccuggacacaugggaagggauguggagaaaagccagguugagggcagagacccaggguguggcuggucaucauuuguguguuaugucugggaggucuccuuggaagaggcagauuccaggagaggacacaacuuugggaagcagagguggguugagcacaggccagcaugagggaggaggggugagcuucacguagaggagaagccuucagaggggaccgggcugaggugaggcuggcgugagguggggcgagcaggaauggaggcacccagcucaccggcccugcuaccaguuccccagaagccuggggacuucugugaauuagggagcguuuaacaucucccacugauuagccgcugccugcuacgguuaagcggggagaggggagagggcagauuggagcccagcagcuuugaaaggcaaugcugcuccuugacaaagccggccuggggagguuucaaaggcaacuucugagcagcccgcacguuuuauguucacuagauccucgcuucccaggcuccaaagacaaacagugggauuuaaggguuuuuuucucuuuuuggagacauuguguuccgagcugggcuuucagcugaggaggaggcagagccggcugggcuccuugcuccaccacauccacagccugagcacagcccagcuccaucuucucuguacacugggagcuucccaggggcccccggaagcuuugcagcagcccuugcccccaggcuaggugagagggugccccuggccaacagggaugggcagugagggauacaguccaggaacugcuggccuuaagcuuggugaggacaggacccagaauucuuguuuguuaucauguccccagcaccugggugcucaauaaauguugaccgaacagaugagggagcgaaaggaugaaugagugggccgaucacuugccgguggcuccagaucugucuccuguucccugcccugccugguguugcugggagcugcauuucccaggcucccuuaccuucuggcuucuagauugguucagccaaucagaggaggcacuggaagaagguggaucgugggaggaggggaaaagccaggauauauuucuucccucugucuguuucaggccaugucccugcaguaucugugucuccucuggcuucugcugaucagcccuguccugcugugcagcucccuguggggggccugugguggcuccaguuucugucugauggccucagcaucgaggcuccuagagacguugccuccuuccagccccaggaaggggacaacuuccugcuguugcuaaucuggguugcucuaccucuucuguuaccuguacaaccaaaucccucguuuaaaucccucugcuugaaaggccuagagugguuucuguuuucccaguggacucaguggaaugaagagugaacacacugcuugcucccuucagaaagaagauuguguaugagcggccaggccugaguggguuugaucugccugggccugugaaucuuauagaugugugcagcc

SEQ ID NO: 15948 - RNA, 68205 nt, Homo sapiens
agagcgagagcagcgagcgcggcuccacauuguugcggaucgccggcacccggcagagcggcggcggcugggacgcgcggcgccuccgacccguucuccucgcgcccggccgcgcagccagagccacccgggccgccgaccgccgagccccgcgcccgccgccugggccccgagccuucugcgccgcccgggugcgucccgccacccucggaggacggccggccauggacgccugcaaguuggagccgagcgggagggugugagcgggccggggccaggagcccgcgccgcgcaaccgggcagccgggcgcgccgggggugggucccucuccccagccccgcucugcguggaagaagagggcggggaccggcgccgggaggagagcggaggaggcgaaggggcaugacucgugcaacuugcggcgggcaucugccgagccucugagccggcggcggcccggggcccggacugcggccgcgcggaucccacccagcccaccccgccccggccgacggcugcagcugaccuggauccuucgagcgcccgccgaccgccagcgaucuucccucaucuuccgggcugguuucugcugcgcgaggagcgcugcccucgccgccccucucgccggacccccggcccccgauggcucggauggggcuugcgggcgccgcuggacgcugguggggacucgcucucggcuugaccgcauucuuccucccagguaagagcgcucaccucugcuguccccacccccauccaaugccuccccggggcugggagccggauggcgggcacgacuggauuguggggagugaaaggagccagaaaaguugggucacggcuuggguaaagggggugggagguggcacggcggagaaagagguugagaagccgaaccgccugcccugcagggaagcagucagaugcacgucucuauguagcaugaaagcacuuucuccgcucaguucuuuacaaaaaauaauaauauguaauagcguucuguuuauuuaauaaccagcucucugcucgggaagcaguuuggaaacacugcguguuacauaaaugcaaaauaaucaccguaaucaccgucuuggggugggagacaacagccccagggggagggcgucagucucggagcugcggguuuggaguauggcgggggggcuucgucucuuucggcggccccuuugccagacggcucaggacgcucgggcccccucccgccccacaccgccccacagcgggcgcggagagucggcugcugcggcagaggcggcuccucgcucaccugcgguuccuuuccuggagggugaggccggggcagccuccucccggccuggcgcgggaccgggcucccccucggaacucugcucccagcucugggggcucucccuggaggagacaccgcgggcuuccugccauccaaguagcugcaugacccacuuucccgagggugccccgcguguccuuccucgaggugcgggcugccggcagccgagggguuaaccucgcgcccgaccccgggguggcccugguggcccauucugacgggugggguggggacggaggcugggaccagcccaggcauauugugcuggggaaugaacuggaaaaugcguuuaggaggcaaauccgaccgaguccccucgccuggauuuaacccuuugugucccuggggaagcugccgagcucgccggcugacuggacaccaagcgugggucaagggguguggggaguuccuccagcucucuggguagaaaccagagacgaccugcagcucuagcaagaugggauuuuggggaggggggcggaucuugacuggagcacgugguccccgccuugggguggcagaauagggggucaguguacagagaccaucuccucguggggcaggaauauuagaucccgaguuccugcaaugugcuuugccgcagaauggccaggcaguuuguuaucgagggaacagucuggcugccuaguuccggggcuagggugcacuccuggaaggcagaagccuggccucauucccuucuaugccucuucugcugccagccagcucacuacgagggccccgccaaucucacuaagugguggaugucugggaagcaguuugugaaagccaguacuggggugccuccacccgugaagccuggggugcugcccugcucgaugugggggguggggaaaauccagggcucacaggugucacugcccacccugcccccagaggguggucuuggugagagugagaggucuucucacacuggauggccugggaagccagccagagauacagaaguucgggcucuaggacuugccuggccauggggauuugagcuuccaggaacccuucaauuacauauguccacauccggaacccagagaaacgagagcuucccagagcucugguugguccagcacacuagggguuaacguaauccugggauggacaaaggguggugggaaggguugggagaaggggaaggaacucacccuauucuccuuccuuuuguuauucucuuuccccagcuuugugauuccuucaugguuaauuccuucauugggggcuagaggccugcugugcuccacccacucaggaagugggagcagggaggugaacucaccuggcucaagguggauacaaccccugccaaaaaucuacaugaaagggugggaugcagagaaaggaaccaggguugagagagguacuuaauaaaugcucuuccauugacuguaauugacugauggguagcauccaugcaccgaaguucccggaccgcccagcuccucugcccaguggcugggcuccuggugccuucucugcuugcuugcucuaggguccacgggugcagggaggcagguggauaugguugugcccagucugacacuuggauggaggcugguuggcccagaaguugcaagcccacacccuacuuugcaucaccugcuggcuuccuccccauugcccgcuauagcgucucucuagggacuugccagucugaugcucuuuucaggguuuuccugggcugugacagggaaccugggucuggggguuugaggagaggaagagggaggggccuggagugugugugauugcccccaacuucaaaacacucccaaucuggcuauugaaguguaaacacagaaguauguuuucaacaacacagacuuuacuaagcaguguggugaagccccaaaggccucuguuuccugagaugacaauccacaguuucuuccuguuaacuuagaggagagggucaguggggcagguggguuacaucccaaaaagagauagggggagcccuaggaggaggcagaggaccugcuugagaagcaggugugucgagcuguugucccaccuacaccacacccucccuaauuggcuuccccacaccuuuugucuggaaagagaacacacaccccaggugucaugcacacccucggaagaccugucgggucacagcacaccccucucugcagccucucucugcagcuugugcagagcuugcugccauguggucuuugaaauuccaagugucggggcuauuggguuauuuuccuuccucucucucuauuucucacauacagugguguccuucagcuugcugggcaaggcauuauggcaaaaccaauucugcuggccugggguuugcagcauguguaaaugggaaucuccuuacccauuuauaaggcagcacuguggagugccuuggaauuggauucuaggccuccguagucaaggcuggaggggaagaggagauacugcagagcuugggcccaguugcccuggcugaguggcccggaaggcaucucuugaaccugaacuucagagcauaugggacagguagcccuuguugccugaggcuugcugaggcuaagaguguuauugguucccuucucagccacucaccuuuguacaaugaauccaccuuggcuacuguuugacccccggacucugcuguauguuuucaggaugguugagccggccagaacccuagugcugaugacugagcaaguggaccaggcuuggggggcagagggucaguuccaguugcugucuaugauacugccauuguuuagcagcugacuaauguucauuguucagcacaaacagaaaauacccaagggaggugugaauguaucuucaauuuuuccgauuguaucucuuccugguuaaccuggugaauugaaugccuccuaccucagagagggacagacagagaggugucagcauauucaccuguuuugcugauuuaaaaaaaacaaaaaacaaaaaaacuuuaaacauuagccagugugccaggcuaaaauggucaugagccagcuguggaacuuaagcugugacauuucugacagucugcauagggucucaccuuuaguauaaagugugugugugcacacagguauacagggcuuugguguuuguguuggugaucuaccauucacugugugugugugcaucuauggggacuaggaguagaagguguaugugcuugugucugugggucacuaugggacuagggccauaaauauauaacaucgaauguauauucacauauaacugacugcuuagaguuuucugacuaggaccugugagugguccagacuugagaaugccuauuuuaugugucagagugucggugagggugacuuugggagggcacccaggauuugcccuugguuagcucuucuaggacacacuaccggguccuuuggggggugggaagccucuaugaugcuuccuuuuucuguucugcccuuggcuuuagacugggccucugccugcucgcagggagaugcugaagaccuugaccacaccgggagagauauuccucucuugucagccuucuguugucucccuggcaggcauagcagcacuggaaccuggcauuaccuggggccuggccugccccacgaguucucaugauccaugaacggcugggaggggcaaagggaggcaguuuuucagcuccuaauuuggcaucuuugcuuccuacauggguauuuaagaaaaagaaucaugguguguguggggaggggagguagcauacucugggcaauuaaaaagggugugagcaugagcuuugguccuccaugagggcccugcagagcugugugugcccagguggacaacauacgugugccuggaagcauccuggguucacgcagcagaaagcaggagcccccuuauuggaaaaagaagugggaauaagggacaaggaguggggaagagggugguccugggagcccagcacccugugcccaagcccaacuagaaaacguuuccccaugaugcccaccgcuguccacagagaccaggucugcagagccagcagcagaugugcuggcuggggcaggagguaacuuaagaucugagcacggaucaccuugcagagggaaugcccugagcuggagauaacacccuuuaguccaguuaacucuuuaagcucuggauucucucgugcuguugggggcuaggagauggagaaagggaagagauaugagaaaacacauggaacauaauaucuguaccucaccccauuccacaaggagagaugaacucaguguaacaggagagacccgagauggacacaaagacagacuuucugacagcagauuguagaaucuucagggcaauagauuaucccagguuugcccugggugggggcuggggaggcaauagguauguauucucaggcgggggcagcuagugggaggucugccuuucacagccucccaggagagagcagagcagcaguggucccaggcccugguggagggagagcagcagacagcucaguuccucucccuacaaccugaugaucacuccaucuuggcagcccagcauaaugagauugcaaauuggggcccacuggccuggguuggaaucccaccucuaccaauuacuagcugagugaccuuggucaagucacuuuacaggccucaguuuucccuuuuuuuuuuuuuuuuuuuuuuuuugagacagagucucgcucucccccaggcuggagugcaguggcaagaucucagcucacugcaaccucugccuccuggguucaagcgauucuucugccucagccucccgaguagcugggacuacaggcaggugccaccacaccuggcuaauuuuuuuuguauuuuuaguagagacgggguuucacccuguuagccaggauggucucagucuccugaucucaugauccgcucaccucagccucccaaaguuuucguaucuuuaaaauagguuuuuguuaauacagaugcccaaagagguuugugaagaugagauugagaauguuguaugaaaagugcguagcacauugccaggcaugugaacacaugcagugaagugaacuucuauccccuaugccuucccucucaaugguccuggccccucugagucugcuacucguguucccuugagaaagagccacucagcugccugcgcacugcugaccucacuucccguguccccagccaggugcuacuugggaagcgagucccugcccccacucgggagccuggcugccuguggguaaugcacagguucagcugaggugguugagggcuaccuaggcagcaggugcuggguggccuuuguucugccgccugucacugagggcucucccggcaccugccucgcucccuggcuguggcccagcuggggcaccauugcccaucuggaggcuagccguggccauagagagggccugggacucagccccugccuucuuucacuuccacauuugaggggaagauggaccacagcaccaucccuccaggacuccacucaccccgugagaugauaucagccagauggguagagaaucccugcuggggucaccuccuucucacuggcagaaagucccuucagccuccuguuacagacugaauccuuuugcaaauugucauaauacugucuguggcacucuauagccacaguuucagcugagccucucaggagccccaugugaauggcauuaguguuguauuaguuccauuuuagagaugaggagaguaagaccuagguuuaguaauuugcugaccgucuuaugcucuuguggccaaauuagacacugggucuucugacugcaaauccaguaaaccagaaggaugaaaagaucgggaauggacagacggaagaggaugaaccaggccaguaggauguuagaaaguguccaugggacgguccuccacuuuaccagccaccaccagcucacacgccuccuacagcagggcagagccuggcagcucccuggggaagugaguaauaaguugaggauauagguuggaggguggcccagccagagcugaccacagagcccagguugguguagaauagaggaugccuaacaauggaacguuccugggggccagggaagcaguguccuggagcaucugucucuggguaucugggcugagacaugggcagggccccugaggugugagcacggagcccuggggcacaggcaggcacagugccagggugugggccuggcccggagcagagagcagguguggacuagacagagcagcagacaggcacgggggcuggcccucuccuggacuaucccccacccacucuggucagcacagaccccaauuucauucucaguuuaugaggagucucauuaccaaaccacagacaauaaaacccuccuggccacucuggccuggaucucauuagaggacauuaguuccacuggcugguggcuccacagggacacagcuucgggaguugggacacagcugcgggcguggcccaggcagcaaaacaggccaguggccuugggcaccagaaugucccacugggagucugaguucaagcuaugggcuuaaauggagucccuccccacaaaguccuggaauucuugcuucccaaagcuggaaauguguguccugcccacccacuuggaugcucaguucugcccccugccugaagaggaggacacagcucccuccagggcuguucuggggagccggccuucuccgggaggagcuggguggaagcucagcaaaucaucauuccauggaggaaggcccuuggggacaggggacagaacagccucccacacucaguacaucuggaugugcucugagauauacgcccuagcaccagagauggacucuggaguccucgcaacagccuuggccugaaucuuggccugucuuucugucugaaaagcaaauguagggaguuggggacccuagagaggaagcauuuccccucaccuauagauggaguuucaccgauggcugaaagagccagccacuacggagagccagcagguagccuuggcaggggcuuccuagucccaccccuccccagcucgcguuccuuguccucagucauugugcuggggccuuggauuccaucuugugguucuucccaccaaagacaggaggauuucuuucuuagcagauucuggugccugcugaccggcagccuucucucugccuguaccuuccccucugcuuugcgucccuccccugcaagccugcauaccugcuggucaucagaacgccgccauggcuugaaggagguguccaugaaaaacaagacaggagccaaggcaagcgugucccuucucgaugccucaggcuugugaaggaaaaugagcaccacgcccaaauaacuggcuuuuagcacacacaggcucacgcggggugcucccauggggggccacacgggucagcccacgcuuucgcaggugccugccaaaugagucaguggagaugggagcgccaaucugcuggggcagaugugagucugcccugcuguggaggaagggggacugaaggauugcgugggcucguggagugccccugugagggccugccagcagcuggucugggguacaugccccgggcaggacuggggaggcagcugcugugacuguucucugugccccaugcaccuucucccucaguccccgcgucuuguggacaaaugcugucaggugcuaggacaagggcaguggaggaggugccucugguccuagccagcucugccaccacgucaugugggucccacugcaggggaggaugguggcacauccucagucugcugcuccagucugcccacacugcuccuugggugaauccaccuaaagcacaucugagggggcacagcaccacccuaacuggucccccacugcccucccccgcacaccaugcuuuccaugcccagcgcuuuccugccuccgugccuuugcacaugcuguucccccauucccgcuuauuucccauaaauaugaaaucugaauacugaagucaagagccacuucuauugugaagcuuucaugacccgcuccccccgcaagcuaaggauaacuucucucaucucaaaucccccagcgccucauccaugccacccccugccaacaauuacucuccauccugcuauccagucacuugggccugggauuuaucuucaucacaagacugagagcuccauugcugaugaggcuugguuucuccagggccuggcauaggggaccaguaggccaugcuggguggauagacaguugcuuguuugaaacauugaugaggauaauaauaacacacuuguauggagaaucccuggaugccaggcacuguuguaaacaucuuacauguaaucacuuaguuaaucuucauaacaacucauauggaagguacuucuguucuccccaguuuuauauauggaaaaaugaggcccagauagagcuuagguaacuugcccagggucacgcagcuaguaaguggcagagccaggauucugauuccagaagucaggccccauguccguguuuauaccauguggcugagcugccucucuuccuggcggguggcagacaggugauggaggaagaccauuuccuaagccuggaguccucacaagacuuugcuuccagaaucucuucccaccccugcauagcaccuucuuauucacauuccugucccuucaguggugcagcgauaaccugguguuguaguuguccaugccugaugcauuuggggaguuauuagugcugaaucuucagagagucuuggcgcagguugaacaucccuaauccaaaauccgaagcuuuuggaggccgacaugacgccacaaguggaaaauuccacacuuauccuccugaagggucgcaauccaaaggcagucaaaacauuauuucauccacagaauuauuaaagccacuguauaaaauuaccuucagccuauguguauaagguguauaugaaauagaaaugaaauuucauguuuagacuugggucccauccccaagauaacauuucauguauacagauauuacaaaaucugaacaaauuugaagucugaaacacuuugggucucaagcauuagggauaagggauauucaaccuguauuacugguauauccugccacagacacuguugugucuugggaguauucauguggcugugccagaguggaaugucuugaaguuaucacuauugcaucuccugagucuuugggcaucacugauaccauuugggcccccucacacacaccaugucucacggugagaccagaggcagguauaguagcuccucggagagaaucugccuggucccccagcgcguguucccaggccagccccagauccuggguggauccagggcucagcaagcugauccuaugccagagccuguucuaaacuucuggaagguuucaggcccucuugcccucacccagagaucccaaaagauggcaagggagggccccuacuagggaguguggauggggaaaaggauuuaggguguucuccugggccggcugcuuugaucuccugggaugaaagggcuggugcuuccucugccccaggcaggaucaggacagcaagcuggggagagaggcauugauccuggguccaggcguccucagcuucauaggcgagggcagagaacuaucccagggaagaagaucacgggggcagaaaaaucaaagcccuuccccaggguuguggcugaggacugggaguugacuucagacagucccugugcagauuguccucucgagggucacccagggugaugcuccucccagcacacccugacccugcaggucaccaugcaggcucaggccucacagacucucuugcuuaauuaggaagguaauucggcugcaaaacagucaucugaucugugucgacgccaaagcgaaauuccuccuagacccuccgcuguucuagauuauccaugcuccguuagcuugaauuaccgcgcggccucuguggcccagacacaagccagagcuaugugaucagcuccuggggcuggaucugcccugcaccuaggaagugcuuggaagcaacaggaggaaggagggcauaggaccugccugacucccauccaagccggagcauugcccagccagcacgaagggaccagcauugcccagagccccccuacccccgggccugcaggugccugccgggcucccaagcuuagccacuuuuaugucccucuccucugcccucugggaccgggccccuuugaggguuuugaaucaguggcagaggcuuucugcagcaacuccuaggcauaaauuggagcggaggcagggacaggcaucucccugaguguaaauaacacuguaaauaacacuggagcggagcagccacacugcacuggauuauuuuaucgugauugcccaccucccccacccccugaacugucccaaucucauuggccuagauugcugcaucucucagaaugauggaggggcugccucucccuucccgggcaggguggccagcccugccguugaggcacccuccuacccagcaacuucccagauuuauucccugucuuuauggugccuggagagucaucaguguccugggccggcagagcacucugauggucuccacuggcgugauggauaggccuuugggggaacgugugcgacagcccccugcucccggccugccucugcccugaccacagcaccguuccccacccucccaggggucagaugaugggccucguggccaguccugaaggggcggugaugauggaagagggagagagcaucaguccucggcgcccaccucucagugcugcugcagagucuuucuggccuccuccccaagcucugcucacaaacacccuucccaggaaauauccccauuacccucucucaucucccaucacuccauuacugcuagccccucggcacuuguguacacaguuugcgcuguaaugauaaucugugcugguuuauguguuucuuuacaaguguuuuuauguccucuguguguguaugaggaagguuuauggugugugugcguguaugaggucacgugcugugugugugugcgugcgugcgugcgcgcgcgugugcacgcgccugcuucugauuagacucugaucgccaucuucucccacacacagguagggggcccucaccccccuccugggguugggggcacagccuggcuacuaaggguggguggagaaggagggggagccaaucaaagaugaugacuguccgggcaaggucuacacugccccccagccgccaguuagagaaccggcgaaggucagucuuagaucauuguuuugucuacagggucacaaacaacuaguuugacuauuuuuccccaagaaauugacugaacccagugguuauuuuggagucaaaugaucucagucuuuuaugacuuaccugugucagcggguguaucugugucuucucuaaacaaguuccccuagcuguacaaugggaugagaugauaagaggcuggaaggggcgaauaacauauguggugugcuuagcacaagcaauaauuugcuugauccagggaaagccuucgcaccgcuggacuguugugagcuaccacugggagggacucccagucuggagaaggaggguccguucccuggggcuggggaagccaggcccaggaacccuccuggcugugugugccccagaacgcuguggggagccccucugcugggcuccugugacuucuccaggguggucaaugcaagcagaguaugucuuagucucaggccccugggcuacuggagauccgcccccccaacccagaugaucaccugggcaggugccuccugugcucccuucugaaaggaaagcaaggguuucacucaaggugcagaauucuggcugccccaagcgcccagugccagucccuguaggaaucccacugcccuggauguguugugggagaggcagacagguucauccuggcauucacucgacaugugccaggcacagaggugggagcuguagacagcaacaaacauaauauccaguccagcacugcauggcauccacgcucugaccucugaccucacacacagcaggugaucccugagggugucagcucuuucaagcaggaaugcuagucggguugaggccuggguggaugguggagagauggagcuagggccuugugggucaggccucagucucuuuaagccauccuguuuggacgugaagggacagugacacuaggcaggggccugcauucuccuucauucugccaagauguguuaaacaccugagcccacugggcacaguggcucauaccuauaguccuagcacuuugggaggccgaggcggguagauaaccugaggucaggaguucgagaccagccuggccaacauggugaaacccugucucuacuaaaaauacaaaaauuagccaggcaugguuaugggcaccuguaaucccagcuacucaggaggcugaggcaggagaaucacuugaacccaggaggcggagguugcacugagccgagaucacaccauugcaccccagccugggcaacaagagugaaacuccaucuuaaaaaaaaauaaaaauaaaaaacuaaccugagcccacuuguuccucucccagacccaggucuggaaagagccucccagcugggccugcagcugaagguaccucccugcccugcaggggaagguggagaggaugucagagaauccuggagucuuagcauuggaagggaaaucaaaugcuguagcaccccauucacuuccuaaaaccccuaaccacauucuggccuguuggucauccuccagcugcagcugaaucccuccacugacaggguacucaccacccuccauggaagccaggacagcccugacugcccccagcucccccuucccccugaagcucccucccauuaguguuggaaucgcauggagcucaugugauccugcaggcauuuacagacagccucggcccccgucucaccucuccugagucucacacaccucaccaucucaggugcuccccucagauccccaguaacagcuccauaugugggcugccacgcccagggaugucagccuaggauucccagccaccacagcugucccagaucuaggaggaggcagugugggugggcccuccaagcuuccccaccucccucuaucccuuucccacccccacccccuucccaccccuguuuuccuuaggauuaaugauaaauuucagugaaagauccgcuuaucuccaguaggaauuaaggaauuaaguuggcgauggggagagaggggacagggagagggagcauacugcagagggucaggaugcagagggaccgugggcaggacaggacagggcaggggacagcggggauguggagcauuccccucugccugcaucaguucacccugcggugggcugggcugugcuccccaccugccugcaccgccaugggggauggauguggggcugcuuggggauggguguggugacucguggaaggagguacaucacagggauccugcagguggggugaccuggcagccucccgugucaccuguugcugcuucgugccauggugcaguggcucuguggcaugucauggcccugggagggcgagccacagcaugugucagggugaggcaccccgcuuuuggcauugggauacagaggcacauucugcaguuggaaguccaggggccaccaccccacagguggcucaugagugccauccaggcucuaacacaacccccaggcaggcccuggcugccccucaauaggggcccacccagaggcugccgcuccugccucuuugcuucuuuggugggacugacugaguugggguuccugcagcaauggcugaaagaaucucuuaccccuggagaaucugagcuucgauguacccucagagcaacucagaagccucuguccugaauaccaaggggggggccacucagggucugcagcaucccuugcccccaaagcccaggagacucuguuuagaguuucuccccaaguccccaggcuugcugcuccuuggcaccccccuggcaucagacaucucacuggcaagcaacgccgggcccaggacuguagccccaaacagugccuccccucgccgaacucugaggcuaacccaggagagauaggagcugcccuccagagggcggggggugaggaggugagaagugaagacugggugggccagaggacaugacugccccucaggucauccaggccaagcuuccugccccaaauaaguuucaaucacugcggucccauucuuuccugucacccccaaggcugagaguagcgguugguguucaguagcagccaccagagcaccuggagauaagaggagauaagggcaaggcugggcagagacagucacagucugggguaaggguggggagggggcaggggaaggggggagacggggcacguugggggagcucaacacucuggaagcuaggggaggccaggaauuggggccucaaguccaggagucaaacugguuaauaauuagugacucugguuaauaaaucauggaugguuuuuucuuccuaauuucagcuucuccuuccaccccacaacccuagagauccuucuaggcucugcccaggccucagaaaagaagcccccacaccuaccccugcccugggcugucaccucccaggcaagauucacccucugucccuccacagcccuccauaggccucugcccccucccccagcugguuucuggucuccaaagccagugugguacuuaaucuccaagagagauuagugaccugcuuucaccacccucccccacaggcugcuuggaugccccuaaauauucccugcuggaagggcaggcccccauggccacccagagagcgucuccaggugcccuccuugacggugccacccgccccacccauugacucacuuggcugcagguccuuucugcuggccagaaggugucauggagcaccuguggguaacugcccaaaugcuuuaggugaggucagucagcagauguucuuugggcaucuacuaugugccaggcacuaugugucaagaaaaaaaauacuuuaagcaacuggaauugagguuaaaggcugaugcacgugagcggggaccugaagaccaggagacuccaggacuggcaguuuagggugaggagaaaaggggaugcugggcauuuuucaucucuaacuccgggaugcuuccguuaaaggucaggcuguuuucuggguuucugucccuuuugcaagauugcgccaagggcagagaucugcuuuuguaagccuugugguggcuggggaaagggagggaggaagaaaaggggaaaggaguugccuccuuccccuuuuuuuuugaagauuuugaaguuucccucuuuuugaaggguugaggcaaaagaaugaggggucccucucccguccuaagccuugcacgugcuggggcugagaguacaguagugauggaugaacuggccucaaaacaggugaggccccugucucccaagugaucuuugcacaaagcccccagagauuuacuuaggugauuaaacuaugcccggggcuaugguggagacucgggggccugaacugggggaggggaggggaggcuucucugggaccgugaccuugauucugaaaccuggaggcugagaaggagugggcugggacgugaccaggacagccaagggagacccagccacgagcaugccuggaagaaaaccagcgccuccgcagccuguggacugggacuugaaaagaacaacccccaaaucuguucucucugauuucagccugaccugugcgcaguccaagcccaacuuguccagagccacccuuguccucuucuucccaagacacagcccucccugagcucuucccauuucugugaugaaagcccaguucugcugugcaccggagcccuggcucccuccuucaccccugccucugauuugcugugaguucuuaucccauuucugcaggaccccuccccaauccuagcaccaccacacccauccagccauuccugugcagggugacaauaaaaaguguccucagacauugccgaauauucccuggaggacaagagcaccccaguugagaaaacacuggucuaggccuucacugcaaccagccucuuuuuccaaaacugcuuuuccacugacugcucuacacucccacaacuuuacacggaccuauuuuagguuccagucaaaauaaacugcuccuggcuucuccagugcacuccucggccuuggcuccugaugauggcugagccccaacacacccaccugugaaaugcgaggcucccagacaccagccccccuuccccuucuguguuguuuaguauuuacuuucucuccuccccucacccagcaccugagcucuuugaaggauaggacccagccuuaaaaucucugcaggcccuagcucagcaccuugcacacaguaggugucccauaaauguacaguaaaccgaugggagcuggcuggcuucacaacccugauaagcugugagguuuccuucuccaugccuuuuuuuuuuuuuugaaacagagucucacucuguugcccaggcuggagugcgguggcacgaucucagcucacugcaaucucugccuccuggguucaaaugauucuccugccucagccucccaaguagcugggauuacaggcacccaccaccacgccuggcuaauuuuuguauuuuuaauagagauaggguuucaccauguuagucaggcuggucucgaacuccugaccucagguaauccaccugccuuggccucccaaagugcugggauuacaggcaugagccaccgugcccagccagccucccgugccccuuucuuucuguuuuugguuuuuuuuuuuuuuuggcaacccuauuuaacccccaugccaagaaaggaaaacuucugaugcuuuccuuuuacuugacaccuccccucccaucucauuuuguuugcaguaaacaaaaucaucuuuuuuccauuugcucaauauuuaucagcaccaggaaggucugcgguuaugugugugugaaguugugcguggaugugugguuugacaggcgggcgcugugugauggcacgguucuuugugugggguguuaguguuugagucagaaauuauacucuccacaccaggacuuguauggggucuucucucccaugaacuccucuacacuucaaacuccucucacacugggcuuaucccauaagcucugaccuuucaguccaccaugccuuugcuguuccugucuccucugccuggaggacccuacuucaccagcuggcaaacuccuacucauccuucaaagcccagugaaauuuuaccuccugugggacaccucuuguuucucuaauucuccuccccacauucaucauuucuuccuguaucaucauggcacuuugugaacaguccuaccguagcagugaucaugucagugaauuuauccuguguccuugauauccuucacaugcauacacacgcaugcagggcuguguguguguguguguuuauagcccuacuggcaggcacuugguagguucuuaauacuuguuuauuaaauaaaugagaauaaauugcuugcuugguuuuccaaagcauuuucuuuguacgguguuagaggaaugugucugugcaaugacucugccugaccuucccgcacugcucccgcguguuccugagcaugucgaccugugugcauaccgcagcguucagcugcacaugugugcuugggugcgcgugugugcgugcauguggcucuguuucagcgcuucuguaaauggaaagcuguggcugccccuccccaagcugacauucccucagcaccacgcccccaccuuugaggacugaaggggugacuggguggugacuucccccaggcagcuuucucuacccaccugaugucccccuccaagaacggugacccaggguuucccguccauccugggggcugagcucucugcggccucgucacaucacacucccuucccuauccaucucugcccuguuuaauuggaauuuggcuaguggagaccaucuguucuauuccggccuguuuccaugacaaccaaguggcuugagacugagguuuguggugagagaaguggccugggggaugcugggaaaaaccagcuagguccucccccucaaacccgcuccgccucguccugcccucucuccacaaacccggaguuaaaauaaagcuguucccugccugagaguuggggaguccccgagcaucacucuccucucccagcccccagcccccagccccagucuuucccaggcuccuuucaggcuucccacacggggcuccccucccucccugcuuccauucaagagcaccuucugcccuuacagacuagggagcuagcccuucccuuccccaaccccugaaccuccaccccuggaagugagugcuuccucacagccugguuacagacgcucagggccccacagaaaggacucuuuagaggguagucucggcuuccucugcgccccugccccugcaggcucucccccggccccagguagcagaguggcccaggcaagugcguggcagacagaggcgcccugggcccggauguggagcuggugaucccagauucucaggggcugagacaggcccugguacacuggggauaugagugagggggucucuuauuucugaacagacaguucuguuuucacgguguuauuuucugcccuaauuuccccaucuauggcaaagccucuucgugccuguucuauuaccaagggacccgccugucuucaaaaauaggugguguggcuugucaggugaccgucugucgcucuggucccaggcaucucaugcaggauaugugcgauauguuggcuaugugggcgggcgugggggguagagugucucaggaucucuccggugcccccucccccagcaaaaucaguccugggcagaaucaguccugggcaguccugaggagggaagcugagucuuggacuucagaagaccggugcucuuagcagcugcgcugagccgugggaccccagggcccccacgcuugggggugcugcaggcuugcagaggucuucugguagccugcuugucuccagccuagcccugccaucauccauccuucuucaugugccucuuuucuucuuuugucuuuguugagauauaauucgcaaaccacaaaauucgcccuccugaaguauacgagucaguggcuuuaguauauucacaauaggccgucaccacugccuaauccacagcauuuucaucaccucggaaagaaccucgguauucauuagcagucacuccccauuuucccucccccggccccugacaaccacucaucuacuuucugugucuauggaucugccuauccuggacauuucguauaaauggaaucauacaguauguggccuuuugugacugacaucuucuacuuagcauuccaugugccucuuuccaaagcacagaugugaccaugucaccacuuugcuuaaaaggcgucaguggcucccaguugccuacaaggugaaguucagacccucaucuaauacaaagcccuuuuacaacuggcuccuaccuugcuuuccauucacccuguauuccccucuccucugccccacauauccagugcuuucgccacauccaagcuuuuaaagacacucuuuccucuuuuccucuuccccuccuguucccuucccucucucugucugucucugucucugucucuaucucugucugucucaaggacuccugcuuauccugcaggacccagcuaaaaaaucucacaucuucuguggcgccuccgucaccuucagacagaaucacucccccuucugagcucccauugcuuuggguuuguauuuuucagaaacaaacaaaaacugcguuuaucacucagucauuauuuguuuucaugucuggggccccugcuagacagagcuuuuaagguaaaagaaaaugucuuagucuuucuuauuccuccacgcuccuuccucuugccacuaccacugucacuuucacccaaaaggugccagcaccaugcuugacacauuguauagguguaguaaugcuuugugaauuaaagcagggguagaagagugucgaggugauggauagcccagcccugauuugauauuuugauaccugccuacaauguauaauuaucaaaucagggcuggaagcucauguacccccaaaauauguacaacuaugauauaucaauuaaaaauccaaaaaaauaaaagcaaggggaagaaccagagacaguacauuagucugagagaggcaacccuauagaggaaccuggaggaaggagaggauucugcaacuuggcauagcagggacaaggugggguaugacuggaccuaggaacugccuacaugggcaguuggaguggggagacgguggggagguguuguucacccuguucgacagccuuguggagugucaugguggucacuagcaugagagaugggguggaagguuuggcagggaugggaggggaauggggaacggccauaaaagagaagguggaggugaccuuuagcaagaaaaggggagugguggguacaggguagggugaucccagcagacagaaccgcuugugcaaaggccccaaggcaagugagagccagugccuaaaagacccaggaguggagcccagugugggguggggagagaggucaguggugagguugggcugguggagugagcagcagccuggucacacagagagcuuuaggacaaggcgagggugguggcccuuacaccugugucugaugaaaaccucccuguccuucaagggucacuuaaggaugaaacggccuuucccuguccacccaagccagcaggggcaguagugggccuacuucccuugccagauggaagcuaccagaaggcaaaugauagauucuaaccccucuccuuccucacccagcuccagggggagggagaauugagggacaggggcagauuuggguucccugccacauacuagcuuugugcccuuggaugcccuacaccaacacucugguccucaguuucuuccgugaauacugacccacugaggacaaaagugggauaaugauauaaacccagagggaguucacgaggauuaaauaagaguauauacaaaugcuccgaaaaggcuguuccagcauuuauucuccugugugcuguuaggacaaggugacaaggaaggaagcagaggcccagggucuccaguuugaaggaaucaccaaggccccugcccucuuuugugcuguugucuuugaugacauuuccaagcgauuagaagcccuggugggggcaauaucaugccguuuauuugaaaucgacuugaaagcaaucaauacuauauuuucuagggggaaacacaaauuuagcuuccacccuuacuccaagggugcaaugcgugcagagagaagauacaguggugccuggcuagaaggucccucccucuuccuaggcaaccagcaguucucagagcaaaggaaaauggguccuuccuggcgcuggggggugaguuggggugggcccaaagcuuucuccacugggagucacaggagccacuggcccuccccacugugggauccaguucccaaggagggugccaaacagaccuucugccccuacaaaaacaaaccugucuaauugccuuuaaucuugggcugucgguccgcugguguuggugcugaauaguaaaaggagaucauaucuuucccuuugagugagaaguuauuugaucucugugugucagaggaaagccugugcccagggaagagguggggacggaaggggaagguggaagaagagaggagcgagggccuggcuggcggccgaggggaggcugcagcugagggcuuuauuucucccaauaacaaucauaaauaaaggggaacaagcaucucucuugucuuggcucaaggccauuguuuugugcagggcuucuucuucaccccugccccgccccuccccgccucccucucaggcccaggaugggaagacagcuugucugcagggagaaggagugggcugccagcugucucaccuggaggggugggagaggagggcuccguagaccuugaugcagccccugccccgccucuggccuuggggcucccuccccagcucugcaggggccgccaagaugccccagaugauugcagucgccuccaccagucucccggccugcgcucccuccuguucauucucagcaguugucaguggucuuguugaaacaaagccgggucacagaucucaucccucugcucguggccuccaacagcaugguccagcucaggggagaggccuggccccugcaucagucuccuccgucuagcuacaccggccacaguuaccagacgcucucccgccacggggccuuugcaccugcugucugcugccucugccuggaauaucuccucccagguggccacaugguuggcuugcucaccuuguuuuuuucuuugcucaaaugucuccuuucucagugagaucuucucugggcaucuuugaucuaaaauuaauuaauccuacacacauuuuaucuucuuucuugucugguugccauugcuagaacauaaguuccaugaagacagagaauguuuucugcuuuguccagugcuguaugccugggaccuaauagguacugaaugacagcaggaauauuuuaauaaaugaauacccuaauggacagcugcugccuccucugccugcacacccuguuucugcaugcaaucacaugaagucucccugaaauuccugcucaugaaggccuaaucucgagcccugccuggccagcacacacugcaucucccuuaugguuccacccuggccugugaugugggcuggccucccguagagccuuaucauccugcagagcuuuauggcaucuacacaguucucucaccuuaucuucuuagcacucucugaggucaggacuaucacccugguuuacauuuaagaaaagaaaguucagagguuaaugacuaauuuacuugaaaauaacaccacauguaaguggcagggccaggacucaaaccagaucuuagcuagagcuguccccuugcugcccaaggucccaggacaccugguccccccucccuggcgugcgcagucauggcugagcucucagcccuuuuucugcaucugcucaccugcccggagagagccucccgggguggaguggggcauucucaccuccaccaaggccugcuucauaccccacggaggagauggagacucauucugagcccugccaacacuuagaaaaccaaguuacagauggggcgguagaagcugggagcacccaguggaccucuuccuacccucaggcaaggggcugaaauccacagccucuuucugggaagcccuucccuccagcucugggcucuccauuucaagaaacacggggguggacugcgugcaguggcucauaccuguaaucccagcacuuugggaggccgaggcggguggaucacuugaggucaggaguucuagaccagccuggccaacaugaacccuauuucuacuaaaaauauaaaaauuagcugggcgugauggugggugccuauaaucccagcuacuugggaggcugaggcaugagaauugcccgccugggagguggagguugcagugagccgagauugcaccacugcccuccagccugggcgacagagugagacuccgucucagauacaaaaaaaaaaggaaacacuggggugguccuggauguagacccagaaggaggaagcagacagccccugcccgcagguucgugugcaggaaaaugaugguggggcgugaggggugcacccagcugugugaccuugggugagccuuuugaggcagcuucuugcccggagaaccguguuccuggguaaagcuggggagauuugccaggaggaaccauugucuuggagaagagguggcaaaaaggcacacuaacacguacuccgagugugaaaggaugggcaugauaaaggccacucucucccugugagcgccauuccugagcaccugugugccaguuccgagcccggcauccuggaugcaguggaggugacaggcugaacaggcugagccgcgcaucucauuacucuagcaauaagcuaccuugcauuuuccaugaucaauccuuuugggaucucaugaagaguguggguggcagaggacuuuaccaauaauccagguugauggaaauucaggguacgaggcagacaggagguucuuugcuaacaugggccaggugugcuuucaugaaagagcgucagccucguuguugggaguccugccucagccacuugugggucgggucaccucaggcauucccuggccucaauuuccuuaucuguacagcaaguagguugggcuuguugcuccuggggagcucuuggagucuccuggcccauccuggguacacaggggaucugugugggaccagcuacuauaauccuaccacuuggacaaguccaaggcaaacaccaagaaggguacaagacagcgugguauugugacuucugagggccagccagccucugagcucuggagaugccugacugccccuugcugaaagacauuuaucugucccguuggugccagcaugaaggcccuuccugacuacuugggccuccagcacgugggacacagaguggggccaggcagaagaaacucguggucagauccucugccaggagcauuucucaaacccacgugggucccaaccccucccacuggagcuggggaagcuuugaggcaccuuggucuccuggucaugccgugugucaguuaccucuuaauuguugaucaccucccaugugcaggcccugggaagugcugggcaucagcuuugagcaaaacaggugccaugcauguucucauggagcucacaggcuggugggggccagacacugaauaugcuuuuuaaguguggcaaaggccugagccuggugggaacauagagcaagggggguuuaacccauacugggggacagggcugccucccaggguaagagauguuacucaaggcacgaagaaugaaugggccauggagaaagaggaaaaaaagaggaagagacccugggaaggcccugcaucugccaaaggugugggggccacagcgccaaaagcuaccaucuacugagccaucauaugccagggucagcucucagggcuuugcuuauagagcuuuauuuaaucuucccuacagccuuugagggagugauuauucucucuccauuuuuauagacgagaaaaaaaagucacagagcuugcaaguggcagagcugggauuugaacccaggagccuggagucagaggcuucucugcuguauaacugagagaacggggaucuucagcaaaugccccuggugagguaggacuagaagggggcaaguggaagggccaggcuaggcccaaccagaagcagaaggaacaaucugcuucuucccagcagcagaguuagccuagcaguacacagauggccucagccacagcccuggacucgccuugauggcaucuggcgguggcugacccacucccaggcucuguaucaaaaggcuuagggaaauggacuugcucuucagcagaagggauugagaugaaaccacaggacgaauuucccagcugucaugaccauacgcuauuaaaacaggcagccgagggagguggaggcccuggugggaaagguuaaugccuugguugcucagagcugcuggagaggugaguggggcagggggagguccaggaugaccccuccagugucuagagaugagaucacaucacacagaucaaaaacacugucccacaggaagagggcacugucagcuguccccaggcuggugccacccucuuccugggacccugucugccccagcccugccaucggacuucauuaaauugcauuuucccagagcagggcaggccggugacagaaugagucaacgucagcuugcuacaacugucgccccuggagccggcgggcauagagggagauaauugggagugguuugacagcuuaaugucuggggcuggcuuccuggagcaguggagggacagggacggggcgggagccagugaggcggaggcagguggauuugggcugccccugucuugagaaugaccaccccccaccaccuuuccccuccauuucccuagcagcagcuuguugggcaggaaaauaaagcaccgggaaggaaaugagaccuggagaauaaauuaggcuuucuuuauuaauuugucagaacuaauuaacaucuccccuagguuugucuccucuccagaugcccccuagagccaggaggaagggaagagucugggagaggccagguuugggcuuuggaaucccagcccuggccucuccccacaauaccaaccccagagcagagaaggacagaagaggugucacucaaagggggucuguggucccguucuagggacugcaagcugagagggcccccacaaugcauuuuguccacuugccuaggguucugagccccagacaccccuuggcauuuuaccucucuguguuugugucacuucaaugaaacagagucagugcccaccucauucagaguuggugggaggauggccugcgacaagcacugcucagagaaaagucagcucucauuauuuugagagacagaacuucaguaaagcucuggaagguucugaguucuuucauacucaugaggucacuuugguuugacccuagcaauaaucccaagagcuauaacaagcaauaauugguguucccauuucacagaugacacagcugaggcacagagcaguuacauacguuacaaggccacacagcgaauggcuggcaguagcaggaucagugcuuagcugagcaagcacccugcuccccagccuccccuccugagcacacacccguacccccacaucugccccacugcagagaccugacucacggcugggagucucacuuacuaacagaugccucacuuccuggguguaaguucaaggucucagcccaggagccaccccaagccacagaagcuccagugcuacugugggcugcucuuugacuugggcaagagccuggauuuguuucgcagaguugaugccuuuucucauauaccccccaucccagaaaggggcccagcccugguuucagagagucaccaacucuaagaagcaccucucaacaggcgcaagaggcccuugacagagccacgccuugcauacaacaccuugaaggguugcaaaauccauucuguuucauaucccgccaugcugcgaucacauccuagagguuucauuuccgcugagcuacaggacccugggaauguggaagugaacacuccccacccaccgucccacccccaggccugagagcuuguugccuuccacaccggcagccuguuggaggguggcugcagagcagagacccccagacuggccaagccagauggaaccugaaggaaggaucaaccgagcagccuuccuguguuuuaaaugaggaaacugaggcuuggaaagagaaagccacacaguucacuggcucuuggcagcaaugguauuaguaccuggaucuccugacucccaagccaggccccuuucacgaacuagguguccgcacuugacaaaugacauuguaacuaaaugaauuugucccauuagggacucucagagccaagaacgggcaaccuuccaggggaggugggguguaugccaauggugucagaccaaaggucagcauccagugcuaggucacaccacacccccucccugccucagugaccacaagggcagauucucccccaggccuccuggcaaaacccucaggcgggcccucaccccagcaggagacauagaguccuguuucagggccucgaaucaugaacacgguugucgcuacagugccuuuucuccaguaacacaguuccggcuccacaguuuguuucaucugauggucuccccacaccucaggggcuggggugguggugguucccacuuuaagagggggaacagagacccagagagguugugauuuuuccacagagcuagaccuggaaagcagccccaucuucugaggccuuggagagaaagggugagcuggugggguacacacuacacuuggagucaggagaccuggcuuugaauccuggcucugccacuaaccgugaccuuggcaaccccgaaugccacuuagucucgaugucuucagcugucuccuaacaccugccuuggaaggcugaggacuucaugagcacuccagggaaugcaccugagcgucuuucaaaaggcccuaccccagacuccugccacucucccuugcauguuugugugugaugagggagcaggcauagauggaacgggcccuccagucauccugugacuccagccaggccucgaggcccagccgugccugcccgccagaggggccagaguugcagggguggggcgggccgcuggggacaggggccucugcucuccaggacucggggcugggcauugacagagcuggguguggccggccuggggagaaggacgcagagagagggaggagcugggcuaguuggcgucugcuggccgggggccgugggaaagagucccagaguucccuugaggacagucggaacucuuagacuccaggaacucagggaggagacugggaaaaguccccucagcucaggucaaagcuccagcacugguccuuguuuuccugcauccuuagggcucaucacaugccacaguauaaacacaggccugugcugguaccuaccagggggccggcuggcagagacacauggcacuuccccuuauccucugcagagaugaugauccuagcucuuugcagagcucuccugggccccuaccugaaaaacauaggacuccaggaccagggcaggcaccacaggccagagugaggaugcugauuuucgaggaaacaauugagcugucugacacccauuguggagcuuugaggcugcccauuuuucugcaggcuggcacagggcagcuuagagaauccacacaaaugggagcagcuguggccuuuggggagggccuggagcccacuuugggaugcuagaaagggucuugcucugacccugaggaauggucucagcuugcagcccuguccaugauccuaggguacccacauaucaguuucgccaccuccagagcaauuauucugugucaggcacuuggcuaaccauguacauacguuauuuuacugaauccuuauagccauuuugugauaaaguauuagaaacugggguuucauguuacagaugaggaaacugaggcucacaggguaaggcaacuugccaaugaguggaagagcccagccccaggucuguccaccaugcgaacucccucucuacucuccacugcucucuccuuauggggaggaacuaccugauccccagcccugguaccugaucccacaugcccaagcacaccaugggacagauugugcuucccuuauaauaagaggaauugaggguagauaucaggaagaacuucuccacuacucagggguauagaacacuuuagcaguuucccagggggaaaugguagaaucucauaugcugaagaccgugaaagaaggggaagagacaauuuaaucaccugggugggguuuuguggaguaaaaccuugccagugucggggguaguuaugacagcacccuucagcugggaaagucuagaggcucaggcccccaacucuggugggguaugaccucugucugcugccaccuugccaaaaggguccagcaugggaauugcuuuuccaagaacuuucuuguccaaguccacuugggagccuuugccaacuagugccuggggcagcaugucaggcagggcagggccugggccugggcaggugugguccccagcuaccugucugggcacuaguuggauccacauugagagcucugccaugccaaaaccccgguuuuugcucuuucuuuuccccuucccugucccugguaaggagcugggagaagacucaggcugggcaggacaccgagggcuucagccucugcagcccauccugccuguccucuggggaaaucacucuucagaauuuguugagaacuuauaaugugcacaccagugauuaggcacugccugccuagaaagcuggaaucuggucuuaagagaggguuccaguugaggagacagaaaaccaaggggcagugucagucugaaagggagcacaguggaccacaaccagaagacucagguucggguucuggauccaccacccuuuagcuacacaacuuggcaaauuucucaaccacugggccucaguuucucccucuguaaaaugggacuaucaguccuugcuccagaagauggaagugaaaaauaggagauucugagugccugguagauagaagguauucagccaauagugguggaaauaaaauaacuugcugccagaauucugggaagcaggaagcacagauacugaccaccaguauuuauuuuuaggguugcgggagccuacgaaggagaggggcugagccuuauaaaaacuugggcacauaaucugucuaaucacuuugaagaugaaaaguugcugugaaaugccaaccgugcugaugggaccagggcuggagcagagaugaagagacacagcagggccaauugugcaaaaaauaaaaugcauauuuuuuuaauugcuugaguucacaucucauaaaagaaaaaauaauaaagcgcaagcccuugcauuucccuaccccccucucucggcugugagucaagaaccaguucccaccagucuuucugggguucaaagcgucuccccgcccuaauccucaccucgaccuccccgccccccacaucuauugugggugagagggccuuucccugagcugcucgcaggcugccccucccaggcccggccucugcccgcugcagcgggcagcacacagagugggcaggccucauaggaggcggggagggggcuggagagacaggaugcccucccuccuccccugccaggucuccuguugaucuuagugcauugugcaggugacaucgcgcggcuaucucacuauucucaggccucagcauugguucuucccuagacaauguggcaagaugccuuccagccucgccccauccgccccuaugccgccugcaguccugcuuuccggggccugccugagccuguaacccaggagagguggaggccuugggccaaagacccacugagccaacccugugcaauucccacccuggggaacccacccuuuccugguuccugccagcccuggucccuguguccucagaaaugggacagaccuccugccccuuucucuugcccccaacacccagcccugacucaccucccucauuucccacucaagcugugucucugggacaugucaggacagggcaccugauucugguccuacaggcucaggcucugcccgcucucaguggggguggggcagcuggggaggauuugcuuugaccugcuucuucagcuucccucccuccuccaaccccaccccagggggcgggcgggguugaacuccagaacaccuccugauugcacugacaagaggcccacucugcucuucgaugcugaagucuagcuggggguagggugcugcccauccucaccuuacucuaggcagccugagucgcugagcacugugcgggggacaccaaccugcccuccaaagacagacuuuuaccuuugggcuggguucaguggcucacgccuguaauccuaacacuuugggaagcugaggcaggugguaaucacuuuaggccaggaguucaagaccaaccuaggcaagacccccaacucuaccaaaaauuuaaaaauuaaaauauauguauagacuuacccagacaccuucacccaccaggacuguaaggcugugccuuguugccucuuccucaccccuuuggcaccaagaguguagaagaagggucaagagacuuggauucuuuuuggcuuuucaauuaguuuauuauauaaccucauguaagacaccucacuuuucugggucuuaauuucaacaucuacaaaauagguagcaccuuccucuugauuauuccaggauccaggacccuccugguaaagggggcuggaggagcgugaugggaucagcacuugcaaaccaaccuggggagcaaaggggggugcucccacuucccacuggaggcaugaauugaaugcggcccccacauaugcagcccaucagccuuucucuuacagagaaucucauuuugguaaauaagcauggcccucaccagggauucugguccuucuuugaucacucagcuuccuaagaagucuugauuaaaagaucgcagugaccugagaagccaccaggcacccccaucccugaguugguucucugggauuugacucuggcucucaguucauccagcagaccuggauccagggccuacugcgugccgggugucaggcugugugcugggacgucgggggugagcacgucugucuucauggcacagccaacacugugugccagggagagcuguuugagcaaggagccaggugcugugggaaccugaggucagagcugaugccagugugggaccugaguguugaaggguggguaggaguuuuccacuggcagcggggacugguggggaggguggggaccugggaggggugggagagggagaugggaauaugggcagggacagauugugaaggccugauaaguaguuuagauuuaccccaaggcaguggagagcgaccggggacuuguguaacaagaucugauuuguauuuaaauccacuuauuagcaguguggcuuggacagaucacuucccgagccugagccucaguuucucagcauacuggggagacggauuaccuaacguaauacccauuagacagugggugcucaguaaaggugugauauuuucaguacugugauuccagauaagagacaguaggagccucaccucccuguggaguugcagggagccgagggagcugaauggcuguauucuagaccuucagaaggagagucaaggggcuauauugaugcaacugugguugggcccugggagggguagggcugaaggagcagcuggagagaggaguucagugcacauggagggcaagaugccugggggggcagcaggacaccuggguucaggcccucagcacagggguaucauugagggccugcccuggaguggaccaugggccaaaucagcauccccauccccuucucuccccuauuucuuccuccaggguuccccuccccagaguaauacaaaacuggugugucaccaucaaguucaaagagcaaacguguugcccacacugcccucuucagcccacaucacuucaggccaaggcaggcggcugugagccaagcaggaaauagauagaaggucaggaaccuucugcaaugagagguagugagcuuccaggggacccaggccucccaacugccugccuaccaccaacugcuccuucucgccacaacuggcugccuccuggcuugagcuauuugcuuaucuggugacccagaggcagggucuuuguaaccacaagagaaaccaccacaguacauuucuaugggcuaguguucaguugaugauucuugcccaggugcuccugggccaugaucacacugcugagccagccgagccacggagccaagccauccaggcucagaucacuccuucccaccccucuucucccuggguccgacccugccagcuccugcuuccccugauucccacuaacugcuuggcaaucuuggaagagcucuccuucucugccccuccauuucccccucugugaauggggagucaagagcagacagucccugucucagagcugcuagcugaccaaugcucagccuggucuuuccuucugccccagacuggucucagccugaguucccugucccuuugacuuuccuguuuauacacaaaauucacccacaauauuuuaguuuuccaaucaaaucauuaauuaccccaguaauuaaaucuaauuagcagugguaggggccuuucugagugaggagucauuagcuagggugaaaaugcacgggggagagagaaaaagaaaacccacccuuucccagcauuaaaaaugaaagcaggagucagcgcugcaacauggagggccccuacuaaagcugggccucacucauuaagcuaauuuggugugcuaucccaguagccucugcuggggaagcccggcuucaccguccaacauuagagguguguuggagcccccugcguguuuuggaggcugagcugggccucccaggaccccagugccccaacucagggaggggugugaggagccucugcugacucuucaugagcaccugcugccacuuccugggcuucaugguggucauggcccagagugggaggggcugagugaaaaacgaggaaaagaauaacagcaccuuccacuccugggccuugggaaaggacagagcuuggcagucacucuccucucuuggcccgaggcugaggggacuccccacucgggguaguugugaagauuaaaugagauuuuacauguaaauggaugacaucacaggugcuugaugcgugcagcugucauucacccuuuaguuuucagaggugcucagcauuccuuuuucacuugguccucaccaccccacagcuccaggaggcaaagggugcaggugccaccuccagguuucacagguggaggagcugaggggcagagagagagagacacacaccccgagaguggcaggguuuggacuggaagucaagucucugagcucugggacgaggaggcaagaggaacaggggaagaaugggggcuuuucaugucuggagucuucagucauauccuugugcugggcugccgggguugcuagccccuguaguccugggggagguggaggugucagcucagccucccgcagaacgaaggaggaguggcaggggugggaggauggugccugcccucucuacaaggcacucccagcagccccaucgucagccucaggccagcacugccagcaggcaggggcugcucacccaggucugguucagagggugcuggccgcucuuuuccccaggaaggggagagagggaggccguggagcuaugaguguggugaagaacgucaccuguggagacagacugcccugaucagaaucagucuugcagacugugugaccgugggcaggugacuugaccucccugaguuuccucaucucuaagauggggacaaucucgcuccuggaguguuguaaggauuaagugaauuaauguauguaaauauccagccccaggccuggcacagaucagcagugcacauguguuaacuguucuugccauccuuugggaggggccuggcagggaaccugacccuuuuguacuuucucccccagggagggaaggaggggagcacuugagccccagcuucugcugcugcuaagggcaugggcccaaccuugggguggccgaaaggaggcagguggcaaacaugggguccacuucccacccccgccacccacacacacacacacacacaucacugccacaagccacuucucggcuuucaggggccccucugcacagagccaagagagcaugggaauggaaggagggaagggaagggaagcagguggccaccgaggcugagcugcauccgcagcugggcgcgagccccgagccuacgugcugguuccuccgugaggcagugugcggagcaggcccuggcacgccaaccccuacccagugacuccugaaaccccgacaagucugagcuggaagcggggcugggcgaggcuccugauagauucguguugggcagagggauggucgggcggggaagcaugggaaagaccccacucucgaaacucugacaccacuggggaugcugggagggagcagguggggcuggggacaugcggccaggcucagggcuucuaccuucucccucucaggccccucaccccacaugccccugcccggcggggcaggaagaagacaggccgcggcagaggagggaugugcuccccucagcauuuugccaagugaugauuucagugcugcugagaaagagggaggaagggaggaugacagccgggagcugggagcagggcaggccaggcaggagggcucccagaaaacuccugggacuggggaggucauuuuauacaggagcucucccuccaaccaaaugagguggaugugcuccggcccauuuacaggugaaaaggcuggguuucgggaaaguuaugagacuuguucauagguccuacugcuaguuaagugccaaggcugacauuagcaccaggaaaaacaaggaagccucugccuucccaccgccccuuucagccuucugggcacuggggaaagggaaagcccagggaccuggauguguccacaggcccugcuguagcggggcaagagcaaggcagagagugggcagcaccgugcccccugcaggcagaccacccgcagagcagccuucagcucagcuggccucuccccaaaaccccaugucacaaccuuuugaagaucccacuuuccccgcccaccucaggaugggggacucucagguggaaagaaaacugugaacuguggcugccugcccuccagggugaccccaagcuggggcuggguuuagaccuggagcuccagaggagcugaguucaggccugcugcugcacugagggccaugcguggaguuugcuucguucugugguuaaaccaggaagagguuaacacuagaguuggggucaugacccggguuuguguuguggucuagguuggcacugauguugagaccugggcgggggcuacucuugggguuucugugagugguuggggagaaugcuuuuggugguuaacacuggggcaagcacauugaguugggguauuccagcucaggcuguguccugagaaaggguggaugaguuugggaggcucagcacuaguugaacaaaaggccauugcuuauguuuggaggauaacugcccauuuucacaggaccauuggccaggggagagaaucgggguuggggugguaguugagccggaagguagguugagguggggggcggcgugaaaagugaguggcuucugcagugauggaagggccacucagagucccugccccuguccccgaguucccccaccucuguggcauccugugaugugggacccuccccaccccaggccccacccagaugcuacucagacauaagccugaacaucugggcacgggcuggucuccccucugugggguuuggguucucucaucagccaagggaacacagggccgggguuuugccucuuaccccagcaguccugaggcccugaucugcuggugccugggggaccugcccuccuggccuaccuccggcagcgcugcuggagacccuuuggugggggcuccugaggccacacuagcugaagaagucaagagaaaacucaacuuuaagccuuugcuaguuccguuucccauccccuuuuuuuucuggccccagccccuggucauugaagcacaucggauaaagacugccaccccccagcucggaggucugugauccaggagcagagcucauaggguggcaaggaagcaaggaagccuuuauuuuuuauuuauuuauuuuuuuuguuguuguuggauggagacagcccugagccaggagacauggaaagagaggcuggccugcuggggucucaguccaugguugugccaccugagacacugcagggugacguuucaccaaggaggggcugcgaggaaaggagcuccggcugucuccuccagcaucacagcucccuuuccuggcaccgccuaaguccagguacagaagaggcccugagcaccuugugccaaggccuggugcaguucuuguaucauccauacagggaaggguucagcagaaggcccagccccaccugggaauguuaugucuaacccagacguuacgugcaauuugaaugcaguaucgcucauuggguccagaccagugaguucugcccagaaaugaaauagcagguuuggugccuaugcagauaccuucuucuucucaagcugcuuuggaagcagguggagggaagagauugcucuggggcccuggucacugauccccacucgcuguccaagaguucaaggucaccacugugcuguggcuacaaaguauuauuucaggggucauugcgguggggauuggugagaccaagaccuucucgaggggauggggucgagagcccuccaucccaauguugcuccaguggcccccaccugcugcucuggcagugcgcacggagcuccuagcccugcugccuguuuggaaugugcggggcacauucagaacuucugaacagucagguugccuucuccucauugccccuucagcagcagggccccacccacacccugaagccugaaccgauagucccucacuuugcagcucccucccacagcagagugccucugggcaggcagaauucugacuccaaagccuugccuaggagcaggaggugccuggggcauggauggaagugcugggagugccagaugccagcccugggugggacgggcucaagggcugaugcuguagggucugaaugccacagggaaggugcgugugcacaugugugugcugcuccugaggcugcgaggcuggaaccaccugcaagucugcaaucaggcccuccuauguucaaagaaaagccaggagaaccaggcccagggugaggagcgcaaacggcaaaacuuaaugacuuuaauaugaaagaauuugccacuaauuaagcacaaacacuccacuaaugcacagaacacauguuguggauuucacuuaagcagaaaccaaaugaggugaaaauccuuccaaaaugauagcaguuuaccagccgaaggaagacgcugccugacuuuguuucagcucuuagaaaccuagcgcagccccuaccuuggcagccucccuccccucccugucuaaaggugcucacaacaccccaccgcauguccccugugucccuccccucgcugccccuacccacccucuugcauccucugaggacacacaugccacucuauaacccauauucugacagccagcuccccagaggacccuguucucucuaccugucucccccaaacacaacucacugccccuccuacagagcccagacucuccagcccuguucccagccacuucuggacccucugucccuggacaaacaaggacaguuccccaccagagugccccccaacuauguuucccacuccucucugcaccagcuugccacagccagcccugcaugucccucgugagcuccaccaucccugccugagcuuuacucccuuccucuaggccaguggucuuacccggggaugauuuugccugccaugggagaugcagcaaugucugugguuauuuugucaucacaaauggagggggugcacuuggguagaggccagggaucuugcuaaacuucugcaacacacaggacagccccccacaacaggacagucccccccuccaaaaugucauuggugcggaguucauucgugcccugggggaguagccucaucacugcaggggucugcucaggaucacagggugggcuuagagccgggaugggaaucagggaaccagagcacgugauuucuagguagguucuuucuccuagcaaauaauacaacugcuuguauagcauagcuaugggccaagcacuacgccaagagcaaaacugaauuauuucauuggauccucaaaucagcccuaggagauaguacuauuacuggccccauuuuauacaugaggaaacugaggcauggagagauuaaugcaccuuucucgaagucaaccagcuaaaaagcagcagacacaaacccaggucuaucugaauucaaagucagcgcucauagauuacuuucuaccccuccccccgcugccauguuccucuuaaucucucaucugucaggccuucuacacaaccccuagaacucccaccccaucccuauuagaaugaguguucccugcagguaggcauuguauaccuucccccacugccuuccacucacccccccggccauccgagcaggcagcugcccauagcuggacagggcaucgggaggguugggcgcugggguggccccacaggccccuccugggaugaggcagaucgagaacccucugcuuccaaacagguguugaacaucagccugaagccugcggggcugagacaaugcagaugucaauacugagcuuuuaaaagauucuccggggaagccuggggaauucucccucugcuuucucggcagccccccgccucucccacccccacacuagccuuccaaagaggcugcugccuacacuccccaaaaugugucauuaaaaaugcacacuugccgagggaaauccaggcugccgugucugcuacaagacaguguuguuugcugcagcugggguggagaggguuggcaucagcggcagacaaugggaccugccugaaucuuggccucagagccaggggguuccagguuggccagaccaugaaaggcugggacagcagaagccccagcgguggugggaggggcgaugaaccggggagugcagacacaaacaaggcuaagaucuccagagcagggccucagggauggaguuugcuugggugagaaaaauguuugucaccuuauggucuggcgugaggaaggaagagggccuaggugcugggaacuggggcagaggagagaggaaagcaauugagaaaugucucggggaagcaagcagaagucgugggguuggaggugggcgagggaucgggccaaccuucccccuguugggauguggcuuccugcuuucagucaaggaaggagaagauucggacccugaccugcuucccuuccaugcaggugugaggccucacuuuccauuucugccuuuuggauaauaugcaguuuccaggaagcugcagucagaccugagaaauggcuaacccuggcucaggcccccagcugcucacagccuuuuccaccugccacuugggcccccuguguuucccaugugccaggcacuggguucauucaaguccuggccuuuuccaaacuccguaugagaaacgcuaggacaggugugcgccgagauacugggacccugggggugcaggaacacgcaauccaugaaggugggaagaggagggcuccgggaagccucccccuugaaagucaacucuaaggugauuccgggaagaaugaaaaggacuugcgcagguaacgggggaguggugcgguuuucgccgaggcagcaaccucaaccgaccggauuguuaaguguggcaaggaagagagagaagaguugggagaggaaguggcuggagguuggggaugcccaagauagggucuagagcccggaaaaacuucauccugagggcugcaggauaccaugggagggucugaaguaguaagugauuugcaucuuacagagaucccucuggcagcugagugaaggaguuucaggguggagcuggaggcaggagacuguagacuuagcgugaugcagcaguggacuagggaagggaugauguuggccuggacaaggggcaaggcuuggggaaauggagggaggcaagagauggcaggugcuaagguucaaaggaaagagcuagugcaaagucccagcccgggaauauugagaaaauaagaaagggagacugccggaggugagguggagggaggugugcacuagugagagagggcuuaggaaguuugaaucaggaccagcggggcuggaaaaucaagaggaauucaaaagcuguuuaggagcuggcaucaguaagacuuggugauuacuugacuguaggagagucccugugugcuccagcuuugccaugcuguggccuggauuuuccuggcaucccacuuaaccugggaggucuuccuggaagagcugggcaguguagagagacagagcagccacuugguagauagguccccagaaguugauccaaggcaaaggcacagcugggucagagugagcuggacaggucauguccaaagugcagucccccaaggucaucagagccaauauuccccauuuuacagcaaaggaaaccacccuauccaaggccauacagaaaaacaaugagcaaguaguggggaccagagcucgccucucucaguguccaggugagcagagcaaagguggcagguacaggagagugauccaagaggugaugucuugaaggcuagaggcaggcagggccaagagagaggcucuguguuccuggggugccacgauggagucagaggcuggcucaggacuggccccaugaugggccauguggauggggcagccagcaugaaacaggccugcaggacagaauccagguguccucagccaccuggugggagaaggcaaaacucagcucccugacucaucucugaccccagccuguccugcuggagggaggugggacuugccagagcacccccaucacugcugccacgccggggcagcagagcagggccagccuggccugucuggaagauccugggcuccugcgcugccuccuucucggggcuuuucccaggccgccgugcccccuccucucccacgcacugugcucacccgcccaaggcgccgggcgccagcuccacagcccaucauuaaacagcuccauguggggaguuggggggucaucaggcaagaggaaaacaucagcaguuuuugugaccccaaaggaggggcggaggcacugacuuggaugguagcaauuagccccugacugugggcucaugggauguuaucagcaccucccaccagccaaagucucugcacugcaggcagcaggggagacagagaugccagacuaacagcagugcaaggccaggccggacucaaguccagacugugcgcagccccagggaaagguggcuggagcaccaggacaagaacugggucugcugggucuacuucugcuuccuugcugagcccuccuccccauccugaguguagaggggagucuggaggcaggagggggcagccugggcacccgugaaucuccuggacuaauggggaaaugagacaggacaagcucagugagagcccugccccucuggguuuugcugacagaaugaucggagucuaggugacacugauuggcaaaaccugugaaaggaggggaccccagaaaggaaguggguguccugauugcacgcuccuccacaccggccucucucccaggcggagcuggccuuggcuucagaagguauggaguuggccagcccugggaguugacaaucagggaagcggcugcacugggaggagggggccuauaaccuuuaggucacugugcugccucagcaggguuucagauggaggcccugccccucccagugggugagucacucccacuuaccacuuagccgguuucucaccggacauccuguccccuucugccaguuccuggggugggggugggagcaucccuggaaagcccuagaaaugcaucccgaaggauaucgauuucacagaggcccuuauggcggagcccagcacccaccucagacacacacgugcacacagacccacucccucucugcaaugugccgccacuuuacuccaggccaaguuggcugccccugcccagccacuucaaggcccccaggcagagucucaggaaaggaggggcuggggugggcuggcacagccaggacaaaagaagugguuuaugccaggaagccccaaaucccccucgccucaccuagguacccacuuucaccuaccccugagcccaguuccagccugcuuggcuaggaagaggggucuggggguuaaaagggcaggaagagaaacugcuuuaaguggguauguggggagcgaagugugccacaccccgcugcgugggaaccuguggcacuggcuugcggaugagcuccauggcaggcagggccuuggggagcagguuuguccgccacaacugaggagucuuuguguuuuguugcugagcucaggcguuugcaggucugugacgucucagggggccggccugaggcccgucaugcuggcucagcacuucugggaagugaggcagccugaacugcccaaccugagaucuaguggggaaacugaggcacuugagaacaagccccaggggcaugggucccagauccuggagcucauaggguggucagggagaauauaggcagugcuugaguucaggaaaaaaaaaaagacugauucuuuugauaucugugggaugcaagagccccucugcugagggcacagguucuauggaugccucugcccuucacuccccaccucucuagcucuuauugcucagcacauagcagccuccugcaagugcccacacacacacacacacacacacacacacacacacacccgggauccccaaagccccuguuucugaccuaucaccugacacccagucaggugaccugcagaugcaauggccaccccaguauuguagcugguguuugugccauuucucacaaggggcaauggaggcacugagguuauauucuaggagggacaccacccagaaagaggccccagggaguuagguugagccagagucuguuuuuguggcagggugggaaagcacugggcugggugcugcuguucugugucccugagcaggugaccuaaucccuccagucauuguaaaugauggauugcaugguccaucaagcuccaauaugcuaccauuuuaguggucccaguucccacaucugggccagccucugcuucucauguaagagggaaccugcgggaaaggagacaggauguguucuguggaccagcccugacugcuuagggaaucagagaaagucagcagggaacuccccaagcccuggacccugccaguggcaggcgugacauggucaacucaacccaaggccaggccugcuccuuucaucuccugcaggggcuuacaauugguugggagacaggcuagacacauaugccaggaaguagaaaauaaagggguacaggucaguguuacauguuauugggguauuaauagaacugucagcugaguaggaagagaugacagucacaagggcguccuggaagaggggcgccuaguagcacucccuacaguguccaguauggaguaggugcucagcaaauauuuguugaaugaaguuccagggagggaggccuguugcuucauagaugaaagaugauggugaugaugaugauggaagcuagcaucuaaugagccuuucauuuguccuaagugcugcuuucugaguuucccauggacucccucuuuuaauccuuacgcaguuuuauagggcagguauuagcuauuauaauccccaucuuacagaugugcaacauuggugcaaacugagcuacagagaggugaagucauuuggccaagguugcacagcucaucaauggcagagguggaaugcaacccccuacugccuggcuccuaacagccccgccaugcugccugaaaggguggugacggaacagcccuucagaaggugggagacgcuagcucagcuuucagguugucaaggcugcagugucuggagaagcuuggcaaggagaggggcugugcagucuuuaagccccuguuucugcugccugucccuggagcaggcugccuuuuaucaauccuggucccuucucguggcccaccuguuccaggauucuugcccccauccagcucuuucuuucuuuccgguggugaucccugcuccucuguugacucuaacauucuaacccgccuguuagagucaccuggacucugcucccgucugaaaaccucccaaucuaaagaaugaggguccuucuccccaacccugaguccuuggaccaaggcaggcagccccuaauacgaggcuuggguucccggucccuaagucuggaguggagaaguggaguuuuuaggccuuuccaaucuuccagcaccucccaacuccagaacucugggauccaguccccacccucaaugacccuaagccccuugcuccaagagcucccuuaugcucaccccaugggucaccuccccuggcccugcuagcagucagauguagcaaagaggcaaauaccaaagugagucuguaccugcuccuuaaagauccucccugcccugccccacccugcccaucaccagggcaaaaauguccaggacgaggggcacccacuuggugcccaguaagagagaggcugggaacguccuucacuuccccaccaugugguugcuucugggagugccacaguggacagaaaagagcaaccuccaccccaacauagacgugggcugccccugccuggugagggauugguagauguaagggggccucuggggugcccggccaccuugcagcacccuccccaccccaugccuggccgcuaucagccgucuccccuccuggcauugacacagcucugagggugaggucaccacugaagacucagacaaugaaugucagccugugccccagggacugugcccugccugccuccacaccuucaggggaugagaggagacaggauugcaggggcucagagggccgugucccguugcagguccaccaugcauggcaccaauccaugcauggcaccaaucccaaaauggcuccuggaucccacaccccuucccugcgcucucaccuggggcccaagcccucccaacuggcuuuuccuguuccuagcuuuguguggugcaaguuccccaauuaugcccacauuaucucagccacugggcagccuccagcagccugggggagggguggggagcacccaauuauccugcuggagagggccuagggcuuagcugcuugccaacuagcccgucagcaagaguacugggccgucuggcccacugaccucaccauggaacuguaucuggaguggggccacagcugcacugggcugucaugagacaguuaggaccaggaggaccacugggacucgggaggccagucugcugccuuacagaggaggaagcuagggcucagaaaggggaggugacuggccacggucccacugccugcuaaaggcagaggcaggcuacagcccagccuucccaacucguggcuggauacuucucccaucguauucccaacccauggggccucugcccagggagcaucagcuccgaagcaccccacaggcuggcagagggaacagcuggaggagugaggguggggauaggccugauggaccuugagggcuguguggaugugaaucagcacagagaagggggaaccucagggaaacuuucagaacacgguagggccuggcuuggugaagccaaagauagacuuauucagcaagcauuucuugaguagcuacuuuaugcugagcaccagggauacugcagugaccuagagaccuggccuguggccucucgagcggaagagaggggagcaacuuacugcacugaccauggguuuuggggcccucagaggagccuguguugcuacaauauccccgucacgcugaggaggugagugagcauaagccccaaauucccacucuuggaucccagacucccuuggggggucauuuagauccucccccugccuugggucaguacagguccugguguuauuaaugcuauugaugacgcucaauaaagugagugaaguaaggauacaaagacaugaaguauacaaaugacagcaaggacacggcuuguggggaguugcaggacucaggagagagcuggaguguacagccuagugcugaggacaaccgccccacguuaagggagcugagccaaguucagggguaaggaagcccaaaaaaaggacauucuaaaggggauaacacaacccauguggagacuggagggaauuucacucccuccuucuugcaaaugucugcucucuugacuuccauugcaauuuguguaguaacaaauauuuacuagcaucugcuaugugccagaugcugcacugggcacuggggauacagagauggaaaggacagacccugcccuuggaggaguucacagucugguggagaaaucagauguguaaccaccaccuuccaaggcaggaaagaaccaagguagagguggccagguuagcucugguggggaagaucagggaagcucccaggaggagguggccucagggggccauccacagguggagaaggggaagggccaucuagguggagggagcugccuggguaagagucuaggaguguuggguggauaggcucugugcuccauggaggccgggacucaauugcuccuugauaugacccaaaugcucacacuagauccuggaauaugucacucggcaaaucguggcugaauaaaugggaggaagagggaaggaaaccgggaauguggcauguucugaggaugggcccagucugguauggugggaaaguguggcugauggagagauguggacaagaggcaggugcaaggaggucuugccaagagaaggcauuuacauuuggcugugaaggccauggggagccagcggaggccuggccuuaugcagugcccacuucccucugccuagcuggguaagaggggcccagcuagugcaccccaggggauggggacucagcugcgagggagaagacagcagggguggccaugaugacagccaccgugggccuucaagcucauccagagccuccugccucugacgcaccuucucguccaucacgccauuuguuucccccaguaaccucgugagguagagaggacuggauucuccaccccauauaacagaggaggaaaccaaggcccaggaagacaaagcagccagugcauggcuccuaggcuggggcucugcucgaaaagcaaccaaaaaugagggugcagacguauguuuacuaacacagagugauguuuauaaucuaucccuaaguaaaaaagcagcuuaugggauaauauguacagcaugauucugacuuuuuaaaauagauagaugguuauguggauauacacagauauaaaguaaaaggagauagauccuucaagauuauccugagcggaaggaucaugggauguugucacuuucuucucaugauuuuucaguguugccuagaguguuuuuauaacaaguaauuaauauuuuuacaaucggaauaaaaacaauaaugacugcuauaaaagacaaggccagagcacagggaacuguguggguggggggaggcugugccugacacugaccacuugcugccauccuccuggccaggcguccacucccaggugguccaggugaacgacuccauguauggcuucaucggcacagacgugguucugcacugcagcuuugccaacccgcuucccagcgugaagaucacccaggucacauggcagaaguccaccaauggcuccaagcagaacguggccaucuacaacccauccaugggcguguccgugcuggcucccuaccgcgagcguguggaauuccugcggcccuccuucaccgauggcacuauccgccucucccgccuggagcuggaggaugagggugucuacaucugcgaguuugcuaccuucccuacgggcaaucgagaaagccagcucaaucucacggugauggguaagcugcccugggcccccucccuguucauccagaggccugugaccucggggcguggccauccucaggaugccucaaugaccccagacaucccccuugggugggcaugcugccaucauucuaggcaugaggcuuccagucccuucuagccaggccaccccacaauucacuagggauuaggggcaggggcuuaucucuagacaguggggaacgugauucuucagguugaagcccacaaggcacugugcuggcagcagcaucagacaccacgguaaggaaaggagccaccugcgcugcuugccuuagacaugcugggacuccaggaggccuaagcucgaugacagggauaugacuaguagggcagggaggacauaacguuagacaugaugaacuuccugcaagagguucugggacagucuuuggugcagcacagcugagaggcagggauggccaaggggaccugaagacaaggccugacggaugccacgcccuuuuggccggugcaucuuggacaagucaacagggcuagucccaucacucucucugcuuccucgcagccaaacccaccaauuggauagaggguacccaggcagugcuucgagccaagaaggggcaggaugacaagguccugguggccaccugcaccucagccaaugggaagccucccagugugguauccugggaaacucgguuaaaaggugaggcagaguaccaggagauccggaaccccaauggcacagugacggucaucagccgcuaccgccuggugcccagcagggaagcccaccagcaguccuuggccugcaucgucaacuaccacauggaccgcuucaaggaaagccucacucucaacgugcagugugagcagggcuggcugccaggggccuccuggggugggcgccacugucccuccucccuccuccucuccuuucuccucccuuucucuuucugggggugcuuucuucuccccuccugucuccccuaucuccucccuuugcucguuuucucuccuccuucccugucgcccuccuguuuccacucccgggcucugugauugccacccucccacccacacuucccucucuccuggcuguuuccaugccacugcuccuuccaucccuuccuggcugaaguucccuuguucuaagucccgcucuccugaccucacccucuucaaacaucccuugccccacagaugagccugagguaaccauugagggguuugauggcaacugguaccugcagcggauggacgugaagcucaccugcaaagcugaugcuaaccccccagccacugaguaccacuggaccacguaagugcugcagggcugaccagucaccuuggaagacagcugacuggaccacgggugaugaggggcaaccauccuaccuccaggagccuuuaggcagggaagaaauuagggucugggcucaguaagaagcggggccaugagagaacaacccccacccccaacacacacauauacauuacguccaugugugacagugucaaggucaauggaacaagcuauucugccagagggguuuccuuugugaucugcuucccucccucuuccuaauaaagaguuuugucguuuuccuuuggugauucagucugagucacucccaccccaaccccccaguauuuauuuuuaucaagguguccccagggaagccaguguucuggagcaucucagcucuuucuuugucccuauuccuucucucuggcacccccagauucuuggggaggaggcagcagccagccuagaaugccugugcucauggagcacgugcccugcggcccaccauccccuucuuggccucacggucuucgccuugccuugccuucgccuucuccccuccagccggcucugacagcuggggccaaggcucuucccagagaagagcuggauggaacacacagaaagacagggacguggggaaccaaggagaagguugauauggguggccaggagacagcugcccagaaggagucugccuucuuuuucuggggagcagagggcacugguaugcccuaccuaugauccuccacuuccuggaauaaaaagugcuucugaaggugugagugggcagagccugcuggcugguuucagcucuguggacccaggagcugcuagguucaacagaauagcuuuguggccuuugagggucaggaggaaggaagaagauccuuuguccuuggcaaauuugcaagucacuucccacaugaaaagguccugugacauucccagcaaaaacacaaaguaguggaauggaacauacuuccuaucucguuaccugaguggcuugucaaauacagauucccaggucuuugccccagugguucugcuucaggagaucugggguuagaaccaaggcaucuguauuauuauuuuuuuuuuuuucuuugagacggauuuucacucugucacccaggcuggagugcaauggcgcaaucuuggcucacugcaaccuccgccucccagguucaagcaguucuucugccucacccucccgaguaacugggacuacaggcgugcaccaccacacccagcuaauuuuuguacuuuuaguagagaugggguuucaccauauuggccaagcuggucucaaacuccugaccaugugaucugccugccucggccucccaaagugcugggauuacaggcgugagccaccacaccuggcuggcaucuguauuauuaaccagcugcccaggagaccaaggaccaacaaccaugagacgugaauggaaaguagaaagagcacuuuaccaggagucccgagaauuggcuggagcucccaugcugcugccugcuagcugugguucccuggccuugaaccucagguuucaucuguuaagggggaccggcaccuaccuagccugccuauauucccauauuaugaucaaauaugaaaagcugaauaauauaaaacuaccaagugaaagagauuauuauuauuauuuuucuuccuucaaagacagacucuaccacacaagcucagcaaaaggcuagggggccuggagccaagugggugacccaggaacagcuucuugaggcuggagagucauaacccuacgcugugucucccacuucccacaggcuaaauggcucucuccccaaggguguggaggcccagaacagaacccucuucuucaagggacccaucaacuacagccuggcagggaccuacaucugugaggccaccaaccccaucgguacacgcucaggccagguggaggucaauaucacagguaggaagcugcauccuccccagccucuccgcacccacggguuccuucgccaccugcaucccucaccuuugagcaaugccacugcaggaagauuaucuccuuuuccugcuucucuaguucucccuugagcucuggccauugguuuugcuuugcuuuucucuuucuuucauuaaagggugcaaaugagacagucagggugacccccaaucagagaggggcaggaggaaggcucugagagggaagaaggaagugcuguuuacagcaaugcuguuuugggggccaauagaaccugcccguagaucugccagcagaacacgcugugggaugcuggcaugguggggauagguuugcagguggagcucaucuccuccaagcucugcaccuguggucaaggaccucuucaugggccagaaagugaggcuuaccucaagcagggagacuggagagaaagcgaagauguagcccaaagccauagugcuuugugugcccugcaacugagcuuucccugcagcuuucugucaacuuaucuauccgggcaaagggaggacaagagcuaggauguucugaggagagacuucaccugggacgugaaaggagcaugggcuugaugucagacagcugugacccuggacagggccccccccaccaucuguaaaacggggacaguaugauguaccuugaagggcuguugucagaauucuacgugauguaagucaagcaccuagcacagaucagucugucaauaaauggccaauguuccgugauuauuacccugaccuccaucaucaucauuauuauuaauggaagcaucaaaacaaguccacacagggguaaacugccaucacaacuucacauggggagcgucuuuuacaguggaccugagcuaucugcagggugacagggugaccgagugucuuaaaaaaggaaguggugucccacugugacugagauauaggaaguaacaugcucagggacacagaagacuggucggcaguugcugggcuccggccacaaagccacugcacaccugcaagccacgaggauucaugagcucugagccagugucucgggagugggagaccucauuuguggguauauuuaggacacagcugcagaaagagccacgugaaguuguccagggucugcgccuaccuguccucagagccguucugucacgucucucacccaggggcgggaguguggagccaccugcuguugucugcaaucccuggccuuggccccgagacuagucauaggaggaggagcaucaggguuggagccuggggaaagcugggggguuuccacggguuggcagguggaaggggccggugucacacacuucuccccagcggggaagguccaaguacagcucaaaaugagccucaugguuacccaagcuccagcucugagauacugggggagucaagggggaggugggaagggcagggccuguguuccauguggaguggccauagggaacaugaccaccccucagggaggcacugucacaugggagacagcacagaccuggccugaguguucacacacuggcucuuccuagcuguguggccuugagcaagugcuucaccucucugagccuuggcuuccuaaccucugauauggggauacucacacuugucucaggcuucuuacgaucaugcaguacucccugcguggugauaccuuccccugauggugggcuaucaacaugugaggggugugggcugggggcaggagggccgggccaccuagggucccagcuggaagagggacacaacauggcucuugcuggcagccccguuaggcaggagccagggacgcauggcacucacugaaucauugauaggcccaggcgcugagcggcuggccucucucggaagggacucucagcccccuccagaggacucagggaguuggccugagccuucucagggcuguuuguucuugugcucucaggcaauuuccaagcagcagcugaccucaccacccuccauuccacgucggcccgugccugccacauucucuggggagcccaccccgcagggcacagccaugcccuugcucuaagccccacugguccagagggaaugcaugagcgagagggauaaguggaaauuuaauuuuucauucugggcauucguucggguaauaacuuuacccugggcacaucuggaaagggaaaugaggagugacuggggcagggcagaaggugggcagcagggggugugcuggagggacacgcauaugcagaacacgugugugcugggccacugcacaccugcgcagacucgcuuuggcauggcuucuuggggaccugggccccugaggaaggagcacugagugguugcugggagaugagugaguaggcagggcuggagggcgggaugcccaggccagggaagcaugggaaggaaaauggcuggagcagagugggcagggaggaaggagcaaggccuucucucuguuggccacagggagucucugaagggcucucagccaggaagcaccguggcgagguguguggguuagacugagcauucagggggcuguguggauggcaccggcacacccguuaggagcugccaccaugagugagucccuagugggaaacaacaggcccaggcuguggcuguggcgaugggggcaccgaggagauggaccggacagaaucugugugugcuuccgugggcacaggccccagagaaccccuuucagaggcccuuacacagaggagcaguuucauggggugggcccaguggucacaaaaugaagcucccucccuucucccucugggguaaugacaagguggggagaggcccagggugcagccuccaccagacugaaaaaaaacagaugaggcagccucuaucccugugggugucgggaggagacaggccaggccucuccagcugggacccagccucucgccacucccaagagcaggacagggaggcugccaggguguaggauguccaucccagggugcagggcgucugucccaacucacauuuccagugaagcccgggcucaucccuugcaggugagggucacagucugcccaucaguccuggaguucuucagacccagaauugcgggccuugaaggccaguguccuggaagggaggcaggugugagccugcaagugugcaugcccagccaugguauggacaugugucucugggcauguaaaugugaaccagugugaacaggcuccgucugcaugcugagugugcaugugggagcccguggcugugccguggcaacgugccauucucugagccagcgaauggcaguguguugggaggucugagaaggcagcugcauccgugccucugggaggauucgguucucccccagcuugccgaggcccugccugauggucugacacgaggcacagcugcugcagcugcagauggacagaagggcuucccagagguggaccccaggccuccccacucucccuguggcuggcugcacugcaugcugggggguguaguucuugcagcuuccaggccuaaucugaugccggagcauuuccugccugaggaagcgccaggcauugguuucggaggcaaacccaaacauucucuuugaccccaaaccuccagauccuagauccagacuguaagcccuaacacuucacuccaccucagaucuauccaaagcccccagcaccagcccacccaccucagucagagaaccaggaccccaaaggcaugcagagcccccacuuccccacugucuuggccagccagggaccccagaagagagguuacaacccuucaggaauagggacaagcugcucccuuuguaagaggaugugagggaggcuggcugggccccugccagcaaacacaaaugacccugcggccuggcucuucucucuccucccagcugcggcccuugcagcucugcuccuggcacagagacaggagcuacuggcugaguguaacagcuggagggauggagggggaggggaggacgcuccacuccacgccagacagccccuucugcuugcaaaugaguuagauccccaugcuucuccuuucuucucucccucacucaguauccucacucgaaagucuuugaugcuggaaggucaucccagccauucugcugcugcuacacaggcccagcccuaaacaaaauaaccgggguucuuuggucccaaaagauccccaggaaagaguaaaccuccuuaagacuuaaggaaaaaaguuggcuaggcgugguggcucacaccuguaaucccagcacuuugggaggccgaggugggcagaccacuugagaucaggaguucgagaccagccuggccaacguugugaaaccccgucucuacaaaauauuagccggguguggcagugcgugccuguagucccaacuacucaggaggcugaggcacaagaauugcuugagccugggaggcggagguugcagugagccgagaucgugccacugcacuccagcccaggcgauggagcgagacucugucucaaaaaaaaaaaaaaaaaaaaggacuuaggaaaaagaauuaaauagaaggccuggaggagaaaaaaagccuagugucaucuggucccaagccaccacaccacuccuccugucacccacuccagagaaacaaggucccagugggccccaugcagguuuauucgagucucuccuuacaauacuugcucugccuagaacaaggcuuaucucuaagacauaaucuugccauuguagaauucauucugucguccaacagauacuucuugaacauugaccacaugacaagcggucuaggugcuugguauaaauccaugagcaaaacagacaaaaagucccuauccuuguggagcuuacguuuucgcauaggaggaaagacaauagauaaaauacauuuuuaaaaaauauguaggcugggcgugguggcucacaccuguaaucccagcacuuugggaggcugagguggguggaucaucugaggucaggagugugagaucagccuggccaacauggugaaauccccaucucuacugaaauuacaaaaauuagccgggugugguggcacaugccuguaaucccagcuacucaagaggcugaggcaggagaaucgcuugaacccgggaggcggagguugcaugagccaagauugagccacugcacuccagccugggcgacagagcaagacuccgucucaaaaaaaaaaaaaaaguaguaauuuugaaggugauauugaggaggaaaaaaagagaguaaggggaucccaagugcuagggaccacacagguggagugggcuuaugagcugcaguuuuaaauaggguaguuggggaaggucuugaugagaaggggcuauuugagcugugucccaaagagaguaaaggagugaaccugggggcccuggggaaguggcuuucagggggcagggcagcccgugcagugugugccaggaguggggcaagccugcaggaaagcgggaacagaugacuucagagguggggcggggcguagggcaagcagagcacguuaaggcucuagggagagucauuggagggcucugagcagauauguuacacuucaacaggauuugucuggcugcuguguggaaaacaguccacagagggaaaggauggaaucaggggagcaguuaggcagcuauugcaaucaauaauccagaugaaagaugagaguaucuuggaucagggugguagugauggagacggugagaagagaucagguucaaggugcauuuuuuuuuuuuuuuugagacggagucuugcacuguugcccaggcuggagugcaauggcacaaacuuggcucacugcaaccuccaccucccagcucaagcaauucuccugccucagccucccaaguagcugggauuacaggcacccaucacuacaccuggcuaauuuuuguauuuuuaguagagacgagguuucaccauguuggucaggcuggucuugaacuccugaccuuaggugauccguccgccucggccucccaaagugcugggauuacaggcaugagccacugugcccagccugcauuuucaauuauaacuuacaaacuaguugggacaccagucauuccugugaaacagauaagaccguacacucuaccauacugcaaugauguggcuugagagguccagaaaauucaaccuaguugaggaagauguaggagagcuuuauuuuuuauugggucucugcuguugaagaaagcacaaauguaacaauagugagcuuauagacuacugcaacacacugaaaugagucaaucccaaaugaucaugaggcugccacuuccucaaacccuguccucauuccugcagaagagaagaacuuuagccauuugaaaacuggcagaaggaccagagccagccaugguaacuucuaauuugcauuuauuugcaauuuauacaggcuuuaccaugcuaugucaguaugugauuaauggaaugaccuuagcaauugucacaaccagaaugagaggugcagaccauuaguacauaaaaauucgaaagagaaaaagaucacgguaaacuggagaagagaaggcuccugaagaaggggcuggagaagugcaaucgguggggagggaggaugaggaaaggcacuccuggcggggcaaacugcauguguaaaggcuugcaguaaggaaucaacuuggauaacaaggacagcaaggaaggugaguugaccaaacccaagauacgguugcaugauggaagcuuugaaggccagacugcacagcccaacaggcaguuggggagccauugcuggucuuugagaaagcgagugguugugucuacagagugaagauuaaccuggugacugcggguggggugauucaaggcaggcagaggcaaaaggaaagugggagauuuaggaaucgaccacagcaguaaaaccuggcauaaguuccaugguggugacaguggcgacaggaaguuguaucgaauggagaggguuuagaaggaagauggcaaaccagguugguacagauggguuuugaagugguggugagaauuccaaaugagggugugcuagaggucaguuuuucuaauguguccaccuagauaucaguuaugugagacugucuuggaggcaggagguaugggguucauguuccaguauguugggaaacauggcauuugacgugucccucuaguaguucacagugugcacgagaagguaacaggcucugaugcuuuugucuaagccaacaucucgaccccccuauuuuugcugacccuuugagccaaugguuugagauuccaugggccacaguuugggagaugcuguggagauacagucccagaguugggcgagaacuauguacccuaaauaauuuggacagccagcaggauaagggugacuccagaaguugauacuagucugucacuaguaaagaaagcagagggucaaggcugagggucccaggacaaagcguccagcgagacagcuggaacagagaaaaggagcaacacagcuggagauagcacucagagaggaaagccgagaaccacggaaucuuguaugggaaggcaagggacauguuucagaaaaauggcagcucccuccaucuggaugcuuccuuauccuccuggccucuccaaguccggccuccuccaagaagccuucucuaaugccaagacacaccaccccguuccccugcacccugcacuucccugccuguucccuuaacaucugcaugugcugucucugaguguccuuugcuucccuggggaggcugugaguuucucauaucccgugacuagcaggauagaugcucaguauguuugcugaugggagggauggaugaagagaggaaggcagguguagacaggagagaucauucagaucugggugagaaccgaggaggggggcaggcaggcugaguacagaggaggcuagguucuucccagcugccucuggggaaccccugguggaggcugcucccaucucguggggagcaguugcggggcccuuuugagggcgguaaacagaugggaccuggugagccgggagaugcuugagguuccagggaggcugcugcggagacaggcggucaggacaaagaucccauggauauguacugggcagcugcuggcugaccugcaccgaggauggugguggcagguggggagcgggguccuccauggcagugcuccucugccagugcccacguguauaggagccccugggggguccuggcucagccgcgugaccuuggaugagugaguggccuccccuuccuugggcccuguguuuucgucagcccuucccgcccaaauuccuggaaggccuuuccucuuuccuagaaucuccacccugcugcagccugccgagugggauagcaccccacacacgccccaggaggagggagugggcucagggaggagcaugauucccauggagugagagauacugaaucagagagugagcuggcagcaguauacaggcaaacaguauacgggcaaacuggcccuuuacgugggccuggagcaaggagggccugagcggcugaggucagccuucugggcuugcccuagacccgcagccuaguggcucugaccgaggccagcuguggucucuggugccacccugugguggugccaggaaccauuucccuuagccucaccuuagggccucuuuggcccguggcauggcccugguuucagccaccuucccaggcccuguaaggcaagggaaggggcaguguuggccaaagaacaguacuguggcccggccccacuggcacagaaagccacccacccagccuucucuccugucccaccugcuuccuuucucuucuuuucaccuuuccugccuccucauuuuggcuguguccacggggcauacagauuugcacacucauguucaucaugucggcacaggcaugcaggcccucccagcaugugcucucuggguggcaggcuugcuaugacggcaagcguguaugccugugcaugugcccacuuguguguacucgacauugccacgcacgcacacacgcacaugcuuucacccccauuucugccguccuugcccugugcuugugcccugccaugcuggugucuuacacuuauaacccaggcuggcagcacugccaggcccccaccuugcccugcaggcccagaccacagccaagaaccacagcccuaguuucuggcaccuuggcagcugauuggcacucacggggcaucuccugagccagugccugggaaccuguuuucccugugcccugcaggcagacaaaaucaggugcagaacaccuagguggcuccugguucugggucuuggaagccaaguugauaguguuggggcagagugacugccaggugucuggcagagggguaucagugacauuugcacacguucuaugugcaggagaagcaacgaugcaucauugcuggguggccucaggcaaguucuuuaaccucugcaagccucagcuccucagauauccaaugagaaugaauggcauaccuccucaggguuguggcugugaauggcauggagugggcagugugcugcagcuggaacuggcacacgugucucacugcaccaugaauagggauugagcugggccagcaccacaccaaggacaguggggauggaagacccuggugcuguggguacugcccucugccucuccucuugccugucucucacuccagcuaccaacgcugcggcauguuagggcuccaggauggguggagugcugcggggccucgaacuggagcugcucaaaccuggggugcagacagccuguccuuccuggccucuccuuucccugccucccucccacccccucuacaccccaggagcacacgcugaugcuguccccuccaucucuuuuccucacccagaauuccccuacaccccgucuccucccgaacaugggcggcgcgccgggccggugcccacggccaucauugggggcguggcggggagcauccugcugguguugauuguggucggcgggaucguggucgcccugcgucggcgccggcacaccuucaagggugacuacagcaccaagaagcacguguauggcaacggcuacagcaaggcaggcaucccccagcaccacccaccaauggcacagaaccugcaguaccccgacgacucagacgacgagaagaaggccggcccacuggguggaagcagcuaugaggaggaggaggaggaggaggagggcgguggagggggcgagcgcaaggugggcggcccccaccccaaauaugacgaggacgccaagcggcccuacuucaccguggaugaggccgaggcccgucaggacggcuacggggaccggacucugggcuaccaguacgacccugagcagcuggacuuggcugagaacaugguuucucagaacgacgggucuuucauuuccaagaaggagugguacguguagccccccuuccagagccucugucugugaccgcuccuccccagccccuccccgcacgcccccugcccaccccccaccucccacuccaggagcugaacagagacuugcccagcugcccaaagccagccccgaacuccuggggggccaggggagcccagggcagccacgacuuggcuuuguguuuuauuuccucccucuccuccgcccuuccccaugguguuguguucgacuguggcuuuaguguuacuguaucuucccuuuacgggccccaccugccugcccucuguguagggagcccuguucucgucuuguguaccugggcaucccuccaggguuuggggagccagccucccccgccccccuacacuggaauuuguuuguguuucuucacuggggguggagggcucaaggggcucuaagagggaaaagcuccccacacccccagaugcugcuccuccucccggcuagagggaacccaacacccaccagugaaaucugaugcagcugggaguuuggaccuugggucuagacagcuggugcgcccaagagguagggggaggggugcggcuucuccccaguucccagggagucuuguuuguuaagcggggccuugggcaguguuuuccugcugagggugguuuuacauuuuuuuuccucauuggcccacagagaguggaguuggccuagcucugacgcguccccucuuuauccccaaugugcccccuccauuaggggcuccaggugggcuccagcccacacuugcucucugccucugcugacacgugcacacacacacacaugcacacacugcuccucucugccugcuuuccccuggagucccaugcccugccccauccagacacugcccaaggcccacccgucuauuuccaccucauucccccuuuaagcugagaauggggucugccuauagaagcuuccagagacagcugagacuggguccccggugccuccacccuaggaucucaggccugccccaaacugcuucuuacagcguggagguuucucugauuucucccuuaucuagcaacacuugguucuuuuggcuagucagggcugggaucccagggggauccaccugcaggagucagagguaaagaagcauccacacggaggguaguggggaaggaagcccacauggcagaagcucugcaaacacaguccgagggacugaggaguccauacaaugccucacacacaaaggccauugucaaagccucgggccuggcagaaagugagggggguggggccgcuaggccaccuccugcucagccaccccugguccucauucugggaugaggggagggccuaggagaagcccucccuuucagugcagauucccuucuugaaugggacauugaguuccuaucagccaccccagacugggucuucccauguauauaauggaggaagaccccucccagcccucucagucccccagcucaaagugccucaguuccuccaucugcucccagauccccuggcacucuagacaggcaugcccaugggaaggacccugggauggagaggcaggcuucgcggcccuucaugccugcccacugggauuccaguuaacucaccccagggugucaggggcucugcaggauggcaaguguuggggaggagggaggcagaccacucugugccccacgggcacugacccacccugccauaggcuuccuaagggagccccccaaccccuccccuccccucccuggugcugcuauugaacccccugccagcuccauuucugcccuggcaacccugggcccagcaggugggucgucguugucuggcccucacugcccuggccccagcccaggcugcccaguagccacguagcagaagucugaagccaugccagcccuggugcggcucuccccucuacacauuugggguacuggauagggugaaguuaggggagaaaauuguggagucuuuccagccacagggcagagggagguggaggagcugggcugcuuuucccagcaguauuagugucccccaggacaggggaccuuuuccacauuacaucacugccccaucccaccuuacaacacucuggccccucugcuugguccccuuuucccccaggcaggaggcaaucccaggggccugccugauagaggcauuuccugucccugucuccuccugcaucuccuuuauccugcacugccacccucuauuccccauucuguguuggacuuugaaggccccaagcccagccaaagcacugaguucccccuuaagacaccuccacacccuccccacaagcaaagcacaaauuuugggguccauguagcaugggccacguaggaggcuccugacuugccaggggcccagccucagcauacccaccgagcagcugccagccugggcugagggugggcaugaggcaggagucagcacuuggaccuagggaugugagguuuucugugccccaaguuugugggaaggugggcacuacugcugggcccacagacacagccagcuggcaaaagggaggucuagcccagcagagagaugaggacauuuugcuucuccuucaugcccacagcaugagcugagcuucugcuuugcuggaaaugaaauaaacuugguaugaauugugccaaggccuccccaguugucauccugccucuuguugcccucccuguccuugccccccaccccacacccaugccccuguuuccuuacagauuuugauauuguucuaauguguaauagaaccagccgaguccccuuuuaucagaagggucugaaaagcagcagcacagaguaggugaacacaggccugcaagugcgaccaccucagacccaguacgugugcccacaguggacacacucacaccuccaacacacccacgcgcaggcauguguacacgcauguacacacgcaugcaugcacagccagauggccacucagcacagauguggcagagggaauggucugauccugcugaaagccauuaaggagaaacgaauuucccagugcccgggcugcaagagagccuuauaggggcccuguuuccugggcaugcgcuuccucugccagccaacccccacuugcccaagucacuggugcaauaacuuuucugccuuccucagagcagagaaauugggaauuguguuaggugggugugggcagcucugcugagccaagcagacacggauguccccucuucugggaggaggguagugcucccaggccucaggaguccagacagagacccccaaagccugacugccaacagaaacccucuccuagugaggggcaggugggugugccccagguccccacacccacagggaggcuucacacacugcccaguaccggggaugccaggaggcaggccccucugcugcugccacugcugccaacacugcccagcuugugaggccaggaggagccccugucccacucggugcugcugcucuucugaccccugcugugaggaaugggauucuuggucgaaaaaauugguuuuccuuuuuuguauaaaugaaaagaauccaggagaagcugccacccuccccucccagcgugaugcgcuaccuugcuucggcgucuugucgcccuuuccgccuuugguccagggacagcccagcagauccuccugguucugaccugggggguguuugcaucacccccuuuuacuuguauuaaaaaaaaaugauggguugaaaauguacugaggauuaaaaauguacuuuuuuauaaauaaaguguuuaaaacaaa

SEQ ID NO: 15949 - RNA, 9098 nt, Homo sapiens
caguggugcaaucguucugggaagcgauagaggccggccugaauucucuguggcaagggaggggagcccaagugggaggccccuuggggacaccgaggaccagguccgcuacugcuccucccccaggagguccccuaggggcuacauuggcuggcaggggcugagcagcggugagccuggcuggcuucgacccggggcgacuccgggcauccgggacagcuucuccucgcugccaccucggccagucagaccccgagacaccugucacuacccccucagccuucccaagccaggagccugggaguccggcucuggccuaccuccggcagcgcuccuaggcgcagcucccgggcuggcggcgccggggcccgcccccuagggcugcggcgcgcggggcgggggcugggggcugcgcggggcggggcgggcccgggcgcuccgggcccccucccccgccccccugacgucagcccccggcagccucgagcugcucacuuggcucucgcccuccggccgggaagcauggggcuucccaggcuggucugcgccuucuugcucgccgccugcugcugcuguccucgcgucgcgggugaguucgcucgcaggggggccgcgccccggcuaggggucugcgguggagcgugccagggagcagagccagcggcgcggcggggucggggcguugcgucugggaggacgagccuccucccuggguccccgauccccgggcgccuugcgcgcgagcaacucuucuuugcagccaguuugcagccgggauucuagaguaucccgggagcagcacucggaaggcggggaggaggcugcuucugggaacgagaagggguggagcucagccuuucggggugcugggggguggguggucccugaggugcucacucugggggcccgcaauugaagccgggcaggaggcgcagcuggggcgcauccucaaagccugaauuccgcgcccgccuguugcuggaaaaggcagcuuccuucgcuggagggggugcgccgacccaccccuucccccuucugccugggcaucacgccaggcuggaggugagcgagagcgggagguucggcggcucccgcccgagcugggcguuggcagggguugcggggcggugugggucgccucgcgccuccccgagugaugggaucauaggggacagagaugagggauggaggauucccauacuggaagcgcccgcuggcuuauuuuggggaccacauucaggugggaagugcgcccgggcaccucggagcguuucuccggauccgccugguagcagggcgcucucggguccacgcugcccuuguauggcccgcagcggugucgcguguuucucuuggcucccauuccgccgucccagccgcuguccggcuggggaaggggagggcuaggcaauacccagcucgcuggccucaugcccagugccaaccaugucccugggguauuccaggcuacugccucccaggcugacuuuauuucuggggaaagggcuaaaucgggcuccacaguugcagccgguccagcuccacccugcccugcucuucuagcucugggaggagucaggggucugaggcucuggguuggagaccccaccuuccaccugcccuccuuguccgagagccaagguaacaacccaggcaucccagagcccaggcagauggugucgagugacaucaccuccucacagggcuggcagcacgcuggcaccacugacgucacuccugcccacugccuggcccuugcccugaccccugggggagacucugaccucuccauccuuaccagcuaccuagggugggguccgcgggugugugcggaguguucauggaggugcugcugagggagcaugagaccggaacuuccgccagaguuagcccgcuggggagugagggcagggauuuuggagggcagaggauagagcaguggugucuuccccuggcgguggugacacaaaagggccugugugccccagccuggcacauucuuugcauucccacacucugagcucacccggagaggagggggccuggaaggaaaggggccuuccucuuggccccgagccuagguugccccuuucugccccucuaccagccucagcuggagcuguucggugcucagucucugcucaaucucugcuuggcuccaaggaccugggaucuccuggacggggagagggcuggcccagguggggcgcgggucgggguggggguagagcguucagaggacagggcccucugcagacccucugaguggcaggaaaaacagcugcagcagcgcugcgaggggaggggcggacagcagccggagcugacacagcugcgggggccccgccucccucccccaggugugcccggagaggcugagcagccugcgccugagcugguggagguggaagugggcagcacagcccuucugaagugcggccucucccagucccaaggcaaccucagccaugucgacugguuuucugugagugcuugggcuccugcaagagcagcccggggagggagacucugccccucuuguagcccaggacccuucuccuccucugugucuccucccauuagguccacaaggagaagcggacgcucaucuuccgugugcgccagggccagggccagagcgaaccuggggaguacgagcagcggcucagccuccaggacagaggggcuacucuggcccugacucaagucaccccccaagacgagcgcaucuucuugugccagggcaagcgcccucggucccaggaguaccgcauccagcuccgcgucuacagugcgugacccugugucugccagcaggguagugaggguggugggacguggccagaugucccccucauuucuauuuucuuguagaagcuccggaggagccaaacauccaggucaacccccugggcaucccugugaacaguaaggagccugaggaggugagauguguggcaggugggcugggcagcuggugcgcagccgcugagauggggcuugaagggggcucggaggcagggagacucacacccugugcucuuuaggucgcuaccuguguagggaggaacggguaccccauuccucaagucaucugguacaagaauggccggccucugaaggaggagaagaaccgugaguagcccuuucucccaaaagccacccuugggccaggugugguagcucacaccuguaaucucggugcuuugggaggccaaggcaggaggaucucuggaggugaggaguucaggaccaccuuggacaacauagggugacccugucucuacagaaaauaaaaaaauuagccaggcaugguggugugugccuguggucccagauacuugggaggcugaggcaggaggaucauaugagcccaggaaaugaaggcugcagugagcuaggauugcaccaccacacuccggccugggugacagagcgagaccccaucucuuaaaaagagcugucccuaugguacuacacaggaacugccuuauauuuucauuaagcuuuuaacuuaaaaaaauuauacaaaugguacuugaaaauauuuucaugagaauuuaaacugacaaaaaaucuagaaguuucuucuugccugagacccccccucccagaaauaaucucugcuaucaggguguguucuuucaagccuauuucuauguauuugcucauauauagaaauauuucuagaaugauauaggcuucuguguuuuauuaucuaaaucagucauucuuaaccaggggugauuuuguacccccuccuccuaggagauacuuggcaaugucuggagauauuuuugguugucacacauagagggggugcuacugccaucuaguagguagagagaccaaggauguugcuaacauccuauagggcacaggacagcccccacaauaaagaaucaacguggccuaaaacaucaguagugcuggcugggcucacgccuguaaucccagcacuuuuggaggccaaggugggcggaucaccugaggucgggaguucaagaccagccuguccaacacggagaaaccccaucucuacugaaaauacaaaaguagccgggcgugguggcgcaugucuguaaucccagcuacucaggaggcugaggcaggagaaucacuugaagccgggagggagguggagguugcggugagccgagauuguaccacugcacuccagccugggcaacaagagugaaacucugucugaaaaaaaaaaaaaaaaaauuaucaguagugcugagaaacccuggucuaaguggugguguaugguauacauuguuagacaauuucuuuuauacaauguuucugggucagucuauuuagaucaacugaucguuuugcuuacugccaaguuuuccauacuacgcauagcagguagucgaguucaccauuccccauuuaguggacaucuagacggcugcucguuuuuaucauugcagcauucuuugcacacauccuuggauaugagcagacaugaaaauguuuuucuaggguugacacugagcaguaaaagugcuggguugaaggguuuccagcuugcauuuguaccuggccuucuacaggggacagggggcuauuuagaugguccccugccaaccccaguggacaacccuaggguggggcuggagguggggcugaggcugagucuuccuccccuuccucccugcccagggguccacauucagucgucccagacuguggagucgagugguuuguacaccuugcagaguauucugaaggcacagcugguuaaagaagacaaagaugcccaguuuuacugugagcucaacuaccggcugcccagugggaaccacaugaaggaguccagggaagucaccgucccuguuuucugugaguacuaaccugacucucugcuuacuggggcuggggcugcuggaaacuccugcuggcucccccuuauccagcccaggguugacucaugggccaagagcuacccccuuugccuaugcagacccgacagaaaaaguguggcuggaaguggagcccgugggaaugcugaaggaaggggaccgcguggaaaucagguguuuggcugauggcaacccuccaccacacuucagcaucagcaagcaggugugggggcuuugugcugggugcagguggggaugcaagcagagacccagguggaguggcgggaggugcacucugcucaccuccccaauccucccuagaaccccagcaccagggaggcagaggaagagacaaccaacgacaacgggguccuggugcuggagccugcccggaaggaacacagugggcgcuaugaaugucagggccuggacuuggacaccaugauaucgcugcugagugaaccacaggaacuacuggugaacugugaggggcuggggacccaggacagggggaccaggcuggggcaauagggaacuggccccacccugcccugggugacaugauugcuguacccccagaugugucugacguccgagugagucccgcagccccugagagacaggaaggcagcagccucacccugaccugugaggcagagaguagccaggaccucgaguuccaguggcugagagaagagguacccaggcgggucuggggcaaggggcugaugggguggguggggcuggcggugacaagaaugugcucuuucccagacccucugacccaucucucaucccagacaggccaggugcuggaaagggggccugugcuucaguugcaugaccugaaacgggaggcaggaggcggcuaucgcugcguggcgucugugcccagcauacccggccugaaccgcacacagcuggucaacguggccauuuuuggugaggcccucccucuggguagagaccaggucaccccaaguggggugguuuuuaagcucuuugacaaaaagccaccugcugcccuggggagcucuggugcggagggggaggcaggcuagcugggcuugccaccucaccucucccuaccuccccaaggccccccuuggauggcauucaaggagaggaaggugugggugaaagagaauaugguguugaaucugucuugugaagcgucagggcacccccggcccaccaucuccuggaacgucaacggcacggugagcgggugucucaucugccacacucuccuaaucccugccugcgcuuuguggccaggaccagagauccuccccauccccugagcugccuccuuccuuuccucgcaggcaagugaacaagaccaagauccacagcgaguccugagcacccugaauguccucgugaccccggagcuguuggagacagguguugaaugcacggccuccaacgaccugggcaaaaacaccagcauccucuuccuggagcugggugagggcugcaucccugcaggggauggcaggggcaggcccaggcacgggcaguaacuugcgcuucuccuaacaccccucccucugccuccuagucaauuuaaccacccucacaccagacuccaacacaaccacuggccucagcacuuccacugccaguccucauaccagagccaacagcaccuccacagguaagccaggccuggcaagagaacagggcugugccagggcauccuuucugcccugucccuccccagagagcccuguccagaaaggugaguagcagccccaucuugucggcccuggacuggcugggccaacgauggugacgaaguggccuggggcagggagugacgaggagugucuuuguggcgcagagagaaagcugccggagccggagagccggggcguggucaucguggcugugauugugugcauccugguccuggcggugcugggcgcuguccucuauuuccucuauaagaagggcaagcugccgugcaggcgcucagggaagcaggagauguaagcccaacaccggccccuccgcccccgcccguuuugccacccagccugcugccugcccagcgcccgccugccccuugacagcaggaguggggcccugggucagggugcugccugcuccacuacccacugcccagcuuccaucagccacauggucucaugaccugcuucccugcccugggcuggcccuggagcaaggagcccucauccauuccacauccuucacagcgggcccuucucuuccuguggcccugagauaccaaccucucaccucccucccuccucccagcacgcuacccccgucucguaagagcgaacuuguaguugaaguuaagucagauaagcucccagaagagaugggccuccugcagggcagcagcggugacaagagggcuccgggagaccagguaggaggcgguuccuguggccagagccugccacauccucagggaccgggggcaguagggacuaacgguucucucuauccuucaucccucuuugucagagauagggagcaggccccaucuugccuucuuaacacuacucacagauggcagggccaagcaaguggcugagggagcuuggaggaagacugagaaagacccugucccaucaccuuuuccugaccaaugcccguggcucuggguguggccauuucaccagugcagucagacgggggccgcccuccuucccuggccugccaugcccauccuagcuuccuccccaacgcugcccaccaaauucaucggcuucugcuuccaucucuccuuccucucggugcucacaccuucaacucagcaccgucuccguguuccccucuucuccucuacccacuuuuagggagagaaauacaucgaucugaggcauuagccccgaaucacuucagcucccuucccugccuggaccauucccagcucccugcucacucuucucucagccaaagccuccaaagggacuagagagaagccuccugcuccccucgccugcacacccccuuucagagggccacuggguuaggaccugaggaccucacuuggcccugcaaggcccgcuuuucagggaccaguccaccaccaucuccuccacguugagugaagcucaucccaagcaaggagccccagucucccgagcggguaggagaguuucuugcagaacguguuuuuucuuuacacacauuauggcuguaaauaccuggcuccugccagcagcugagcuggguagccucucugagcugguuuccugccccaaaggcuggcuuccaccauccaggugcaccacugaagugaggacacaccggagccaggcgccugcucauguugaagugcgcuguucacacccgcuccggagagcaccccagcagcauccagaagcagcugcaguguugcugccaccacccuccugucugccucuucaaagucuccugugacauuuuuucuuuggucagaagccaggaacuggugucauuccuuaaaagauacgugccggggccaggugugguggcucacgccuguaaucccagcacuuugggaggccgaggcgggcggaucacaaagucaggacgagaccauccuggcuaacacggugaaacccugucucuacuaaaaauacaaaaaaaaauuagcuaggcguagugguuggcaccuauagucccagcuacucggaaggcugaagcaggagaaugguaugaauccaggagguggagcuugcagugagccgagaccgugccacugcacuccagccugggcaacacagcgagacuccgucucgaggaaaaaaaaagaaaagauacgugccugcggugaggaagcugggcgcuguuuucgaguucaggugaauuagccucaaucccccguguucacuuggcucccauagcccucuugauggaucacguaaaacugaaaggcagcggggagcagacaaagaugaggucuacacuguccuucauggggauuaaagcuaugguuauauuagcaccaaacuucuacaaaccaagcucagggccccaacccuagaagggcccaaaugagagaaugguacuuagggauggaaaacgggccuggcuagagcuucgggugugugugucugucuguguguaugcauacauauguguguauauaugguuuugucagguguguaaauuugcaaauuguuuccuuuauauauguauguauauauauauaugaaaauauauauauauaugaaaaauaaagcuuaauugucccagaaauca

SEQ ID NO: 15950 - RNA, 4979 nt, Homo sapiens
gcaggacagucuggacaggcucuuggccaagcugagagccaucaagcagcagugggauggggcagcacugagacuucacgccaggcacaaggagcagcaacgccaguuuggacucacccccccuggaucuuugaggccaccagccccuagucucuaguguucucugaggccccagcaauaaagugucuugauguagaacucaauagagcugugggcucuggccguuuggcagagagaaguggaucuuauuuuuauuuuuauuuuuauuuaguuuucuucuuuuuuuguuuuuguuguuguuuauuuuuaggaguggcugucauacagacaucucaguucuggguugacccauuaucccugagauucagugauugauaggaaauaaauuugaccaggucucaaccucucuccugcaggagccgcaucccaccccuugagccugaggcccuuuuggucccuucacaccacugccccuuacccccaccaacacaaacacaggcagucagauuuauggcgaauggccauuucuauaacaaaugcaacggugaccaagcaccacccucccgcaaugcuaaggcacccacagagggcaggcauagcuggucuccaaauuuuugcauuacacucaaggguccuggagucauaucuagaaaagguccagauggcuucaauccuagccagacccacagccacaccuucauccuugggacacagcucucuaaaacucccauaugacauccucuggagccucagacuccuucagggaccugucugaggccuccaaccacacccucugcuggcaggugggccugcaggaagggagggagcaccugggccagccugugaucgguggugucugagucccucuggucuggcuuagagagagcauccugccuucaccaccucaggcuggagagugaagacacgguagccccugaguaugucuguaccaagcaggggugcucuacaguagauccgaggccagagcccaguccuauacagagagaggagguagaaggucauuccaggugggacccagaagaguuccuuuuucuugccccgcccugcacuggaaugcccagaaaugggguuuauuucacgaguccuucuguccccaccuaccacgaccugaagucccaaccugcauaccccacacggcuucaccuuguaccucgcccacucugcccuucuuucucacuccucccugcccucuguagcuacucacagucccaucuguuucuucuuccucaccucugcagccccagggggaauccaggcuuccaagccccgcagagaccuggcugccagcuucaggcagagggguggcucagccucaggcagcugcugaagccucuccaggucauucugucccccaacaggauacccguucacuuccagaaucacgucucccacuugcagcccagcccgggcagcugagccuccuggagucaccugguguugugggggcaugcagaacaggggacaccgggggaaaguuugcuggcuuuaggcucugggagggaagcagaggaagaccgaucaggcagcaaaggaucgaagggauucaagauccauggggcaucagucaccugggagaugaagagacgaggcccacuggccacacaacugagucggaagccauagcugccaccaggcccaggguacaggaagcacugucgggagccaagagggacagaaggcacgcuugugucuucaagugaaggguccucugucucaaccagugaggcugagcugcugccccggggcgaggcgggagccucuguguucuccaagaagaggaguggggacaggcgaaccuggaagguggcagggagagcaaaucuuucggaccucagcccugccccacuccugccccaacccuagccccugccccucagcacgcaccaugcugaagaagcgguccgccucagggucgacgacagugagggagacacaggagcccugccccuggauccuggacacugucuccucauggcccagccccuccacgcucuccccagccacagccaccagccgguccccagccugcaucccagccuucuuggcuggcagucccggguccaccucccacaggaacuguccuggggcauagacauccucacugcuccucuccagcuauccuaggccacuguguacacaccaggggacugaccccagagugaacgggaagaggcggcccagggccagagcucagacagggacaccucuucggugcacugaaagguguauauacgcuugugugcccaccccaaggcccaccuucccccaccgcccccagggcucccacucaccagggcgaccgucaaggcccuuuuccucccggagcaggaacccaaaacccuggggcccuuucuccaggugcaggcagcggggcuuggugggcagugcccagcccucugccaggggugcagccaggggcaaucccagcuggcgacacuguucuuccaccucuggcccugccaccagcaaggucaccugcuguccacucugccaaagcuguggggacccagcagggcaucaguauaacaccugggcagggagagaagagguaugcuccccccacagccccuccucccaggcacuaaguggagccuggcacaaacuguagagggggaggauggugauaaagguaggagaccagauaaggagguuaggcgcauggggaaggaggcgucuucccgagguggggcccaggcccggauugggggaggagagugggagacaggcagucacaccuuccuggugaguugguugugagugaacuucuccacacugaccccauucacuuccagcagccgggccccggggggcaccccugcccgcucagcugcuccuccaguacuuagcaccaaccagaaaggacccugauugccuagaaauuaaaaaaaaaagcaagguccagucuguuuccugccugcccugaacaggggcugagaucccucauccuugccgcccccucgcacccucugggcucaccaugggugacacugaagccaaaaccacccucaucuuucacuauguggcacagccggggccggaccccugggccuagggugggacagaggugggcaucuucucccagcugagcucgggccacgucaugugcaugccgugccaauacugucagcaacacccgagggcugcuggcccggaugcggcguaccaccuggacagagggcacgugggcguggguuuggucuagacccucuugccaacccccaggaccucccuggaauccacauuuuuuugccaagggaaucggcuuuuuuucuuuuucuuuuuuuuuuuuuuuuuugagauggaguuuugcucuugucgcccagguuggagugcaauggugcgaucucagcucaccgcaaccuccgccucccauguucaagugauucuccugccucagcccucccgaguagcugggauuacaggcgccugccaccacgcccagcuaauuucuguauuuuuaguagagacagggucuugccauguuggccaggcuggucuugaacuccugaccuugggugauccaccugccuuggccucccaaagugcugggauuacaggcgugagccacugcgcccagcgggaaucggcuuucuagaugcuuucccuaccccucugacuugggcacuucuaaauccuggggugugggggagugaggcuugugcccugcugccauacugcccaggggacugagcaacccgcuucucuuucugaggugcuagcaugcucuccuggaccacagccuuaccaccgcauagucuucguguuccacaacaucauuguucaccgccaggauccugucuccuuccugaagacccuggcgcugggcagaggugccuggguccacccugcacaccacaugcccagcccugcccagcuccugcugcagguggaagccaaaacucuugcccuccucuuugcucaguaaacagaagcgaggccgcuccaggcuccagggaucuggagggugaggugggcagcagaaaagggggaggagagggcacagcccaaguacagguucgccgugugccuggcagacccuguguccugauagggugcugggcaguuucugccugguuggguguuggguggugggguucgugggcagagggacugggacaggagaaaacacccggccccuccuaucucuacucccaaccaaggcuguuaucagagggagaccgagugagugguuaccaaggagaucggaggccguguggagccguggugccuccagggauagggaaugguugccagggggugagggaguuaccauaggggucguggucuucggccagggagaggacaggauuaucaaugcccagcuuuggguuaaacuuaaacuuccugcaaggaggcaggggaagcagguacaagcuggcagcuggacuugggucccaggaucuccuuuaggugcuaauggcagugaagcgcuucgcugccuccaauuauuuccuccccuugccccaacccucguggcacuuacagaguuaacgaggcuguguccugcagaucuacugggcaaagaagugggugagaggaggagagucacauucuucuccccagaugugccucuuccauuggcauaaacuaaaaggacucagggaaacccccaaacucagggcaugcccccuccuuucugcuccaaaggggucuucucuucucacugccauacacacaggacuauugugcgguccccucccuuucucuccccccaaguccuuggcacauaaaucugagcauaucaguacaggguguggaccaggaagacagacauaucaacucauuacuuuucuccugacuuguuuaccugccucagggcuccaagccccaaaaucaagugugcccuggucccaaagcuucagccuccaagucggcccccugccugucccaaaguccccugcagaggauuucuccuggccuccuaccugcggcuuucuccauagcuggaucagcaaccc

SEQ ID NO: 15951 - RNA, 10628 nt, Homo sapiens
cggcgcgggugcggcuccuuuaagggcgggugggggcggggcgccggcgguguugucagugucagcucugcgcacgcagcccucccggagccggugccggcccgcgagccccagcgucucugcagaccaguccccuccaggguccggcggggcccgcgcggugggaggagucgggcacuggccggcgacuaacggguccgacugcugaccaagcuaggagagacccggaccacggagacagagaccccggcaucgcgacccccgaggaccuccucuccucgcccuguggcacccacuaguccugggcacucagccgcggagagcccccgaccccgcgcgcccagccccgggggagcccaccuccuccccgcggcccgcccgggccaugcucccccggggcagcgggugagccccagccgggaccgggaucggagcccgcgcggagcauggauccgggcugggggcagcgggacgugggcugggcggccuugcugauccucuucgccgccucgcugcucacgguguucgccuggcugcugcaauaugcccggggcuuguggcuggcgcgggcccgcggggaccggggcccgggacccgccuuagccggggaacccgcggguucccugcgggagcugggcguguggcgcucgcugcugcggcugcgggcgacucgggcuggcgccgccgaggagccaggaguccggggccuccuggcgucacucuucgccuucaagucuuuccgggagaacuggcagcgggcuugggugcgagcgcugaacgagcaggccugcagaaacggggugaguuggaccaagcgcuuggguggucccuucagccuuuccuuccaggggagggacugacugcucgugcuaggaggccagacgagggugggcauaaacuggggaacccuauggcuucucuuccccucccggaucagagaaaagggugccgcuaaggcuggagguuguagaaauccaacuggguccccagacuuccauuucugugggcaagguacucugguuccaaacccaugcacaaguugcuguucucauagcaacgcuaaucccugugccugagggcacuuccgccuugccugggugcugguuguguuggggcaugggagacaggugcaccugcagaaggaauuugccugcuucucaugccaccacacccauuuaacauuucaugccccaaaucccugguguggucaggcagauccccaaggagccugaaucaccccccuacccgacaguaauuucacugcuacagucaaacacauccuucuccuccaugcuggccugugguucacuggggguuggggaguguucagguggagagcagauugacagugccccuaccaguagaugagcuuggaacugccccuugagggucagucacaaaccaguccagccuacuuccucccauugcaccaugggcaucuggccucccaggaaguggggcaggaagcguggucaugagauggagauaaggugggagguagaagucucucuuuucuggagcucccucccauccugacccagcaaucucuccuugcucucacaguccaucagcuccuugcucagaggguucucuauuuccagccacuaugaguuuggaggcuuuaccuuacuaguuccccagaugccggaaacagaaauguccacaagaaauugcucuauuuacucuguccagcuggcuggcuaaaagccagauggcaucugucaguuuacaccuugaacccaccucuucauccaacucucccuguaccuugucccucggucagaagcaacuccccaggauagcugacucaacuggacauuggccucccuugcagaggguggggagauugagguuucaagcauccaucuccccaucuuccuuggccuagccuuugaaugagacagcuaccagagcaaaggaguuggcuuccccugguuugccaagcaaaugaacccuauggauuuguuuccuccaucucaagacccaaggaagaguugccagccaauucugugccccuuccucaauucuguguccgcacugcucuccagguggggcugcgguagguugcuuccauuacuguggacgaauuagggagcagcucuuuugagaucuaagcagcuuucugcucucuaauaccguccugcuaucugccuugaggaauuagccaggccccuggacucuuggguccucugagcuuguaucucuucccagucccccugguacggauccccaaggccaugcucaucuucaucuccaagaauaugaagcaucauacucuugaagccuccacaucuuauuuauuuggaagaaggcuuagcuucauuucugcagcucuuaucuugaacaagguggcucuaccaccuuuaccggggcuuagcccuuucccucugcccagcuauuauauauagguggcaaccagcaccuuaacuuuuuucuauguaggauuuuuuguuuguuuguuauuuguuuuuuuaggggguaggguaggggaugaaagggauugcagggagaagaagaaggaagcucuugguauuccaggaggaagccagggucuucagcuuaaggugaucuagucucugagguggacuaccuccccauugcucaguggcuccuagcagcuacaggccccuggagaggcaggccuugaggggacuaccuccugucuuaaagcccugagccaaggaggggccagaagccagccugcagcugaggccuccgcaguggcagaguccagccagcaacugagcaggccaacccuguggggggcagcuccagagaccugauccaaugcccacauuacucccucagagcuccauccaaaucgccuuugaggaggugccccaacucccacccagagccagcaucagucaugugaccugcguagaccaaucugagcauaccaugguaagggucugaugggcacugcccucuuugggguccaagaaggacugaccccaagggcucccuuuaguccagagguucuuaaccuggagucugugaaugccuuauggaucuaaggauugguuucaggaagucugagaaucccauugaaguuaugugcaaaauguuggauguguguuuauaugcauuuuucuggggagaggagucuuuggcauuuaucugauucuuuuagggauuuaugauccugaaaacaugaaguccuuaggaaaacggaaguggggaggggucugcugaacuauuacagggcaguucaaagcagggugagcacccuucccccacaucugacccaccucgccggucucaggugcugcguugccagcucucugcugaggaggugcgguucccagucucugugacccagcagucccccgcugccgucuccauggagaccuaccacgucacucugacacugccaccaacacagguagaaggggaugugggaaacugaguugggcaggggcgguuccauuggcucagcuucuuccauuuguuuccucucugggauggaauucaggaagggagaguccucgaauuaggaguccuuggguaaauggggcaagucagcccagucacuuuguuccugucuguaguuggaagucaaccuggaggaaaucccuggugaggggcugcucauauccugggccuucacugaucgcccagaucucagccuaacggugcuucccaagcuucaggccagggagguaaggaggcagagcuggcagagaagaggcagaacggggagggaggcagaggugggggauccaccuccuuguuguucccuucuucucucugcagagaggugaagaacaaguggagcucuccacaauugaggaacugaucaaggaugccauagucagcacccagccagccaugauggucaaccucagggcuugcucugccccaggaggccuggugaguuggcacccaaagcaaaagauuugcaugcaccuuguuccuagggugcuaugucaggauucuugcucuuuggaccuucuucugcucuuagguacccagugagaagccacccaugaugccccaggcucagccagccauccccagaccuaaccgguuauuccuacggcagcuucgggcaucucacuugggaaaugagcuggaaggugagagcuggaaguggcugcgggacugccaaggcuaugguugguugcagaugcucucugccccucugccaaggguacagccucuuuauucugcagugacuucccaucucugaucugagcaucuucuaacuucugguucaucacaggcaccgaggaacugugcuguguagcugaacucgacaaccccaugcagcagaaguggaccaagcccgcgagggcuggauccgagguggaguggacagaagaccuggcacuguaaggaguaacccugccccgaccccaugcuccagagcagagaggaucaaaccuuuccagcacaguccuugcaggaaucagcucuguuuucaguagccuuuggcgugagcuccuauuguaugccaggcccuggcgugggucuuagggauacagacuugaccaagauacagcccccaccccugggucaaugacaagcuugaggcagagacagguguacauaaagaagaugguaaaaccgcuccaguugagguuuauguaaugugccgucagagugccuaggugggggggagauuaauucccaugagggaauaaggaucagaguaggcuucauggaggagaugacauuuaaaccacacuuuagagcaagaguaggauuucaucagagugugaaaguauucucggcagagggaagagcuggagcaaaugaaagaggguggcuugcaacugagagacuggcaagacaggaagagcaggaccagggaggauuugaaugcauagcugagaagcaugguuuccacucaggcccugucccuuucucuugggacgagagagaauuuggaggccaggagaaucugauuggagcauuuaugccguuuuauuuauguacacagcucucugccucuggccugugauccacucaaguguggguucagcuugcuaauuuucuccuuccugccccaucuccucuugucccacagggaucugggcccccagagccgggagcugacccucaaagugcugaggagcagcagcuguggagacaguaagugaggggugggaggggcaccccuggguggguacagaguggggucuggccaugggcccagcucacagugccaucccuuuccccagccgaacuccuaggccaggccacacugccugugggcucccccuccagaccacugucucgaagacaguugugcccacucaccccagggccagggaaagcccugggaccagcagccaccauggcaguggaggugagaagcugaccccugggguaggugggaggacacaggggaugggcagucuccgaggcucugucucuucucucucccaccccugggcagcuucacuaugaggagggcucuccccggaaccuggguacucccaccuccuccacuccacgccccagcaucacaccuaccaagaagauugagcuugaccggaccaucaugcccgauggcaccauugucaccacagucaccacuguccagucccggccccguauagacggcaaauuagguaaagagaaggagccugggagcccagcucuagccaggggcccgggacugcagacccaaggcaggacagugaaagaggagagagccuuaauuccaacucccccuguuuucagacauuccauuccaguccuaccacaucuuccucccaaucuuugucucuuccaaacuuucccuuaccuccugccauuuccccagcaauuccucucacucugccacccuucuggauccuccugccccuccucauacaggacuguugcacuccuaccuuccagcuuccccucuggcuuuucacagguguccuuagccccagcugacuauaauuguccauccugcuacccucagcccuccagcacccccugggguccuccaacaaacccagaggccucuguggcauuucuaccccacucagugggcccccauggcacuucugccauuauaggggccccacugaauugccccaacuucagggagccccaguacccccucuguccccgcuccauauuuucauagcaucuccccacaccuucagcaggccccauggcacuuuccuacacucccauuagcuccuggggugucuuuuaguccccacggcaucuuccuaaucacccuugugauuaaucacccuuuaaucauucuugcccucugagucacccaaagucugcaucucaacaaagacaguaggggugggggccacucugaagcaacucccagcucacugacccucccccacccaccagacucccccucccgcuccccguccaagguggaggugaccgagaagacgacaacugugcugagugagagcaguggccccagcaauaccucccauagcagcagccgugaguggggaauggggugcaugaguguggguuggcccuggugccccagcaucaaaaaguacucugggugggauaggaggaguuccaauccaagaaagagccagggagaagucagguuauucauucucugcaccccuagcaggggacagccaccuuuccaacggcuuggacccuguagcagagacagcgauucgccagcugacagagcccagugggcggguggccaagaagacacccaccaagcgcagcacucucaucaucucugguguuuccaagguaacagggcucuggggagaggagcugggauggggagaaagcccuaaugggucggucacuccugcccauuaaaacccgucccuccugccaggugcccauugcucaggacgaguuggcgcuaucccugggcuaugcggcaucccuggaagccucagugcaggaugaugcagggaccagcggaggccccucuucaccucccucagacccaccagccaugucuccaggaccgcuagaugcccucucuagucccacaaguguccaggaagcagacgagacaacccguucggauauuucugagaggccaucuguggaugauauugagucggaaacgggguccacuggugcccuggagacccgcagccucaaggaucacaaagguagggggacguuggcagggugccccucaucucuucuuuuauacacauaucaugaccugggggaccucgagccagugugccuucuccuuccuccccuaagagauagccggauucccagccuaguucagccaagcuagccuagagggggaucuuggugccuugguuccuggccuagaucugacaugcuugugauaggaagggaugccaaauuauuucccuuuaccuccauuguucuuucuuccugagucuaagugccauuuuuccugcccuuuaaaaaaaaauuauaaaaauuuauuccuaggcagggugugguggcucacaccggcacuuugggaggccaaggcggguggcuuaccugaguccaggaguucaagacuagccugggcaacauggcgagaccccaucucuacuaaaaauacaauaaauuggcugggcguaguggcacacaccuguaaucucagcuacucagggggcugaggagggaggauuccuugagccugggagguugagguucaaggagguugaagcagugagccgugauugugccacugcacuccagccugggugacagagugagacccugucucaaaaaaaauuuuuuuuuuccauggcugggcacggugguuaaugccuguaauccuagcacuuugggaggccaaagcggguggaucacaaggucaggaguucaagaccagccuggccaacauggguaaaccccaucucuacuaaaaauacaaacauuagccagacgugguggcaggcgccuauaaucccagcuacuugggaggcugaggcaggagaaucgcuugaacugggggguuggagguugcagugagcccagaucaugacacugcacuccagccugggugacagagugagacucugucucaaaaaaaaaaaaaaaaaaaaaaaauucuucccuuucaaucugcacccucuccccaaugaguauaagaaauccuacccuuggauuauccaucuggcagcaagacaggcagugaccaguggugguaguucuucuaacuuuaaaagaugagaggcucacccuaaaacaucuucauuccucuaccagugagacuaucaaccauggaucuaucuaucuauuuuuuaagccugcaucacuucuugagauaaugagguuucuaccuccaaagccugcugggugagcaccuugcucauuauacugguucugaauuuaccucuuugaaguuucuagaugcaccacuuccugcucacagccuggaauucgguuaacaagucagugucaaccuaccuuucccuucaugauuuauagacuuuugggaguaccuucugguagcuuuugucuucccauaggaaagaggcccaaucccaguuuguccucacaaagcggccagcuccgugauaucucuuuugcgggcagaguuaagauuguacacagauccccacaaguaccacgauuuuugccucaggaaggauaaagcacauguuuguuucugcuuucguuuucuuuuuucuuuuuuucacgaagccuuauggagaaguauguuucugcuuucuuuccugaggaagccuggcuucugggccacgggacugauccuguccacauccucuuucccuccauucuccaucgugucucugcccccgucucaccccaccccgugccccucucugccucagcuuccccucuuccccugcagugaguuuccugcgcagcggcacuaagcucaucuuccgccggaggccuaggcagaaggaagcuggccugagccaaucacacgaugaccucuccaacgcaacggccacgcccaguguccgaaagaaggccggcagcuuuucucgccgccuuaucaagcgcuuuuccuucaaauccaaacccaaggccaaugguaaccccagcccccagcucugaggacccagcucugaaagggcacgaguucucucagcccauuccccaccuccccuuccauaccccuuccuggaucuccagugccugggccaggaaagcccucuggguuccgggaagccccguccacccugggccauggggccgguuggaaggauacuuggaacgggaagcacaugagaggugggcacccggugccgaggacauggacgagggacugguggcugggagggagaggagggcccuguccggcauguguggguauuccccagaagcauuugccuccugcugagccuggucccugagcggagucccagggugcucagcucuucagcugacccuucuucccuuauuuauucucuuuucuauuuauauguguggcuuaggacccuccgugaacagaugauagagggcaucucucccaggugacccuucuuuucugucccaggaggguggguaauucccuuugggauggggcucccacaccucccucagguccccacucagaccagcaccagugucugccucugagaauguuggcagcucacagagagcagggccggcccgggauggggggcagguacuccccaccuuccugccuccccuccugcuccucaucccucccucccccuuuauuaccguuuuuuguacuugaugccuucucugugagcaguggcucugugggaaggagggagccgggagccuggugggaagccuuccccagagagauggcuuuaggggcuuuauuuaaagacugugaugauggagccacgcaaggcugcaccucuguguguugggagacgaugaugauguccauugcugugugauggcuuggaauuuaauuuauuaaagucaaauuggaguuuauaaacuggacaacugguuauccuuugaaaggcaguaggcagccaggcugugacauggauggugugggaggaugagacaggggcccggauaaugagguuggguagaugacacacauuguggaucugcuaagaaguuccugcagggaagaaggggugugcagagaaaggauggaagagacaggaggcucuggaguaugaaauuguagcaaaaaacucaaucaacuaguacagguuagucuucauuccccuuucuggaacaggcugcuccuucuaggauguaauggagaucaaagcuuggacccuguaacuagacugccugccuggguuugagucccagcucuucuaauuacuugugugaccuugggcaaguuauguaaccucuaagugccucaguuuucucaucuguaaaaugggaacuucaaucaucauggcuaucauuugguuguggaugagaaguaaaugaagugcugaguguuaacuguugccucagaagaaacugggagggggaagucuuagaaguguuucaacauaauaaaagcucucucauucugaaaugugggcaaauuucagggauugauagauccuagcaaacugugucccugguucccgugcuugagaucuuauacaggacuugaaccagguaagcugcuacaggauauugggcagaaugcaggaccaggaagcaagaaaacugagucugccacagacaaaccaagugaucuugagcaggcaacuucuccuuuggggaccucaguuuccucauaucuaaaauaagggugaccuggauaaacauucaggucacuucca

SEQ ID NO: 15952 - RNA, 1715 nt, Homo sapiens
acacccaaggguuaaccgcaaccaaccggaggcggguauuggagaaaagagccaaucaggagggcgcagagguguguccugggggcuuauaaaggcggccucgcggcgcgcgcgcgacagcaguuacacugcggcgggcgucuguucuaguguuugagccgucgugcuucaccggucuaccucgcuagcaugucgggccgcggcaagacuggcggcaaggcccgcgccaaggccaagucgcgcucgucgcgcgccggccuccaguucccagugggccguguacaccggcugcugcggaagggccacuacgccgagcgcguuggcgccggcgcgccaguguaccuggcggcagugcuggaguaccucaccgcugagauccuggagcuggcgggcaaugcggcccgcgacaacaagaagacgcgaaucaucccccgccaccugcagcuggccauccgcaacgacgaggagcucaacaagcugcugggcggcgugacgaucgcccagggaggcguccugcccaacauccaggccgugcugcugcccaagaagaccagcgccaccguggggccgaaggcgcccucgggcggcaagaaggccacccaggccucccaggaguacuaagagggcccgcgccgcggccggccgccaggccuccccaugccaccacaaaggcccuuuuaagggccaccaccgcccucauggaaagagcugagccgcuucagacugcggggcaagcgggccgcggcucccuuccccuccccuccccucgcccgccuucgccgcccggccucgaguccccgcccgcccccgcucccgucccgcaccgccugccgcgucggccucgggcccugcccuguccgccguccgcccuccgguaggguucgggccuuccggaugcggcuugggcgcucuucggggaccuccguggcgcggaagacccgagccugccggggggaggccggcggcgccgcaccugcccgccucggcguucgugacucagccgccccaucccgagucgcuaaggggcugcggggaggccgcagcaccuucuggaagacuuggccuuccgcucugacgcagggccgaggugggcaguccaggccgagaggccggcggcccugaaggugagugaggcccucggcagcugcagccggggugucugguacccccccggcguggugcuuagcccaggacuuucagacgcggccgcuggccgggaggcuuuggugggagagacgcgaucgccgauuucggucuggcgccccuucugcggccgggacccaggccuuucacaucagcucucccuccaucuucauucauaggucugcgcuggggccgggacgaagcacuugguaacaggcacaucuuccucccgagugacugccuccuaggaggacauuuaggggagggcagaggccugcaguuuggcuucacggcuggcuauguggacagcaagagucguuuucgcggaagccgacuggcagccaggccugucgggccccccgacgccgccccauuucccuuccagcaaacucaacucggcaauccaagcaccuagauaccagcacaagucgguuaaucccugucuggacugagccuccguuggcuucugaacuggaauucugcagcuaacccuuccacgacuagaaccuuaggcauuggggaguuuuagauggacuaauuuuauuaaaggauuguuuuuuuuuuaaauggag

SEQ ID NO: 15953 - RNA, 2379 nt, Homo sapiens
uuuauucugugugaaaugaaaacuauugaggcagaagcagaaaggacguaccaggagaacucugggcaaaagucccagccucugagguaaggaugaaagggcuuuguguuuguuccuaucuucccgccaacuccacacgcgcacacacaacaccuucagaacugguuuauuaguaggauugguuacauucaaaggcuguugcuuggacuucucuaaagagaugaagcccccacauacugaggaggcaaggcagucaucaaggccccaaggugaggcaaaucccuggaaggcuugaacccugcaguucagucucccgggguaaucacuccccagauagcagugagaauggggcacugaggcccgggauguaggcacuggacagcagcaacccaggcaucugugccccacaaaccaguuaaugggcaucguuaagcugccgugcaacauccaggauguuuuuggcuccuuugcucagcaacaaguuggccaggcugaugcccaaguucugggcagccaacuggggcccucguggaauguuacgagcagugaugccuaccaacugugggucauccucagggccaucuucaugcuguaugagggaaggaggugggauuuggugagaacaagagauuauaugcacucuuguuuauuacccccucgcccuccagcuuugguaccugggcagggacauggaugguagccugcauggucucuuguaugcuaucugagccgucuagacuccagacuccuccagucagguacagcuggggaagaaaacaguugccucagcacagucugagaggggacuaccuagaaaccugggaugcacaggaagaaaugccacaguccuccuuucccuggcuucccgcccauuuccccccacuuacuugcccauccuucauagcuguaugcacggcuacuggcacacugcagccuccuuccuguaacaagaaguucuugugagcugcaagggcucuuaacaccacccugugaccacagaccugaggacaucacugaaaaggcaacugugggcccagaccugguccuauccauacacaacauucaacaagaaugaguuagcacuguauacagagcauucauguaagaaaucuucccugccaccuuucccagcucuccaaguccccagcccuccacagguggagcacaggcccuaccaggugccucaggaaggcccuuucagcgaugcagcgaagcagagucucgggaucgugcagcacacccaccagauccaagauguccugguccuuggcucgcacuuccacgcccaaggcccccugauggaaaaacauccuaggacaucaggccugaucuuuccccaaccaauggcgcaaagcaugggaccaccucuaucuacuugcuccccagcgccuuuuggaccgguagcaucccaaggucugccccucccugagaaugcuauucuggggaagcagaugcagaagguugugagacaagcuucuugguugagaacaaagggaaggcauaugucaccauguggcuucccuggucaaguguaccuggcccacagcauacaugcauuccucagggugcaggaucuguggaggcggaacagggagucaaaaggguggacacgggggugucuaaaagcaccuggcagugagaugggaguucccuaucaucuagaaagccuggguaggccuaagugugagucuggccucuuuuuuuuuuuuuuuguaaauuuucuccaugaaagccuagagucuggccucugauucacaaucuucccagccuacgguguuagaggugggguggucaagaagugaagacagaugguccuugacuuacaauaggguuacauccugauaaacccauuguuaaguugaaaacaagcugaaaaugcauuuaauacaccuagccuaccuuacaugugcucagaacacuuaagauuagccuauuauaguuggacaaaaucaucugacaccaagccuguuuuacaauaaagugaauaucucauguaaugaauacuguacugaaaguaaaaaacagaauggcuguauggguacuaaguacaguuucuacugaacguauaucgcuuucacacaaucauaaagucuaaaaauccuaaauuggggaugacuguaaggcagaaaggagaugcagaugagcuggggagaggauaggggcaggcccuaccugccccacccgguugugccagcccaugcgcugcaggccagcuguugccaggaugauggcacugaacuccugcugcucguccagcuuccgaagccggguguugagguuuccccgcuguggagaguugcuaaggaccacagugucgggcaaucuggggccucgugcgguucccucugccugagucugucuuucccucucuagcuggcu

SEQ ID NO: 15954 - RNA, 2379 nt, Homo sapiens
agccagcuagagagggaaagacagacucaggcagagggaaccgcacgaggccccagauugcccgacacugugguccuuagcaacucuccacagcggggaaaccucaacacccggcuucggaagcuggacgagcagcaggaguucagugccaucauccuggcaacagcuggccugcagcgcaugggcuggcacaaccggguggggcagguagggccugccccuauccucuccccagcucaucugcaucuccuuucugccuuacagucauccccaauuuaggauuuuuagacuuuaugauugugugaaagcgauauacguucaguagaaacuguacuuaguacccauacagccauucuguuuuuuacuuucaguacaguauucauuacaugagauauucacuuuauuguaaaacaggcuuggugucagaugauuuuguccaacuauaauaggcuaaucuuaaguguucugagcacauguaagguaggcuagguguauuaaaugcauuuucagcuuguuuucaacuuaacaauggguuuaucaggauguaacccuauuguaagucaaggaccaucugucuucacuucuugaccaccccaccucuaacaccguaggcugggaagauugugaaucagaggccagacucuaggcuuucauggagaaaauuuacaaaaaaaaaaaaaaagaggccagacucacacuuaggccuacccaggcuuucuagaugauagggaacucccaucucacugccaggugcuuuuagacacccccguguccacccuuuugacucccuguuccgccuccacagauccugcacccugaggaaugcauguaugcugugggccagguacacuugaccagggaagccacauggugacauaugccuucccuuuguucucaaccaagaagcuugucucacaaccuucugcaucugcuuccccagaauagcauucucagggaggggcagaccuugggaugcuaccgguccaaaaggcgcuggggagcaaguagauagagguggucccaugcuuugcgccauugguuggggaaagaucaggccugauguccuaggauguuuuuccaucagggggccuugggcguggaagugcgagccaaggaccaggacaucuuggaucuggugggugugcugcacgaucccgagacucugcuucgcugcaucgcugaaagggccuuccugaggcaccugguagggccugugcuccaccuguggagggcuggggacuuggagagcugggaaagguggcagggaagauuucuuacaugaaugcucuguauacagugcuaacucauucuuguugaauguuguguauggauaggaccaggucugggcccacaguugccuuuucagugauguccucaggucuguggucacagggugguguuaagagcccuugcagcucacaagaacuucuuguuacaggaaggaggcugcagugugccaguagccgugcauacagcuaugaaggaugggcaaguaaguggggggaaaugggcgggaagccagggaaaggaggacuguggcauuucuuccugugcaucccagguuucuagguaguccccucucagacugugcugaggcaacuguuuucuuccccagcuguaccugacuggaggagucuggagucuagacggcucagauagcauacaagagaccaugcaggcuaccauccaugucccugcccagguaccaaagcuggagggcgaggggguaauaaacaagagugcauauaaucucuuguucucaccaaaucccaccuccuucccucauacagcaugaagauggcccugaggaugacccacaguugguaggcaucacugcucguaacauuccacgagggccccaguuggcugcccagaacuugggcaucagccuggccaacuuguugcugagcaaaggagccaaaaacauccuggauguugcacggcagcuuaacgaugcccauuaacugguuuguggggcacagaugccuggguugcugcuguccagugccuacaucccgggccucagugccccauucucacugcuaucuggggagugauuaccccgggagacugaacugcaggguucaagccuuccagggauuugccucaccuuggggccuugaugacugccuugccuccucaguaugugggggcuucaucucuuuagagaaguccaagcaacagccuuugaauguaaccaauccuacuaauaaaccaguucugaagguguugugugugcgcguguggaguuggcgggaagauaggaacaaacacaaagcccuuucauccuuaccucagaggcugggacuuuugcccagaguucuccugguacguccuuucugcuucugccucaauaguuuucauuucacacagaauaaa

SEQ ID NO: 15955 - RNA, 13081 nt, Homo sapiens
ggggcggcgggggcggggccgggcgcgcagcgcagggccgggcggccgaggcuccaaugagcgcgcgccgcguccggggccggcuggugcgcgagacgccgccgagagguugguggcuaauguaacaguuugcaaaccgagaggaguugugaagggcgcggguggggggcgcugccggccucguggguacguucgugccgcgucugucccagagcuggggccgcaggagcggaggcaagagguagcggggguggauggaggugcgggccggccaccccuccuaggggagacagcgugcgagcuccgggggcgggucgggagcgcaagggagggccgcgcggacgccgggcgcucggccucgcaccggggggcacgcagcucggcccccggucuguccccacuugcuggggcgggccgggauccguuuccgggagugggagccgccgccuucgucaggugggguuuaggugaacaccggguaacggcuacccgccgggcggggaaccuuaccgccccuggcacugcgucugugggcacagcggggccggggagugagcugggaaaggggagggggcgggacaacccgcagggaugccgaggaggagauaggccuuuccuucauccuagcuacccccaacgucauuaccuuucucuucccguccaggcccagcuggcuuuccccgucagcgggggagcuccagguguggggaggugguugagcccugggcggggaucccuggccgcaccccaggugucugacaacaggcacagugcugcggugcgccacucacugccugugugguggacaaaaggcucgggucuccuuucucuuguccuguuagcuucucuguuuagggauguggcaaagccgaggacccaugcucuuucacuugggccuuugugugggcgcugcugggaugauuagagaaugguuuguacccaucaggagggagaagggagaaguaggcugaucugcccuggguaagaaugaaguagauaugaaucuuacagccucuccguucugggaugugauucugucuccuucacuccggguauccaguuuuaaguguuuucuuucuucgccucccccaggggcacuauggcagacaaaguuaggaggcagaggccgaggaggcgagucuguugggccuugguggcugugcucuuggcagaccuguuggcacugagugguauguaccccaguagagggagcaaauggauaaaugaugacugaaggaugcaugaugggaauugagcuuggggcuguuggccagaagucucuugaguuguuagguccaggccuuuuugucuuuugccaucuucguuuacccauggaaagugguaugcuuugauuagagggagucccaggaaggugggcgaagggagagcuaacugacaaaccucuuuucccuucagauacacuggcagugaugucuguggaccugggcagugaguccaugaagguggccauugucaaaccuggagugcccauggaaauugucuugaauaagugaggguggcccccguguuaaggguggggaacgagggagucugggcuccaagugugaauguguuagucauagugcccacagcagacuucggcaucugagugguuaaaugugugugagugucgaggcuucugaguccuucugcugcaggcaccugggcccaaaaucucuuuuccucagggaaucucggaggaaaacaccggugaucgugacccugaaagaaaaugaaagauucuuuggagacagugcagcaagcauggugagcuagcagucccucuucccagaguggugggcagaggagaggagauggcagcccccagagucuguuuccuuaucagucucugugauguaagagguagguaaugguggacuugggagccuaauacuagucugcuccuucuucaccccucaggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgugagugcucuguuggggaagguggucucggcaacgcugcugggcuccucauugguguguguuccugauuguccugccuuaaugccuggcuuuccuuggcuccaacuaccuuccuuccccucaggcagcugcaguucucaccugaggaaguguugggcaugguucucaauuauucucguucucuagcugaagauuuugcaggugaguggucaagguggggcccuuagggccaggcuccccaggaucuagggcagugauucuccaacaggggcaaguuugccucccagggaacauuuagcaacaucugaagauagauuuugguugucacaucugaggggugcaccugcuaucuaguggguagaggccggggaugcugcucaacauccuacagugcacaggacagccccacaacacagaauuaccuaguccaaaaugucauuagugaccagauuagaagcccucaucuaagguauggagccggcgggacccuuuucuguugucaucuguagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccaggugagccaggggagccuugaccagacaugcagggugacugaaucuaaggauggaggccacuuggucccuuuugcaucugguuugcauggcugggcugacccuuggcaaaaugcaccaauagccuccucccagccccuguuggagcuguuuaguuuuguguuaagagucagacagcccauuggaagcaggugggugggcaggcaggcccccuggaguuugagaagguuccugugacaguugccuugauaucucuacagaauaucauguucuaugacaugggcucaggcagcaccguaugcaccauugugaccuaccagauggugaagacuaaggaagcugggaugcagccacagcugcagauccggggaguaggguaaguggauacuuggcagggagggcugcuugugaagacccucaagucagggguuucuucuuggaggagacacacugcuuugcuuuccugcaugcugcaggaauggucuccugauugaggcaucagucauuguaggggaccacucacaaagaguaaggggaagcugaggcucaggggaggacaguuugggaaaacuggaagacauggaacuuucaaaauguauucuaaggaaauccauggagccgcaggcaauauguagggugucagauucaaucauguuuuuguucucuugucauuuccaguuaaauaauuuaccauucuuguugucuuaccucuuuuuaaauuuuuuuuuauggccugugacauagcccucaggagauccugagaacaugugcccuguugucuuauuucuugaaaucaucuuuuuccgucuucaccauuaccacccagcccaaguuaccaucaccucuuauuugcagaauuaaaaacaucucccuguuccuagugacgucuccuuucaguucuuucuucauauugcagccagaggguucuucuuaaaauccaaccuaaucauuaccuguuucuuuaaaaaccugucgcuggcuccauaacuuucccugugccugucucaacccugccuucugcagccugucugagcccugagcccucucgcuuuuugagccccagugaugcuugcccuccuccggaacuugccaugcacucucccacuucaaggucuuuaugaacguuguugccucugucuagaauguucuuuccccuccagcuagugaacucugaacucuucaguucaagugaugcuugcacugaacucauccuucagguuucaguucaagcaucacuuuuuaggagacauguucuugggucucccucaguagccugaaucuccccccaugcauguucugcaggcauuguccccucaccuuuacaacaugugacguagugauaauuucacauuugugugauuauucaacuuuuccauagcagggacccugucucucuccccaccgccacauuuguauucccagagggaaguacauaaguaaugcucaguaaacacugucgaaugaaugaguggaagaagggucacugcgaggugucagcugugcuguagagaguugagggcagaguguguguccacacauggggcacuggagaugaacaagguccccugagaugaaggaaaggugccauguggggaugagaggcuccugugcagaugcggggacuccauguguucuucacuuuuuucccugcucccuuuucucaacagauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacaggugcccacaaguggcugguugaggcuauauuuugucccacguagagggugggggacccugccacugaacugggcugcucgugccuggcauggcccaugcuccucccgcuaccauccucccaaagaccuauucuuuuuguuucuguccuacucaccaagagagcgggagcugggcaagaacccccugacaguccccauccucucccagauugaaggccugauggaugauguggacuucaaggcaaaagugacucguguggaauuugaggaguugugugcagacuuguuugagcgggugccugggccuguacagcaggcccuccagagugccgaaaugagucuggugagcgaguaggggaaggcgggaaugccccguaggaaagggcauaggaaacccaugggacgucaagggacgagucagugcuaacugcaugcuguugcaccugucauucuuacccacugcaggaugagauugagcaggugauccugguggguggggccacucggguccccagaguucaggaggugcugcugaaggccgugggcaagugagugugggggcuagagcgcuuggcugaguucugccuggggcagggcuuugggcugagcagcuggagggcugaggggagggaagucccgguugcaugcuccaggguagaccgugcugaggcuuggggcuuucccagggaggagcuggggaagaacaucaaugcagaugaagcagccgccaugggggcaguguaccaggcagcugcgcucagcaaagccuuuaaagugaagccauuugucguccgagaugcaguggucuaccccauccuggugagugagccugacugagcaggugacaagcucccuuuaccucucccaaguaggguuuccccuucugucugcucuggcucaucccuuugucuuucugcuaagaggucucccccaucccacccccauccuuaccccagaaccuacucggguucucuagugugcaacagugugccucugucugccugcuguguagguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggugaggggcagggguguaggaugggagcuccagggagggggaggcguggcugcuggauaaucugaggacugggggugagggaggaugugggccugcggggcugaaacagggcagcuaugaucagcuucgcuggagaaugcauccguccucuugagugugcccuuggggagugccccugacaccuugugccaggaggccauguagucuagagggcgagaugggcuggggugggucccccugaacuccucuuuccuucccaaccaggguauuuggcucccagaaucugaccacagugaagcuaaaaggggugggugacagcuucaagaaguauccugacuacgaguccaagggcaucaaggcucacuucaaccuggaugagaguggcgugcucagucuagacagggugagagcuaaaggauacccugugugcagagcaggggcucaggcccugccagccauuuccaaaguggguuccacauggcauuaggauaagauaaccaaaaaagguuuaggaaucagaaaaauguuggcucugaacagagcuaacugaugaucuggugcagaccuccuuauagccuauaaaugcuuauaggcauuguaaauuucuuggaacuauugaaugguuugauauaggcauuguaaauuucuuggaacaauugaaugguuugaagaauccacucuuuuuuuuuuuuuuuuuuuuuuuuuuuuuuuuuuuuuggagagggucuuggcucuguuacuuaagcuggaauauaauggcauggucauagcgcauuccagccuugaacacuugggcuuaaaugauccucccaucucagccucuugaguagcugggacgauacguaugugccaccauauccugcgaaauuuuuuuguacuuuauuuauagagauagggucucacuauguugccagacuggucucuaacuccugggaucaagcgaucauccugccucaaccucccaaaguacagggauuaugggugggagccacgcagccucaggaauccacuuauuauuauuauuacuuuuuuugagacagagucuugcucuguuguccaggcuggaguacagugacgugaucuugcaaccuccgccucccggguucaagugacucuccugucucagccuccugaguagcugggauuacaggcgccugccaccacaccuggcuaauuuuuguuauuuggaguagagauaggguuucaccauguuggccagucuggucucaaaccccugaccucaagugauccaccugccuuggccucccaaaguguugagauuacaggcauaagccacugcacucggccaggaauccguuuuugaagaacaaaucuggggguaauauggauguaauagccaauacaguuauugaguggagaaguagggggcucuuuggagaaagaggagcugggacccuauucauggagggcucuuaaucaaaggagaugggcagccaccuccaaguccuuagaaaaggcaggugagagacuaggccugugacggcauggagugugcauaagcaaacacccacuuuggcagauguuuguggagaaaagguggauuagccuguguauuuuuucauuuugaaccuguuuucagguggagucuguauuugagacacugguagaggacagcgcagaagaggaaucuacucucaccaguaagaugagcaugcauguguguaugggagagaauauacuugugugaagguuggggagguggacagggcauggcccuuggguuagaagguggagucacugcuguggucuccuuuugagucuuuggguuuuacucccccuagaacuuggcaacaccauuuccagccuguuuggaggcgguaccacaccagaugccaaggagaaugguacugauacuguccaggugaguucaggauggagccagggaagcauggaggacggugggggaugcagguaguagccgcagaggaagggggugaggguaggccaccccugccccuguuguguuaaccauucacuccccaggauccucugggcucugagcuguuucuugacuggugcucccaaggcccauuccccucauugcagaugcucuuccuuuguccagcuagauugccacaguccaagcaggccauugaccguuuccauacagcagucaccuguauggaacccccauggggucggcggugccgagccaggccugccuggaggcucugcuccugaucguucccuggggcgccugugguguuucccaggaggaagaggagagcccugcagaggggagcaaggacgagccuggggagcagguggagcucaaggaggaagcugaggccccaguggaggauggcucucagcccccacccccugaaccuaagggagaugcaaccccugagggagaaaaggccacagaaaaagaaaauggggacaagucugaggcccaggugagcuguggcagaggaaggccaguguggauccagaggcuaagggagcaggcgccugccuuguuucuggccuuguggagaauguaggagggcagaggcuuuuccugacaccccugacucuucccacccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaguaagugaggacagcugguguguguguguacaugugugugcaaggugggcaggaugugggauggcgcccugggagggagggcugucggacccagagucucaaguucucacuugcccucucccucaucccuaccccuccuuugucccauagacuucaggacuugacacuccgagaccuggagaagcaggaacgggaaaaagcugccaacagcuuggaagcauucauauuugagacccaggucagugggcaggaggcagcagcccccccacugggcuuacaccuggcucugugggccuugccucugggcuugugggugcauguguuuacaugucccccuccccaggacaagcuguaccagcccgaguaccaggaaguguccacagaggagcagcgugaggagaucucugggaagcucagcgccgcauccaccuggcuggaggaugaggguguuggagccaccacaguggugaggggccucucaggacauggcagguggagugggagcucuccuuccucucccagggucagagagagagaagagcuggggcuugagcccauaaagaaggacauggggcugacuccaggcucugcugucgucccuuccaccccucugcccaaucgcacauccaucagauguugaaggagaagcuggcugagcugaggaagcugugccaagggcuguuuuuucggguagaggagcgcaagaaguggcccgaacggcugucugcccucgauaaucuccucaaccauuccagcauguuccucaagugagcagccccugaacccuuuuugcaguccugccaaggccacugguuuucauuccuaccagcuucccacuccccacacuccaggccccucucccucuggggcuaauggucuccuuucuggcuuccaggggggcccggcucaucccagagauggaccagaucuucacugagguggagaugacaacguuagagaaagucaucaaugagaccuggguaaucacuucguaaauacuuaaccagauacuuagcugccauccuagguacugugggagagguggagagaugaagccacagcagccccugccuccuggcuuagcaucuaaccugaagacaaaagauguuuguauuugagcccaccucugauuagucccaagcaagggccauggccauaagagucaucagccuggaggagcaaaaaagcccaucccaugaggacagagaaagcugcuuugaggggcugggauuugagcuagguucagaacaugggccaggguuuggcuaggugaaacugaugugucaugugaagcagaaacuguuuuggauguguggggacucuugagccagagcucaguaaaguggagagucaagaaaugaguauucagcugggcgcgguggcucacgccuguaaucccagcacuuaaggaggcugaggugggcgaaucaccaggucaagagauugagaccauccuggucaacauggugaaaccccgucucuacuaaauauacagaaauuagcugggcguggucgccuguaguccuagcuacucaggaggcugaggcaggagaaucuuuugaacccaggagucggagguugcagugagucgagaucgcgccacugcacuccagccuggcaacagagcgagacuccgucucaaaaaaaaaaaaggacuauucaagggguuuguucaguuguagucacuccagaguaguaggauguaaaccagaaaccugcagguugggacuucauuguggagaaccuuuaauacccuucugaggagucuguuagccucuuggggcugaggccagggguggcagugauuugcagucugagggaagaggcugguugggggugugauuccaucugggacagagaugucugcucucuccauggcuagcuuggagccucuccuggucucacccacaggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggugagaacaggguaccuggcugcauguucugcuggacagggagacagccuccuuuccuuccugaggcuaugucuuaccccugguuuccuucuaggccagacugaagaugcagagcccauuucagaaccugagaaaguagagacuggugaguuggagcaaccaugguugagcacguggauguugcauuagcccagggguaggcaaacuggcaggcacagccuguuucuagacagcccaugagcuugaauggccuuugcguuuuuaaaggguuguuuaaaaaaaaaaaaaaaaaaaaaggccaggcacgguggcucacgccuguaaucccagcaguuuggaaggcugaggcggguagaucaccugaggucaggaguucgagaccagccuggccaacauggugaaaccccaucuuuacuaaaaaaauaccaaaaaaaagagucaggcgugguggcgcacaccuuuaaucccagcuacucaggaggcugaggcaggagaacacuugaaccugggaggcagagguugcaguaagccaagauggcgccacugcacucugcacuccagccugggcaacagagacucugucucaaaaaacagaguaggcaaagagaccaaaugugguacaugcauccuaaaauauuuacuagcuggcucuucauggaaaaacuggcccagccuucccuuagccucuuccucccuucugaggagacuaaccuguuucuucccaaagcaggauccgagccaggagacacugagccuuuggaguuaggagguccuggagcaggugaggauggagccggggcuacggugggaagccugguggggucucaggaaauccuuugcaaagaacugggguugguuccucuguuucaccugcggugauuccuuugcucccccaaacucccaacagaaccugaacagaaagaacaaucgacaggacagaagcggccuuugaagaacgacgaacuauaacccccaccucuguuuuccccauucaucuccacccccuucccccaccacuucuauuuauuuaacaucgaggguugggggagggguugguccugcccucggcuggaguuccuuucucaccccugugauuuggagguguggagaaggggaagggagggacagcucacugguuccuucugcaguaccucugugguuaaaaauggaaacuguucuccuccccagccccacucccuguucccuacccauauaggcccuaaauuugggaaaaaucacuauuaauuucugaauccuuugccuguggguaggaagagaauggcugccaguggcugaugggucccggugaugggaaggguaucagguugcuggggaguuuccacucuucucuggugauuguuccuucccucccuuccucucccaccaugcgaugagcauccuuucaggccagugucugcagagccucaguuaccagguuugguuucugagugccuaucugugcucuuuccucccucugcgggcuucucuugcucugagccucccuuccccauuccccauccagcuccuuucccccuggguuuccuuggcuuccugcagcaaauugggcaguucucugccccuugccuaaaagccuguaccucuggauuggcggaaguaaaucuggaaggauucucacucguauuucccaccccuaguggccagaggagggaggggcacagugaagaagggagcccaccaccucuccgaagaggaaagccacguagagugguuggcauggggugccagcaucgugcaagcucugucauaaucugcaucuucccagcagccugguaccccagguuccuguaacucccugccuccuccucucuucugcuguucugcuccucccagacagagccuuucccucacccccugacccccugggcugaccaaaaugugcuuucuacugugagucccuaucccaagauccuggggaaaggagagaccauggugugaauguagagaugccaccucccucucucugaggcaggccuguggaugaaggaggagggucagggcuggccuuccucugugcaucacucugcuagguugggggcccccgacccaccauaccuacgccuagggagcccguccuccaguauuccgucuguagcaggagcuagggcugcugccucagcuccaagacaagaaugaaccuggcugugucagucauuuugucuuuuccuuuuuuuuuuuuuuuugccacauuggcagagaugggaccuaagggucccaccccucaccccacccccaccucuucuguauguuugaauucuuucaguagcuguugaugcugguuggacagguuugagucaaauuguacuuugcuccauuguuaauugagaaacuguuucaauaaaauauucuuuucuacaguuuuugu

SEQ ID NO: 15956 - RNA, 13081 nt, Homo sapiens
acaaaaacuguagaaaagaauauuuuauugaaacaguuucucaauuaacaauggagcaaaguacaauuugacucaaaccuguccaaccagcaucaacagcuacugaaagaauucaaacauacagaagagguggggguggggugaggggugggacccuuaggucccaucucugccaauguggcaaaaaaaaaaaaaaaaggaaaagacaaaaugacugacacagccagguucauucuugucuuggagcugaggcagcagcccuagcuccugcuacagacggaauacuggaggacgggcucccuaggcguagguauggugggucgggggcccccaaccuagcagagugaugcacagaggaaggccagcccugacccuccuccuucauccacaggccugccucagagagagggagguggcaucucuacauucacaccauggucucuccuuuccccaggaucuugggauagggacucacaguagaaagcacauuuuggucagcccagggggucagggggugagggaaaggcucugucugggaggagcagaacagcagaagagaggaggaggcagggaguuacaggaaccugggguaccaggcugcugggaagaugcagauuaugacagagcuugcacgaugcuggcaccccaugccaaccacucuacguggcuuuccucuucggagagguggugggcucccuucuucacugugccccucccuccucuggccacuaggggugggaaauacgagugagaauccuuccagauuuacuuccgccaauccagagguacaggcuuuuaggcaaggggcagagaacugcccaauuugcugcaggaagccaaggaaacccagggggaaaggagcuggauggggaauggggaagggaggcucagagcaagagaagcccgcagagggaggaaagagcacagauaggcacucagaaaccaaaccugguaacugaggcucugcagacacuggccugaaaggaugcucaucgcauggugggagaggaagggagggaaggaacaaucaccagagaagaguggaaacuccccagcaaccugauacccuucccaucaccgggacccaucagccacuggcagccauucucuuccuacccacaggcaaaggauucagaaauuaauagugauuuuucccaaauuuagggccuauauggguagggaacagggaguggggcuggggaggagaacaguuuccauuuuuaaccacagagguacugcagaaggaaccagugagcugucccucccuuccccuucuccacaccuccaaaucacaggggugagaaaggaacuccagccgagggcaggaccaaccccucccccaacccucgauguuaaauaaauagaaguggugggggaaggggguggagaugaauggggaaaacagagguggggguuauaguucgucguucuucaaaggccgcuucuguccugucgauuguucuuucuguucagguucuguugggaguuugggggagcaaaggaaucaccgcaggugaaacagaggaaccaaccccaguucuuugcaaaggauuuccugagaccccaccaggcuucccaccguagccccggcuccauccucaccugcuccaggaccuccuaacuccaaaggcucagugucuccuggcucggauccugcuuugggaagaaacagguuagucuccucagaagggaggaagaggcuaagggaaggcugggccaguuuuuccaugaagagccagcuaguaaauauuuuaggaugcauguaccacauuuggucucuuugccuacucuguuuuuugagacagagucucuguugcccaggcuggagugcagagugcaguggcgccaucuuggcuuacugcaaccucugccucccagguucaaguguucuccugccucagccuccugaguagcugggauuaaaggugugcgccaccacgccugacucuuuuuuuugguauuuuuuuaguaaagaugggguuucaccauguuggccaggcuggucucgaacuccugaccucaggugaucuacccgccucagccuuccaaacugcugggauuacaggcgugagccaccgugccuggccuuuuuuuuuuuuuuuuuuuuuaaacaacccuuuaaaaacgcaaaggccauucaagcucaugggcugucuagaaacaggcugugccugccaguuugccuaccccugggcuaaugcaacauccacgugcucaaccaugguugcuccaacucaccagucucuacuuucucagguucugaaaugggcucugcaucuucagucuggccuagaaggaaaccagggguaagacauagccucaggaaggaaaggaggcugucucccuguccagcagaacaugcagccagguacccuguucucaccugcuggagggaugaccuucucccccuggucacuggcacuggcauugagggguggcucugcccgggucccauucuuguccuuaggccggggccggggcuugguaaacuuggccuuauugagcagauacugcaccucucgguccagggccaucaucuuagcuucaaugucuuuugagagcaacacaggcuucucuguggcgggcagcuuagccugcucggccagaguugcauucuuccaggccugugggugagaccaggagaggcuccaagcuagccauggagagagcagacaucucugucccagauggaaucacacccccaaccagccucuucccucagacugcaaaucacugccaccccuggccucagccccaagaggcuaacagacuccucagaaggguauuaaagguucuccacaaugaagucccaaccugcagguuucugguuuacauccuacuacucuggagugacuacaacugaacaaaccccuugaauaguccuuuuuuuuuuuugagacggagucucgcucuguugccaggcuggagugcaguggcgcgaucucgacucacugcaaccuccgacuccuggguucaaaagauucuccugccucagccuccugaguagcuaggacuacaggcgaccacgcccagcuaauuucuguauauuuaguagagacgggguuucaccauguugaccaggauggucucaaucucuugaccuggugauucgcccaccucagccuccuuaagugcugggauuacaggcgugagccaccgcgcccagcugaauacucauuucuugacucuccacuuuacugagcucuggcucaagaguccccacacauccaaaacaguuucugcuucacaugacacaucaguuucaccuagccaaacccuggcccauguucugaaccuagcucaaaucccagccccucaaagcagcuuucucuguccucaugggaugggcuuuuuugcuccuccaggcugaugacucuuauggccauggcccuugcuugggacuaaucagaggugggcucaaauacaaacaucuuuugucuucagguuagaugcuaagccaggaggcaggggcugcuguggcuucaucucuccaccucucccacaguaccuaggauggcagcuaaguaucugguuaaguauuuacgaagugauuacccaggucucauugaugacuuucucuaacguugucaucuccaccucagugaagaucugguccaucucugggaugagccgggccccccuggaagccagaaaggagaccauuagccccagagggagaggggccuggaguguggggagugggaagcugguaggaaugaaaaccaguggccuuggcaggacugcaaaaaggguucaggggcugcucacuugaggaacaugcuggaaugguugaggagauuaucgagggcagacagccguucgggccacuucuugcgcuccucuacccgaaaaaacagcccuuggcacagcuuccucagcucagccagcuucuccuucaacaucugauggaugugcgauugggcagagggguggaagggacgacagcagagccuggagucagccccauguccuucuuuaugggcucaagccccagcucuucucucucucugacccugggagaggaaggagagcucccacuccaccugccauguccugagaggccccucaccacugugguggcuccaacacccucauccuccagccagguggaugcggcgcugagcuucccagagaucuccucacgcugcuccucuguggacacuuccugguacucgggcugguacagcuuguccuggggagggggacauguaaacacaugcacccacaagcccagaggcaaggcccacagagccagguguaagcccagugggggggcugcugccuccugcccacugaccugggucucaaauaugaaugcuuccaagcuguuggcagcuuuuucccguuccugcuucuccaggucucggagugucaaguccugaagucuaugggacaaaggagggguagggaugagggagagggcaagugagaacuugagacucuggguccgacagcccucccucccagggcgccaucccacauccugcccaccuugcacacacauguacacacacacaccagcuguccucacuuacuucugcaccgacugagccagcuuauccucuggcaagucaggcagguccagaacaaccagcuccaccccgaucuccucuaccauucgccgcuuccuggcgggcuucugcuucuucucucccucuggggcuggagcgacgcccucaggcccugccucugccuucucacuugguuucugggugggaagagucaggggugucaggaaaagccucugcccuccuacauucuccacaaggccagaaacaaggcaggcgccugcucccuuagccucuggauccacacuggccuuccucugccacagcucaccugggccucagacuuguccccauuuucuuuuucuguggccuuuucucccucagggguugcaucucccuuagguucagggggugggggcugagagccauccuccacuggggccucagcuuccuccuugagcuccaccugcuccccaggcucguccuugcuccccucugcagggcucuccucuuccuccugggaaacaccacaggcgccccagggaacgaucaggagcagagccuccaggcaggccuggcucggcaccgccgaccccauggggguuccauacaggugacugcuguauggaaacggucaauggccugcuuggacuguggcaaucuagcuggacaaaggaagagcaucugcaaugaggggaaugggccuugggagcaccagucaagaaacagcucagagcccagaggauccuggggagugaaugguuaacacaacaggggcagggguggccuacccucacccccuuccucugcggcuacuaccugcaucccccaccguccuccaugcuucccuggcuccauccugaacucaccuggacaguaucaguaccauucuccuuggcaucuggugugguaccgccuccaaacaggcuggaaaugguguugccaaguucuagggggaguaaaacccaaagacucaaaaggagaccacagcagugacuccaccuucuaacccaagggccaugcccuguccaccuccccaaccuucacacaaguauauucucucccauacacacaugcaugcucaucuuacuggugagaguagauuccucuucugcgcuguccucuaccagugucucaaauacagacuccaccugaaaacagguucaaaaugaaaaaauacacaggcuaauccaccuuuucuccacaaacaucugccaaaguggguguuugcuuaugcacacuccaugccgucacaggccuagucucucaccugccuuuucuaaggacuuggagguggcugcccaucuccuuugauuaagagcccuccaugaauagggucccagcuccucuuucuccaaagagcccccuacuucuccacucaauaacuguauuggcuauuacauccauauuacccccagauuuguucuucaaaaacggauuccuggccgagugcaguggcuuaugccuguaaucucaacacuuugggaggccaaggcagguggaucacuugaggucagggguuugagaccagacuggccaacauggugaaacccuaucucuacuccaaauaacaaaaauuagccaggugugguggcaggcgccuguaaucccagcuacucaggaggcugagacaggagagucacuugaacccgggaggcggagguugcaagaucacgucacuguacuccagccuggacaacagagcaagacucugucucaaaaaaaguaauaauaauaauaaguggauuccugaggcugcguggcucccacccauaaucccuguacuuugggagguugaggcaggaugaucgcuugaucccaggaguuagagaccagucuggcaacauagugagacccuaucucuauaaauaaaguacaaaaaaauuucgcaggauaugguggcacauacguaucgucccagcuacucaagaggcugagaugggaggaucauuuaagcccaaguguucaaggcuggaaugcgcuaugaccaugccauuauauuccagcuuaaguaacagagccaagacccucuccaaaaaaaaaaaaaaaaaaaaaaaaaaaaaaaaaaaaagaguggauucuucaaaccauucaauuguuccaagaaauuuacaaugccuauaucaaaccauucaauaguuccaagaaauuuacaaugccuauaagcauuuauaggcuauaaggaggucugcaccagaucaucaguuagcucuguucagagccaacauuuuucugauuccuaaaccuuuuuugguuaucuuauccuaaugccauguggaacccacuuuggaaauggcuggcagggccugagccccugcucugcacacaggguauccuuuagcucucacccugucuagacugagcacgccacucucauccagguugaagugagccuugaugcccuuggacucguagucaggauacuucuugaagcugucacccaccccuuuuagcuucacuguggucagauucugggagccaaauacccugguugggaaggaaagaggaguucagggggacccaccccagcccaucucgcccucuagacuacauggccuccuggcacaaggugucaggggcacuccccaagggcacacucaagaggacggaugcauucuccagcgaagcugaucauagcugcccuguuucagccccgcaggcccacauccucccucacccccaguccucagauuauccagcagccacgccucccccucccuggagcucccauccuacaccccugccccucaccgaagaucuucaggccccaggaagcccaggucgccguaguugauguggaaguugaaaucauggcuguagcgguuaaaggugaugacuuugcguugaggguagggccccauccgagagaagaguacccguuuauugugcuucaggcugugaaucccaggcuccuccuccaccucccucgugaacuccaccuacacagcaggcagacagaggcacacuguugcacacuagagaacccgaguagguucugggguaaggaugggggugggaugggggagaccucuuagcagaaagacaaagggaugagccagagcagacagaaggggaaacccuacuugggagagguaaagggagcuugucaccugcucagucaggcucacucaccaggaugggguagaccacugcaucucggacgacaaauggcuucacuuuaaaggcuuugcugagcgcagcugccugguacacugcccccauggcggcugcuucaucugcauugauguucuuccccagcuccucccugggaaagccccaagccucagcacggucuacccuggagcaugcaaccgggacuucccuccccucagcccuccagcugcucagcccaaagcccugccccaggcagaacucagccaagcgcucuagcccccacacucacuugcccacggccuucagcagcaccuccugaacucuggggacccgaguggccccacccaccaggaucaccugcucaaucucauccugcaguggguaagaaugacaggugcaacagcaugcaguuagcacugacucgucccuugacgucccauggguuuccuaugcccuuuccuacggggcauucccgccuuccccuacucgcucaccagacucauuucggcacucuggagggccugcuguacaggcccaggcacccgcucaaacaagucugcacacaacuccucaaauuccacacgagucacuuuugccuugaaguccacaucauccaucaggccuucaaucugggagaggauggggacugucaggggguucuugcccagcucccgcucucuuggugaguaggacagaaacaaaaagaauaggucuuugggaggaugguagcgggaggagcaugggccaugccaggcacgagcagcccaguucaguggcagggucccccacccucuacgugggacaaaauauagccucaaccagccacuugugggcaccugugccauguggucagcguuggcacugaggacgguuuugagccgauuagccucacgcagcagcuuggccauggcacgcggguucucccgcacauccuuugcucucugacccuugcgcugcucauugaaaagcccagccaggcguucucgaagccggagcuccaucuccaggccccccaggguacggucaaaucuguugagaaaagggagcagggaaaaaagugaagaacacauggaguccccgcaucugcacaggagccucucauccccacauggcaccuuuccuucaucucaggggaccuuguucaucuccagugccccauguguggacacacacucugcccucaacucucuacagcacagcugacaccucgcagugacccuucuuccacucauucauucgacaguguuuacugagcauuacuuauguacuucccucugggaauacaaauguggcgguggggagagagacagggucccugcuauggaaaaguugaauaaucacacaaaugugaaauuaucacuacgucacauguuguaaaggugaggggacaaugccugcagaacaugcauggggggagauucaggcuacugagggagacccaagaacaugucuccuaaaaagugaugcuugaacugaaaccugaaggaugaguucagugcaagcaucacuugaacugaagaguucagaguucacuagcuggaggggaaagaacauucuagacagaggcaacaacguucauaaagaccuugaagugggagagugcauggcaaguuccggaggagggcaagcaucacuggggcucaaaaagcgagagggcucagggcucagacaggcugcagaaggcaggguugagacaggcacagggaaaguuauggagccagcgacagguuuuuaaagaaacagguaaugauuagguuggauuuuaagaagaacccucuggcugcaauaugaagaaagaacugaaaggagacgucacuaggaacagggagauguuuuuaauucugcaaauaagaggugaugguaacuugggcugggugguaauggugaagacggaaaaagaugauuucaagaaauaagacaacagggcacauguucucaggaucuccugagggcuaugucacaggccauaaaaaaaaauuuaaaaagagguaagacaacaagaaugguaaauuauuuaacuggaaaugacaagagaacaaaaacaugauugaaucugacacccuacauauugccugcggcuccauggauuuccuuagaauacauuuugaaaguuccaugucuuccaguuuucccaaacuguccuccccugagccucagcuuccccuuacucuuugugagugguccccuacaaugacugaugccucaaucaggagaccauuccugcagcaugcaggaaagcaaagcagugugucuccuccaagaagaaaccccugacuugagggucuucacaagcagcccucccugccaaguauccacuuacccuacuccccggaucugcagcuguggcugcaucccagcuuccuuagucuucaccaucugguaggucacaauggugcauacggugcugccugagcccaugucauagaacaugauauucuguagagauaucaaggcaacugucacaggaaccuucucaaacuccagggggccugccugcccacccaccugcuuccaaugggcugucugacucuuaacacaaaacuaaacagcuccaacaggggcugggaggaggcuauuggugcauuuugccaagggucagcccagccaugcaaaccagaugcaaaagggaccaaguggccuccauccuuagauucagucacccugcaugucuggucaaggcuccccuggcucaccugggcagugguguuaauaucuuuccggcggaagacaccauagcugagggcaguggcgguguugucauugaugagcugcagcacuuugaggccagccauacgagcagccugcagcacagcucggcgcucggccugguugaagaagacuggcacggugaucacugcauccuugaugggcugcucuacagaugacaacagaaaagggucccgccggcuccauaccuuagaugagggcuucuaaucuggucacuaaugacauuuuggacuagguaauucuguguuguggggcuguccugugcacuguaggauguugagcagcauccccggccucuacccacuagauagcaggugcaccccucagaugugacaaccaaaaucuaucuucagauguugcuaaauguucccugggaggcaaacuugccccuguuggagaaucacugcccuagauccuggggagccuggcccuaagggccccaccuugaccacucaccugcaaaaucuucagcuagagaacgagaauaauugagaaccaugcccaacacuuccucaggugagaacugcagcugccugaggggaaggaagguaguuggagccaaggaaagccaggcauuaaggcaggacaaucaggaacacacaccaaugaggagcccagcagcguugccgagaccaccuuccccaacagagcacucacgagcugaucugaaagugcacagucugccucugugggucgaaagucagcucgugcuccgggaagcgggccugguaaagagcuacauggggguuaucugccugcuuccccaggaggugcuggaaguaacguagcguagccuuuggauucuuaaucgccugaggggugaagaaggagcagacuaguauuaggcucccaaguccaccauuaccuaccucuuacaucacagagacugauaaggaaacagacucugggggcugccaucuccucuccucugcccaccacucugggaagagggacugcuagcucaccaugcuugcugcacugucuccaaagaaucuuucauuuucuuucagggucacgaucaccgguguuuuccuccgagauucccugaggaaaagagauuuugggcccaggugccugcagcagaaggacucagaagccucgacacucacacacauuuaaccacucagaugccgaagucugcugugggcacuaugacuaacacauucacacuuggagcccagacucccucguuccccacccuuaacacgggggccacccucacuuauucaagacaauuuccaugggcacuccagguuugacaauggccaccuucauggacucacugcccagguccacagacaucacugccaguguaucugaagggaaaagagguuugucaguuagcucucccuucgcccaccuuccugggacucccucuaaucaaagcauaccacuuuccauggguaaacgaagauggcaaaagacaaaaaggccuggaccuaacaacucaagagacuucuggccaacagccccaagcucaauucccaucaugcauccuucagucaucauuuauccauuugcucccucuacugggguacauaccacucagugccaacaggucugccaagagcacagccaccaaggcccaacagacucgccuccucggccucugccuccuaacuuugucugccauagugccccugggggaggcgaagaaagaaaacacuuaaaacuggauacccggagugaaggagacagaaucacaucccagaacggagaggcuguaagauucauaucuacuucauucuuacccagggcagaucagccuacuucucccuucucccuccugauggguacaaaccauucucuaaucaucccagcagcgcccacacaaaggcccaagugaaagagcauggguccucggcuuugccacaucccuaaacagagaagcuaacaggacaagagaaaggagacccgagccuuuuguccaccacacaggcagugaguggcgcaccgcagcacugugccuguugucagacaccuggggugcggccagggauccccgcccagggcucaaccaccuccccacaccuggagcucccccgcugacggggaaagccagcugggccuggacgggaagagaaagguaaugacguuggggguagcuaggaugaaggaaaggccuaucuccuccucggcaucccugcggguugucccgcccccuccccuuucccagcucacuccccggccccgcugugcccacagacgcagugccaggggcgguaagguuccccgcccggcggguagccguuacccgguguucaccuaaaccccaccugacgaaggcggcggcucccacucccggaaacggaucccggcccgccccagcaaguggggacagaccgggggccgagcugcgugccccccggugcgaggccgagcgcccggcguccgcgcggcccucccuugcgcucccgacccgcccccggagcucgcacgcugucuccccuaggagggguggccggcccgcaccuccauccacccccgcuaccucuugccuccgcuccugcggccccagcucugggacagacgcggcacgaacguacccacgaggccggcagcgccccccacccgcgcccuucacaacuccucucgguuugcaaacuguuacauuagccaccaaccucucggcggcgucucgcgcaccagccggccccggacgcggcgcgcgcucauuggagccucggccgcccggcccugcgcugcgcgcccggccccgcccccgccgcccc

SEQ ID NO: 15957 - RNA, 5240 nt, Homo sapiens
aagcgcucgcccucuagccugaggcggaagacaggaaguggauucuaguucccaagccgcaccgccuaaauacugccggagucugcgcuaguugugacgcauacuauagcgcuguuuuccugcacugauaaacgaaaagcaauccaccaggucucggcagcuaacuuuccggcacuacuuaugcccgagcgugucgcucccagugcgcaagugcagcagguggcugcacggggggcgcgggaggaggaggaggaggaggaggaggcugggguggggccggcggcaagugcugugaugcgguuccggggaggggccgucggguagaggcugaauaccaguuuccgagcggcaaggcagcgauggcgauuuuuaguguguauguggugaacaaagcuggcggcuugauuuaccaguuggacagcuacgcgccacgggcugaggcugagaaaacuuucaguuauccgcuggaucugcugcucaagcuacacgaugagcguguguugguugcuuucggccagcgggacggcauccgaggugggcuaggcucgggcccguggcgggugcgggggugggagggccccagugcuguagaagugggcugguuguaggugcgggguugggggaaaagggguugugucgggucccuuguccccucggcggaauccccgggcugcaccuucgcugaccguuagcuucaccucugcagugggucaugcagugcuggccaucaauggcauggacgugaauggcagguacacggccgacgggaaagaggugcuggaguaucuggguaacccugcuaauuacccgguguccauucgauuuggccggccccgccucacuucuaaugagaagcuuaugcuggccuccauguuccacucguaagucccccgucuccugaacggcagcgcuuguaauuugucuaccuuuucuuaaaucgucguucugguguuaugaaaaacgcaaccgauccagaucuagauuuuagguaauaacggcaguggugucaucuuuuuuugcuggguggggaggggccgcggaguuacccaggcuggagcgcaguggcgggaucucggcucacugcagccucugccucccagguucaagcgauucuccugccucagccucccgaguagcugggauuacaggcgcgugccaccacgaccagcuaauuuuuguauuuuuaguagagagggguuuugccauguuggccaggcuggucucaaacuccugaccucaggugauccaccugccucggcuucccaaagugcugggauuacaggagugagccaccgcgcccggccgaggugucaucuuacuuaaagucaacuucucuucucugagccuuaguuucuucauauuuaaagaaagccaguuuaacuaaaugaccuuuaaacuuuuucugcucucaauugugauaucagaugugccggccuuugcuuaaacacaagcuuaguaagcguggcacauauuccuagaguauucauuuuacccaaaguuuuagauguaaaaugucuuguaacaaaguaugaauguaaaauauucacagaauucaaaugaacuuagaaauuuugacacuacugccagucaguucacacuacuucuccugacugucccaggcuguaaugugaacuccucagcaaauagggacacuucaguggaaguuugagaagcacuccuuccuuagagcaacuuugccuccuuugcauauaggcucuuugccaucggcucccagcugucuccugaacagggaagcucaggcauugagaugcuggagacagacacauucaaauugcacugcuaccagacacugacagguaugcaucuccacggaggccagaggagugugauggagaagguggggaagagauacugauaaguuugcaucuccaggugggccagaggagugugguggagaaggugggaggaggggguugaccaaagacaccuuugguaagcaagaagagggggugugcuuuuccuggcacaauucuuuuuuuuuuugaaauguuucacucuuguugcccaggcuggaaugcaggggcaugauccgcccccuggguucaagcgauucuccugccucaggcucccaaauagcugggauuacaggcaugugucaccacacccggcuaauuuuucuguuuuuauuagagaugguguuucuccauauuggucaugguggucucaaacucccgaccucaggugauugcccgccucccaaaguguugggauuacaggcgugagccaccacacccgacccacaguucuuuuuuuuuuuuuuuuuuuugagaugcaguuucacucugccacucaggcuggaguguaguggcaugaucuuggcucacugcagccaccaccuccuggguucaagcaauucuccugccucagccucccaaguagcugagacuacagaugcccgccaccacacccagcuaauuuuuugugggguuuuuuuguuuugucuuguuuugagauggagucuugcucugucacccaggcuagagugcaguggcgcgauguuggcucacugcagccaccacuacccggguucaagcaauucuccugccucagccuccugaguagcugggauuacaggcauccgccacacgcccagcuaauuuuuguauuuuuuaggagagaugggguuucaccauguuggccaggcuggucucgaacuccugaccucaggugauccaccugccucugccucccacagugcugggauuacaggcaugagccaccgcgcccggccuuccuggcacaauuuuauagacacaucuguuuguuuguuuugugaauacaaaaccaauauuuaaucugaaacugauuuuguccaugccacccagcauguucagcagagguuaucuuguguucagauaaaacucaccuuaaugcuauuuccuguugcguguacuuuggaagguguuaaguguuuuuccaaaaugaaauuugaaagcaaaauggauaugaccuuuggauugccagugucauugcuucacccucuucauuuauugaaaacugccugacuuuguccccugccuggcaauguuucugcugagggacuccaaaacuguuaguaaguggcagagcuagaacucaaagccuggucuuaaucaggugggugacauaacaaaguuacuucacuucucuggucucaucgguagauucaaagucuugccuuuccugcauuaugugguaaaaagaauaaaauuaaaauaggcuuaugaaaguguuuugcaaaauugaaagugcuguacaaauacaggaugacacuauuugcuccagugucuacgcuuugguaaccauucuuggucucucuccagggaucaaguuugugguucuagcagauccuaggcaagcuggaauagauucucuucuccgaaagauuuaugagauuuacucagacuuugcccucaagaauccauucuauuccuuagaaaugccuaucagguaaguggccccacuucccagauacuguuuaaagcguccuugccccucccugugugcucuguccaaaguuagcugaagcauaguagaguauuacuuuuuuuguuuguuuguuuuugagacggaguuucgcucuuguugcccaggcuggagugcaaugaugcgaucuuggcucgcuguaaccucugccucccggguucaagcgauucuccuggcucagccuccugaguagcugggauuggaugcaugugccaccacgccuggcuaauuucauguuucuaguaaagacaagguuucaccauguuggucaggcuggucucaaacucccggccucaggugauccaccugccuuggccucccacagugcugggauuacaggcgugagccacugcgcccggccgaguauuacuuuuaaguaagacacaaggaaaggccgguggcucacguguguaaucucagcacuuuggaagacggagaggguaggaucacuucagcccaggaguuugagaucagccuggacaacauagaaccccaucuuuacaaaaaaaaaaaaaauuagccuggugugguggcggacaccuguagugccagcuauuaaggaagcugaggcgggaggauugcuuaaaccuggaaggucaaggcagcagugaaccaugcucgugccacugcauuccagccugggcaacagaacaagaccgugucucuaaauaaauaagacaacaguagcugggugcaguggcucacgccuguaaucccagcacuuugggaggcugaggcgggcggaucacuugaggucaggaguuuaagaccagccuggucaacauggugaaaccccaucucugcuaaaaauacugaaaauacaaaaauuagccagguguggucgugugcaccugcaaucccagcuacucaaguaggcugaggcaagcagaaucgcuucaaucugggaggaaaagguugcagugagcugagaucgugccacugauuccagccugggugacuauuuagagaaaacagacuuuccuugguguuuaugucauuuuuguuuguuuguuugugggguuuuuuuuguugauguuuuuuuuuuuuuuuuuuuuuuugagacugagcuucacucuuaaccacccaggcuggaaugcaauggugccaucacggcucaccacaaccucugccuuccggguucaggcgauucuuuugucucagccuccggaguagcugggauuacaggcaccugccaccaugccuggcuaauuuuuguauuuuuaguagagacaggguuucaccauauuggccaggcuagucucaaaguccugaccucagcugauccgcccaccucagccuuccaugauauauguuguucuucaagcaguuuccccuggcuuaaguggggagaaagccucaggccucacacuuuuuuuccucacccugggcccggcuuaggugugagcucuuugaccagaaccugaagcuagcucuggagguggcagagaaggcuggaacuuuuggaccugggucauaggcugaaccuguuauggacccccaaauucugagaguuccugcaacaagaauacugcuguugacacuccaguggaaaucccagcagccuuguuagugcacuugaaagugggagaaugcugacccugaugacuuguacugauuccugagccuuaacacugugcucuuuccuucuguauauaccauggucuuacuuuccaacucuguacagauuuauuuauggaggagcuagguccauaaauguuguaauaaauauuccuuugaucuugguguuugcaauc

SEQ ID NO: 15958 - RNA, 31275 nt, Homo sapiens
ugggguagcuagaggaaccaacccccauuucuagaacaucccugccagcucuucugccggcccuggggcuaggcuggagcccagggagcggaaagcagcucaaaggcacagugaaggcuguccuuacccaucugcaccccccugggcugagagaaccucacgcaccucccauccuaaucauccaaugcucaagaaacaacuucuacuucugcccuugccaacggagagcgccugccccucccagaacacacuccaucagcuuaggggcugcugaccuccacagcuuccccucucuccuccugcccaccugucaaacaaagccagaagcugagcaccaggggaugaguggagguuaaggcugaggaaaggccagcuggcagcagaguguggccuucggacaacucagucccuaaaaacacagacauucugccaggcccccaagccugcagucaucuugaccaagcaggaagcucagacugguugaguucagguagcugccccuggcucugaccgaaacagcgcuggguccaccccaugucaccggauccuggguggucugcaggcagggcugacucuaggugcccuuggaggccagccagugaccugaggaagcgugaaggccgagaagcaagaaagaaacccgacagagggaagaaaagagcuuucuucccgaaccccaaggagggagauggaucaaucaaacccggcgguccccuccgccaggcgagauggggugggguggagaacuccuaggguggcuggguccaggggaugggagguugugggcauugauggggaaggaggcuggcuuguccccuccucacucccuucccauaagcuauagacccgaggaaacucagagucggaacggagaaagguggacuggaaggggcccgugggagucaucucaaccauccccuccguggcaucaccuuaggcagggaaguguaagaaacacacugaggcagggaaguccccaggccccaggaagccgugcccugcccccgugaggaugucacucagauggaaccgcaggaagcugcuccgugcuuguuugcucaccuggggugugggaggcccguccggcaguucugggugcucccuaccaccuccccagccuuugaucagguggggagucagggaccccugcccuugucccacucaagccaagcagccaagcuccuugggaggccccacuggggaaauaacagcuguggcucacgugagagugucuucacggcaggacaacgaggaagcccuaagacgucccuuuuuucucugaguaucuccucgcaagcuggguaaucgaugggggagucugaagcagaugcaaagaggcaagaggcuggauuuugaauuuucuuuuuaauaaaaaggcaccuauaaaacaggucaauacaguacaggcagcacagagacccccggaacaagccuaaaaauuguuucaaaauaaaaaccaagaagaugucuucacauauuguauuuauauauuuauauuuauauauauauuuauauaaugguacaaaauggcuggggguguggccauggauggagggaagaguaggcuggccuguggcgugggugggaggagaggggacggagagggcacucggcccgcugcaaucugaccccucucuccucagggcaggaaacacagagucagacaguuugggggggucuugggccagggguggagggcucaagggcacagggcccaggcugaggcagggcgggcaaagcgccuggcaggaugaagggcaaguggccccccaaacacagaggcccuggccauggacccugggaggugaccggggugagucaggggccuguugucagccccagaggaagcgcuggaccuggccgauggugggccgagaggacagcaccaggcugggagaaguggggcgaguucccuuuguauuacagcugccagugcaagaccaggcccuccaggccaggaaggcuagggacggguccugguagaagacacccugucuagaauggcccuugguccuggagguggggcgcaaaaggccucagccagggaacugcccugccaccucccgaggcaggaaaggaagugagaaaaggagaaguuuuuuuacuccuggggccaaaguagggggacaaacacccagucguauauggcuucagcucugaccaaaggcggauagggagcucuccuggguaggagcagggagccaagggggaggcaguggcugugccugggugggcacagacagaucugguacauggcccugagcccugggcagagggacaaccuugccggugagugggcaggcagagaggaggcggcaggaugcuguuuccccgauuccauccucagggaguggagacuggaggggaggugcacugacucagaugaacuguucucccccuucuuugauaagaaguagguggcagcagccucuggaaaagucagggcccuggagguuaccuggcccagggcuacuacagccacaggccccaguggcaccaugccaccccuuccauggcuccacucaagggggccacacagccaccgccucuuccuccuuuccuucaucccaaacugggacaaaagacuucaaguucuggcuaagauguagcagcagcggaugcccgggcauccaaaguggaaagccagggccccgugucaccggugugggcaaacacacaugcacgugcacacauguucucccugaaucacucagcagcagacaggcugccgcccugggggucucagcccugcuagggcucaccagguggaagccuagguggucugaccucaguuuaggagugggucauuuacgucaucuuaccauuuggggacgagacaggaaugguaucccuuagggacccagagacacugcaaacaguggguggccauguagggcugcaugucccuggguccaggggaauggagggagcaauaacuugaagaaggggggaaggguuucuuuuauccuuuuuuuuuugugugacuucuaucaaaacacagaaauacagcacacgcacaaaccagcacaaaagcgcagcgcucuauuuacagcuccggcuggcaccugcccaccuggccagccgccugcagggaggggugggagaggggucagccacaucagcagggaaaggauacgaagcagguaaagacagaaggaaaaugggcgggugcggagaaaccaagagggagguggagcuccagcaaugcggacacgaggagacaggagcagaaggggcugggggagaccugaccuguccuuccucucuccccccagauucccauccaggacuccaaaagcauagcugaaggggguguggcgggugcagggaugcacggaaagagguaaaauagagaggcuccauaggaauugggaggagugggggaggggcaguccugguggccgaaauggaaccaaccccaaugcaaaaucccccaccccacacugccacuucccccuaagcugccagcacaucugguuuccacaaaugccacucccuacacaagcccccucccacccccuccaccccaccccgcgacccaggccaucccaacauugaggggaagaacuuuguuaagguuaucguauuugcaacauugccccggcuccagcccuggcagcgacuucuagaagggcagguuggccaugccgccuggugccgggagguagcccaucuggcuguccagggacacacugcgcugccgaagggggugggacaccaugagguucugcuggggcggggggcccaugagggagcccugcggggagagcauguggggcggcuggcuguagaccucgccccccacgccccgcugcuucaucagcaugaaauucugcugggucaugaggccuuguggaggggacaugacccccuggugcaggccauggggcaccauccccugcugugggggcacgccuguccugcccagcaaggacaucuguccaggguggcacauggacauguugagcccccgcuggacgcccugcuggccugggagguugggaggccgagagggagucugcuccgccaucauguucugcagguucaugagaugcagauuagggggcugagccuuggggggcugguucucgcucuuggggaaguacuggagggugcugcuuggcuucucagaggggaugauccucgacaagucgaacucggggauccccguuggggugggccggaucaccucgcucagcucggggucguucagcacugaugccaccccagggagcacacccgguggguaugcgucgcccaugcgcccagccauggcuuugcccaucaggugcugcuggggaggcauggggccuggcggcugguugggcagguccucgggaggcagggccaugccugacggguagugcugcugcaggccaggccccccgcccccacccccagugggggccauggcaccauggggcugcugcagccgaggggggaagggcaucaucugggaggagcugggcacugggccacagggggcauucagggagucggggcccccuggggccaucaucauggaguuuugagggggccccccuguccccugugcguugggaugcaguggaauguuggagcccagaggggugggggagggcagcauggcgggcgggggcucaugggacaggggcugcuggccuggcagguucaugcccauagggcucugggcagcggcugaguucaggugcaucuggcugggcuggcuguugcugaucccuguagggaauagaagacagggggucaggcacggugugcccagcucggggagggugcagggcucaggccuuccccacucccaagccagggggugccagaggucaaagucuucaccacuggcuuccccuggcugggagggaagggacuggaggcauugaugcuagaagccaagagaccaaguucuggcccaguucgccagacacaccaccagguguuggaaagaccacucgagugcucugggcuggguuucccuaaugacuccagcgagugggaacagcaucccggagccuccacccccacacccagggccuucagaggcacaaaaaagccagcacaaccacagcugugcuccccgcucccagugcccacaccagcuggccucccuggggcccuggccuguccucgcaccuggcccggagcccugcgguggugguggggggggcagcaggggccggucgggcagcagcucgucgucugagguggcgauggucuugauggcauugugguagagcgggguggagcugggcauggcguacuuggacaucugggucaucaucagugacaggggguucugggaagguguggggucuggggaggaagugaaugguaggcugggguucaugaggccgcugggaggguuggcgggaggugcugaggagcugcuccgggggccgcuaggcgggaggguaccuacagaaacggggagacaaagagagcaggggugacuggggaggggcagaugaguuuggcuguggauauggggagguuuaggaagcggucaguuccccaaaucaccugguccuucagacacacccacaggcccccacuaucuccagagcccaccagucuucaagcaauuccugcagccucagggccccaggcaaggggaagaucccaggccccaaguacgaucacucaaaaugccugggagacucacgugguacccccugagaaagcccacaaaugucaucaucugccccauaagcagagccauccaccucugggcccgugguacacaggcccuuacucacucacugcccagccccagcauggacacacugcucagcgccugccugccugccugccugccugccugcgcaauugacucacccuguuccauguugcucagggugguggaagaguucauguugagaggcggcugcuuguucugggagacccccgggcugggcauggccgucuuaggugaggcaacccagccuggagaaggcaccgccauggaaggagacuugagccugcugggcgagccagugggugaacggacacugagggaggagccgaggaccuggggcgacuugagagguccuggcggguuggcagaaggcaagggcaccaucugugagggagucuggggugacuugagguuggcagagggcgaggugaccaggggugagugcaccuggcuaagggugggcgacuucaagugccccaugcccggugagcccaucugauuaauacugauggugagguccgaaggccgccugccuagcccccgguuuggggcugaaugcacggucccaggaggauuggacgcagggggcagaggcauguggcugagccggguggugcccacguugcucaugggcauugagcucugaucagggcugaacaugucuuggguauugcccauguccugggacauggcuugguagggucccuggccuccagagaaucccugcuggcccugguugggaaacugugaaggcaucagcaucuucugcgggccgcccaucacgccacugcuguucugggcccgaacccgggccaucuccucaggacugaggcccuggggccccaucaaguccccagggccccgcaucuucugcgacaucagcaucugcugcugcggggucaucugcacguucagguucauguucauguucauguugacauucauguucauguugagguugccuggccccauggguggguccaccucccucagcccagacugccccaugggagggcucaggaggccccggccuccaccaaacuccaugcccaugggagugcccgccaggcccucaccaccagccaucugcccgggaaacauggcaggauccaucugucggugcgccugcaucauccgcuccaucuccaugcucugucccaugccacugccugccaugcccagggggcgcugcaugcccaucgaccgcuucuccagcagcuggugccgcagcagcuccucacggacccggggagucaugaaucgcuccgccucacccugcccaccuggguagggcaugguguucugggcaaaauugcuggguccccccauagggggcaagucuucgguccagcccaugccuggucucacgggccucugcauggcauucaugggcaccuccaugggcauacucugcaugcccccaaacccagguacccguuguaucugguugccugggaaacggggcccaggaaagggagguccgccccggagcugcaugggaucuugaacauccaugggcccccgcagcugcgcacccauuccagguggccacugauccccaggcuugcugugguaaggaggcgggggcccccucaccaucaugccccccaugcccaucauguccugcagaggacggcucccaugcagcccaaucuguuccucuuuccgccguuucucuucguaguacuccuccugcagcuugcgccaggccaccugcucaggcgugaggcuguccuggcccagccucuguaucaucauguucaucugcugccccauguccccacccggggggugcccaggcacuucaugcuccagcggggggcccccuaggcucugugucugugaaaucauggacugcaaggguuccucauauuucuucagcccgcugggaggggccguggguggcugcugggggggagggggggcuugugcuggugggccccccucacccgcuccuccugggggccccuugaggaagggcucagucucuccgcugcggagcagcagucgcucaaugucucgcagcgucuggagggaccguucccgaugcuccagcugcucuuuggacaagcccucugagcccaccaggcugcgcugcccauuuccaggggcggcugccucccccagcagggcagggccgggggcacugcuggggucuccuccaggaggcagaggguuguuggcggugguagccgucgggguguuagggugggugcccccagucccaccaccugugcuggcagcucccaccgaguugggggccagguccugacugcuguccucaggaggccccucugggggcagagcaggcggggcacugccaggggccggggguggcggcggcggcaguggagguggcugggacugcggggugccugcugacggcgugcucagggguagcgguucugggguggggggcacuuuaggggccugcagaaggacaaagagagcaugagacagguaaggggacguuccacccaguccugcugcucacagaggcgccacgcucaccuggucaagcuuggcccggggcacguucugcuggugguaggcgaggauggagucggcccggcccugcagcacugccucugcagcccugcacagagugggggcaccgacagcucagagaggugagcaggagggagccccacccucacccaccccacccugccccugcacggggcucccucggaaccccaggcugagaggugcugggcagagagagagagagacuuggccugcccaccaggcacuuacguguuggccagguggguggugaagacauauacgaacugcgagggaggcuuuccggggacgcccccgcccccgcccccgcccccaggggcaucaggccgaaggccaggaggagggccgugcggggcgccuggcacgcugcucucgcugaggggcaguugggugguuuggccgggacccagcuguggggccgccauggcugggucugcuacauuacaaucugcaggagagaggacagggaaaggggcuaaguggucuagauacaagaaggaccagcugaugcccccucccacugaugcucacagccuuacagcucgugcccacagggacauuugaugucaguaucugguguucucaccaggcugguuuccacgauggcaagaguggugaccauguggagagcagggacagagaaaauguguccucuccacaggcucccaugggccuggcauucugcuggggacuuaacaggugugauuucaucucaucaacacacccugggaggaacgugucacacacuccacuuaacaaaggaggaaauaaguuccucacccacaguuacacagccaguuagugcagagccagaacugaacccagggccgggacucugaagcuccgcucugagcugcugccccucucacuggguaaguguaugugcacacagucuagugacccaguuagggagaaggcagagaggguacacaagcugaugauccaaaugauggaugguuuuucacucuagccccaccacuaacugacuuugugauuuuaugaaccagacaucccucuaagccucgguuucuucaucuauaaaauguaaaauacuaaccuccuccuugcacagggggcaggccaaagaaauauauuuuuuaacaguaaguuuaaaucaaugucacagacuaaaaaaauccauuugaaaaacagagagccgggagcggugucucacgccuguaaucccagcaguuugggcgguagaggcgggcggaucaccugaggucaugaguucaagaccagccuggccaacauggugaaaccccgucucuacuaaaaauacaaaaauuaacugggcaugguggcgcauggcuguaaucccgcuacucaggaggcugagacaugagaauugcuugaacuuaggagguggaaguugcagugagccgagaucacaccauugcacucuagccagggcgacagagcgagacugucucaaaaaaauaaauaaauaaauaaaaauaagaaagaaaaaacaguuagaaaaagcugacauacuggaaacacucucaagacagaccagcugcccucagcaccaagggaaguuuuguuccaugguuagacacuugacuguaagucuuagcguagaaaaaaaucuacaacgggucuaggugaguggguagacccauucgcaugccaagaaaagcaagucacaguuccuggcccgcagacaguaaguaccagcauucucaguuaaugggagacagauugccugaaguugucuccauccagccagggcagugaccaccuucccaugggcccagugucaggcugcccucuuuggaaaaaguuucuucugcaccuucuucucugauggacccaccccaaaacggcccugcucuggacccuaucuauccaauuuuacauagaagagcagagccagaaauuugcgggggagcuugagagcugaccucaaugugugaaggcugcugaguagcucuuggauacgagcuauggggagacaggcagggcuuaguccaacaaggaacuuucuaguacaauaacaaugauaaaagcuaacauguuacauguauaaccucauuuacuccucauaccaacccuaugagauaaauaauacuuuuacagaugaggaaacugaggcccuuucccaaauuuacagaaauaaccuggguugcaaacgaaggcagccugauggcagaacuaguccugucaaugucuacguucuaucgccccuccaguaagaacucuucaagaaucuaagggcaggccgggcacgguggcuuaugccuguaauccuaacacuuugggaggccgaggcgggcggaucacuugagggcaggaguucaagaccagccuggccauaauggugaaacuccaucucuacuaaaaauacaaaaauuagccaggcguggugacgcaugccuguaaucccagcuacuugggaggcugaagcaggagaauuacuugaacccaggagguggagguugcagugagccgagauugugccacugcacuccagccugggcaacagagugagugagacucugucucaaaaaaaaaaaaaaaaaaaaagaaucaggccggguggcucacgccuguaaucccagcacuuuggggggcugaggcagguguaucaccugaggucaggaguucaggaccggucuggccaacaugcuaaaacuccaccucugcuaaaaauacaaaaauuagccaggcgugguggcaggugccuguaaucccagcuacucgggaggcugaggcaggaaaaucgcuugaacucaggaggcagagguugcaguaagccgaguucgugccauugcacuccagccugggcaacaagagugaaacuccgauucaaaaauaaauaaauaaauaaauaaauaaaagaaucuaaggguaguacgacuaaaauagucgccuugaguaugggauguuagcaauuucuacuuuguauuucccuauguuugccaggcacaguggcucacuccuguaauuccagcacuuugggaggccaaggcaugaggaucgcuugagaccaggaguucaagaucagccugggcaacauggcaagacugucucuacaaaaauuagccaggugugauacaugccugagccccagcuacuugggagucugagaugggaggaucacuugagcucaggaguuugagguugcagugagcugugaucacaccacugcacuccagccugggugucagagagagacccugucucuaaacaauaaauaaauaaaacucacaaaguuucuacaauggugcagucugaugugacauaagugaacuggaggugguggcuauggggggaggugucuggucugggaagcaguaaaggcuucuaucaucaaaggguucagccagaggcuuggcgaccaccagguuagucccacgggggagagagaacugauacaggauggucugugagguuccagcuagcuguagagguuugguauuugacccucuacaccccugucacagacauagucugcucacuccauaacauuugcugacucucucuccuccucuguaauuggcaucaugauaacacugaccucacagggcuguuguaaggauuaaauaaaacagaguagcaaaguagccaauguacucuuuucuuucuucuuucuauggucccugccuucaaggaguucacaauuuaauagucucuggcuaguuucuuuuucuucuuucuuuacuucuuuccuuucuuucucucucucucucuuuuuagagauggggucucccuauguuggccaggcuguucuugaacuccugggcucaagcaauucuccgguuucagcuccccaaauucuggggauuacaggugacagccaccacacccagccucucuggcuaguuucuuaugucucucuccucaaaaagauguaaacguaaacuuugagggaaaaaaaauauguacaagcuucccaggggcagggguuacaucuggcucucccccaucacucauggaaggacaagauauaggcgaauccauaaaagaaucagaggaggagugggcaucccuccacacccacuucuuguccuggugacacacccuggguacuugccaggagucaauuagagguuagggaagggcacuagagacacggccaaguggcaacucacacccaggcuuagcagggcuuugcacagcagagccaacugcccggcucccagugucccuggacgcuucaccgcccucccuccacuaaccaguagguggcagcauaggccaggaauucacagguagaggugcaggugacgugaccaagaaggaggccacuccacucugccccaccuagggucccuagggagagggggucacugagcaccuggaaggcagaggcgaggcaguugcaguguagggagggacagagucugagagguaggaugggagagaaaaauccaggacucccaguccucacuucuuucccaggcucaguccucucaaguccaucccccaggaacaucacgggcuacagcacccuggcaucgacaggcacucacuguggguggccccaaugggcuugucguccuccucacuguccgguccagagcaccauucguccccacuguacggcugcuuccgcuccagcacacagcgccgcuuacuccgcggcgccaccucugcccaggcaggacggaggaaagagugagugccuagaggccccauuauucucccacacccagggucccucccagauccauucucuaagaugccccacccuagagggcacugcccaggccauggugggcacuucgccagcccguggcccccaccacgccaccauuuguuucugauuucucucuauagccccaugccugucuccccucccccccaacaccaaguacagcauaauccccaaccacaacugguucuaauuagggcuggaggggagggggagcugcugcuacucuuccaggccccagugccugcucccaaagggcucccaccagccgggauacggaggcuccuggaagugugugggucuggggucugcuccucacuccauggcaccucccucuccccuucuggagcucuggugggaaagcaggaggggaaggaguccagaaguccgaccacucuguguggccccuccauggguggcaucauggccaaccccaaucccgaaugaucugguugguggguguugaaagguacccaugcagaaauacuggagaagaacgugggaugaggacuggacaagcagggagcagagaggugaucucccagaacaucugagccuuggacuaugggagaugcuagggucuuagggaugaggaaaugggguaccuuuggccucugaauccagggauggggucccagccucucgcugcucuccagaguccacagacacacuccggucccucuucaccuugcccuugagcgagcugaaagggggcaccccugccuggggguucuucagacuugaguugcuaggcgagaucugguuggccuuggccccaugguuccccgcccccacgcccuucgagcccacguugcagguggguccuugguucacauucuggugcugagauugggccccgccauucccugucuugccaugauuggucaauuuauuuucugggugcauuggcuuggcuggggcaggggggcaaugaccgcggggggacagcggcgggcucccuggagcuucucuccuccuggggugggguaaccugggaggaggugggagaaaugugaaaaguuaaccuugcuaggggcuaggcaugccugcaacuuaauuaccccauccugccuccccuaacaaugggggaggguggggggaaggggugguaucucaagaccaccaccagcuauucucuaccucccuccauggcuuccucagacaagggcugaagcccucauccaccuuggggaguggagauggggaaacccuccacccccuagccuccacaauuugaauggaaaccagggccuagaguuggcagaauucacccaccucagccccaaaacacccaucagccugcaagcuucuguggcaacccuguccucuguaucagacuuaagcauccucucuucuaagaucugcugucuucagacuccuuccaaggucucaaaccucaacucccauaugucccaacaccagcagagaagggccacaggaccuggggucacugcacaugcccgggucucauuccccagggacagugggaaaacgcacaccagggagugcuacccacugguccagacagcuggaggggaaggccugaggaggggggcuuggcaggccaggccggcaggcagaagcaggaggaaagggggaggggagcggugugucaagcagauggggaguguagcuugaagccaaggauuccugcagccuaggcugcgggcccuuuaagcuccagcccgcuccccccgccgccucccccuccccggagaccuauuaauagccgcuggaaagaucacaucacgggagaggauauuuauccccccucauuccacaccagcucagauuuauuucagcucugcuguccugcugcugccgccuggcccugucugccggcuucuccggggaggggggagggaggcaggcaccgcccccuacuccagcucccaccuccagcuagacugaggccagaggcggccuucggaccccacaguagggugggagggggucugcucaaaccauuuuaaggagggaagaacuagaagggaccagaagccgcaagcauagcuggcugccaguccccucugccccccacccaggcccaggcacuaaggcuggcugcgccuccugccucgggccaggccuucccaugcuaaccccccuuuagcccacugguggccugggagccaggugcccagggcggcuccucuccuggccagcacagcuugggccccaucaccacugggcccuucccuucccgcacuccacacacacacaucccacccgccacgacacccacacaccuugucuuguuagccaggauccucauggcucccacacacaguggggcuacggccccugugcgugcccagggcccagccagguacucgguacuggagcacggacugcagcaacaagccccaaagagaaaacucgugacuuggggagggggugucagagggggaggggagaagggaggacccaacagcccugggacuagggagcuggauagggugggguggcacuggaaaaagaggauuacgagauggggucucgauccuggaggccagcccuguccccaucccucccgcaccuugcccucagggggcuugcagucuccagcaagccuccgccccgacgggcggcagagacagaauucacuaaaaggcuagguagcaaaggugccguguggggcggcugugaggucuccccuggcccccugagggauuccugcucccagacgcgccccucacccagggugggguaccccucgugccccacccccagagcgcuccagccguggagggggcccgggguuggggccacgccccgccccguccccagcucgaggccuagcccgugcccaucccagcaggcccgggcgggcagcgagaggccuggcggggccccggggcugcagcugggcucuucuggagaccaguaacgcuggcucggauuccuccccgaccgcaagaaugcaggagccuccccuccccccgcccugcacccccaccccgcccccuucggcagagcccgggcggagaggcagagcgagcgagcgacagccagcgaggcagcgagcgggaggcggacaggacugcagcgugcuucuccaggccccgcgcgcggacagacacacggacaagucccgccaggggcugggcgcgcgccagccggcaagagcuuggcgagccccgggugcugccagcagaggcucagagacccacagacacccgaacucugacucacacacacucacagcucacacguggacagggagacaagacacgcacggagcccaggaagcuagaggcgcgccgaggccagggaagcgccgccggagcgggaggcgcggagacagccuggggcacgcgcagacaccggggcugcccgagggcugagugggagcgccggacccauugaacagaugaaaagacugaggccggccacaagagagccgaagaaaguugagccugguagucacaaagaaacacgcacagggccauagauacagcaacagacuuacacaaacacagaggccucacccaaccgcccccagcccuggcuccccccucgccuccccuacccgcccuccagcagcccuccagcagccgaucccggucaaaggggaggagucuugggcccaggagcuucgucccggugacaggcccggccagacaccggugcacacuccugaugcucccugcggggcugcuggaggcugggcggggaccugggggugagggggccccaccugccacccugcgggagucuaaccccaacuuaacccuagggcacauuggccuucgccacuccagccgugucucuggggaggaaggcuccugggggaagguuccaaaguccaggaccugccugggaagcagcccgccacccccagcuucuccaucacaaccagggaagagcagaggcagaggcuggagucacugagauaccagggcucugagcaggcuccuggcuggcaugcaucucaggcucucccuucaccagcucgcugauucucaaaaggaucgaccccauuucaacgaggaaacugaggucugggaaaaggaaguggcgugaccuugagucacauauccaguauguggcaguguggggacggacccucauuccagacacugcagugaccccaccuccccacgccagccaugacugcuccucugagccugcaucagauaguugggcuucccacauuccagccacagugcccaggucccccauaaggggggaggggcagggcaagggccacucacuaccuauguucacagccucaaaaauugagaaccuguaagaauuugggaaggggcuauuagaaaaucaguccucuccaguggccguucaggccuaggcuccuccccagaagacucuuccagucacccuccccuccgggacuccacccccucucucccaccccgccgcagggcgagcugagucaagcguggaugagucaggacuuucccaucucacaccuccccccuuugccccucaagagucugccccagcucccgaagaccccuccuccuccacacacucacagucuccgaagacaccuggaaggccuggugaugggaagccaagagggcugaucccagcccaaugcaauuuuaaagcacccagugaagggggcuugcuaguaccaggccaggggcccuugagguacgagaaagcaaagggauggggcucugggaacacgucaccgugccucccucuuaggggguuagguggggagggguagcaagcucacaaacagggagcaggugcgagucaccugaguggaaggccaggcgcauaccaggagaaugaaucggaggagcggaagaggcggcuugacaaagggccugagauauccauccgcucccccaccccgagugacgcgaggguaggagcuagcagccuaaggguugcuaaggguuaaaguggacuugauccuagcugggggagggagcugaggaaggcucagaugcccagagccuccagguaugacacaccggcucugcuccacacacaacuaccacagguagggcaggcguucacacauccaguggcaaccugccugcuccuagcugcccccacguugggagccucugcuuggcucaccagcuggcccagcagugucacugccuagcucaaaaccaccccaaagaggcagugaggaaauguuuuggaggguucaugcuccugagcugccagggcccccugugaugacgugaaagcccaggacccugcuggggacaacagggcgaacgagauccuuggccucuggcucagggagauacagcgcccgagacgacagggucccaaauccccuuucuccugggugucaggaccccucaguccucagaagcucucuccaccacucaggucacuuccucuuccugagguggugacucagcgggcagggaggucaaggauucguagcccagcaggaaaucugcucaaggaccaaggugcugcucugggacccucgauguggggacuuccaggcuuagggggccuucccauggcccugguuccuaguagcucuccacacuucccccgacucugugccaaaggagaccaugcaaaucagccauuuuugcuugggagguuuucccugggaguuuccagccccaccccaccugcagcccuaggguaaugucagacaaccccagcuccacaggaccagggaaacuccuggucccagaccuuucuagucugggauuguugaacaggguacuggggggugaucggcgguuuugcccauucuggcccacugucccuucuggagccugcacagacaaguggcauugcuuggacaggccugaggucaccucacuucucuuggcuccuacagucauugucaguguggccgggccuugggaagcaaucauggccuggcaguggggugcccccaaagacagcuacccaauccccagcugcucccucccacagggggagggguagagaggggguggggggcacaaggaaacaagacagggcaggaagcccaggcaggcggcgggcacucugggccaggcacaaacaaccaacacaggaaaccacagcccacccccgcccaccccacccgcccaaggcucugggagagaggagugccaaaagcuugguaccccaacagaggcaagggccagggguuagcccagggcaagggaggagcaagaagcucuccaguccucucucugccccagacccuaccuggggaggguagagggagccaggcuggcagggauggugcugccucuuuaaauccaccgaaauccugagcuaggcccaaccuagcucugguuucacaggaaggaaaggagcucaggagccaguagggcaggcagugguggcuggaauuagccccaccggcccaaauauaucuggucucugcccgccgccccacugguacuuccuguccccuggcaccugcaccaggguggggguaggagaugauccaggugccacucucuacccuauggagacucccaucucaggaggugguguggugcuggguucacauggguagaagguaacuucccaagccuggguucccagaacaggcagagaugggcaaggcagcucccugugggcccucaccuggccucaguccuccaagggguuaaucuguccccuauuuagggggguagggguggccgaggaaccuccuccaaacugccuggcugcugggaacaauggggccauugugggaggauggagugcagcagacugcuggcacagccaagcgcaccacggugggaccucacccagcgcccgcccgccugccugccugcucugcucucuccccagguacagccagaggcagaggcauccuccuggccccucaccuccccugauggcucacacucuuggcagcagcagcaccugggggccccacgagcucugcccacauugacauccagacugucaugacccuccaggaugcaggggcacgugggccaggccgggaggggugggggugaugagacaggauguaugccugugaccucugcagggagacagaaggccacacgggguuucuggugucaguccuggcacccucaggcaagaaaggcuuaggggauugugagagcagugacaggcaggguccccuguccccaggccuccucucccacacccauucaguaaagcugcucccagaggaggucuggugccugguggccucgcccucugagguuggggcccuggcaggcaguaugaugcaguggaauaagaacugaguuugagggccgggcgcgguggcacacgccuguaaucccagcacuuuaggaggucaaggcagguggaucacgaggucaggaguucaagaccagccuggccaugauggugaaacccugucucuacuacaaacacaaaaauuauccagacaugguggugggcgccuguaauccuagcuacucaggaggcugaggcagagaauugcuugaacccaggaggcggagguugcagugagcugagacgcaccacugcacuccagccugggcaacagagcgagacugucucaaaaaaaaaaaccaaguuuguagucagacagugucaaucacacccugccccuucucaucuauggggccuuguccuucccuuuaucccucugagccucagcuuccucaucugcaaaaggagaauaauuuuauagagugagguaacaguagugaaacuaacagaaugccuaagacacaccagcccuugacaaaccacuucuggccucaauuuccuuaucucuaccuccugccauggcacccaaauaugugggcauuugguaaaggcaggcacuguccagauauuuucccugugaguguccaagagaacagggccugugggcaucauauuagugguaccaaguaaaaagacuuggcuccuccccugcccuccucucagaggucagcucccuccgcuggcacacuccugggcauccugggcucaccgacacacucaaauccagagcaugaacccagagaggggcuggguggcuguccacucucuuagccucaggaccaugucucaaaaguccaggaggcaagugaagggggauuucccuucaagagagccagccuccccucugccagguccccuucucccugccugccccuuggcagucacccuguaguacuugggcugggagaaagcuuaagccuacucucuugccauggaucucaaaggaagggucugggagagaaagaacaacugacaagcaguucuggaaaguagggggcccagggagaaaaccuguucucuucucaacuagacagggcuguaucucucaggguggccccagaagcccccaaaggguuaacaaggcccuaaaaauaaccugcgcccagcaggacccacugaucggaacccuccagccaucuguucccauuuucucguguucacauuggaacaucugaaaccggccccagagccccagcccgaucccaaaaauagccccagccugcccaaggaacaggccccaggggcugggcacaggaggcauggccaguccaguagcaaggcauggcccaggcagacccugagcccucaucccccaggcccauggaugggagguguccucucuagauccagaggaacaugauaagcagagccaggggcuccagcccaccccucuugguaccaagccagagagagcaccugcuagcuaaguccaggccucagacccaggggcccugggauccuaggcacuucuaccacaucuuaguccccagaagauuuuacccaccuugucugcauagcuuccccaccucauugugggcaccccaucccugccgcccacuccugggcuccucauccagaaguucccaagccucagccccuccaccaucccacucucaccccagggccuauaggagcccuggccaccuggccccacucagcauucucccuugccagcacacaggguuaaggcagaacuuuuccuagcacuguccacacucccccuugcagcucagggaaggacucuggaggugucccuuggacgcuguagaugcugauauuaccccacuccccuucugggcuucaggaugcccccucccugaccaucuguguccagcaggugacagacaggcccaucggggcucccccacaugaucauaggucugggcacugccccucagagaaaugcccaggcacggcacagggaauccgggguccagggcccugagguguuccuaacagcugccauccaggucacagcuccacacugacacuucucuccccaagccaggucccugaccccuaggccaggaaggagaggaggcggccauuuaagccauuuaaggacggaaugucuuguuugccuggugagagcagagcagcaggggauggggcagugggaggagugcugagcugaacugagcaaacagccucagggaggagggcuggcccugggaagccugaagauagcgagggagacguguccuaagcucccugggccuucuccaggccccuggcuauuuggcaaacuugcaaucaagaagucagcaggcaccaacgauggggaagcggcggcagcaaacaguggaucuggagggguauuagaauccaggaaucuggaguguggaaaggcugucucuuccccacccccacacucccucucucaccaucaauucuuucccugcuaaaaccccugggaggaucaaaaguuccugugaagagcucugacuaaucaaaugaggggaggaucaccaacauuuauugagcauuuacuuuguaacuucaccaguccuaaaugcuucacgugcauccucuaguuuaauccucagaacaaucugguaagaaaguauucuuauuauccucacuuucccacuaagaaaagggacaugccgagaaguuaaauaacucgccuaaggcccauaauuuuagaagaagcaggauuugaauucagacacccuggcaucuggguucugggccauuucacaauacuccagaugcaccacaguaucaguccucugaacgaugacgaaagaaagcauggguguccaggccccacccucucacuccucacauccucccuccaugccugaugugcccggggcuugcccagggaagaucagagagagagcaccgcuccccacucccucaacccagguacccgccuggccuggccuguggugccaggacagagcaaaguucuccagccucccccagccccgcccaacuccaguccguuacuuccucacccauccuugucccugccggucagaggagggcacaaggcuagucaccgagacaacagcacagagccccugccaagaguuaccacgggcucgugagaggccccaggugggggucaaaggucaagugggacucaccggugaggguggagucccagcccugccccccacccaccuguucagccacaccuggccaaugcuccccaucucuuucauuccucaguagagagcaggaccacuuccuuggugucccuugggggguggcuucaguggagagguucggggcugaggugaggggaugagaagccccucccuccuggggauggucuaggagaagugccuccucccaguccccagcuuccuccagcuuucccuagucgaaccgggagcccucaggcguguuuguugugaauucagggaguuguugcuaaguaaggaaggggggcuggcggagggaagaggcugugugugugugugugugugucugugucugugugucuguguguguacacgcacgcauguguacgcuaggggaccaggggccagggcagaaaccacacuacuguggcugguagccacccuggcuuugacugagccagaagaggccaagccagcgaggaggagcaaggacuugggauaaccaggaaguuguaccuugcccuccagggcgauugggcggaaucuccuugccucccgcaggguggggcggguggggggugagauccgcugagauagagaagggcuggacucucacuggagccuggcucuaaccccucccagcccggccccacuccccaccugacugggucuaggguucuggucagccuguuugcccaccaggagccagaggagaccucccuccucuggagggaggggaaugaaaggagagaugggggcagaaagccaagagaagggagcccaaaagacaaaacgccaagcaggaggcuaagccagggugacgcggccgccgcggacagaaaucagggaggcugagagggacacacaggggcacacagaccucucaccucaggaauaaugucgggcucaggcucaaggguguggucuggguugggggcucccuguggagagagggucaaagcuagaagcccccuucuagcaaucuauguccccgcuccucccaucaccccagcaccccccacgaacacaccacagaaacauguacacacaguccacacagccugcagcuccaggaagucucugagcuacucaauugccaccccccacccccaccaggacuucuguggauuggcugggagccaagccugaccccagcugcaccgcugcccccccccccccgaccccccaacccccgcccaccacaccauccccucccuagccuggaagcaggagaggaggaggcacuggaagaccuuagagcucccuuagagcuuggccccacggggaggaggagaggcagaggacucccaugaccuggccugaggaccugggggaggagagggauggggagguuggaggaccccagauucuagcaccagccaccuccagguuauccuaugucagggaaaagaauggcuguguauucuaugucccuguguggucucccuggcuauagcccugguucccugaagaggccaaguccugaggaccuggucugguugggaggaccugggccgagggagucgguuuagcaauucaguaggagggggcugggcgaagcucccacagcaggcgggagagaggcugguggcugggcucaguuuguacuggggggucaaaggggaguucuuuuccgaagaauucugggagagacgccaacuagagcaagcugcuaaccaccccucccucucucucacugcacugggcggggggugucccugccaaccagacuuaacccucuccagccuguguuccucccagaccugagauggggucugcuggggaggagaccuucggcugggcucaacuuuccauucuaaggcucauacagagcagggcaucuaccagcauaaggcugguuccacauggccccgucuggcacugcccugcccugccgccaccuaggugacuuuucugagcucaucuccuaaaggugucugcagugacgugugugcgugucucagagacagagauugagaaacaagcugaaaauuccuugcccaggcccucccccugcugggucacugagcacuguaccaaccuguaccccucccuuccucccacugugcucugggaccagaggccacuggggguggggacguaaaagggacagcuuauccuuauguccaccuccugcugcugucuccauaggucucugacucacacaaucagccccggccccagcacucugcuuccucacugauuugucacaagugcuucuggagaaaugcauuccauucccauccugagaucccaggaugggaaacugagaugcagcaagguuauggggguucuagugccugcaucccaugcacuaacucugcuaucaccguccuugcuuuggccccaaaucaaaaaacccuaggaaccuccucuaauguagaauacugucuaagugcaguaggagggaaugagauuaaacaucaagaaggacuucccacgaucgaucaaggcuacaagggcagcuggccccaccccagaugccuggauuccagaccccuccgucuucugcucaggcuggaaauaugagugucuucucuuguuuagcuauuugacccuagcuggagaagucaacuuuucugaaccuuaaauuugccaccaagcucccaaguccaaugugauuggcuguuccuugcccucaaugaacaagugaccccagagugggggcuuagcucccuuuccccaccccuuuuccuuuagaacaccgagccucucuguaacaaccaccacuguauaaucaggacaagaagagguggacaggugguaugaggacccuacaaggugcuagguguccgugagggguagagggagagaccccaguccccagggagaguuuaucacaaagucuccacugcaccacucucucuccaaggaccacggaacugccagaagccuuggccccacuccaggaaacuucccuaucaaagggcagaggacugcaugucccagggagcuguggggagaccugugacuacauaccccagacauguucccagggaggagagaggagggaagagaagugaagcgcaugugugugcccgcacacgcacauacacguggacgagacacgcccccagcacacacacucuccagagguaccccggacacuuacaacacagacacaacucccaaagaugcacauccaaagacguuuccuaaaaagcacuccaaauucuccaagaguggccccuucagacccacagaggcucccguauucauagagacagccuaggggagcucaggaaacacacaugacaucggccaaucacacagaacugccaaacagaaccgccgacagaagauacacccacacugagacacacacacacacaaacuuauacacacacacaaaguaguacgcagccaugugcuagcacacaaacucagacacacaaacuugcagcgcagagugugugaagucggauuagaaggcaaugcucuggggaggaggggagccugcaggggguggagaaccacucagggauuucaaaacaauccugguuucgaaaugcuggaaaugcuggauucagggccauuccgaguugaggcuggggguggggaaguggagagugaggaggaggggaagacgggccagcccagggcuaccaguccauuggaggaggaacgggaacggacagagggagucccagcucugguggaagggggccuagaauaaaacaccaggguuaggagggggaccaguccagggccaagcagggagggccugggcugcaaaggagaggccucugcuuuugccacugacaggaaaagugagaaggcaggggaagccgccccucccccuuggcauggagaaucagagggaaccugucuguguccuuuccccuacuccugggcaguggugaccaccuucuccccuccagaguggcacccuggcuccccuuccccaccagcuagcacagccccaagguggguggaaagcuaaggggucacaggggauggggagauggcaagggccugcaggagucaggggucuuccacagguuccaggaccccccacacucagagcaggcugugggcaucccccugggaacccaaggcuuucuuccucuccacaaggaugcgggacccucggggagacugaggcaguguaacacaugcccacacccaggaagucgccccucccacggcagccagaaugcccuuacugccccucccccagccuccagggaaagucaggcugaguucucccaggaggggagggaggggaggucaggccaggcuggggguggggcucagaggccuggcccuggcaccaggcagaggaaauuccaggcuguaaguccaggcagccuucagggccgccgagccaagugacaugcaccagcucaggagcugcagugcucuggccuuccccuccuagcccuggccuuccagcccuccaacuggcuccagccccagcucugggacucagauaggcuccucagcccuggcaggagcucccaccagccccaucccggcuccucuggccaguuagagcuucccuuccucaguucccugagggcagcccccacgguguguuugugggugggcagcugucggggcuggcaggcaggggcacacaugcggagcuagagcagccaggcgcucaacagguugagccaguccauggaacagccggccccaccccagggagagcgggccuggcagaggcucccugcccgcggcacccagccuguacccgcuuggcucccacggcugcccacuuucccacggugccaucccccuucugcccccuccccccaucggaggucagcacccgggcagugcccagggcucuggcacaaggaaggaagggaugccauuccccugucaccccugggugcccaggcucuugagcuaccucacucucagcacccaaggagccccagaaacagccagcauggcagcaggaccacaagaaccccaaaggacuucccaggcaccuccuugugggccucuucugauucugggaagacuggaaacuugaacaccccagcucuccagagcugucccaggguccugggacagaacuucagcgugugguaccagaggcagugugggggugcccccagcuccuccuauuggacucccuggaggaggggcugcagagcugggugacaguggcucucggacucccuggaggagggcugcagagcugggugacaguggcucccuccacuccugccccggcagcugcugcugcaacccugguccuuuccucccacuccacuccugggcuccauggagcuccaucgcagucacuccccugauaggcaggcagcuccccuuugcucggcaucuccuuuaaucuaaagcaggugccaggcauuccagcccuugcugagccgacacugccacccccuaggccccugcccagaggcuacuguccugccuggucuggaaguugagaccccagccuagggcucccgcuuaacccagguaccaggacuccaaaggcaggaacuagcuaagcagggucauggguacccaacacagauucaacaggcaagaucaauaggucccaaauugccacugaggcgcuagauuucuguggacugccaaucccucucuaggacccuguaguaucucuccggucccaugacuccccauccuaguagagacucauucugaaccuccauaugggccuccagaacccaucaccagucaugggaccccuucuacuccaggcacaagagucacucuggauccaagauuuuagguauucuaccugccccucagcacccuuccugcugugaaccaucaccccaccccacucaggagcaacauggguaagcagggaaccccuagagggagguggccagaaggcugcuuccaggccuggcucuccaaggccaaggaggcaaaucaccugggggaggcggcaccuuccuuccuggcaccagccucccagucucucucccugcuccucaccuuccucacccauucucucccuguccuguccugaggccucuaucagcagggccucagagcugacaccaggaagacagggccugagcaugcuccuccucuggggucaugaaauugugguccugaccuggagaagguagcccggcccaugcugagaggcagcagaagagcaaggcagccccugcccggaaguggcugcucccuggagagaccaagaagagaaggagaagacaguggaagcccacucacugugguggucucauccagagagcugcucagaggcagcagcagaguuggagcagauacagggcacagucagcuuucacacuaaaccaaggcugggagugagggcagaagauccagggaggcuuggaaccccuuugugagggcucaaacacacgcccaguucaccucucucagagcaacacuuuuucuccucgcagcagagguucccccagacacagacacagacacagacacacaccccaagcaguagacagaaagagaagggagagagggggugucagaaaaacccggaaggaaggaagcuggacagacagacaguagcugauccuagcuucauugcuccagagagacacccuccagacuccuagacuucaagggacacuauccuucucagaaggagagagcagcccucugucucuucugaaaccaaauuccagcagcccuggaauaggaccuaccccagcgcaacaagaagccuaagcucacuucucuuccuacauucuuccccgaggguuccuuuggaucaagacaggggccaccuccccuuagcagcgcagggacacuuccaaggaacuguaugacugccccaccccccagccaagcccacaucacucagaagccuuggaagaagagacuccucagucacagcccccgcuacucacaggcagugccugggagaaaagggugacccccagcucuccccagucccaacccaccuccuucuggaggcuccuaucagccagaggaggagggcuggggugcugagacccacgggguuggugagccugggagggggacuacaucucccagaagcccccagggcaagguucgcugcuccagcuggcccaaggccggccuuguucucugcgcuaggguggcaggguccccuggcugucccuaagcccuccccacgguguucuggagcugccaaccugauugggggcuuaagaguagccuccacugacccugggggagucccccacaccuuaaacagccuggggguacgugccagagagcaagagacaaucagacuguguuuccccuccccgauucaaacuggaucucccuccucgcgccucugcuggccuggcaugacuuucgccuugcccccagcccaccccucaccucacgcggauugggggguccucacgccaggccggagcuggacgccaugaccaggucagggucguuguguggauggggguccuccugcucgccaguuggagaugcagagggggcgggcaggcggugaucuuuugauccuggacgccuugaucucaauaccagcccggcccgggagaggcuauccggggaucgcugggugccuggguuccugccucccaaccgcggagcauggucgcgggcgccgggcaguggcgggagagcgcgcacacccgccggggccggggcgcggggccggggucucggccccgaaccucagggcuccggcuccugcuccugcuccuccuucccuugcuugcuugcuugcuuccuuccuuccuuccucgccucuccuuuccuuuccccaaagcccgcgggaaugccgggcgcuggguggggaggggcugucugggcgcuuauuguuggucggacuccgaggguccgggucacagcccccgggcggcgcggcgccgggggacccaggcgugcgggcguccggccggcuggcuccgggcggcggcgguggugcagcggccccggguccggggcauguccagccacuggcuccgccgcgcgccgccgccuccccgggcuccccugcgcugccggagccucgcuugccccuccacucggcuccacuccccagccugaauaagcaucggggcucucuggcugccuccuucugccuucauaccagagcccggagaggccccugucaaaauaagagcucccccaucucgcuugccuccucgcccaacccggcucccccagccucccaguggucugacucg

SEQ ID NO: 15959 - RNA, 2033 nt, Homo sapiens
ggaauuuaaaaggugucaacuuuugaccaaaaaaauugugcccuuguaccgaugcagcucucuuucucccccaccucuugcgagauaagagggaucauucauguagaagaaaagaguauaaaugcaauucuguaucucgcuagagaacgugugggugacuaaacaaaaagugcagucuccuucaccaacuuuagacugcguggugccacaugccugugggucccucuuaaagcacagacuuaaaauggaaaguauuacugaaguauagccucuaaugaggaguggcacuuaaacuaucugggacaccacuacuggacacggucuuguagaggcagcuguccaguuuuggugcuugacucuugaauaggaauuguuaaauggaaagaugcucugaggacuaggucaaagccuggucuuuuuuuuuuuuuuuuuuuuuuucuuucuuuuuugggcccucauaauaagcauuguuacuauuggaaguuguuuucacauucuuuccaauauuaaauauguauuuuuuuaaguaaugauaauauuuuccaguggcucauuuggaugagaacuacccucuauuuuuaauauuaaaacuacauccaacucaucauuuagccuuugguuguacaguuguguaaugggcuauggacuguuacacaccuuaccaccucuaggccuauguuuuuucuuuccccauauauucugauggggauaaauacuguuuugccucucccauaggaauggaauacauuuauucuaaaaugaucuuucacagaaguaagagagagggaaaccuaaauauaccucuaaauuguuugaaguuggucccagcagcauaaaauggguuggccccaaaggguuggagggugggcuugguuaucaguauuuguuuucagaaugagaugggagcaucuuuccuuugccacgugcuuugugcuugauaacaucaugcuugguucaaacgacaacucagcacaaagccuugaguauaaauuguuggaaucaaaacaucucauucugaugacgugguuuaauuuuuuaauuuuuuuuuuuaauaggggugggagggaggguacuuugccccagaagggagggugucugcacuaaggauuuagaaacacuuuggaagcucauaaccucaucagaaacugccuuuagccacacuccugaccuucuagaugaguaacaaaaaaaugaaauaaguucuuggaaauuaagccauuuauuuuaauuugcuauuuuuuucaauguucuagguaucuuuaaauuuguuauuguggaaucauuuuccugccagauaccuuuaucaaaauuauuggccucaugagagcugaaguaagucagcuuuuuggugaacuuuaguggacuucugugagauuguaguuguacuuuguaucucuaaaucuaaagauaguuuuuuaaaacucccaaagaaaaucugcucuccuuucugaucuaaaaacucaucuuugggguaaagaguuaaguguccaaagguugucacaguucaugaggucagagggagcuagccuggcaccuggacucugcccauccacagcugacagauuccaacagaaguguauuuaaauucuccaguagacaaugcuggguaagggaggggguagggcuggguuauuaagauacaggcugcuguauuuuacauugguugugugggaaggggagccuggagaaaacaaagucacuauucccuuuuuugaaacaggaaaaaaaauuauuuuuuguucaguaaaaaugguagagaauuccaaugucccuagccacaagggaccaguuccacugagaagugaacagugggaacucaaaauuucagaaacauugggggaagggaaaauuggcuuucucuuaauuggcagauguuccaguggggggggggggggcucuguuuuuguugggauguguuauguuguauguacgcauauauggaccggagucugcugaguuuauaagguuccaaaaauaugguaaaaucuugguuuuuguuaauuuaucucaauaaaagcccacuggaacuccaa

SEQ ID NO: 15960 - RNA, 7675 nt, Homo sapiens
ugggacgggguccugcagcggguccuuccggcgggugacauucagccggcgguucggggcgacggacucuccauuccagaaccauggcccaauuuguccguaaccuuguggagaagaccccggcgcuggugaacggugagcgcgaugugagaccgccgaggcgggcacacgggcggcagggaggccugcgauggccugagaggaagaagcgggcugcgaagacccgaggggccugcgggugccggggcgggauggccugcagguggagggagcaggaagcagguuggcgacucuuuucuagccuuccacucgucugaccugcagauuggguucucuacacaaccuagaaguuccugaauucuaaccacgacugggaagagagguagugugaaggaagcccggcguugcccggcagcugcaaccauuacgcccccugagaucgcuaagagcagggaucuagaggggaugguucuguuaggagagcuaagaaaaggaagggcagaaacgugaaaguaaaucaauucggccucauuacaugugguguuguucucaguggaguauuuggaagucaacagaaauguuuaaggaugggugagcuuuuuugaacguugacuuugcuuucuguccuagacggauucuaagauacuuccgcuuuaauccgagggaaauuuuagguggaaauggacuucauggaugaguauccaugccccgagaagcauaggacgggauccguauaaacaauaaucuuuguuacgaagcuuagcauucguggaauuuuuucagcuugaagagccucacugguagaccgcuguauuucacaacaacccugaauaaucacagccucugaguacuaguuuauuuggccaguaaauauuucaguugucuucucaguggcaagcuauucauuuuauuccugaagugagauaagcuaaauugacguaaguuuuuccuagaugugcuguauuccaguaagugacugaaggucggaucucuuaacuuuugccuacguuuaugaaaugugaauagaaagcagaacuucaaaaaaaauguaauacuuucuagccuauuuugcuguguuugaguuugguuuggguauuuucuuuuucuuucuuucuuuuuuuuuuuuuuuuuuccuagaagacagggacucacucugucgcccaggcuggagugcagugcagaucacagcucacugcagccuccaccuccuaggcucaagcgauccucccaccucagccuccugaguagcugggaucacaggcacgcaccaccacacccagcuaauuuuuguauguuuuaagagacgggauuucaccauguugcccaggcuagucucuuaacuccugggcucaagggauccucccgccucggucuccuaaagugccagaguuacaggugugagccacagcgccagccggguaauuuauccauucucuccucccuucccuccaucaccagccaaacuaugaguuauugaaggcuguccugcagaaccucacagccuacuagugaaacauuuuacacauuuucccaaauaauuucauaagcuugcaagaaaaucuuuuacuuuacuaagauuguuaagauaccugucauagagcucuacaauuuuauauaaaucaaaagagauggcccugcggcgguagcuuacgccuguaaucucagcacuuugggaggccaaggcgggcagaucacuugagggcaggaguucgagaccagccuggccaacauagugaaaccccaucucuacaaaaaauacaaaaauuaggcaggcuugguggugcaugucuguaaucgcagcuacuugggaggcugaggcaggagaaucgcuugaaccccggaggcggagguugcagugagucaggauugcaccacugcauuccagccugggcgacgaagcgaggcuaggucucaaaaaaaaaaaauaauaaugcuggacacuguggcucacgccuguaaucccagcacuuugggaggccaaggcagguggauuaccugaggucaggaguuagacaccagccucacuaauauggugaaaccucgucucuacuaaaacagaaauuagccgggcaugguggcaggcgccuauaaucccagcuacucgggaagcugaggcaggaaaaucucuuuaacccaggaggcggagguugcagugagccaagauugcgccacugcacuccagccuggcgacagagcgagacuccgucuaaaaaaaaaaaaaaaaaaaacuaaagagaaaaaaggauuagaggcuucacucuggacuuugugggugauuuaaggcacaauucuuaauauuucaaguggauuuuuuuucugguguggcuuucacauuuuuuagguggcgcauauuaaggaauugcaaacuaauuuuugugaucuaaaaagaaaaguaacaccaagguaauuuuuuuguuaugaaauauauaauaugaacccuucccuccguuguaaauaauugaaagauaacuuguuauucuuccaaaaguacuuagaaaggaggacucaacugggcuggaauguuaacguggaaauacauuuugcuuuauaacauacauaggcuaguguauuaaaugugaauguuaaauauuuaauaaaaauuacugacuauaucuguuaauuccccugggggucaaaaaagcuuauggaaauaaguaaauuuaucaucagguuugccuaggaagaucauagaaucugauuuuuuuuucccuuaacuguagacuuuauuuguauuucaauaguuuuuccaauaaucuuucaguuccgggauccaauccaguguaccacauugcauuuaguuucuaugucuucccaaucuccucuggucugggacaguuucccagucuucccucaucuuuccugaccuugacaguuuuaagguaucuagguaucuugucugucuagguaucugucuugucaaaguaucugucuagguauccugaagaauuuccucaaucuggauuugucugguguuuuucucaugcuuaguuuggcacuauggauuuugaggaaauaccacagugaagagaugcccuaaucacaugucaggagguauaugauauuccugugacaucucuggugauacaagcuuucaucacuugguuauagguuccucuacuguaaaguuacuguuuuucucuccguguucuauucuauagaagcaaauaacuaagccuaucccauaaaggcaaggugugauuacaguggggggauuccauccccuguaggagggaauaucuacauaaauagaauuuuucugugagaaagauuugucucuucuccauuuauuuauccagucacuuauuguauggacuuguacauugauuucauacuuucuguaucaaauacuguauuauugcucaaauuauuucagccuuggcuauuugggagcucuuucagguuagcaccucugucccuuugacauaccgccucccuuucugauacuacaagaugcuucagauuuauauuguauuuucccugucccagcccuagaaucagccauuucuccaaggaaccuuaguuccuuuuauuggacaauagaauugagaaacuaaggucugggugcuguuuauguuccuugcuaccagaauaucacuacuucuagguccucucauuugacaggaauauagauauguaucaguauagauguguguauguguauauacaugcauacuaagccauguauauacaugcauauauguauauauaauuauuucugugucugucagucuguguauauauuaagcuaaaccugaguccaacucuaacccaguacugugggauuuauucuugcugcuuuucuuguuuaccuguaacaucacucaaccuccacugagaaaucuagcucccauuaucuaccauucauuauguuuuaucucuuguauacauguaaagcaguuucaaacucuaaccuguauccccuaagaaacaaauuuaccaccuaaaauauuguuuauguacaguauacugauucauuuuuuuuuuaaggaugaaaugucuguguguuggagauaauauugacaauugauugacuuauacaagauugugcuuuuuuuuuauugucccaucuuucaggcauuggcaguucuguuuggaacuaucucuuagagcuuugugucugcuuaaagguaugcccauauccccaaacacagaagaugagggagauaguaauucagaaauacucaaauggaggccguuaauaugaggaaaacaccaagagccuuggguaaucugucuuugaacaguagacacuuuaugggcuuucaugcuauuuuuauuacguuucucuuguaauuuuugaaacagagucucauucugucccccagacuggaaugucauggugagaucuuggcucacugcaaccucuggcucccguguucaagcaauucuugugccucggccucccgaguagcugggacuaccggcacacaccaccaugcccagcuaauuuuuguaguuuuaguagagacaggguuucaccaugcugggcaggcuggucucaaauuccuggccacaagugaucugcccgccucagccucccaaagugcuggguuuacaggcaugaccacugcacuuagccucucuuauaauuuuuuaaauaaaaaaugucuuccucuuucugaaaucacuacugcagucucacaacuacccugguuguuaaugaucucuucucuugaaauaguaaauaccuugaggaauuccagcuugguaauagauucuaguuuuggcucuucuuaacuauacauguagauuuuacuuuuauuauuuguggugccuuuaaaagaggagcagcugugcuuuugucagagaaacauuuaauccagcacauauugaugaggauaccaaaauggguaccaguuguuuuaauuccaucuggauuuguggauaauauuaugauaacuuuucaucuuguucuuaagagugccauucuaaauccuucaucccuuucuucaccucuuucuucaaauuugcuggucucucuccaagaaaauaugaauaaauugacuguucucuuguuuuuaaauccaauuccuagcaucuuuacaguuagcuagauuugccauucauaaaugaaguacaguacuagcuggccacuagugaaguacuggcauaauugaaugugcuuauagcauccugccugauugaacaucccuguggcacagguguucugcaucuuuaaaagccucuuguuaccagggagcagcuuugacuuuucacaccgggugcacauuugguacaagcagugaaugaaggugaugcaugaauaaauauuuguguccagcccacacaucugcuucuuucggucucuagugaguucauccugguuuuuuguuuuguuuuguuuuguuuuccagcugcugugacuuacucgaagccucgauuggccacauuuugguacuacgccaagguugagcugguuccucccaccccugcugagaucccuagagcuauucagagccugaaaaaaauagucaauagugcucagacugguagcuucaaacagcucacaguuaagguaaccacgggcuaaaugaaaacggaugugcauaacagaaaaugucuucccuugggauuuuucugauuguuuugauuaauauauauguuuccaaugaggcugaauccagcauaaugaggaaaaaaauuuugacugcugaggaagauacuuacuuuucuaauuuugucaccuggguagaaauaauuagcccauuuuaugucuuaguuuccuaagagucuuaaaccuagcaaaaaagugaccauuuuuauugggaaauuuuuuuuccuuuccuauauuagauaguauacuaaaauaugauggcuugcuuugcugagucuguacuuuuuucaucuggaguccugagauuguccccaauucagccaaaacaucucuugaacuaugucacagucaggaagcuaacacuucuuauauauaagauaaaaauaccaaacuggguuauugaauugugugaagauaaaaucuaaaaacuguaagaauuagaacuugcagccauacgcagucacuuccugccuguaaucccaguacuuugggaggccaaaguaggaggaucgcuugaggccagaaguucaagaccagccuggacaacauagcaaggcccuaucucuauccaaaaaagugaaaaaaaauugccaggugugguggcauguaccuguagucccaacuacuugggaggcugaggcgagaggaucgcuugagcccaggaguuagaggaggcagugagcucugauugugucacugccugggugacagaguaagacccuaucucuuaaaaaaaggaaaaaaggcugggcgcaguggcucacgccuguaaucccagcacuuugggaggccgaggcgggcagaucacgaggucaggagaucaagaccauccuggcuaacacggugaaaccccaucucuacuaaaaauacaaaaacuuagccgggcgugguggcggaagccuguagucccagcuacuugggaggcugaggcaggagaauggcaagaaccugggaggcggagcuugcagugagccgagaucgcgccacugcacuccagccugggugacagagcgagacuccaucucaaaaaaaagaaaaaggaaagaaaagaacuggaacuuggauuuuauuugcaugauccaagcacagaguacaaaaagccuaaacaauugcuaguuuuagagccuacauccugggaagugugguuguuuuucagaagacuuccauaaauuucuggucuaauuugauggggaaaauucacuuccagaagugcuaaaaggaaaagguccaguuuuguuauggaaaguuauuuuuucaacuagaauuucaagauccauauuauugcuccauguauuaauaacagugcuuuccugagccauaugugcauauuucucuuugggacaacaaaauguugauaugaauaccagauacuuagucagaguuaagucaaauacugaaugaauaaaaaugaggucuaaaggggaagacagcacuucaucuuucagcagauuuucuuuugccagacaaaaaugucuauucagagacucggccuuccuauagccauccuaucuaaaugcgccagcuauauccaggauguggauuguuuuagggcucauaaagugucucauaaacuuauaaugaaaggguuaagucaguucaggucuuuaaagaaugcuuugaaagaauuuauauaagcuuugacuacuuaccuuacaaaauugaaaguucaaggguucucagcaguugaagagaaguaauguuaguaauucucaacuuugacuaaaacugccuucuaguuugaauagcaucuuuuauguucuuugucuccuuaauucuggaaaagaauaguuucaaauauauauauauauauauaauuauauauauauauaaaagguaccuuaaaauguaugcuucuuuuuucaggaagcugugcugaaugguuugguggccacugagguguugaugugguuuuaugucggagagauuauaggcaagcggggcaucauuggcuaugauguuugaagaccaaucuuuaacaucugauuauauuugauuuauuauuugaguguuguuggaccaugugugaucagacugcuaucugaauaaaauaagauuugucaaaacucaguguuuucuccaucagauacuccaugaaaggucacaauuucucuugauauuaag

SEQ ID NO: 15961 - RNA, 7454 nt, Homo sapiens
acuggccaaauaaacuaguacucagaggcugugauuauucaggguuguugugaaauacagcggucuaccagugaggcucuucaagcugaaaaaauuccacgaaugcuaagcuucguaacaaagauuauuguuuauacggaucccguccuaugcuucucggggcauggauacucauccaugaaguccauuuccaccuaaaauuucccucggauuaaagcggaaguaucuuagaauccgucuaggacagaaagcaaagucaacguucaaaaaagcucacccauccuuaaacauuucuguugacuuccaaauacuccacugagaacaacaccacauguaaugaggccgaauugauuuacuuucacguuucugcccuuccuuuucuuagcucuccuaacagaaccauccccucuagaucccugcucuuagcgaucucagggggcguaaugguugcagcugccgggcaacgccgggcuuccuucacacuaccucucuucccagucgugguuagaauucaggaacuucuagguuguguagagaacccaaucugcaggucagacgaguggaaggcuagaaaagagucgccaaccugcuuccugcucccuccaccugcaggccaucccgccccggcacccgcaggccccucgggucuucgcagcccgcuucuuccucucaggccaucgcaggccucccugccgcccgugugcccgccucggcggucucacaucgcgcucaccguucaccagcgccggggucuucuccacaagguuacggacaaauugggccaugguucuggaauggagaguccgucgccccgaaccgccggcugaaugucacccgccggaaggacccgcugcaggaccccgucccacuuccaaggucaggccgccucuuuucgcgccggucgaagauacuuaaauguccaaagaucuuugcagaauccagccugucaauuuaauuuuucaacauggaagagaaaguggauaugaaaagaugguauuagagagcaugugaagaacaguaggauuccgcagagaagcaggcauuuuguggggcagccacucguagagguccggaaaaccggcaaggagcggaaaugcgcaugcgcccugaaccugcagugcuuuucuuggcgccgaccuccgcuauuuugcguagggugcuuucgccgcgauucugagaaccuuugaagucaguacuggagaaggauucgcugagauucuucuaguccaacacgaucguuguacagagguagagaggguccaaggccaaacauauaaaguuaggggccgagcaaucaccacacaggcugucaccaggcucaacccauagcccuuuuuauuugagacagucucgcucugucgcccaggcugaagugcaguggcacgacuucggcucacugcaaccucugucccccggguuccagcgauuguugugccucagucucccuaguagaugggacuacaggcgcccgccaccacgccuggcuaauuuuuguacuuuuaguagagacgguguuucaccauguuggccaggcuggucucgaacuccuagcuucaagugauccacccgccuuggugcugggauuacaggcgugaaucaccgcgccuggccccauagcccuuuuaaaguugauuuuuuguaaucccaaucuccccaaagugcuguaucacgauuggaauccauuuccccuaauucccuaguuaaccacaaggagcugugcagaugugaggaaaaaaucaccuguauugaacgcccacacuaugccaggcauuuuggaauuuaaagaaagccuguaaggcauuguccccauugagacugggcuugaaaaauggccacacaguuuggaaguggcagaguugagaucugaaguugcaauguauacucagagagggggcauuccaucagauuaggcauggugcugauuucagcauacuuccuagaaaagauccuugagccgauguguaagagaacagcuguauacuacagagggcugaaacuucauaguuuaauaugaggaggaaaagauguauguagggaaguggcauuugaugagaggaacagaacuauaaguaauguaaccuggggaagucugagcagaaguaaaucuccgauuuuuggaaugguuagagagauggaaagaaaaauuagaaguguaaucaaggaacuaagaacuuuucaaugaaggagugauucugcugcccuagauacugcagaaaagucaaauuaaggaugggaaaguuaauuuagcaauauggcaaucuuuaacuaacuagcgccuuuucaaaaaauuaggauagaauccagggugaauggugaagaaauauggcuguaaaggauuacaagucagaaaaccaaagggggauguggaacucaggggagaaauugaagacagagaagaggcagucauuuauuuauuuagagauggggucuugccacauugcccaggcuggccugaaacuccuggccucaagagaucaucccacuucagccucuugcuuagcucugggauuacaggcacaggccauccugccugauaaaaagggauauugacaagagcccugaugaggcaggaaaagagaacuagccagggaucuauggggccuuuuccacagaugugauuaugggagagaggucugaaagucuucaaagucucugaagucuuuaucuucccagcaaaaugaaggcaaagucaucggacugugaggggucaaugggagggggguaugagaaggaauuugaggaaggaggccaaaguuuggaauagcugaaggacacacagaaggguuguugggcaacguuagagauaaguuugugguuguaccauucuaaaaauuguguuuuuccuccaacaauggucugcaguuuggauauuacagcagaggggaauggcugaguuaaucuaggcugacaucuugcauggcagggguauggaaacaaggagcaagaaaggggaagauaacagcaaaugauuacaaagaccugggguucaggccagauaaagaaaaacagugaagccaaaagagagcugguuaggaaaaccauacugugagauucaucuccugaggguaaccccaggguccccuccagaggccugguaaggcaggcugggucagccaggucacacauauuugauguuacuuaccuaaaaaaaaagugaaacgucagaauccucuaaguuuucagggggauuucugaaacugccacuagcuuuuaauacuggaauaaagugauaacaaagguuguaagucagauguucauuuauuaaauacaaguuuugaacaaacacugccaggcaaguuugacaagaaguaaccuuccuggaauguuucaaaauacagucgcguugaucaaguuuuauuucaaucaaccuuuucauuuucuguuucuagguucauuuccuguugagcaguuagagcaugugcauuauuuccucacaugacaucaacagugcagcaucagccucuggcauguaaaggcacccaguagacuuaugcucugugcaauggcugcuuagcaaccaccaucaaauaaaguaaugaagcuuuuguagagugugauaucaaauagcaacuggcaccuucacuugcaccauuaaaaaaccuuuaacauuuccuucaguuuucacauauccauuaaaaaguauauuaaaaaacaaaacccagacugcuugauaaaacauacuuaaacaauuuuccaaguuuaguauuagccucuugguaaguuaugagcaauaccagagcugaguaaaagagucuucauuuugcuaucauacuccagcaaagccaauacacaaaacuagguauguuagaaagucugcucuacuagauuuagagcugcuucuaaguuccagacaaaacaccuuuuuaagcuuccaaguguauauacacacgguguuguaccaagauaacuuuuuaaagucuaauuuuuuuggauauucuuaaauuacuucacagaaagaaaaaaggcacagaggacacuugguuuccuuaccaguaguggccuuaagcuacacacuugcuugugcagaguuuaaagauauucagcagcauuaauggugccauagccauucauaaaaaguuucaggaaaagaguuuaaaaaaagaagaaaagcuugccagaaaaggcuuacaaucugaagguuaaauacagaagaauacagacaaagacuggaggcagcauggggguuguuaacuaggaagcugcugggaauagcugccuucugaguuuuugugcccauuuuccuccaguuuucuccugaaaaacucuggucuuuuccccucguuuuuaaaaugagaacauccuacuagauuggguuuggaagauaaaugcaaauaggcagaagcuuauuuuauacauaguucauucucagagagggaaaggaggaugauaaauauugaaugaagcuaauuuuagaaaauaaacaaauccugucaacccaugccauaaaggcccagggagcacacugaaugaaucuuacauucuggcauuugcaaaaguguccucaauuuccuuuuucauuuuauaagcacagcaauaggcaacaccuauuuuauaucuaggaugggaagcccucuuagauuugaggcuuuccagcugaugcaaucaaaaacccaucaaggacugcuuauagcaacuuguguugaaauauaaaacuacuauuuauuugaaagagaccauaguuaauaacauguuccaaaugaagcagugacacccauuucuugauccuaucacuuuucuugucacuuaugacaucucugggcuuagaaagacagugauauaaagauaauccauaggggaaugucccuagucagcauauuaagcugcacaauugaguagugagcucaaguucacuuaugaaagugguguccaccuaccaacuacacagggcuaaguggauauuuaaaauggcuguggacaagguugugcucaacuuccuacuuuguuaauugaagaccuaaggcuguguuagaaguagcucuuagaagucaggucacaagcucaaacaaauauuaacuauauacauuuuauaaucucagaauuuugugaagaaugaguauguuaguaaacauggccacauacugcauacaucucacuauggaagagaaaauauaaagugguacucaguuuacacuaaaccaacaaaaaagcacaugggguguauguguauuuauauaucucacacacugagauauacuguugauauuagugucuuaaaaugacauuuuucauggauaugauacccguugccuaaaucuacuuaggccuaguccuuguagaaacagauuuucauaagagaauaagggcccaacagucuccucacccccaucaauugguaggauugcccuaccaauccucauuaaaaagacuguauaacaaaauuaagagcuaucaacagaaguugcacaagauuccuuuaaauuccuuuuuuaaaaaaaauucucgucuaucaucuuauucagaagucuacacaaacuuaaagguaucugcuuuuaugugaaguuacucuguaacacagaaaagggguuaagucuagaucaugaggacuaguaaauacacaggauaacaggauuuuucugauaacaucagcugucacugaaauaugugacaucacauauuuauaaaagcagcacucaccaaaaauguuugaacaguaauuggaagagaaauagcaggguggcgggaaguuuuaguaguugaaauaauauaauuucauuuaggaaaaggaagaagaauaugaagagacaacagagggugaaaauuagugaugauuucuaaacuuggugaugcuauaauaaguauaauuuccugcaagccaggggagcauugucaaguucuuaggaaucuuaacuaucauaauuucagcaagagcaguucucuaauuuaguaaaaaaaaaaaaaaaaaagaaaaagaaaagaagaaagaaaaggaacagaaccagaaagagagaaaccacaaacaauuguuuaucugcacucugggguugguuuugguuugguuaguucacaguaucuauucaaguugcuccuuuuguuguuuccucucugcaagccaccguuggauuuuuucuuuuaguucuguguuuggccggaucugguccauggugaggggacuacgguuaaagggaucuguuuggucacugggacaaagagagaaagggaaauaggguuauuuccauaaguucuaacauucuaagccaaaaacagaacaccugggcgucgcaucuuaagaaugaagccagagugcauuauaacuuugagucaaaugccgaguugggguuagaaagagugagaacaagaugauucaggaguuuuuguagcuacuuugucuauuucuuucuuucuuuuuuuuuuuuuuuuggagacagucuugcccugucgcccaggcuggugcaguggcacccaggauggagugcaguggcguuaucucugcucacugcaaccucugccuccugggugaaagcuauucucugaccucagccucccaaguagcugggauuacaggccugcaccaugacacucagcuaauuuuuguauuuucaguagaaacagaguuucaccauguuggccaggcugcucucaaacuccuggccucaagugauccaccagccuuggccucccaaagugcgcugggauuacaggcgugagccacccaccuggccucuauuucuuaauaaacuuugucucaacacugcuguucagaugauauuuaauuacaguggcuuaaaaaaugcuaugcuucugucaccuuuagauuucucuaaggcagagacacuauacauucaugucaguguaaagaacuauuuguaauuauagugacagauucuuagaacaguaugagauguuaaggaauaaagccuuguagaccaacauuugauuuagucagcugauuguuaugcaaguacaugcagauuaugguuucuugaaacauaagaagguuuaugacagaugucaaucuuuuggcuucccaggccacauuggaagaacugucuuggccuauacauaaguucuuguaauguuuuaagaaacguuaugaauuuuuguugggccacauuucgagcgauauagugaaugcuuaauaccaaauaccaagagguagaaaauucuuuuuuuuuuuuuuuucugagauggagucuuguucuguugcccuggcuggaguugcaguggcgugaucuuggcugacugcaaccuuugccucccaggaucaagggauucuccugccucagccucccgaguagcugggacuacaggcacgugcuaucaugcccagcuaauuuuuguauuuuuaguagagaugggguuucaccauguugaccaggcuggucuuaaacuccugaccucagggugauccaccugccuuggccucccaaagugcugggauuacaggcguaagccacugcaccuggccaaaaauucaucuuuuuaauauuuaaaaauuuccuuaacuuugggucaaa

SEQ ID NO: 15962 - RNA, 7454 nt, Homo sapiens
uuugacccaaaguuaaggaaauuuuuaaauauuaaaaagaugaauuuuuggccaggugcaguggcuuacgccuguaaucccagcacuuugggaggccaaggcagguggaucacccugaggucaggaguuuaagaccagccuggucaacauggugaaaccccaucucuacuaaaaauacaaaaauuagcugggcaugauagcacgugccuguagucccagcuacucgggaggcugaggcaggagaaucccuugauccugggaggcaaagguugcagucagccaagaucacgccacugcaacuccagccagggcaacagaacaagacuccaucucagaaaaaaaaaaaaaaaagaauuuucuaccucuugguauuugguauuaagcauucacuauaucgcucgaaauguggcccaacaaaaauucauaacguuucuuaaaacauuacaagaacuuauguauaggccaagacaguucuuccaauguggccugggaagccaaaagauugacaucugucauaaaccuucuuauguuucaagaaaccauaaucugcauguacuugcauaacaaucagcugacuaaaucaaauguuggucuacaaggcuuuauuccuuaacaucucauacuguucuaagaaucugucacuauaauuacaaauaguucuuuacacugacaugaauguauagugucucugccuuagagaaaucuaaaggugacagaagcauagcauuuuuuaagccacuguaauuaaauaucaucugaacagcaguguugagacaaaguuuauuaagaaauagaggccagguggguggcucacgccuguaaucccagcgcacuuugggaggccaaggcugguggaucacuugaggccaggaguuugagagcagccuggccaacauggugaaacucuguuucuacugaaaauacaaaaauuagcugagugucauggugcaggccuguaaucccagcuacuugggaggcugaggucagagaauagcuuucacccaggaggcagagguugcagugagcagagauaacgccacugcacuccauccugggugccacugcaccagccugggcgacagggcaagacugucuccaaaaaaaaaaaaaaaagaaagaaagaaauagacaaaguagcuacaaaaacuccugaaucaucuuguucucacucuuucuaaccccaacucggcauuugacucaaaguuauaaugcacucuggcuucauucuuaagaugcgacgcccagguguucuguuuuuggcuuagaauguuagaacuuauggaaauaacccuauuucccuuucucucuuugucccagugaccaaacagaucccuuuaaccguaguccccucaccauggaccagauccggccaaacacagaacuaaaagaaaaaauccaacgguggcuugcagagaggaaacaacaaaaggagcaacuugaauagauacugugaacuaaccaaaccaaaaccaaccccagagugcagauaaacaauuguuugugguuucucucuuucugguucuguuccuuuucuuucuucuuuucuuuuucuuuuuuuuuuuuuuuuuuacuaaauuagagaacugcucuugcugaaauuaugauaguuaagauuccuaagaacuugacaaugcuccccuggcuugcaggaaauuauacuuauuauagcaucaccaaguuuagaaaucaucacuaauuuucacccucuguugucucuucauauucuucuuccuuuuccuaaaugaaauuauauuauuucaacuacuaaaacuucccgccacccugcuauuucucuuccaauuacuguucaaacauuuuuggugagugcugcuuuuauaaauaugugaugucacauauuucagugacagcugauguuaucagaaaaauccuguuauccuguguauuuacuaguccucaugaucuagacuuaaccccuuuucuguguuacagaguaacuucacauaaaagcagauaccuuuaaguuuguguagacuucugaauaagaugauagacgagaauuuuuuuuaaaaaaggaauuuaaaggaaucuugugcaacuucuguugauagcucuuaauuuuguuauacagucuuuuuaaugaggauugguagggcaauccuaccaauugaugggggugaggagacuguugggcccuuauucucuuaugaaaaucuguuucuacaaggacuaggccuaaguagauuuaggcaacggguaucauauccaugaaaaaugucauuuuaagacacuaauaucaacaguauaucucagugugugagauauauaaauacacauacaccccaugugcuuuuuuguugguuuaguguaaacugaguaccacuuuauauuuucucuuccauagugagauguaugcaguauguggccauguuuacuaacauacucauucuucacaaaauucugagauuauaaaauguauauaguuaauauuuguuugagcuugugaccugacuucuaagagcuacuucuaacacagccuuaggucuucaauuaacaaaguaggaaguugagcacaaccuuguccacagccauuuuaaauauccacuuagcccuguguaguugguagguggacaccacuuucauaagugaacuugagcucacuacucaauugugcagcuuaauaugcugacuagggacauuccccuauggauuaucuuuauaucacugucuuucuaagcccagagaugucauaagugacaagaaaagugauaggaucaagaaaugggugucacugcuucauuuggaacauguuauuaacuauggucucuuucaaauaaauaguaguuuuauauuucaacacaaguugcuauaagcaguccuugauggguuuuugauugcaucagcuggaaagccucaaaucuaagagggcuucccauccuagauauaaaauagguguugccuauugcugugcuuauaaaaugaaaaaggaaauugaggacacuuuugcaaaugccagaauguaagauucauucagugugcucccugggccuuuauggcauggguugacaggauuuguuuauuuucuaaaauuagcuucauucaauauuuaucauccuccuuucccucucugagaaugaacuauguauaaaauaagcuucugccuauuugcauuuaucuuccaaacccaaucuaguaggauguucucauuuuaaaaacgaggggaaaagaccagaguuuuucaggagaaaacuggaggaaaaugggcacaaaaacucagaaggcagcuauucccagcagcuuccuaguuaacaacccccaugcugccuccagucuuugucuguauucuucuguauuuaaccuucagauuguaagccuuuucuggcaagcuuuucuucuuuuuuuaaacucuuuuccugaaacuuuuuaugaauggcuauggcaccauuaaugcugcugaauaucuuuaaacucugcacaagcaaguguguagcuuaaggccacuacugguaaggaaaccaaguguccucugugccuuuuuucuuucugugaaguaauuuaagaauauccaaaaaaauuagacuuuaaaaaguuaucuugguacaacaccguguguauauacacuuggaagcuuaaaaagguguuuugucuggaacuuagaagcagcucuaaaucuaguagagcagacuuucuaacauaccuaguuuuguguauuggcuuugcuggaguaugauagcaaaaugaagacucuuuuacucagcucugguauugcucauaacuuaccaagaggcuaauacuaaacuuggaaaauuguuuaaguauguuuuaucaagcagucuggguuuuguuuuuuaauauacuuuuuaauggauaugugaaaacugaaggaaauguuaaagguuuuuuaauggugcaagugaaggugccaguugcuauuugauaucacacucuacaaaagcuucauuacuuuauuugauggugguugcuaagcagccauugcacagagcauaagucuacugggugccuuuacaugccagaggcugaugcugcacuguugaugucaugugaggaaauaaugcacaugcucuaacugcucaacaggaaaugaaccuagaaacagaaaaugaaaagguugauugaaauaaaacuugaucaacgcgacuguauuuugaaacauuccaggaagguuacuucuugucaaacuugccuggcaguguuuguucaaaacuuguauuuaauaaaugaacaucugacuuacaaccuuuguuaucacuuuauuccaguauuaaaagcuaguggcaguuucagaaaucccccugaaaacuuagaggauucugacguuucacuuuuuuuuuagguaaguaacaucaaauaugugugaccuggcugacccagccugccuuaccaggccucuggaggggacccugggguuacccucaggagaugaaucucacaguaugguuuuccuaaccagcucucuuuuggcuucacuguuuuucuuuaucuggccugaaccccaggucuuuguaaucauuugcuguuaucuuccccuuucuugcuccuuguuuccauaccccugccaugcaagaugucagccuagauuaacucagccauuccccucugcuguaauauccaaacugcagaccauuguuggaggaaaaacacaauuuuuagaaugguacaaccacaaacuuaucucuaacguugcccaacaacccuucuguguguccuucagcuauuccaaacuuuggccuccuuccucaaauuccuucucauaccccccucccauugaccccucacaguccgaugacuuugccuucauuuugcugggaagauaaagacuucagagacuuugaagacuuucagaccucucucccauaaucacaucuguggaaaaggccccauagaucccuggcuaguucucuuuuccugccucaucagggcucuugucaauaucccuuuuuaucaggcaggauggccugugccuguaaucccagagcuaagcaagaggcugaagugggaugaucucuugaggccaggaguuucaggccagccugggcaauguggcaagaccccaucucuaaauaaauaaaugacugccucuucucugucuucaauuucuccccugaguuccacaucccccuuugguuuucugacuuguaauccuuuacagccauauuucuucaccauucacccuggauucuauccuaauuuuuugaaaaggcgcuaguuaguuaaagauugccauauugcuaaauuaacuuucccauccuuaauuugacuuuucugcaguaucuagggcagcagaaucacuccuucauugaaaaguucuuaguuccuugauuacacuucuaauuuuucuuuccaucucucuaaccauuccaaaaaucggagauuuacuucugcucagacuuccccagguuacauuacuuauaguucuguuccucucaucaaaugccacuucccuacauacaucuuuuccuccucauauuaaacuaugaaguuucagcccucuguaguauacagcuguucucuuacacaucggcucaaggaucuuuucuaggaaguaugcugaaaucagcaccaugccuaaucugauggaaugcccccucucugaguauacauugcaacuucagaucucaacucugccacuuccaaacuguguggccauuuuucaagcccagucucaauggggacaaugccuuacaggcuuucuuuaaauuccaaaaugccuggcauagugugggcguucaauacaggugauuuuuuccucacaucugcacagcuccuugugguuaacuagggaauuaggggaaauggauuccaaucgugauacagcacuuuggggagauugggauuacaaaaaaucaacuuuaaaagggcuauggggccaggcgcggugauucacgccuguaaucccagcaccaaggcggguggaucacuugaagcuaggaguucgagaccagccuggccaacauggugaaacaccgucucuacuaaaaguacaaaaauuagccaggcgugguggcgggcgccuguagucccaucuacuagggagacugaggcacaacaaucgcuggaacccgggggacagagguugcagugagccgaagucgugccacugcacuucagccugggcgacagagcgagacugucucaaauaaaaagggcuauggguugagccuggugacagccuguguggugauugcucggccccuaacuuuauauguuuggccuuggacccucucuaccucuguacaacgaucguguuggacuagaagaaucucagcgaauccuucuccaguacugacuucaaagguucucagaaucgcggcgaaagcacccuacgcaaaauagcggaggucggcgccaagaaaagcacugcagguucagggcgcaugcgcauuuccgcuccuugccgguuuuccggaccucuacgaguggcugccccacaaaaugccugcuucucugcggaauccuacuguucuucacaugcucucuaauaccaucuuuucauauccacuuucucuuccauguugaaaaauuaaauugacaggcuggauucugcaaagaucuuuggacauuuaaguaucuucgaccggcgcgaaaagaggcggccugaccuuggaagugggacgggguccugcagcggguccuuccggcgggugacauucagccggcgguucggggcgacggacucuccauuccagaaccauggcccaauuuguccguaaccuuguggagaagaccccggcgcuggugaacggugagcgcgaugugagaccgccgaggcgggcacacgggcggcagggaggccugcgauggccugagaggaagaagcgggcugcgaagacccgaggggccugcgggugccggggcgggauggccugcagguggagggagcaggaagcagguuggcgacucuuuucuagccuuccacucgucugaccugcagauuggguucucuacacaaccuagaaguuccugaauucuaaccacgacugggaagagagguagugugaaggaagcccggcguugcccggcagcugcaaccauuacgcccccugagaucgcuaagagcagggaucuagaggggaugguucuguuaggagagcuaagaaaaggaagggcagaaacgugaaaguaaaucaauucggccucauuacaugugguguuguucucaguggaguauuuggaagucaacagaaauguuuaaggaugggugagcuuuuuugaacguugacuuugcuuucuguccuagacggauucuaagauacuuccgcuuuaauccgagggaaauuuuagguggaaauggacuucauggaugaguauccaugccccgagaagcauaggacgggauccguauaaacaauaaucuuuguuacgaagcuuagcauucguggaauuuuuucagcuugaagagccucacugguagaccgcuguauuucacaacaacccugaauaaucacagccucugaguacuaguuuauuuggccagu

SEQ ID NO: 15963 - RNA, 39655 nt, Homo sapiens
cacaugccccggcgcuuguugaugacguaacuuccgguugcugugcugagucggaagugggaacccuucggccgcugagauucugucgugucgucgcugcuggcacuucaggcucugguaagacaggcaauagcuucaggggacggggucguugacuuugcguugugauauuuucugcugguccaaugccacuucaagccuguucacucuuaucuucuccaaauuccuucuccuaugcuuugcuaaccagggaccuucuccuucuugaacuucgacccugucugauuuggaaccccuuacagugccccagcuucugaugucucuuuguacauuucuguccccaucuuugccaagccccuccuggaagaggccggagcgcuaucauugcauuaucuuuugacuuaacuuucucuagaacgugccccgggcggguggaucucccuccuucccgcgaaucccuuauggagcauggaaggauaaaauauaaagaguagauaacaaauaggcagaugccaagaagauaagauuaaucgugagucguaagcaaaccaguucaaugcauacgucaggguguugauaauucuuaaggcaggugaugaguucaccacagauaacucuuggggcacucugcuucauguuuccuuggguuuagaagacacuucuaaaauugagugaccaugccucaugaccuuauauuugaugagccuuccuuuuaggaucaguuuuaugcccugacagcaagcauguguuuagucucgcugucauuuacuguuuuggucucacguggaagcccaccugcgauaaaaugggauccaagaaggacugcugucugcuuuuugacuugagauccuucuaggcugcagauagauguguugauggaauuuguugccacauuagcauggccugauaguguuaggugaaacauacgacaacgaaaauuguuucuuaauuucuauuuuaaauugauauuuuaauuucuauuuuauauugauauauguauuauuugccaggacacagaccuuaugggaguaugauuugauagagcuugauuuugacgaucccaguuuuacaaaguguuccagauauuucuguugaaaaacaauaccaagucugauguuaacacacuuguguguucaugagagcugacaguggucuuaaaggauuagugguacuauucauaaacaaaagcuuguauuaggaggaagugacagaauuuuguaggacagcuauuauagauauagaucuuugcagcaaguguaucagagugaaacuuguuuucaaggaggauauauuuuaaaagaaucaaauccaaaagcuucuaagguugguagcuguaccaucccaaagugucugacaacaggauaguguuguaucucuguauggcaguugaaaauaggaaaaaaaauacauacauauauguauguauauauguguguguguguguguguguauuuuuuuuuuuuuuuuuuugagacagagucuggcucugucacccaggcucugcucuggagugcaguggcacgaucucagcucacggcaaccuccaucucccaguuuaaaagugauucuccugccucagccucccaaguagugggauuacagccuggcuaagguguggugguaugcgccuguaaucgcuuuuaguggagacgggguuucaccacauuggccaggcuggucucaaacuccugacuucaagugaucugucugccuuggccucccaaagugcugggauuacaggcaugaccuacugcgcccggcgcugaaaauaggagauuauaaaucccgaaugacauuauugaauauuaaacaaaauauuuagguuucauuuuaucggaccuuuagagugggugauuaucuggguacucuuacuuugguaaguccauugaacaaaucuaaacuggcaucuccacaaagguucucaucaagugaucaguccuccuuuuuccuguaaaauuuuucuauaagugacuacacaguuuuagcccuuuuuuaaugaaaaaaaguuugugcacagauuugacauacgugugaaaaagaugagcuuagugaaagauaggugagaaccuuuuuguuuuuuacagauaguagagaugacaacagagacuuauuuccauccaccauucuacacaugccaagauaccaaagaaccagugucuagccugguagcuugaccuuccacugcaaccuaagacaaguaguaaagcccuuaccuugaaguagggucaugggugaugcuguugauuacaaggaguucagaaagaacuacauguaagauugaagccauucaauaacuacuuauuuaggauuuugugauugugauguauaaugccagacacagaagaaagaauaaucagauaugaacauguaaucagaagagcuuacagccuagcaauguagaagaucugcuuagaaauacaaugcagaaaguuuaaaauccuaguaaaaauagagguaaaauguagaaagcuaguuucuuuauacagugcaacaguauaguauugagaaagaaggaaguaaugcaguuuauggugauaaauucuuuuuguuucucuugauagucuuuuuguuuguuuguuuguuugagacaguuucccucuguugcccaggcuggagugcaguggcaacgaucuugucucacugcaaccuccgccucccagguucaagcaauucuccugccucagccuccugaguagcugagauuccaggugcacgccaccaugccuggcuaauuuuuuguguguuuuaaguagagaugggguuucuccauguuggucaggcuggucuugaacuccugaccucaugaucugcccgccuuggccucucaaagugcugggaucauaagcaugaaccacugugcccggccuucuugauagucuuaagagcuucucugucauauguccuauauuccuggcuuucagcuuccuuucugcuuacguguugcaggugaugcauguccuuuguaauaaucuggacacuuuucaguuguguuuuaaaaaacaucaaacugguuuaggcauuuagggaaauuuuauugguuuuuauaacugaaaaguccagacuuaucuuuccaucucucaauucuguuuucuaguguauguuggcuugguuuuaggcuaggccuuuucuaaaugguguaaagauggcaacucuaucuuacuggcuuaucaacucaaucaggagaaaacucacuuuuccguagauucagcugaaguccugaagcugguauucauugacucuguuaggccuccauagugucuugugcccacuccuggaucaguugcuuuggcuggaaaaugcuguauucuuuuuagccuggccagacuuguauguucauuccuggggcuagugggugaggucaaccccuucugaacuggucagccucuucuggauugaguggaguggauacccaaaggaaaaaaaugaaugugauguuuuagagagagaaauaacaagagcucaauauacuuuuugcauuccucuggaauuugugguauuuuaggauggaaguagaaugguggucagcuaacaauaagacaauucuugguguuuuuacauuaacuacagguaauaauuaaacuugugcgguaauuacauggggaaaaucccucucauuaauuucaauacuaaauaugguaucuuucccuuuuuuugcauuauuaagcuuacugaaauauacauagcaaaaaauaaaauacagaaggccaggcgcagugacucaugccuauaauuccagcacuuugggaggccgcggugggaggaucacuugaggucaggaguucgagaccagccuggccaacauggugauaccccgucucuacuaaaaauccaaauaacaguucaauuccuugaagcaguaaagcuuugagcugcacugagaggagacuagacugccuaagucauuacagcuaauuagccguuagcucuuguguggaaaaaauggcagaggagcaugaagcaagugcugaagaugccucagaauugucaagaaauguuauaaauaaucucuuucucugguaaauaaggguaacuuuuucgaccacauuagcuuuuuuuuuuuuuuuuuuuuuuugagacgaagucucgcucugucacccagguugaagugcaguggcacaaucucagcucucugcaaccucugccucccgaguccaagcaauucuccugccucagccuccugccucccaaguagcugggauuacaggcaccugccgccaugccuggcuaauuuucguguuuuaguagagaugggguuucaccauguuggccaggcuggucuugaacuccugaccucaggugauccaccugccucagccucccagggugcugggauugcaggcaugagccacugcaccuggcccacauuagcuuuuguugauaugauccugugaggagucuugccucaauaaaccaaagguagaccaaauguucuuuuuuucuuccuuuauaccccuacucccgcuauuucuaaggucucuguccuuauagcaguucaagauccuuaugaacaaaacauucauacccuuugucucuucccacccuuuucaguguuguauuuaauauuucuaugucauggccuuaaaauuucagaaaggggagaaagccuuucagggagcccuguuuauucuguugugccacugaguucacuuggucuugaaugaggaaauguaaucagaagagugugaaugcaggcucagccagcucuacuaaacaccuuugagguaucuauauuucauauuacacaguagaccugaccguuggaauucguguuucuucaguauuauuuuaagaaaucagguaaacagugaagguuagauauagcaugaagcaaagaccauuuaauuuuuaguggaagaaauaucaguauuuuuaagccuagaaauaaauagauugcuuaaucuauguuaaaaacccacaacauacagcugaacugcuuccaguccugauuugccagaguccaaaucuaagauaugggcuuuuacuuaauuuauauguagcugagaaauauccauccccagcccuaagucauagaagucccuuguccucaccccagugaaugagaacuagacugccagcuuaauucuugggaaauccauaauucuugucuuauuauuuuucagugccacauuguuauuacaauuaguaggugaguucucucuuugacuucaauaauucuuucuacuuaaccuguuuucuuaaagguauugcaaauaaaaguauaucaacagauuaaugcauuccagcugaacguuuuagccuuuuuaguuucagcuauccacaaaucaagccaccgaguccagcugguagguuuguaaccauuuugccaaaaaugucuugaguuuggggacaggaauuggaaaaucuuaacccaaaguauuuuaaaauguauuguauuugagaaaugggaaaagaaacaaccacagguauauuacagcuauugugucaucugcccucuugugucuaauaccuguccuuugaacagccucucccacuaggucuggauggaggauaccuuaaagugaaaugacagaccaggagaauaacaacaacaucucaaguaaccccuuugcugcucuuuuuggcucccuggcugaugccaaacaguuugcggcaauccaaaaagagcagcugaagcaacaaucugguaaguggaggagccaauagcagcaaauaagaugaccuagaauggggucuucccaaauuaaguauucuuugaguccuuaauugcaauuggaauuuaaguuuggaacaaaaguugguuuuuguuuguuuguugagagcagaaauugggguuuuuuguuuguuugcuuuuauuguugguuuuguugugagucccuccccuccgcuguccucuccacuguacaaaaagagaccagguaacaggugguuccauaguaacagaugccagucgugaucccaaagcugucaggcuguuuucuuuaaaagaaaaaaaaaaucaccuaguaaaagcuauuuaaauaaauguuuuuaacaugggacacagaggugguaaguguagguguagaaagcaagucaugugcagcuauagaaagcagauguaaaaggaagaacuauaaaagcuuuuugaccuguaggcaaaugagacuuguucuuaagcucagcacuucaaaggcccucccaagcaaagugcuucuucuguuccgaugaguggcaucauuuguagcuuaguccuguuaggacagacuuuuuuaaaaaaucugauccuuagccuuacuaugaaaaacaucagaauaacaucucaguaaucagaaaaaaugguuuucuuucaggcaccgaauuuaagaucaaguccagcuuccuccuauaaggagacauauacacuagaagaauuaggauuuuucucaaauauguuagucuucugaagauauucacaaucuuucaaaccagaaauugcuccccuucuccucucuccgaaaagaauaauaguguuuuucuuuugagagaaggagaaguguuugcauuuucccuuuauuuuguuuauuuaaaaaaaaaaaaaacacucaggugcauagcugacuuuuggccuuucaguuagaaagggcugaagaaaaaagagguaaaggcaagacagauaagugauugaugcaagggaaaaacaaaaucaauguugauuuuuuuuaacaugguauuuucagucucugaaaucucucccagauuucuaugauacggggccagaaugggaaacucugguuuagaagauuguaggggaaaaagcagagugaaaaauaggaaaaauaaggaaugagaaaguaugauuuaugaguaugugguugagggaaauuuugcuaaacagauucuuagcuucugucaccauuggaggucagagaaaaacucaacaguauagcagcugagcaacagaacgcuuguccuucuggcuauaaacagacauaaaucuggcuagaguugggagcauugcaggcacaugcccuucuguuacuauuuuggcaccucaucauccuaguuuguuuacacugaguuuaucaugccaccagguccaaccuguuuccacuagcaauuaguacuuugccaaaaccuuuggcuuccuauguugagcuuauacucaccacacugaaacaacucuuacuuugagaguuuuaccuggacuuucagacuagccauucugucaauagagaaaaguacauauagacucauauguggcauauagugaauaacacuacuuuuauguagucauucaacaugaaugauggggcugggcgcaguggcucgcgccuguaaucccagcuccuugggaggccuaggugggcagaucaccggaggucaggaguucgagaccagccuggccaacaugacaaaaccccgucucuacuaaaaacacaaaaauuagucgggcaugaugacaggcgccuauaaucccagcacucugggaggccaaggugggcggaucaccugaggucaggaguuugagaccagccuggccaacauggugaaaccccaucucuacuaaaaauacaaaaauuagccgggcgugguggugggcgccuguagucccagcuacuuggcugaggcaggagaaucacuugaaccugggagguagagguugcggugagccgagaucacaccacugcacuccagccugggcgacagagugagaguccaucucaaaaaaaaaaaucaaaggaugggagcagauuuugaggacagaaguuuaaaaaaaaaaaaaucgaaggaauuucaucaauaagaaaaaaauaacaagaaagaauaaaaagguacaaaagaugugacaugcaacuuauaaccaaaugauuaaaaaauuuauucucaucaaucauuagagaagugccaauuaaaacaaccauuaaauuguuuuuuuaccuaugaaauuugugaagauucaaacaggcacucucucauauacuguuggguuugcauguaaaucagacagucucuuugaggguaacuugguaguaaauguuaacuuuuuuuuuuuuuuuuuuuugagacgaagucuugcucugucaccgaggcuggagugcagugcaaccucugccucccggguuuaagcaauucuccugccucagccucccgaguagcugggacuacaggugugugccaccacgccuggcuaauuuuuuguauuaguagggaugggguuucaccauguuagccaggauggucucaaucuccugaccucgugauccgccugccucagccucccaaagugcugggauuacaggugugagccaccgugccaggcaguaaauguuaacuuuuuaaauguucaagcucuuugauccagcaguucugcuacugugaauuuauccuauagaaauacucauacaaguaaacaaaaagaguuaaguuguauuguauucagugcaguauuuaaaaucaugaaauauuagaaacaacccuauuguucaucaguugaaaaguagcuacauaaaccacagggcaugcaaaagaugugauacaauacagcuauuaaaaauagugagguaggccucuaaauggccuaacagggaaagguguuggugcugauuaaaaggcaagcugaaaagagcuauguauaguaucccauuuuuuaaaaaaauuaaaaagauaguaaugaauauuagcaccagaaaagaaaaaaauucuugaacacuguuaagugucuuuagggaauugguucaggagacuuucuauacuauauuuuucuguacaguuaagaacuauuaaaacaaauguuaucucuuaaaaucagggagaaaagccauacauuuaaaauaauuaaaggcauuuugaucuauuagguaauucuuuguucacuaggauucuguagagaagauaacuuugcuauuucuggcaguguggaguauaauuauggauagaaauaaaacuuuugcuuuguaaaaugugguaggauuuauagccaggaauuucaaaacccuauauuuaacuucccugacuugagauguucacuaauuagaugauuagcuuguuuuacaucugaaauuaucaucuucuugguuacauuuauuauuuuugguagcaugcuugguucucucuuaaagggguguaacauuuaacaguauacauuuucuggcagaugaacucccagcuagcccagaugacucggauaauagcgugucagagagccuggaugaauucgauuacucuguggcugagauuagccgcucauuccgaucacagcaggaaauaugugagcaacucaacaucaaucacaugauccaaaggaucuuccuuauuacucuggacaacagugaguuacaaacuuauagcauuauucuacccuuccuauuugagcuugggcuaggggcuugcucuuugaaacugguuacagcuaaugguuagauacaaaccuacucacugcacucccuggaacucaggguuuauauuucagugaaccuuuugguaugaccuaaaaacaguauuuagaugcagaucuaacuuuuguucccauuucaauacugacugcacuauauagcuacuugccuuuacuaccuuaaaaaggaaaugggaaggguagccaaacccauuuucuucucagagguaaccuaaauauucagauggaagccuucagaggcaucagagaguguuugcccucugugcccugucuguguuuaaaccccaagguugguacuaaugucugggauuuacucuuuaaaugucaugaugcuagguuuauaacaaaucccauucucugugacuagagggggaaaaaaaaagauuugaaucuuuagauguugcuuuguguaucaggaucauucugguauuacuugagucagauuugcaguucaagagugaugcugucaagaucaguugucuguauaaaacagaagcauuauccuuaaccuaucauauuaaaaccauuucccaggugaucccagcuugaaaagcgggaauggcaucccuagccguuguguguauuuggaagaaauggcaguagagcuagaagaucaagacuggcuugauaugagcaauguugagcagguaauauucuuacguuccuaaugugugcccuuagcaaaaauuagcuaugcggcugaauucugcucacuguucuccaacuuaugcuuguguccauauguccaucccucucucuuuuuuuuuuuuuuuuuuuaccaguagaaggccaaguaaccuggaugugcaucucuaacauugugguguuccucuuuuggaaucuuuucaucuaccauggccacaugcccaaaucuacccauccucuaagaaccaguuaaaaugccuucuuaauuacaaagccuuggccaggcacauugacucacgccuguaaucccagcacuuugggaggcugaggcagguggaucacgaggucaggagaucaagaccaucuggcuaacauggugaaacgccgucucuacuaaaaauacaaaaaauuagcugggcaugguggugggcgccuguagucccaacuacuugggaggcugaggcaggagaaugguuuaaacccaggaggcggagguugcaaugagccgagaucauaccacugcacuccagccuggacaacagagcaagacuccgucucaaaaaaaaaaaagaaaaaauuacaaagccuugccaaauaaaaguuguuacucccuccucuggguaccuagaauaaucagccucugaaucucuugugggaauugucacuuucugucucauguugcggcuuucuuauguaccugucuuaucuccccuauuagacuuaaguucuuaagggcaaggcccaucgcuuuuucuucuuuauauccuuucuaucuuagucuguuuuguguugcuauaaaagaauaccugugacuaggcacaguggcucacaucuguaaucccagcacuuugggaggccaaguugggaggaucuccaggccaggaguuaccagcccuggcaacauaacaagaccauguuucuacaaaaaauacaaagaauuaacugggugugauggcauguaccugaaguccuagcuacucaggaggcugaggugggaggauugcuugagccugggaggcagaggcugcagugagccauagucacacgacugcacuccagccugggcgacagagcaagaaagacccaucuaaaaaaaaaaaaaagaacacccaagcaguaauuuauaaagaaaaguuuauuuagcucacaguucugcaggcugagaagauucaggguauguccuuggccucuggugagggcuuuugugcugccucacaaugugguggaggaagucaccaaaggacacauaccaugaggacgcaugcaaggaggagaaaaccugagagguguccuggcuuaauaagaacccgcucuggagggaauuuguccauuccuaugagaauuaauccagucuugugagagcaagaacucauucagcaccuugagaaaagcaccaagcaauucaggagggauccgccuccauacccagacaccucccacuagccccaccuccaacagugccacauggagaucaaauuucaacaugaauuuuguuggagacaaacauauaaaccacagcacuuuaaaaaucaaaacagugcguuguaccuugcaggugccugaguaacauuaaaagaauaaaaguuugguaggaaagacaguugacagcuugcaguuuaacuucacauuuggaguaucuuuauauaagucugaaugagaucagcaaucacacagaauaguagauuucacaucuaaguuuaaucacugaucucagcaccauucaacaaauagucuuuuaaugccuacucuaugcuggggcuauacuagacacuugaggcuugauuuaggauaacuuuauauaugccauaauuuucuaaaauuuucuaaaguaaaaauauacagggcccuuuuuuucuccuucacucuacauucaaaucugugauucuugcuaauaaccugugucagaauuaccuuuuacaucuuaauguucucagauuaauuuugcaauaguuuaguauuuuuguuugguuuucuuuauaggcccucuucgcucgcuuauuacuucaagauccaggcaaccacuuaauuaacaugacuucuucuacaacgcuaaaucucucugcugaucgagaugcaggagagaggcacauuuuuuguuaccuuuacuccugcuuccagagagccaaggaagagguaaaggaauaauccccauugaauacuguauuguccucuuggguaugacuucagcaugugggccagaguuggaucagucuuuauuucaauuuauauaugucauaguaugucuagaagugaauaucagggacacuaaagcuuuuauaucaauuuauauaugucauaguauguuuagaacacuggauaucagaugcacuaaagcuuuagucuccuuuccguaucuugggguccacccuucuccccaguuaaccaaugccuccuauucucucuaaaaccucuuuagaaaucacauccuuaaaaaaaucucaugaggcugggcacaguggcucacuccuguaaucccagcacuuugggaggccgaugcaggcggaucacaugaggccaggaguucgagaccagccuggccaacauggcaaaaccuuuacugaaaauacaaaaauuagccgggcaugguggcacacauuuauaaucccagcuacucaggaggcugaggcaggagaaucacuugaaccugggagguggagguugcagugagcugagaucacaccacugcacuccagccugggugacagagcgagacucugucucaaaaaucagaaaagggcucaugaauucauuuccacugagauguaaauauuagaguaggcuaagccggauauuuccagguuuggaauuuuaaauaggcagauagaugauuccuuaagccaaggaaggaaucucuaauuaauuuucaagcauccacaggagaccaguaugucucuucuauuguauucacuaugucuacuuucguuccagauuacagaguuagacuauucccucuuuucuucaugcuguuugcagauuaccaaaguuccagagaaccugcuacccuuugcagugcagugcagaaaccucacuguguccaauacccgaacaguucuucucaccccagagaucuauguugaccaaaacauccaugagcaacugguagauuugauguuagaagccauccagggagcccgugaguacaugaacaagaucuguaagcuucuacauuuugauuuucagauuuaaaauuucacuaauugcauuagaaagucucagagccauuaugguucugguauaaauuaaggaggagggcucacaucuugaucuuugagguugaguaccaauagaauaaagcugggcaugguagcacaccccuguagucccaucuacucuggaggcugaggcagaaggaucccuugagcccaggaguuugaggcuguagugugcuauaaucacaccugugaauagccacuacacuccaggcugagcaaaaaaacaagacccccagcucuaaaaaaaaaaaaaaaagaauuauugaaaguaaagagcuaguguguaaaggcauauaaaaauucuugugcccuccuuucucucucauuugucuucuguuagauuuugaagauguaacugaguuucuggaagaggucauugaagccuugauauuggaugaggaaguuagaacauuuccagaagucaugauuccaguguuugauauuuuauugggccgaauaaaagaucuagagcucugucagauccuuuuguaugcauaucuggauauucuucucuauuucacuaggcaaaaagauauggcaaagguaggucugaaagaugauauguauucaguugagcuagauguguaauacaugaugcuucccuauccugaagacacuauaauacuaccuauaaaauaagaaaaagauagcuugguuguuguaucaacuuaacuguuuugaggcccucccaccccaucaccuuaucucaccaugaagaugaauaagcagaacuugucuucucuuacagguuuuuguagaauacauucagcccaaggacccuaccaaugggcaaauguaccagaagaccuugcugggaguaauucugaguaucuccugcuuauuaaagacuccggguguuguagaaaaucauggcuacuuuuugaauccaucucguuccagcccccaggagaucaaaguacaggaggccaacauccaucagguggaacuguuuaccaggguaucccagcccccugaucuuaaaagaguuuucucagaaagcagauacagauaaggcugcucaagccucucugggaaagcaaauugaucuaguuggcuuuuacaucacauaaauaaauuaaaacugggcaugguagcucaagccuguaaucccggcacuuugggaggccaaggugggaggaucgcuugagcccaggaguucaauuugaaaccagccuaggcaacacagugagacccccaugucuacaaaaaaauacaaaacuuaggugggcaugguggcaagcaucuguagucccaccuacucgggaggcugaggugggaggaucacuugagccugggaggucaagacuucaguaagccaugauugcaucaucacgcuccggccuggaugacagaagaagacucugucucaaaaaaaaaaaauccccucuuuguagcauaugcuaagaacagcacgugugggguaagaaugagcugcugcuacucauuacccuuugcuguagcacugcuacagcuacuucuccccaacccucauuuuucucacugagcuauaacuuuagcucugaaaaucuuuugacugaacucuagcuuauaaacccaguuuuucuuccuuuucgugucuccaccuaugcccucucuuugggcuucuucacauaaauuauaguagaggucuggccaacaugaggcauugaaugauugaauuggggauaguuuaaguccccuaaucauuaaucauuacaacucucuaaggcaaggcauggcaaacuagcaguggccaaaucuggccugccaccuguuuuuguaaauaaagguuuauugaacauagccaugcgcauuaguauauguauuguuucugguuugaauucauacuacagugauagaguugaauaauugcuacagacacuguauggcaaguaaugccagaaauccuuauugucuagcccuuugcagaaaaaauuuacagaccugugcucuaauaccguguaaugccaucugcaguugggcagcugaucagaaaaucucuuauaagugcccagaaauauauuuuaaaaucaaauuaggggaugaggcacagagagugaggggaaagauuaggauuagcauauuuuuggaaacugccaguugcuaagguuugggaauaaaaacuauuaggauugugaaacguucugugguuguguuuucugguugaacaguucauggcucaguuccacgaaaagaucuaccagaugcugaagaacuuacuccagcucucuccagaaaccaaacacuguaucuuguccuggcuuggaaacuguuugcaugcaaaugcaggccgcaccaagauuugggccaaucagaugccagaaaucuuuuuccaaauguaugccucagaugcuuucuuucugaaucugggugcugcucuccugaagcuaugccagccauuuugcaaacccagauccucucggcuccucaccuuuaaucccacauacugugcccucaaggaguugaaugaugaagaacgaaaaauuaaaaauguacacaugagagguaggagagaaccaggcuucucaaaacuguguguguguguguguguaacguguaaagcauucacucccuuauccuuuuucacagaguuccuuucucaaaaaaagaugaggcagaaacgagcuauuucgauuuuuuuuucuuuuuuuuugagauggagucuuacucugucacucaggcuguagugcagugacgcuaucuuggcucaccgcaaucucugccucccguguuccagcgauucuccugccucagccucccgaguagcugggacuacaggcacgcgccaccacgcccagcuaauuuuguguauuuuuaauagagacggaguuucaccauguuggccaggauagucucgaucucuugaccucaugauccauccgccucagccucucaaagugcugggauuacaggcgugagccaccacgcccagccagaauuuuuaaaagacagauguuugagagaaaaaaaaaaacaccugguagcuuuuaaauguuguacuuuagugagaccuucucucuggauuuggcagccuugcauauucauucauucauaguuuauaaaaaugaauaaagcagaguccucauccuuuuugaacucaggcuccagaaggcagauauauuaacugauaauuauaauaugguauagggcuaagcuaugggagcacagaggagggaguaaauaaucaauucugcagaaguuggaggucuucauagcugagucuugagagacaaguuagguuuuaccaggcaaagaagcaagagggucccuuuauacagagagaaaagcaaguguaaagguacaaagcuauggaaaaucuugacuaaggaauggugagaggcucaauguggcuagggcaagggguagaugggguugaguuggggaggaaauggaucaagggaggaagauagguggggcuggauuggagaaaacaguacagagaaaugaagagaaaauaaaugacucacaguccuaccauucaaagugaaaucacucuuaauuuugguauauuucauuccaguuuuauaauucuaauuguaaacaugauaacugcucaaaagcaaauaaucaaauucagaaaagcacaaaauaaauacaaaugaucuauugccuaucacuugaaacaaucuauaguaguauuccuuuuaauuuuuggugauuucaugaaaaagauuuaacuguauuucuguagacggugagaaaccaaaagauauauucagacaaagaacuaauaugacaagauauguuuuuaagaagauaucacugcuaacaguauggaaauugaaugaguguaagaggagacuggagaccaagacauuuacccucuuuuuuuuuuuuaacuucuuugagguuuggacaaagaaaccuguuugaucccagcugugcaggagccgaaguuuccacagaacuacaaccuuguaacagagaaccuugcucugacagaguacaccuuguacuugggauuucacagguaacuccucugaugucauuaggaaaaaacaguuuaguuguguugauaacuagaagguagaaauugagucuuuggccaggcacaguagcucacaucuuuaaucucaggauuuugggaggccaaggcagaaggauugcuugaggccagaaguuuaagaccaccaaccugggcaagaaagugagacccccaucucuaccaaaaaaaaaaaauuagccaggcaugguggcauaugcuuguggucuuagcugcuucagaggcugaggcaggaggauugcucuagccgaagaguuggaggccacagugagcuaugauugugcaacuguacuccauccugggugacagagugauaaccuguuucuuaaaaaaaaaagagaggaagagucuuacagauauaaucugagcuuauucuaaagguucacauuagaaucuaauagaaaaggggcauuguaugaauuuacuuguguuucaugaaucagcuuuguccagauuccuuaaauuuguuuuuaacuuuuaucguugucguuguuguugaaauggauuuucgcucuugucaccuuggcuggaguacaguggcacauucucugcucacugcaaccuccgccuccuggguucaagcaauucuucugccucauccucccaaguagcugggauuacaggcaugcaccaccaugcccagcugauuuuguauuuuuuuaguagagaugggguuucgcuguguuggccaggcuggucucgaacuccugaccucaggugauccaccaccuuggccucccaaagugcugggauuacaggcaugagccacugugccuggccuguuuuuuaacuuuugaccuguuaaacuuuaaaaauuaaaucacugucuuccuauugugaucugggaaaguggaauuguuuucauuuuauauugcacuuucugcucuuaaauuuucauuacuggccgggugugguggcucaugccuguaauccuuugcacuuugggaggccgaggcaggcagaucacuugagcccaggaguuugagaccagccugggcaacauggcaaaaccccgucucuacaaaauauacaaaaauuagcugggcaugguggcgugugccuguagugucagcuacucacgaggcugaggugggaggaucucuugagccugggauguugagacugcagugagccgagauugcgccacugcacuccagccugggcaacauagugaaacccugucucaaaaaaaaaaaaaaaaauuucauuacuacuccuggugauaaaagaugaaguucagccgggcgcaguggcucaugccuauaaucccagcacuuugggaggcugaggcaggcagaucacaaggucaggagaucaagaccguccuagcuaacauggugaaaccccgucucuacuaaaaauacaaaaaauuagcccagcuuggugguacgcgccuguagucccagcuacucgggagguugaagaaggagaaucgcuugaaccugggaggcggagguugcagugagccgagauggugucacugcacuccagccuaggcgacagggcgagaaucugucucaaaaaaaaaaauuaauuaaaaaaaagaaaaagaccaaguucuacucuacagauagagacaaaaguggcaaauauuaaggaaauguuuauaagggagcuaaugagaucaauaggaccacaaaagacauuagauaaagaagauucuagaaauguuaagauuuuagaacuagaauguaugacuuccaaaaacaguucugguucuggcuauucauuauucuguaauuuguuuuccucugauuuagcugauuaugacagguauaaguagaggaagaaaacagcaacucagucauagaaagggacacuaagaauagcaauuuuuaaugccuucucaagauaccugaauugaugcagagcauuuuucaaaacuacucagucaacacauugccggaagaaggaaauuaugucuuuagagagaaaucuccaucauagacauuuuaaauaagacaguagauaaaaguucagcaugugcuuaagcugcucagcugccuagauucaaacaaaaaaugaauaucaucuaguuucccaauauuagcuagcucaagacauuaucuacagggccaaaggaaaugauuuuggacuauuauccauaacuuugaauuaugugucuuccuuucaguagagaauauuaggcugaccuuuucugaagaauaauuuaauuuaauauugaacaacagagagcuggaagcugcucuuagauugcaucucagguggcuacuaguuuauauguggucauuacuaaucuagagucccuuuucaccagcuuaguuuucuacuaaccaaagaaagacuauccauauaaccccaucaaaguaugaucauugcaucaaaguaugaucauugcccuugugugauguaaaacuauccugcuggccuucuuguacuuugccuaauaauuauuuuauguaauaacaacccauucuacacccuacucaaccaagcugccuuucuuuggauagugcauuucaacugaaggcugcuauuugcaauuagcuucaauuauguugaauacuuggcagcauuuucccauugcugugcacccugccuguguccugucaaaaacuuuugugagugccuucugugucauugcaacugcaacucccuacuauccuuaaagagaaggcuagauaaauaauugaggauuuguuuuuuugugacuuucuguuuucccugacccagucucuucugcuuucuugggggcagguugcaugaucagaugguaaaaaucaaccaaaaucugcaucggcugcagguugccuggcgggaugcucagcaaaguucuagcccugcugcugacaaucuucgugagcaguuugaacgacugaugaccaucuaucuuucuaccaagacugccaugacagagccacaaaugcuacaaaacugccuaaacuugcagguguccauggcuguucuacugguucaacuggccauaggcaaugagggcucacagccaauagagcuaaccuuuccuuugccagauggcuacagcucuuuggcuuaugugccagguaagcaggcucucccuugggaauguccuguuuauagccuucugaguuuaagugggucacuuuggaaguuuaauccucaaaauacccuuucuucguuaucauucaguuguuuuuggagaaacaacucaaacuuagauaauaucuacuggucaaaguauuaggggacuaacaguuuguucccucaaccuugugucccccugcuaugcauaucagaaaaucaucuucaaaggauuaaguguaaucagaguuuucagagcuguuaguuucuaucauuaauauuuguucaacuuacacauucaucuaacuuucccuguccuuuuuguagaaaaaaaauuagcuccugcugguuaacucagaagggaaagagugugugugugugugugcgugugugugugugugugugugugugugugugugugugugugucagugagucauugaggggugggcagguguugucaaucuaaucagguuauguguucuuaaccauuguauuggccauaucaugcugaguaacagauuaccccaaaacauagcagcuuaaaacuacagacuggguaugauggugcacgccuguaaucccagcacuuugggaggccgaaacaggaugauuacuugagcccaggaguucaagauuggccugggcaacauagagagacccuaucucuacaaaaaauaaaaaauuagccaggcaugguggugcacacuuguaguuccagcuacucaggaggcugaagugagagaaucgcuugagcccaggaaguugaggccacagugagccauaauugcacuacuguacuccagccugggugacagcaggacccugucucagaaaauaaauuaauuaauuaauaaaauaacaacaacaacugcaaacagcucacucaccugcauuguucugacucagaguuccucaggaaguuauauagccaagcugucaaucagggccuuaggaaucugaggacucugcuagggcuggaggauccacuuacaagcccagucaugugguuguugacaggccucaguugcuugugcuauuggccagcagcuucuuuucuaggccauguaugugucuucuaaauacuacucaugauauggcagcuggcuucccccagagcaagugaccaaaauggagacuguaagcuuuuauacccuaaucuuggaaaugacauacuaucacaucugcuguaugccucagaguuuaucuucuacucugaaagagugaaugugggaggggacugcauaaggucaugaauaccaaaaggcaaugaucauuggaggaccauccuggagucuggcuaccacagucaccuaacauauuaaucuuuauuagagaguccucacacaucugaaggguuuaaaccacaguuaaccuugagaguaaaaauguauauauuaguauacugguguguuaacauuuugugucauuacuguucauauauuuacuugaauaaaaauuuaaauugacuuacauuuaaaggagauuuuacauuuauugacuuaacgaccaucucuaguaccaacaaaacauuuaggguuuuuuuuaaccuucauuaaguagggugaaaggaauuuaaauguuguuuauuaguacagauauacagauguuuggcuaauuccagugaauauuuucuuuuucagaauuuuuugcagauaaccugggugauuuucucauuuuucuccgccgcuuugccgaugacauuuuggagacaucagcagauucccuggagcauguccuucacuuuaucaccauuuucacuggaagcauagaaaggugaagugcugaaagcuugguucugucacuguuuaggcuguaaaacauucagaagacuucuaaaccaagaaauaaacaagccugaaucauaagggguugccuucagaaguuaugguaacauuaaggaaucaccugaccauccauauggguagccagaaaucccacuguugagagguauaauaaacaaaggacuuuguccacagagaauuuaauccugcauauaaguaucuuaugggaaguccacugccagucccugguuaaaguaguuaaccuaaugccagaaacuuaacaguggcagccaggugcuaaugaucuucuaauaauuauaugauaauaaagcuuauucuugcuauucugaguuggaugagcaguaaacuuaagucaauguuauuucucauuucaaguuuucucacucauagcuucuaguccucuuuuccaaaggaagauacugugacuuguagaauugcuucccugauuuuuuugaugcauaggcuaaaggaaguggaaacucuguguacaaaagugaagauuugcugcacaaugaagagaaugacccacaauucccugagccguaucagugauaaguagagagaagccauuucuucacugagcugagcauaccuaaugagaagucauaagucaacaaguauuaugcauacacuguaugcgucauggguaauguagcauaauuauauucuagucuuuacccucagaaagcuugaaaaggcaaguuuauuccacaugaaacugucagagaauaggaagcaguaaauaaugcauuauuacagagaaguaaacaauggcuaagcauucaauagaaacuuaagugcucaccgucauauuugguaagcugucaacucaagaguuaaaugauguacccugcaucaccaccccaccccccgcccagccgcaccaagaaacugacaaacuuaaaacugcagaaguggauccuuuuuuuuccuguaauaugguuuaggguggauuuugauucuuauguggagagaacagagucauaaauuuggaguuaagcuuaucugcucaucuugcuuuuugcccauuuugcagaaugaagaauccccaccugagggccaaacuagcagagguguuggaagcagugaugccccaccuggaucagaccccaaaucccuugguauccaguguguuccaccggaaacguguguucugcaacuuucaguaugcaccccaacuugcagaggcucuaaucaagguuuuuguggacaucgaauuuacagguaaagcagucaugaagcugagcccagaacugggaagcugauaccaguggaguuucauaguuugauccguauuuggauaucaaagaaaugucaagccauuacuuauugaauaccuacuauaugccaggcuugaugauaagugcuuuuuuuuuuuuuuuaacauuaucccauugucaccauuggaaaaguuucacucuauuaucccuguuuuauuuauuuuuuauuuuuuaauuauucuuguuuuacauaugaagacaugacugcccaaaagaucaguuuguccaugucauaacaaacuaccaagugguagaaucaggucugugucaccuaaagaaaucuacauauucaacacccuuauuauguugcaucaucaaaucagacucaaauuagacuauuugggucuuuauauuucucugccuuaaaauuacagaauagugcauaaagaggcaguguauugguugagagauucuuuuaucuuaaccagacuaucuaacucuccaacagucuaaugguucgauuaaaaauaccagcaggcggacaggcacaguggcucaugcuuguaaucccagcguuuugggaggccaaaguaggcagaucacuugagcuccugaguuugagaccagccuggccaacauggugaaacccauucucuacaaaaauacaaaaauuacccaggcaugguggcaggugccuguaaucccagcuacuuaggaggcagaggcacgagaauugcuugaauucgggaggcagagguggcagugagcugagaucgcaccacuccagccuggaugacagagcaagaaaucccucucaaaaaaaaaaaaaaaaaaaaaaaaccagcaggcaacauucccucucuaucuaacccugagccccuguguuuguuuaaacaguacccugucucaaucaguaaauaagauauguuaagaaguuguugaagaccauuuuuuaaagggauaucuaccauccaaugauaaauacaacuaacauuuaaagaggcauuuaacauuuuacuggccgccuuuccauauuuggauucugguuuuuuuuaauucgcucaccuaucaaccuuaguuuccucaucuauaaaaugggucaaagugaugauuaagugaaauaaugcauguaaaucuuuauaauacauaagaaauuguauaauaaaucauugcaguuaucucguuaugugaccauacaaccaaaguguuguaauggaguacaauuucuguuuuauuucugaggaaguggaagcugaagaagauuaagagacuuagauuaagcagagccagaaugaaaacguaggucuuuugacuccaaauccuacacucuuccuuuauuaugacccagccuguggagcucuaguaauaccuuugguauuucaaaagcaguauaagccucagauuuuuagcuccugaccugauuuuucagaguaaucaagaaccuguuggcuacacaguuugggauauugucugugaagaaugugggaauugcuuagugucccguccugcacauggcuuucacugccauaauggccagcccugagcccucauuuaaagccugagaaguacucauguuuggauauggaaacauuuguuucccuuaacuuuuauuuuacagcuugguacuugucucuugcagaguaagguauccuuuaucucugucucccccuuacuucaucaguaaggaaaugagcaaacacuuggcgauaacucuaggccuuuagaaacuccagggcagauuuuguuaguagccuuaacacacucaaaagcaaaugacuacaaagcaaauggcuacacauaagcauaaacucuuccucuuauggcaccgccuuugcugauauuucgcucuugccuuacuccaggagacccccaucaauuugaacagaaguuuaauuaccgccgucccauguauccuauccuaagauacaugugggggacagauaccuaucgggagagcauuaaggugagagaguuuuugaugaaaccuguugcuuuauauaagcccuaaugaguuguaauucaguacuaaaaugguuuucuugugggcugggacuuacaggauuuggcugacuaugccucuaagaauuuagaagccaugaaucccccacuuuuccuccgcuuucuuaaccugcuaaugaaugaugccaucuuccuuuuggaugaagccauacagguaaaaaaaaaaaaaaaaaaaaagauuuaacuucuccauaccaucaaaucaucagcaguacauacauuuuaccuuuuaaucauaauagagcaguccuuaugccccuaguaccagacuugaacaccaaaaauuugugauuaguaguguaccaccaagcuugucauuauagagcuuucuaguucauuccauuagagaccaagaucaagggucauugaagcaucaugagauggacauuuuggcagagucaaaaauaccauauggugaagccaaacuaaguuguacuggcaggaguaauucaucaggccagcacuacagaaagaaaucagaggagcuugcuuuuggucagugacuuucaacccuuuuaaucccaacaugucaguaaaauaucucacuaagacagugauuuuuaacccacuuuccuaaaagauucugauuuuugcaccacuacuugaaagaaaaucucugauuuggguuauuuuuucauauaaaggcuccaaguugucaauacuucucauauuuccacugccuucuaaauucuuagcuauauggugaaacaaagguuucacaaaguauaaaaugcagcugggugccucucagcuccuucaguguauuauuuccuuaaccuucccugguggaacugcuuacuucucccauaaaaacuuggcugucuguagagcaaaacuucccuuaccugugauggguauaggauggacaaggcacugaccuaaagggagaugaagcagguaaauccugaggguagccuuuagacagucaugagcuccuccuuaugaucagcaauccccugaguagcuuguguuuaauuugugagaaagguuugaucugauuucuucauaauccuacgcuuuaggauuuaagauagguuuucuucaaaagcgagaauagguccuguuacaaacaggcccuuuuaagcaagaggugugugacacaaagcaugaagcagaugguauuuucaugagacuguaaguuuaacaaguuguuugcuacaacaggaaggaugacgugagguagagaguuuuaaauaauuaugguucuuccacgcaucuugcauaugugauagagcuuugauuuuuuuguaagcaauuuggcaggggggauuuguuuucaucuuucaggaaggauucauuguuuuuucacuauagugugggguuuuuuaguuuuuuguuucuuggccuggguuucauauauuaaacuauucauccuucuuugcauuucacaaugcuauacuauuucuaggggaauuaccugugaaucuacccaagcugaaacaaaucuguaugaagccacaauuucuuuuuuuccugaaaguucuuuugagcuucagccuuaugcugagaaauaaaggcucaugucuuuuacauggucccucguuuucccagcuuaguugacuggauuuugaauaggaccucuuaaaugucacgucccuucaacugcaccuuucuucucugauauaucccaucucugguuucugcaguauuugagcaagauaaagauucagcaaauugagaaggaucgaggugaaugggauagucugacuccagaagcccgccgagaaaaggaggcuggccuacagauguuuggacagcuggcacguuuccauaacaucauguccaaugaaacaaucgguacccuugccuuucucacaucagguaaggacaugaaguacugcuuccccccaaaaaaguaauggccaagaucagcuucacuugggggaucagcccagcugaaacuaagaauucagacccuggugacaguauccuccacaucuggaagggaaacgaaucacuugagaagcuucaaaaagaaugaugaugcccauuguugacauggaagugaggaaauggucacccucacacagcugccagagagcauaaggugguaaaaucuuucuugaggacaaguuagccauauaaauauaugugugucuguacacacacauauauacauauauguuuguuaaucugagaaauacgcuugaauccugguuaaauaugguggaucuaacagaaauuuaucucuacuccuucuauagcuccacuguccaauucaguagccacuugcaacguguggcuuucaaggauuuaaaauguagcuggucugaauugagaugugcuauaaguacaagacuuaguguuaaaaugugaaaucuguccauuuuuauacugauuacauacugaaauuaucauuuuuaaugucucagcuaaaugugauaugacaaucaguaaucaccagacauuugaggaaauccucuaaugugaaaaacaaauaggugaaaacuuuguaaaaacuuuuuaaaaaaacuuuuuaaucucagagggauaagagaagauacagcagccacaaaacaagaacaaagaggcaaugaaagagauuauuugaagaauaagaaagagcccuuggauauugaaauuuuuaccucggaaauguuaaauauucaguaaaggaguuagaagauauaaauucaaggaacucuucuaugaacguagaacagaaggaaaaagauggaaauuagaagagaaaggauaagaaaacaaaaggauggaucuaggaagucucaaaagcgaaaaauggaggggaggaaguuaucaaagauaccaaaaaauccccaagacucaaagacagccucuaaauugaaagggcuugccaaggccccugcacagagaauuuuuuaaaacccacagugagguaugacauugugaaauuuuaggaaaucaugguaaaaacaagacccuaaaauagcccagagaagucagguaauguuaccauaguuuaaguaucaaaauggcuuugcacuuccaacagugucauuugaagcugagacacauuucugagggaaaguaaaccuaggaggaggaagguggaauucaacacaagggagacgcaaaggagauucccaggaugacggugaaaggagcuuguguggccacuacauagcaggccuguagagcaagcaguccagguuggagcaaaggauggaaacauccagaaagaauguuuccaaaaauuaaucagcagcuggaaaugaccauguugagaguuuuaaauuccaauggagaguuuggaaaggauuuagugauaagaggcucugaaaauaagcaaauaagcaaaaaguuauacuaaaaaggaacuauauacucauuaggacagcacauggcucugcugugaauaauauuuacauaaucuuaauaacaaacuaaauuauuuaagcaaaaauuugacuauauauugagggcaucugugauaaugacuaaaacugaaaaaucaagaacuaucaguaccaaccaaacauagcauuaugauacugucugacuuguuaaauuuggcauguauaaauuuuuuuuaauuuuuggaauucaugcccuauaacauagcaguuccuuacagauuuguuaagaagaagcgauaggccaggcacgguggcucacgccuguaaucccagcacuuugggaggucgaggcaagcagaucacaaggucaggaguucgagaccagccuggccaacauagugaaaccccgucuauacuaaaauuacagaaauuagccaggugugguggcaugugccuguagucccagcugcuugagagacugagguaggagaaucacuugaacuuaggaggcggagguugcagugagcagagaucacgccacugcgcuccagccuaggcaacagaaugagacucuaucucaaaaaaaaaaaaaagaagcgaugagucuacaagauguauccacaaugaaguucauugauaaguguaggaaaaaacugaaaauaguaaaaauguccaccaguaaagacauuaaauaaauaacuuauggugcaguuacaacuggaaaagucagccauuaaaaaugauguaaaacagacuggguacaguggcucacaccuguaaucucagcacuuugggaggccaaggcaggaggaucacuugagcccaggaaguugagacugccuugaaccaugaucgugccacugcacugcagccuaggcaccagcaagacccugucucaaaaaaauaaaaaauaauuuuuuuaaaaaaugauguaaaacagcugggcacaguggcucacgccuguaauccucuaacccuuuggaagccgaggcaggaggaucacuuugagcccaggaguuugagaccagccugggcaauauagugagaccccaucucauuuuuuaaaaagauuaugugaaucaccccuauucuauagaacuuucugugauggugaaaauguccuauaaaucugggcuguccagaaccauacuuaacuagccacauguggcuagugugacugaggaauggauuuuuuauuuuuuauuuuaauagccacauauggccaguggcuacuauguuggauagcacagggacauacacuuacuaaaaugauaaaguauuugcaauauaguuacugaaaacaguaaguuucagaauauguaaaauaugaucauuuuuguuuaaaaaaugucuguguguguguaaauaaggacagaaaagcuagaaggacaaaauguuaaauuagcaagauguuaacaguguuuaucucuggaugguaguuuuugucuuuucuguuuuuuguuugguuuugguuuuuugcuugucuauauuuucugcagugaaaaugaauuacuuaguuuuuuaaaaaaguaguuccuucaaaauguuuagaaauaaaauaacaguaguucccagaggucuccaaauaaacuauaccuaauaaggaaaagagugcuaauggauugaguuuucagagacuuuggauucuuuuccagagaucaagucacucuuugugcaucccuuccuggcugagcgcaucaucuccauguugaacuacuuccugcaacaccugguuggccccaagaugggugccuuaaaagucaaggacuucagcgaauuugacuucaaaccccagcagcuuguaucagauaucugcacuaucuacuuaaaucuuggguaccugagauugaaaucugucaagccagaggggaugcuguuuugauuuaggguuuugauaguagaaugacugguugguaauuaugugaaaauagaaaagaaaugguuaauuccuaguugcuugaugaaggaaucuucuguaguuuuaaauaaggagauuuuaucugggcaaggugucgugugccugugguccaagcuacuugggaggcugaagugggaggauugcuuaaggccaggaguuugagaccagccugggcaacacagcaggacucugucucuaaaaacuaguaagauuuugugugacccaugggacauugagauuuccaguauucugcuuugaucugugcaaagagaaacuuuacugguuguaccacuguuuagaaaaguagcauucuuuuaaggucacaugauacuugauagacuuccuagaaagucuuucuguaucaaaaaguauauauauuaaauauauaauauauuuaauauauauuauuuauaauuuauuauuauauuuuauauaauauaauuuuauauaauuauaauaaaauauauauuauauuuuauuauuauaaauaauaaauaauaaaauaauauuuauauauuauaaauaauauauauugaaauaagucuuucuauaucaaaagaauguucauggcuuuuaaguggugagaaugcuuguucugcagccuaccuauugucucuuccauugaccaacccucuggugaucaguuuuuuucugaugcuaauguuccagggaugaggagaauuucugugccacugugcccaaggauggacguuccuauuccccaacucucuuugcacagacaguucgagucuugaagaaaauaaauaagccugggaauaugauuauggcuuucagcaacuuggcagagagaaucaaggugaggaagaggaggaauuguuugcugauuucauuaagaaccacguugucagccaggcaugauggcucaagccuguagucccagcuacuuaagagccuaaggcuagaggaucacuuaagcccaggaguuugaagcugcagugugcuaugaucaugccuguggauagccacuacacuccagccuuggcaagauagcaagaccccaucuccuaaaaauccaugcaaaaaaaaucagauugucaccucagcugugcugauuuuuacucuauuucagggagaaaaagagcauuaccaagagaaaauauaaacagaugguucuuuuuggacagucacuuagaacuacaauauucuuaguuuuauucuugucaacaugagagugagaauagaaauuuaagaaaucggcuggguacaguaguggcucaugcuuguaaucccagcauuuugggaagccagggugggcagaucacuugaggucaggaguucaacaccagccuggccagcauggugaaacccugucucuacuaaaaauacaaaaauuagcugggugugguggcaggcgccuguaaucccagcuacucgggaggcugaggcaggagaaucgcuugaaccugggaggcggagguugcagugaucgcaaccacugcacuccagccugggcaacagagcgagauuccaucucaaaaaaaaaaaaagaaaaaagaaauuuaagggccaggcgcgguggcucacgccuguaauccuagcacuuugggaggucgaggcgggcagaucacaaggucaggagauagcgaccauccuggcuaacacggugaaaccccaucucuacuaaaaauacaaaaaauuagccgggcgugguggcaggcaccuguagucccagcuacucaggagacugaggcaggagaauggcgugaacccaggaagcagagcuugcagugagccaagauagugccacugcacucccgccugggcaaaagagcgagacuccaucucaaaaaagaaaaaaaaaaaaauuuaagaaaccucaacuagaagagaagaaugugcacauuuauguaagauguuuuuaugaaaacguuuaugcacaguguuaccaauagauuuuaaaagcuaggguguuaaugcagaauaacuuuuuagaaaaaaaaaaagaugaguaguuuucagucauuaauuuuuauuuggauugucucuauguuuguaguugguaguuggcuuuuauuggaauaugcauacauuuuaaagauuaaaauacuauauuguauuuagcuaaaucccuuugguuagaguaugacagagcucuauuagcagguaagaagaaggaagaucauggcacaaaagucuaauagaaaaccuuccuuauugcugucagucuucccucuauugaguuucuuuuuuauugaguuggacuucaucuuuguuuagagcuuagccagguggaucccugaggaacucaaguugugaaggaauuaaaugucaaaaugacuuuaaaauuccuauaccuguuuguaucaaaaaucaaaaacugcuuuucauacgcaggcugcaugagugacucuaauuaugcaaauaauacccuccuccauucucccuucuccauccacuuuugaauuauggcauuuacaacagaacuguugccagauggauguuauaucugauguauuucuuuuccuccuaacauuuaaacccauuuccaguaugacugccagcagcugagccaaccuaaagguccagaguuggggcucaaugcuuaauuuguucuuagaauaucuuggcuuguuuuugagaaaaugaagcucacgugugucacugucacugucaaggguuauuaaugaccuguuuuuuuauuuuugagauggagucuugcucugucauugagcacgcugaauucagcuacacugugaauucacuuuaacuaccagauguuguauacucagucucuugcagaccuccaacaacaggaagaggaaaccuaugcagaugccugugaugaguuccuggaucccauuaugagcacacugaugugugacccuguggugcugccaucuuccagagucacuguggauagauccaccauugcaagacauuugcucagguaggccagucccaaaaacagacucaagagcauauauauauauuaguuugcuaucuuuuucucccaggcaccuaagacaguacuuugcacccaacacauaccacauauuauugauuuacugauauguuggaagacauuuugguuucaauugcuaggauauaaacauuucaaaacaaaacauucuguugagaaaugcuaacucuaaccucaccucuuccugccuuaagaaaauaauuucuggccgggugcaguggcucaugccuguaaucccagcacuuugggaggccgaggcagguggaucacuugaggucaggaguuugagaccagccuggccaacaugguaaaaccccgucucuacuaaaauacaaaaaauuagaggggcaugguggugcgcacauguagucugagcuacucaggaggcugaggcagaagaauugcuugaacccaggaggcagagguugcaaugagccgagaucgcaccacugcacuccagccugggcucaggugauccuccuaccucagccucuggaguaacugggacuacaggcaugcacuaacacgcccaacuaauuuuuguauuuuuuguagagacaggguuucaccauguugcccaggcuggucuugaacuccuggguucaagcgauccaaccgccucagccucccaaaguacugggauuacgggugugagccacugugccuggccuguuuuuuuauuuuugcgacagagucucgcucugucaccaaggcuagagugcaguggcgcgaucucagcucacugcaagcuccgccucccaggaucaagugauucuucagccucagccucccgaauagcugagacuacaggugagcaccaccacaucuggcuaauuuuuguauuuguaauagagaugagguuucaccauauuggccaggcuggucuuaaacuccugauuucaagugauccucccaccucagccucccaaagugcugggauuauaggcaugagccaccucacccagccugcuuuuucuaauucagguuuuacacuauauucaccauguggauuaacucacguucuguugcuguuguuguaucagcugugguaaccaugaacuuuccccagccugccuauucuucggacagucugccccauuauaacuauagaaaagacaggaaugaagcaauaaaugguagcuuauuagcugcuuaaugggccccuuaacuuuuuuuaguccggcauuagaaagaaaugaguacugagagacucugccuauuuauauauuuauuuaucuauuuuuuugagacagggucuugcucugucaccaggcuggagugcaguggcaugaucucagcuuacuguggccucacccucccaggcucaagcaacccucccaucucagccucaccaaguaacugggaccacaggccaugcaccacuguuccuggcuuauuuauuuuuguauuuuuuguagagaaggggucucuccauguuacccaggccagucucaaacuccugggcucaagcaguccacucacaucagccucccaaagugcugggauuacaggcauagccaccuuguuuggccucuccauauuuaaaauuaaguuauaucgagccaggcacaguggcucacgucuguaaucccagcacuuugggaggcugaagcagguggaucacuugagaucaggaguucgagaccagccuggccaacauggugaaaccccgucucuacuaaaaauacaaaaauuagccgggaguggugacacaugccuguuguaaucccagcuauuugggaggcugaggcaggagaaucacuggaaccugggaggcagagguugcagugagccaagaucacaccaccgcacuccagucugggugacagagcgagacucgucucaaaaaaaaaaaaaaaauuaaguuauaucucuacaaaaaauuauuuuuaauuagccaaguauaauggcacaugccuguaguccuagcuacucaggaggcugaggcagaucgcuugagcacaggaauucaaggcugcacugaguuaugauggcagcacugcacuccugccugggcagcagagcaagacaccgucucuaaauaaacagauagauacaugugguauacuuugacccaaaguuaaggaaauuuuuaaauauuaaaaagaugaauuuuuggccaggugcaguggcuuacgccuguaaucccagcacuuugggaggccaaggcagguggaucacccugaggucaggaguuuaagaccagccuggucaacauggugaaaccccaucucuacuaaaaauacaaaaauuagcugggcaugauagcacgugccuguagucccagcuacucgggaggcugaggcaggagaaucccuugauccugggaggcaaagguugcagucagccaagaucacgccacugcaacuccagccagggcaacagaacaagacuccaucucagaaaaaaaaaaaaaaaagaauuuucuaccucuugguauuugguauuaagcauucacuauaucgcucgaaauguggcccaacaaaaauucauaacguuucuuaaaacauuacaagaacuuauguauaggccaagacaguucuuccaauguggccugggaagccaaaagauugacaucugucauaaaccuucuuauguuucaagaaaccauaaucugcauguacuugcauaacaaucagcugacuaaaucaaauguuggucuacaaggcuuuauuccuuaacaucucauacuguucuaagaaucugucacuauaauuacaaauaguucuuuacacugacaugaauguauagugucucugccuuagagaaaucuaaaggugacagaagcauagcauuuuuuaagccacuguaauuaaauaucaucugaacagcaguguugagacaaaguuuauuaagaaauagaggccagguggguggcucacgccuguaaucccagcgcacuuugggaggccaaggcugguggaucacuugaggccaggaguuugagagcagccuggccaacauggugaaacucuguuucuacugaaaauacaaaaauuagcugagugucauggugcaggccuguaaucccagcuacuugggaggcugaggucagagaauagcuuucacccaggaggcagagguugcagugagcagagauaacgccacugcacuccauccugggugccacugcaccagccugggcgacagggcaagacugucuccaaaaaaaaaaaaaaaagaaagaaagaaauagacaaaguagcuacaaaaacuccugaaucaucuuguucucacucuuucuaaccccaacucggcauuugacucaaaguuauaaugcacucuggcuucauucuuaagaugcgacgcccagguguucuguuuuuggcuuagaauguuagaacuuauggaaauaacccuauuucccuuucucucuuugucccagugaccaaacagaucccuuuaaccguaguccccucaccauggaccagauccggccaaacacagaacuaaaagaaaaaauccaacgguggcuugcagagaggaaacaacaaaaggagcaacuugaauagauacugugaacuaaccaaaccaaaaccaaccccagagugcagauaaacaauuguuugugguuucucucuuucugguucuguuccuuuucuuucuucuuuucuuuuucuuuuuuuuuuuuuuuuuuacuaaauuagagaacugcucuugcugaaauuaugauaguuaagauuccuaagaacuugacaaugcuccccuggcuugcaggaaauuauacuuauuauagcaucaccaaguuuagaaaucaucacuaauuuucacccucuguugucucuucauauucuucuuccuuuuccuaaaugaaauuauauuauuucaacuacuaaaacuucccgccacccugcuauuucucuuccaauuacuguucaaacauuuuuggugagugcugcuuuuauaaauaugugaugucacauauuucagugacagcugauguuaucagaaaaauccuguuauccuguguauuuacuaguccucaugaucuagacuuaaccccuuuucuguguuacagaguaacuucacauaaaagcagauaccuuuaaguuuguguagacuucugaauaagaugauagacgagaauuuuuuuuaaaaaaggaauuuaaaggaaucuugugcaacuucuguugauagcucuuaauuuuguuauacagucuuuuuaaugaggauugguagggcaauccuaccaauugaugggggugaggagacuguugggcccuuauucucuuaugaaaaucuguuucuacaaggacuaggccuaaguagauuuaggcaacggguaucauauccaugaaaaaugucauuuuaagacacuaauaucaacaguauaucucagugugugagauauauaaauacacauacaccccaugugcuuuuuuguugguuuaguguaaacugaguaccacuuuauauuuucucuuccauagugagauguaugcaguauguggccauguuuacuaacauacucauucuucacaaaauucugagauuauaaaauguauauaguuaauauuuguuugagcuugugaccugacuucuaagagcuacuucuaacacagccuuaggucuucaauuaacaaaguaggaaguugagcacaaccuuguccacagccauuuuaaauauccacuuagcccuguguaguugguagguggacaccacuuucauaagugaacuugagcucacuacucaauugugcagcuuaauaugcugacuagggacauuccccuauggauuaucuuuauaucacugucuuucuaagcccagagaugucauaagugacaagaaaagugauaggaucaagaaaugggugucacugcuucauuuggaacauguuauuaacuauggucucuuucaaauaaauaguaguuuuauauuucaacacaaguugcuauaagcaguccuugauggguuuuugauugcaucagcuggaaagccucaaaucuaagagggcuucccauccuagauauaaaauagguguugccuauugcugugcuuauaaaaugaaaaaggaaauugaggacacuuuugcaaaugccagaauguaagauucauucagugugcucccugggccuuuauggcauggguugacaggauuuguuuauuuucuaaaauuagcuucauucaauauuuaucauccuccuuucccucucugagaaugaacuauguauaaaauaagcuucugccuauuugcauuuaucuuccaaacccaaucuaguaggauguucucauuuuaaaaacgaggggaaaagaccagaguuuuucaggagaaaacuggaggaaaaugggcacaaaaacucagaaggcagcuauucccagcagcuuccuaguuaacaacccccaugcugccuccagucuuugucuguauucuucuguauuuaaccuucagauuguaagccuuuucuggcaagcuuuucuucuuuuuuuaaacucuuuuccugaaacuuuuuaugaauggcuauggcaccauuaaugcugcugaauaucuuuaaacucugcacaagcaaguguguagcuuaaggccacuacugguaaggaaaccaaguguccucugugccuuuuuucuuucugugaaguaauuuaagaauauccaaaaaaauuagacuuuaaaaaguuaucuugguacaacaccguguguauauacacuuggaagcuuaaaaagguguuuugucuggaacuuagaagcagcucuaaaucuaguagagcagacuuucuaacauaccuaguuuuguguauuggcuuugcuggaguaugauagcaaaaugaagacucuuuuacucagcucugguauugcucauaacuuaccaagaggcuaauacuaaacuuggaaaauuguuuaaguauguuuuaucaagcagucuggguuuuguuuuuuaauauacuuuuuaauggauaugugaaaacugaaggaaauguuaaagguuuuuuaauggugcaagugaaggugccaguugcuauuugauaucacacucuacaaaagcuucauuacuuuauuugauggugguugcuaagcagccauugcacagagcauaagucuacugggugccuuuacaugccagaggcugaugcugcacuguugaugucaugugaggaaauaaugcacaugcucuaacugcucaacaggaaaugaaccuagaaacagaaaaugaaaagguugauugaaauaaaacuugaucaacgcgacuguauuuugaaacauuccaggaagguuacuucuugucaaacuugccuggcaguguuuguucaaaacuuguauuuaauaaaugaacaucugacuuacaac

SEQ ID NO: 15964 - RNA, 3106 nt, Homo sapiens
uggagcguagccagccggagcacucacccuggaagaacaggacgcccagcagagggaagagagcgcagccacggcuuccagcugcuccucucugcugcaucccggcagcucuucagaugcuugcacaccuuguuuacagcucccgguaacgacacagguaacaccggaagugacgucagagcaggaggccgagagacaacuuaaauggcgauccgaaguuaccauaggaaccuggcuucuuuccagaaccacaccugguuucacugaccagagauuuauuaacuuucaggcgggagcuaaaugcucucuuuugcuugaaaaugaaguaggcuacggacuuggaauaauuacaauuuuguuuuuauggaauucugcagaacuaaauaauuuugaugcucugacugcaugucagacaucguuuuuacgucucgagauuuaguugaagguucucagaauacacuacuguaaauuuagaguucagaaacaccugggagaucauacaguauagauaaauauauauuaggugcuuguagugauaugugccacaagccucauugguugguguccuuuuuaguguaaguauugcagccuccaaaauuggguguuuauuaaauuacuuuuggcgguggcaaugaugaucaaaucauuacagccuguauuagaggaaaagaggaacugggauuucugugucuuugguuggaaaaguaagaaaguuauguuaucacaguacuugaagugagauggcgucacauacuucugaaaaagagaugguacaauaaguacacugcuuuaauaaucaguaagccucuucccuggaaauugccacaugucaaugaaagcaggaggagaauaaaaguaugcuuucgcuuuggggaagaauuaauaaguuuccauuuuucaauuuccauuccuuuacuagacuugaaagccaguaguuuucccuauuaaaaguguaaugcaaaguacuaaauagaaucuuugauacuuuucuuugaaagagcccucaaacuaaguaguguuguuaugcccaauucccagcuauccaaaacagugugaaaauucuguggaaauccguauacuucuguuuacccauuagaaacuaacuguauccauuauugacuugcagguugucucuacuaagaaaacuuuuugguaaagauuaaauauauauccaucuguuuuuccugcaauguagaacuucuagauauguauauacacaaauuauauaacugauaauucuuuauuacuaaagguuuauuuacauaguguuuaaagcauaauaaaaaauaaauuacaauacaaaagugcucuuuaggaaggagacacuaaacaacaggcccauauuaccccuugacuauuuagccaagacauaagcuacaaauuuugccggaaaaacuguccauacauuuuuaacuacuucuucauuauucuuauggaccaucauccaggacaucuguuugaagaaauauccaguuauaauauuuucaaagguuagaauugugaagaaaaaauauaaaaugugauuaaaggauauauagccuucagauguaauuuacaguuuuaaaauugcacuuuaaaacuuugcuuuuuuagacaguauaaaaggcagaaugagacagauauguaaugaauuucagaacugagguucauauguaaaucauacaauuuuuuaaaaaauaguauuggaaaaauaucaaggucuauacauuuaaauacagauaaucuguuugaaaauuccaguuuguuaaaagaaaaaacaucugcaguccagucgauuaaaaacugaaaauaucaaucuguaaagauugaucuugagccuaaacuuuuagaugcuuucuauccuuugaacaaaugcuucuguaucuuaagcuuguaacuuuucuuucaauagcccacuuauaaaguuugcuuuaucuaccaguaugggggaaaaaaagaauaaaguugguuuuauuccauuuaaaguaguuuugguauuucuuugcuccauaccaaagucuuccucccccaaaauaaacaagugaauuagaauuaaaaaagaaaaaaaguuaauaauuucuucuaguucucagaguuuuauauaaaacuguacaaaauuaucaucauuuagaguugauuuuuuucaccagcccugaauuuucaaacuuguaauaugcuguuucacaauuuuuuuauuaaauuacuuaaugauuccagucugcaaaugagcauagacuuugcucuguuguuauagaucauugaauugggggggaaacauaguaagcuaaacuauccgucacugcucaugaaagacccacauuguugauuauuuuucccagcacagaagaaaagugacaagugauucauccugcaauggccucugccaaucuuuucauaucuauguaaccuuuuguaguuacugugugauuuagcguugugcuauuguaaaucuuggauuaauuaacaaaacaacaaaaaucuaucaccuggaauauugaaagaaauucaguaaaacaagaugugucucauaguuaaggagagacauaaaaauaaaaaugucauuuaacaguuugaauuuaggauuuacuguuaaucagaaacaccgaggaggcuuagcucaccuuuuaauugagaaugugggaaggaaagagaguaaacacauuaacuuuaguagcagaagugcugcuaaaagaaauacgugaaaggaaauguaacagacaaauuggcuuuuaucccuuuugauaccaauauauguguauacaagucauaacacuguaaguagugucuuaagggcaaaaauguagcuucuuguuuauaaaaccuaaugagcacuugaaaaaauuuacacucugaaauuaaauaagaccuuaauaaugaggcuguguaugacuggugauauggaggagcacugugcuggcuccagagggguguugcuugucuagaaucuaauaugcugcagaacugguuggaaaacgggucacaacuggaaaagccaaagaaaaguuuccauuaacuucaagaaauacuaggguucuuguucuuggaaaucaucucagcuuccuaaaacacaaaacaaaaguuuaaauggauaauauauuugagaagaguacaauaggaauacuuggca

SEQ ID NO: 15965 - RNA, 13775 nt, Homo sapiens
ggaaauaaagcuuccuuaauguuguauaugucuuugaaguacauccgugcauuuuuuuuuagcauccaaccauuccucccuuguaguucucgcccccucaaaucacccucucccguagcccacccgacuaacaucucagucucugaaaaugcacagagaugccuggcuaccucgcccugccuucagccucacggggcucagucucuuuuucucuuuggguaaguuagacacaucugcaugcucccgaggguucagaaguguagccgcaaugugaagaggaugggggcaggggauaggaaagaagacauugcuagcgcuuucccucuguguccuugggaggggaggugcuggggacuggaagggacguugcuggggagugcagaacccugggacuacuuagucacagaaauguugggucaggggaucugaguguugcugggggcugacaauugucaagggaggugaaucuucucuggauuuccccuaaguggaccuacguggcgguggggcagagaguggauugaccugcagucucuucagggauuauuuuuuggaguugcugcaaaugcgggguccugggacuuaaugcucccuuaaggggcuucuuuucagaagcuugauccugguggauuuaggguauuaggagagugugcaggggagcugguggcagaaaguugagucugggucuggcuucuuggcacucggucucacugaucuguuggaacgugugugggaguaggugggaagcgggcuuggggaaugaugucuggguugggaggagaccugcugaggcacgcacugauggagaaggcaccuuuggcuugggccggauggaauggaggaagggccagguguagagauucaggaaaaaaauggaacccacaggcugagcgagguugcagcccuuuaaauccagccucagaacugcccagcccagucuugcagacuguccugucaaguguuuguauuugaccacucagagacuuccugguggggaagugggcuagaaaguuauuugcaagccugcuuuguagaguuucauucuugcuccuaaacuuacuuauugcuggagcagcaacugagagucaaguccaaggacuguugauggaacuauuccccaccacaaaggcucucucucuuucuguggugugaugugcuggguuuggaguaggagugcuaaacacagacagugcagaggcccugccagccugcuuugcugaguuacuuggcauauuaacaucagagcaggaaugcuauggaaucucuggcaggaccuggguuucaagccaccuuugucauuuacguaaugaucacaggcaaguuacucaaccccucugagcuucaguucccucccggguaaacuaaagaaugccuacugccugacguguuugugauuuggugcauggcaggaacucaacgauggcuaacauaagaaugcuuuucgugagcccaggcacuguguaucuuguuuagcccucacagcaaucggagguagauucuauuauacucagguuacagggaggaaacagaugacuaugguaacgggagcugaaauuugaacucccugugucugacuucagcacauucucuuaaacguuggauuccacuccccaauguucaagaaauggcacugcuauauuaacaguaccuaauugaucagagucucaggacaggcugaaagaaggggaguugggugaguggccuguuguaaggaggcccagcuggaggacaggacccuuuccucaggaguuaggaagcacuucgugcaggagagaagccgccuggugagagccauggcuaaguaaagauagaaagggggcucagugaccaggacccagagcucugggcuagggugaggaagagggagucugcgaugaagaggucugaguguuugggguggggagaugguagugggaggaagcuaaagcuucugcaaagcugagugggagaggaugcaggaauggggaccuugaacuugaacuugauuggugcuguaaugaggcaugucccuggcacuccaaugcugagggccgaguugacaguggaacuuuggugguguugcaguagcaucgauccccaggauggaggaugccacaagugacgagggaggggacucugucggggcugggcuuguggggaugacuauggagguggcaaagagaaagggcaggugggcaaccagcucuacccacggcagaagcauaugaggcuaguuuuagccagaaacaauucaaaugacugggcuucccucaaguuuuucuugagaccguugacuccacagucacuggccugcuuaccaauguauggauuauguuaguggaggcauagaaaguggagucugggcugagcaugguggcucacgccuguaucccagugcuuugggaggccgaggugggaggaucgcuugaggccaggaauuggagaccagccuggacaacauagcaagacccugucucuacaaaaaaaaaaaaaaaaaaaaaaaaaaaaagaaaagaaaaauaagccaggcaugguggcauguaccuguaguccuaacuguuccaggaggcugaagaaggaguaucaagaguuccaggcugcagugagccgugaucaugccucugcacuccagcgugggcagcagaaccaaacccugucucuuaaaaaaagaaagaaagaaagaaagaaagaaagugaagucuaguccucacucuagcccacugcacauaucugcugcuuguggugguggggacccagacauggagagaaagcugucucuucuuccuuuaguagacuuuauugaguccccacucugccacacacuguccugggugccagggauaccaagaugaauaggagucaguuccccggagccucuagagggaaacaggcccaugaacaaauaauaacaagacaacauuguauguauggcaacaauaauagcaauaaugcucaucauagucgcagcugacuuuuguccaggccaugugcuaggcacugugcugagcuucauacagguaguaagucauuuaauccuucgacagcccuaugaaguugggcuuauuguccccuauauuacagaugaggaaacugaggcacugggagguuaacuauccugccauucugcccucaagucauguggaagagauaggaacagggcuggggugaggacaaggacaauggggaaacagucaccgaggcuaaugcccuguaagcugggaccugaagaauaaguaggaggggcccaggggcaggagggcaaaugagcuucucaaccugaagcaaaaauacgugcaaaggcauggagaagggaaggaaggugguguuuucagaaaaaaucagaacuggggucacuggagugaaggagaccuggggggaugggggcuggcaggggaugaggcuaggguauagguuggucccagaugccaaagggcuuggaagcugugcccaggagccuggacuugauccugaaagcaguggguagccguuggaggucuggaggugaggagugaugaggguggguugcuccuggcugcacggggauggacuggaguggccgggguuggggaggcccuugagcaggaagggucuggaugguaaggcagugcaggugcggagauacgggcuggaugccacacucaccugggaggcaggggcugccccgggagacaguucaucuguuuagacacuuaaaaaaaaaaaaaaaaaccaagaagaaaauaauuaccucauagguugcuguaggguggaaagaggagugaagagauuaacuuccagucucugcaagagacagcauuuggcagaugagcaaauuuuuauagucucugcaagaugggcuaguuagaacaguggaugacacgaggccugagggcccagaugugccuuggagacagcggguggcccgccacugcugagguuuuggaucuaagaucagaagccucaucccguugaugaucuuuucccuucugugaguugaaaaucaggagacacaggccccagaccuggucucaaaugggacaaccaggaagauugugggccccccuuguauggagguuccuuuaaaugguacaauucccugcuggcgggccugccuggaguuggaccugccauauagucggcaagagaucggaugccuuggaauggggcucacuucaccacucagcuucaaugccucaacccagucuggagccaggcaggcuggcuucagauucuagcuucgccucuuacuagccgugaacuugggcucgucucuuaacuucuuugugcuccaucuuccucauccggaaugugggagcgauaacagguuuuguuaguauuaaaugaggugauguauguagaguauguagacagugccuggcucguuguaagcauuuuguaaggguuuguggcugugaugaaguccuuucuguggccuuggccaugcauucgggugcuuucccgaagcaggagaguuaaucaagagaccagaguuuugcucacagcucugaccuuguugagccaugguccccucgucuuuaaugagggcccggacuggcgggaggucugaggccagcacccuagagcugcugggauucuggugaggccacaggcuuacguggagauauuggauuaggggcuaggaaccaugauucuggccucagcuugucccuauucucuguguguggcucucauggccuuuccucaccgguaaaacaauggggcuagaucuacgguuucugaucucagcuccagcuguggcuccggaucccaugcucgcuccgcaggauggaacuugacguuugacucugugaccacuagagggcacgcguguuccgcccgguaccuucugcagggccccgcugcaggguggggagggggagcccgcauugcaccucuccggcugcccccguccugccggccagaaaaggcgcccccgcacuccucucuacccugcccucccccacggcagggugcuagcuccuucgagauggugagguucaaguucuaaucuggagcacugccuugggcuugguggggggcagaggcccgcacagaguccgccgggcuucgcagaacgcagacuuuuuggucuggggagccccugggaagaugaucgaccuuccaagggaagagcuagagggauaggacauuccugggaugggagguaagcucaggacaagcacugucagugccuucccucagagcucugggccucugcagaugaagaugcuguuggcauuuucugcacaccuccuccuuggcuggugcgcugccagaugcuuucagaacggcgaugaaaguacaggagauggaauugggcuuuguucuuccugacaggggcccacucagccuccccaguccuuauuccccuaaugagcacuuaagcucacaccuggaauccucggcccuggacuccuccucuagaaaacgcagauggugacagcugucucccagcuuggagaacagaugagguccccaugccuaccccuccauccagggcugcugccaguucagagaaucucugguucuuaaguccugccauuugcccuggucacucgggccaggggcggggcuggcagaagggugcuccaggcagauguugauuucccugcaggcugcagggcggcugcuucuacggcuuugugaagaaaaaaaaaaaguuugaaaaauaggagcccugcaggccugggcuguucgccaauuccuacggacugguuggaguggggcagucuccaaggugcccucaggccaggccagaggcuccccuagaagcccuuccuguuugcaaggcagaacuuggggagaauugaggauaauagcagcuaccauuugcugaauacuuacugcuucuuuucauuaucgaaacaacccugggagaucggugucaccaacugcguuuuacaaaggaguagcccccacucuuccagcuucugaugcuggagcugggauugaacccaagucuagucucauccccuugucuaugcgauucccacaucagccucuaucgggcucaucuggacagccucccagcagcccccauacuccccaacccugcagggaccuccuaucacacuccaaagaggaaacuccuaauuccauauccuagcccacaaagccuuugugagcuggucccugccuaacucuuggaccucaggucucaccaugcacccccucggucauucugcucccucugccucaggcacacgaaacuccuuccagccacugggacuuggccccugggaguacacuugccugggaacucgacucgcucaaaacuucaacgggcucacucucucacuucaggugggcgcugccugugugucccccucagagcagucuucccugcccacccgacaucagacaaugccccucuaccuugccgagugucucuaccuacaacuccaugauuuuuuuccuuguugaugucuauccuucuccccagaauauaagcuucaugaugcagugacucugccuguccuguucacagcaguaacccccagggccuagacuaagugccuggcacacaguaggugauuuauaaauauuugguaaaugagugaaugaaugaugcugaacacugcuguuuauccuccauaaagaaaaggaaucuucugagauaagguucuugaggauacgggcagagcaucuuggaaugaaggccagggcucaggugaguccagugaggugccuagggcgugacauuuaaggagguauuuccaugaccaggcaguggaugccccuuaagugucuugccccaggccccucgcucgccucccuguaggcucuguccugcuuagaaugucggagugggacaggccuuucucagccccagcaccaaagucuccuggccucagucugguguuccuaauaggacucugcagaaccagcagcucccacccugccugccuguagcagcuccuugcuguggugucuccagguugacaucuucaagagggacuccugucccugcagacccaucagcugguccuuggaauggugccucaccuucuggggcaccucuucccucccacagcuugucugcccucuuucuugucuguugcaagccugaggaagguagggggcugggcugggcugggacacagcuuugcucugucccugggguauggagagcgaggccuuccaaaucuccagcuguucucagucugcuguccugagaacagaacggcaggggagcccugcaguuucagcuggaaggguuuuggcccagcaaagaugguuagaaguggugagaauaagggggaaacugaggcaagcauagugaagccccuugucuguggucuucugcuggcaugugacagaacuggggcaaguguggugggggcaggggugccuaacagugguucuagaaaaggcuugaggccguuuggcugccccuggcuugacagauauagaugaugugacgauuugguuucucuccuccccuaccugcucuguggccccgcuuugccccaaagaccacaucuggugccccauaugugccugcccacuccaggaguauggacuggggaggcugagugggccccugccaggaagaacgaaguccaauuccaugcggcuugcaccuguacucccagcuacuugggaggcugaggugagaggaucaccugagcccagcaggucuaggcugcagugagucaugauugcgccacugcacuccagcuugggcaacagagacccuguugcaaauaacaguaacucccaccuccugauuaacuggagcugucagggacccaguccccucccuguggcucugcucugccucaucccccaacacucccaggcacagagggcuugccccuccccagcccuuucagccagacuccucaccagcuuguggcuucaucugcagugccaccaggacggagcauggaggucacaguaccugccacccucaacguccucaauggcucugacgcccgccugcccugcaccuucaacuccugcuacacagugaaccacaaacaguucucccugaacuggacuuaccaggagugcaacaacugcucugaggagauggugaguccugggcugaaggcaggggcaggggaggagguaggagccccauggcaugaagccccuggucccaccaccggccccggcacugcgcuagggccccagaggacccugggugggcugcgugcucuggaggcucuugaaacaaggugugcugcgcauccaggugccucacagagguaacugccucucuuccccaggaaaaggguggaugggaagagggggcauccucacuguccuuguaguuccuugcucauccagccacccauccugucccuugcuccaaccccaguuccuccaguuccgcaugaagaucauuaaccugaagcuggagcgguuucaagaccgcguggaguucucagggaaccccagcaaguacgaugugucggugaugcugagaaacgugcagccggaggaugaggggauuuacaacugcuacaucaugaaccccccugaccgccaccguggccauggcaagauccaucugcagguccucauggaaggugaaggcuggggugccagcugcggggcccugaccuuucccacccaccuacucucugcggcauuugcucagggcacuuuggggaggccaggcccuccugaggaugggagcaaccauuugugcugcauagaaggaauccauuuucuucccucuaguccucaagaaccugggaacaugucccagagaguccugguaaugauacagaauauaaucccagucuuaauaauggggcuuggugugauggcucacaccuguaaucacagcgcuuugggaggcugaggcaggcagauagcuugagcucaggagcucgagaccagccugggcaacauggcaaaacuccaucucuacagaaaaugcaaaaauuagcugggcaugguggcuugcaccuauacucccagcuacuugggaggcugaggugagaggaucaucugagcccagcagguagaggcugcagugaaucaugauugugccacugcacuccagcuugggcaacagagcaagacccuguuucaaaugacaacaacagcaauaauaaugauggugaugauggcagcuuucauuuauugggcaccucuaugucucagucauagggcuaagcucuguuuaugcauuaucucauccucaugaaaaccuuugagggagguacuauuauuaagcccauuuuacauguuagaaaacugagguuagagaggauaaguuacuuaaggucacgcaauucguaaguuguacaauuaggacucaaauuugggucuguuugaucuuaaaguucaugcucuuaaauacuucaucacacuagcuccucugggggcuuuggguguccugggauuuggagguggcggcgcuucagggucagucacuggauugcuuuucggcuuugcuaaaguccugucuguggaggagaguaaagucaggaugguuccacgcaugccacggguaguggggugaugggggaggccccuuucccagcccuggugcucaguggcucugcuuccuuuccagagcccccugagcgggacuccacgguggccgugauugugggugccuccgucgggggcuuccuggcuguggucaucuuggugcugaugguggucaagugugugaggagaaaaaaagagcagaagcugagcacagaugaccugaagaccgaggaggagggcaagacggacggugaaggcaacccggaugauggcgccaaguaguggguggccggcccugcagccucccgugucccgucuccuccccucuccgcccuguacagugacccugccugcucgcucuuggugugcuucccgugaccuaggaccccagggcccaccuggggccuccugaacccccgacuucguaucucccacccugcaccaagagugacccacucucuuccauccgagaaaccugccaugcucugggacgugugggcccuggggagaggagagaaagggcucccaccugccagucccuggggggaggcaggaggcacaugugaggguccccagagagaagggagugggugggcagggguagaggagggggccgcuguccaccugcccagugcuuggccuggcaguggcuucagagaggaccugguggggagggagggcuuuccugugcugacagcgcucccucaggagggccuuggccuggcacggcugugcuccuccccugcucccagcccagagcagccaucaggcuggaggugacgaugaguuccugaaacuuggaggggcauguuaaagggaugacugugcauuccagggcacugacggaaagccagggcugcaggcaaagcuggacaugugcccuggcccaggaggccauguugggcccucguuuccauugcuaguggccuccuuggggcucccguuggcuccuaaucccuuaggacuguggaugaggccagacuggaagagcagcuccagguagggggccauguuucccagcggggacccaccaacagaggccaguuucaaagucagcugaggggcugagggguggggcuccauggugaaugcagguugcugcaggcucugccuucuccaugggguaaccacccucgccugggcaggggcagccaaggcugggaaaugaggaggccaugcacaggguggggcagcuuucuuuggggcuucagugagaacucucccaguugcccuuggugggguuuccaccuggcuuuuggcuacagagagggaagggaaagccugaggccggcauaaggggaggccuuggaaccugagcugccaaugccagcccugucccaucugcagccacacuacucgcuccucucccaacaacucccuucguggggacaaaagugacaauuguaggccaggcacaguggcucacgccuguaaucccagcacuuugggaggccaaggcggguggauuaccuccaucuguuuaguagaaaugggcaaaaccccaucucuacuaaaaauacaagaauuagcugggcgugguggcgugugccuguaaucccagcuauuugggaggcugaggcaggagaaucgcuugagcccgggaagcagagguugcagugaacugagauagugauagugccacugcaauucagccugggugacauagagagacuccaucucaaaaaaaaaaaaaaaaaaaaaaaaaggcaauugugcggagccaaccaucacugccauuacacucacauucaauggaaauugauuaggccugagagaaggagcaagaggcagaaacacugacucugagaccaugaccuuggaagauccucagagaucaacuagccaagucacucacuuaaaauggggaaacugagguuccaacugacagaaacugaggguccugcccucuucucuggcuccucagucuccaguuugaagcaacagagccaucauuuucccagugggaggggccucuguguccuggucuaugauggggcgaguuggaggggugggcuucucuagcccugcccccucccaggagcccagccccucuggccaggacugaggaggaguggagggaagcagggagggagggagcaagugugaagggcacagcugcuggcaaaugccccauucccugccccagcacuucccagccuuuccaggagcucugccccaccccuacucaaggagucaggugcccaggguagggaauaagucuaggaaaggggguggagacaggaccgugacagucucagggaccaaucccugccucugcccaucagauugccaauuuggggagacagcaauaucaucugggagauucagcuuaauuugcuucaauucagcaaccauuuauugagcaucuauuaugugccaggcacugugccgggcacuggggauauacacaaagccauaagcacuggggacugccagguuggcacuguagggaccaagauuaacuuuuuggugcaucuaauuccaccucugcaagacacugcuuccaaggcuacaguuggggaagaugaagagauucuagaaucugugcccugggaagggagaaacagcagggaagaggggcaauacaacagggucaagggugcagaggccaggcagagugggugcagagugggggaugggcaaccagccugguaacaccugggugaggugagcgagucaagcccaucuggaaaugcuaaacucaucagcucaguaccuaacugccaaucaacacacugccaaugcgggugggcuaagccgccaggaugccugcagcagauggacgcugcccauccuugagccagccagcugggggcagagagguggguggcgggcaccucaugccagcugagaccaagagugguuguauacauuucugcagcuugcagauuucauuuuuuuggucacccuuuaaguguccuucucucccaggaugagugaggagcugugcugauguugggaacuuaucuuuuuccaggauccauaacauuuaggggaauuauuugcgggcuuuccuaguguauucuaagaaguucuaacucuccaucaagaagcccaagauuccuggagucuuuuuuuccucugcccugaucaacuggggcccaggaaaagcaaugucucuucacgggccucagggccccagcagauggggcugggucaggaaccaucucugucccaggugcucagcccucauaugcauuuucuucuggagccucuuagaaucuccuccagaggacucauagagcugccucccccaggauggugaaguugggagcaaaauggggcuucuguaaguagagguggaaaaccagagagauguuuccacagcagccauuucccuacccuguuuccuaacuuaugcugacaaguucuuccucuuccuaccgugggguucgagccccacuucugguugcauguucccaccaccacgcucugcugguuuuagucggcugacuuucucaacugccccagccucuccugcucucucagaaccucccucugcccccaccccccaucugucucuuccuccuaauuaagggccacugcaaagagagacgggcuggcuaacccaugggauuuagcuuauaagaacaaagcacaauuauucaggacugaacugcuuugaggugccuuggaacuggcuuuggaaauagcuaucugcccccuagcuauggacucuucacaguuauuuccaguuuauaaaaaggaaaagcugaucggauccauguuucucucugcgagucuccuuggggagguugggcugguaaauauuugcaaggucagguuaagcagacagacaauugaaaauacugggcagguccaaaaggauaguuccaggccauaggaauggcuuggugcaguuaacgggugaugaagcaagaaaucuuccuuccuacuuaugucuuaaagauggacagccugugucucuugcugugccucuugcuggcgucuuccuuuauugaagcuugcugaugcacuguacauagucucucucucuagguauagauauauuauauauacaaauaucaaacaucucaccacacccaccccaaaaguuacacuguguguguguggggagguguaauaacuucucaguguuuugaguugauucaccaaaggcaaauuuuggaauguucuugcgcuuugugcacuuggaggggaaaacccaacuacauaugcacuuucuugguugugugugcuauagagagguuggaaggggugguuggaaggggagagaaacugagauggcccucugugacucgacugcugggauguaucugcuuuugggagcagacugaguuucuuuugcaauuugucuuauuguuugggucuacuggcaacaauaaacuaucuccccugaaaau

SEQ ID NO: 15966 - RNA, 40043 nt, Homo sapiens
cagcugauggcaaauccgcuccggcgcuugcacgccuccucggcggcagucuccuguugcuucucggagcuugacugcccuuuggaaaaaucucuccgccccucgagaggagagaggagcagaggacgcgcgcgagcacagagcgggaggacggacagggagaggaggagagggggucugcgcgcggccgcuacccagaagccagcggacggcagcacggagugggcuguccccgagcccagccccgagcgagccccccccccgcccccgcaggacgcgccucccagccagcccgacuccuaggaggaggggaggcgggaaagcagcucaagccucacccaccgcccugcccccagccccgccacucccaggcuccucgggacucggcggguccuccugggagucucggaggggaccggcugugcagguaggcggcuggggaggugggcaaaguuggcuccuuuuuccgaggaggggcgaggcucgguggggaccgaucucuggagcgccgggagcgccggguuuuguguguucagugggugugugcgguccuccgcggucagcugcgccgcgguccccgccugggcagcgggaaaccgggcuggggauguaaacaaggagaucggcgucggaagagagaggagccucuaggggaggcaggcuguggcgcugggggugacgcugguggcugggaauugcucucggugcugccuugagcuuggggucaggguuuucaggagaaggggaaagggcugcgcccacccuuuauccaugaggaguuuucccuuuguuacuuggaagcuguggacacuugguggagcguggggaauuacggacgagggcguguggcugggugugaguguggacuuaugagcgacacaaaauggaacuugcugguuuggugcuuggggaagguggggcugggcagugggcacaggaugggggcgcagggaaagaaggauucuagcgcucggggauucaugagagugcaucauuuuuucccuccuucuugucuuauccauccaauccuguuuccuuuccggggggcccugggguccgccauugcccccuuuccccagcagggcuggcccuggcagagccuccccuauugugucucccgggcuuccguggagaguugggugugcagccuggagcucccagcgcuggcuucuggcucuuacaagugguggcugguagaggaggcacccgagggugggagcugggagcagccucgcuggaaacaugggucugccgcgucaccugcugcaagccugcacgcucgcgggaccguggcuacuggaggcuucuccccaccagugugcucucugccacuacuuccuuugucucuguggcuucgugcugucuggcugggcuaagauuuccagcuuugaagauggaucagugggcaucucaggcccucucugaaaggagcccccuuuggggauccagccacccucauauuauggauguguaugucuacguccgcaacuuagccuuuugcacgugacuugccuggucguugccauggaaacuccuccauuucucagccucccucuuucuccugcccauuccucaccuccauaucuccuccccuccccccaguaugguugccuagauacugguuaucccuggcuaggagaccuagauaucuggcuccuacacccaauugcaguggccccuuacucacaccacccacuucacacacacugcacaucaccaacaccacaaacacauacagacauauaccacacuacgcaaucaacacacccucacacucacaccacacauacauauacaucauaccuauacacacauacacaccaaacacaccgcauauauaccgcaccaccacacaccagcuacaaugcuacacugacacccuacaugcgcacugugcaugcacacacacacacacaguacaucuaaauaagucucaggcugggcugaggcaggggagagagagggcaguuuccuuccuuauccagccaccucccuagggguguggaggggaagagauggaggcucaggaagcccagaaggaaaacccuaacaucucccugggaacccugcagaggaagguggagggaaaggcacugccagauucccucaaaagaggagccccuucccuaaaccuggaagggaagguuggauaaagagugggcgcagcccuuuucccuccuccucaaagccccaguccggagcuccagguguuaacgagagccauucccaggugcugggcuccagaagcugggcacugaccagaauuucaaucucuccacugccgcugcucuuuucccugacccagagaaagccugaggcucugggagucauccucaccagcagaggaucaggccagcucugggaccaucggaggcucugagcccuaacaaaggagagaaggaaaagugguuacugucccaggaaagccaaggaggccaggccagggaggcaggaaggggagggaaaccagaaagagggaaggagaggggccacaggagucaagaaagcgaaaguuagggcuacccgccguugccugggguucaggccacccucucuuccuggcacguuuuccugcuuccccccuggcuccuccaaacagaucugugcaucuaggagaggaagcgggugugcaaagggcucuaggcuugccaggguucucccaagacguguggcuucuaugguugacagacgguaggcgccugggggaagcguuuccuuccuggcuuccaucggaucuucagacugaccugaggaccgauuucauucaaucauucaaagaacuguuuuaagugucuacuguguauuaauugcuggggacaugaaggugaggagggagacacaaucccugacaucggaauccuagguuucucagagccggaagaggccuugagggagcauccagugggaacacagugggggaaacugaggcucagcagucacguggccaguagucgcugaggccuucuaacuccucggccaggauuuuggccuucacacugccuguccugcaacccuugcuuucuuuucucagucaccaucagagaugguggguugauggaaaccuauggagggagagccuuuggucggcuggugacugggacgcccuuccaaagugagggucccuuagugggcggguacaaccgaggagccugcuucacuauguuuucuuggaaggcgaggcuggaagcuguggcaaggagaugggggagaaagggcaguuuccuagacccuggaaauuucccgacagccucgggggaguccacccaccgaaaucuccccuaaauaagagcaccuccucucuuccucccaaccuuguuggacuuagucggccgccaucuggauggcagacugugccaggcagccccccaauauucaccuucgaacaaaucaccuucugagcacccuaagggaagcaaaccagucaagaaaggcacagccccaaggaggcagggagccugcuguggaaaggccggguucuagccccagcucucccccugagcuuccgugcuaccgaaaggcaaaugcguucauugcacaaauaucccuuuggaugcaaacugggcuucuggugaaauccagaaauggcuuggacugcucuucagcaacugaaagccuuucggauuuuagaccuuuguuuccgcaucugucaauagugggguuuagacucaugauuuccaaggcaugucuuccucuaaauuuguguggauuauacaaucuugaaagagaucccuuuucucuccagguaccaaauaguacucauuauuucauaauacagggcugcagcugagcugagcugagcaggaaggggcugggcucugguuacccuggagaaaguuuccuuuucacccaguguggcagaaggugcccuagaagcugaaaccaaguuuuuuucuuuagggcugagggagccaccuccuccuggaugcuguggucuaccuggccuuuucuaccaggcugcacacuggaggcgggcggcgguugggggggguucuuuaaagaguuguucucuggaagagacaacuggagaggacugggcugucauuuuggagguccaugaaaucuucugcagggagaaccccuggccagcuggagaguugcaacgagaggggccggucgggaacacagugcucugacaccgucccugaugagaggcaggacaucuccggccgaaacaaaagcauggaaccaauuuggcagcaucaucucugcuccagaauccggggagggagaggucccgaccugggaagggaugaagccagcuuguaggcugcgcaggaacauguuuguuacaaagaugugggagggagcacacagccugggaaaggggcugggcccccacggaccaggcuggggccaugggaauggggcugccccagcucagaauaucugaugugggcagagagggccaaggaugaagggguguaguuagaauaacagugacccccacgcagcuggaggacaaagccaggcccacacugagagaccagaggcuaagguuucaaacucccucguucauccuuuuaauaaauguuccccucauaugucaggcaggcccugugggcuucugagguuucuccuuugcuggagcccuccugcucagguagaucaaugggcuuguccuguuccuuccucuccccuacuguccaccucauguccacauccuaccaggaggcccugcgacuuucuuccuccauaggaagagccccuccaugcaaucacgggugcacuuacacucucacacacguucccuuccucacacauauauaaucucccacacccgacagggaggcaguggcucacacauucucacacgcccugucaccucucccgaagagcugcagucucucagaccauggugauggccugugaacguccacccucucagcccauuccauuuuacccacugauguuacagcucagguccagguuugccacuccucugcucaaaaaccuccccaggcucaccagugccuauuaauaagcacagguacaugguguaggcacuccaggcucagcgugaccuggcugcagccaccucugcaggcaccuucuccagauggucauccgaagccugguacugucucacccucugccugagcucaagccguugcuggaaugugccgaguagaggguggcagucuuuguagacacacaaacuuggauucuaaacugcauucugaugcuuccuggauuucuucacuuugcuaaaccucaguuuccuuaccugucaaaugagugugaggacaguaugaggcgagcuguguaaagggcucagcaugcugccuagcauggaguaaacacucaggagauaucagcugcuguaauaaugauaguaaugacacauuauuaggauuauuagaauggcauuauuauuguuauaucauccuucguggcuccucccaaguguuuauucuuucaaguaauuauuccauauucccaauaaacaggcauuaaaauucccaauaaacauacucauauaccgugaauguccugucaguucuuccuugagagcacacaccugcauuuuagcugcagagggacacgccccgccucccaccccgcccgcuccacugcaccgccucucaauggcaggucuguucuccccacggugccuggcacagugucagacacguggagaaagcccagugaacagcgugugugcugugacacgcauggggaagaguccucaucaccaggagguguagacaccuagucgcccuucccggcugucucccauacgccggugcacaccacgcguucccaagaugcacaucccuuuauuaccgugcgucaccucagucucccacuugcuuugguagagucuagaaacuaagaauuugaccccaucugaggucugagagaugcuuaaaagcugaagucaaaggagagaggcugauuccucacagcauuuugguaguugggauuugacagagacacagagauuagaaaugaggcaauggaggaaggaggauaccgagaaaguuuuaaaugccugaaaaauucccuacagauccuuugguuguucugagcuuagaauggauuugauguaaagggauaaugaugcugaagcguccuuucauucacacaucaacauuuauugagcagcugcugugcucagugccagggauccagagauggccagagugugccugugcucccagggagcuauggugugaugggggcauacacuggugacagcccuacaugggaagggguguaggccuuggcucuguggguaugaggaugcauugaggggagggaggggauaauguguuuccugaaacagagacagagucaggucaacagcccccuccucuaaaggcagggcacauuucuggguauccaggcccgugggucaggguucaucuucaugccacuucuaccccuaaaagggagacaauaugaaauugugcaaagugcccuguaggcugaaacaugcaggccagagcuguccuucuaaagagguaggcagagagagcaaagggggcugccuggugcuguggccuggcugugggcaggguggcgugggccuggcuucuggguuccuggcccuggcagcugcucuggguuucugugucugcugcugggacugcugucuguccugucuugaaugggccuuugucagcaggugugugggggaggugaucccauccuggccugacuccaucacgcccugcuggggcgugcagccugcuggggccccagccuguggcuucugugcaauaccacucaccauucagacucucuggagccagaccgagaucuccuggggaaccagaggggccucagccccugugcuggcaggcaggaggccugaaucccacucugacucccucugggcaaggcgcggcauuggccugugccugaguuggccucgcaguacuguucuguguuucugcuucugagggcuguugugagaaguccaugggugauggcugggaugccacagugucacgguugucagugauggugaggugacagcaagaccugggaagggggcuggggccccacggaccaggcuggggcccagagaauggggcugccccaguucagaauaucugaugugggcagagagggccaaggaugaggggaugugauuggaaugacagugacccgcaugcagcuggaggacaaagccaggccggcacgcacugaaagaccagaggcuaagaucucuccaccaugccuccgcuuaugguccagcuugggaucuuuccagggagacuuccagaaaacaggccuggauuugugauuugugaauucuguuucuguuucuaaggaagaggccuuauuucuuuucacagucaguuauuuucugucucucucucuucuucuucuucuucuucuuuuuccucuguccaaguuucucuucccuagaaagaacuucauguuuucauguuaaagauaaaggugccuccagguuaaaaauaaguccccugcuauaugacaagagaguuuugccucucccgcuccacccugugcagccgggcuggguugggucugggccgguugaguccaggguaccugacgacucagccuccagcacccucgcagugggagugccccucuuccaugaaugaggguuggaggggcagcauucgagccguugggcuacugaaggcgccugacaggagagggaaaggccacccugggaggugucagccacagugaugcgcugggcggaggugcccuguccugcuccuagacuguccagcugccuuccuggcagcuugggaaauucagcagugucugcagccuccuugagccauggacugcuggaauuucaccacccucugcucuguccuuucccuugccagucucugaguccagucuccuccucgacuccucucuggaacauugcuggcugggcggggcgggcaaucauuucaaguuaggugauuuaacaauaauugaugcuuaauuguuuauuugaugggcauuuaaaaugcaaauugagggaacugguugcauuuuccacugauggaucuguggccucuggucgacccaaagcacuuguuuuaaaaggcagcuuuaaaagcccuugaugguuguuuguuugcucugaggcucugaaccagagaagcccagcuccuguuacagauucaucaaaugccggaaaggugagcaggagccggagugcugggaugggguugaggauugcuuuuaacugaauuuuugaauuuuuauuauuuuucuacgaauagacuaucuuuuuagaacaguuagauuuacagaaaacuugggcagauuguaugaguuccaauuuucuccccuggcaugcaguuucugcuauuauuacgaucuuacauuagggugguacauuuguuacaauuaaugaacaaauauugguacaauaauauugacuaacauugacacuuuauuaaaaugucguucguuuguaccuuauguccuuuuucuguucuaggaucccauccaggauaccacacuccauugagucgugccucuuuuggugccucuggguggugaccuuuucucaggcuucccaggacuuugacaguucugagggucacuggucagguguauuguaggauguggcccuguugggauuuguucgauguucuccucaugauuagacuggagugauggguuuuagggaggaagaucacagagggaaagugccauuuucaucacaucacaccaagacgauacaaucaggaugauucauugcuguugacguugaugggacuggguuuuccaucccuuucaugccccccacgcagcacaguuucaaggccuggugauuggagcuguguucucuccgcuccucgagacaaacauaccaaaccaucagccagcacuuucggccguccucaccaucccaggugaggacagaucaugggguagcacagagacuuuuccgauaggagaaucuuaaugaagcgagcaugaaacagaaugugcuaugcgccaaauuagugccaacgacaggcgacaggcgcucuuggagucuggagaaaggggucuacguggaguggcagcuggacaaagauagcauuuauuaaccuuggcugcacaucagaaugagugggggagauucucaaaauuaccgauaccuuggcuacacugcccuuggcuacacugcccggguuuagagcugaauguggcugaguugauuuccaggcaucuuuuuucuuuucuuucuuucuuucuuuuuuuuuucugaagcucuucaugugauccuaagguacaaccaggguugagaacuggaauaaacaaagaagggaagggcauuguaaguagaaggaacagaauauacaaaggcacgcaguuagagacacauguggcagaagauggaacguagaccaucuuagcugaaaguaaugagaagauacuggagggguagaagagagguacacuuagagauuuucauaugccagaaagaaguuuggauuuuaaaaaacuaaauaggacguagaggcaccaccgaaugccuuugaguuugggagggagguauucagaauacacuuuagaaagguuaguccugcaguaaucaguguccagcacagaggggaaggaggagguuaaagauggguccagcuacugcacuauuagguaaguuacccagaggagugacggaaaggaaguuccaauuagagagauacugcaagugcgagcauggcuaggacuuugccacagaugcaguguggagauggggaaggagagaggaagccccggaaacuuggugaggccguaaccuccgucaggcagggaggcagggauugugucugucuugcucacugcaguguccucagugaugagugaagugcuggaaagcauuaggccaucaauaaauauuuguuaacuugguuacuggaaggauaagggugccauuguuuccaaaauuacaccuuguuccaaaaguacgcucuuucucccccaauuucuccaccuaaaugcaggcaaauuucucugcuguggaaagcaaucugauuaaauaacucaggccaagauauaaaugacuguuaggauugggaguauuucucuuguagugaugccgugacauuuaaacgucucuccuugggaagaauuguuguggaggcagauacauuuuugaguagggguggccuuuauuucgauucuacacccucaucuaauucugagccauaccagaaaaaaaggugaucugcagcucugcagcccacggugaaaggcugccggcuaguaguucuguuggcacccacccugagcugagcuccaguggacaggauagccuacaacuggucugggacuccauccaguacucagcauaaaugcacugguauucugcuaggcaaagugcagcggggcacucagcagcugugagauggacagaggcugagagggacacaggagugccugugcugaugccaaagcucagcugggacugauggggcaucgcugggaacagcugggaucugacaauggguaacagacaugccacaaccucuccuauuaacaggccccagggucccagcuuuaccccaaccucagucauagucagcagaacagaguugggcaagaaaaugugaaaggcggaaaaaggggauaaugcaugccaaagucugaaaagcuguauuuuggguuauucuuccuuggccuggguaagaacacccucaucaggugagcccagcuuggucaggaguuagggucaacauguuuuuucccgucaccuauacccauuucccccccaguuuuuuuuuaguaugguaaaauacacauaccauaaaauguacuaugauuuuuaaguguacauuucagcagcgagguaaguauauccauauuguuguggaacgaucaccaccauccaucucaagaacucccaucgucuugugaaacugaaacuccauacccauuaaacacucacuccccauuuccccccuucccggugccccuggcaaccaccauucuccuuuuugucucugauuuugacuacucuacgugccucauaugaguggaaucauacaguacuuguccuucugugacuggcuuauuucacuuggccucacguccucaagguucauccauguuguagcuggaacaaguaaggacauggaaagaugcucagccucaccacaggcacucuuuuuuguuuuuuuugagauggaaucuuguucugucgcccaggcuggagugcaauggcacgaucucacugcaaccuccaccacccggguucaagcaauucuccugccucagccucccggguagcuggaacuacaggcgcgcaccaccacgcccggcuaauuuuuuuguauuuuaguagagauggaguuucgccguguuggccagacuggucucgaacucuugaccucaggugauccacccgcuuuggucucccaaagugcugggauuacaggcaugacccaccgugccuggccaggaugcucaaccucaccacagucacucuuauguuccuccucagccucuguccaucucacagcugcugggcacaagauucaugcauguguuggaauuuccuuccuuuuuaagguugaauaauauuccuuuauguguauauaccacauuuugcuuauccauuaauccacugaugaacaccuggguugcuucuguguuuuagcuauugugaauaaugcugcuaugaacauggguuuacaaauaucuccucaagguucuauuuccaauucuuuuggguauauauccagagguggaauugcuggaucauaugggaauucuauuuuuaauauuuuaaggaaccacuguacuguuuuccauggcagcugugcauuuuacauuccuagcaacagugcacagugguuccaauuucuccacauccucaccaacacuuguuauuuucuuucuuuuuuuuauagcagcuauccuaaaggauaugaggugguacgcauuguaguuuugauuugcauuuuccuaauuauuauugagguugagcaucuuuccaugugcuuauuggccauuuguauaucuucuuuggagaaauguuaguucaaguuauuugcucauuuuugaauugaauuguuugcuuuuuuuguuguugaguuuuaggaggucucuagcagauguaugauuugaaaauauuuccuuccacucugugguauuuuugaucuguugauugugucuuuugaugcacauuuuuacauuuuuauaaaguccaauuuuucggccagacgcggugacccaugucuguaaucccagcacuuugggaggccgaggccugcggaucacgaggucaggaguucgagaccagccugacccacauggagaaacccugucucuacuaaaaauacaaaaaugagcugggugugguagcaggugccuguaaucccagcuacucgggaagcagaggcaggagaauugcuugaaccccggagguggagguugcagucagccgagauugagccguugcacuccagccugggcaacagggugagacuccgucucaaaaaaaaaacgugcaauuugucuauuuuuuucuuuuguugccugugccuuuguuguccuauucaagaaaccauugccauauccaacgucauaaagcuuuugcuguguuuuuuucuaagaguuuuaaguuuuagguuuuacguguagcucauggauccaguuagguuaaauuuugugugugguguuaaguaagggucuaccuuuauucuuuugcauguguacaucugguuuuccuggcacuuacuuguugaaaagacugucuuuuccccauugaauggucuuggcacccaagucaaaaaucuuuugaccacauaugugaggguuauuucuggacuuuauccuacucuauugguguauauaugucuguucuuaugucacacacuguuuugauacuguagccuuguaguagaauuugaaaucaggaagcuugaguccuucagcuuuguucuuuuucaggauuuuuuuggcuacccagggucccuugagauuccauaugaauuuuagcauagauuuuuuuauuucuacaaaaacaugucauugggauuuugauagggauugcauuaaaucuauagaucauuuuggauaguauuaauaucuuaaaaauauuaggucuuucaaucuacaaacauggacuauuuuuuccguuuauuuacaucuucuuuaauuucuuugagaaauguuucuauugcaugaguuucucaucuucuugguuaauuucuaaauauuuuauucuuuuugauauuaugauauggaguuguuuuuuaguuuccucuucagauuuuuuauuguuaauguauagaaaugcaauuguuuuuuguguguugaccuuguguccugcuacauugcagaauuuauuaguucuuacaguuuuuaugugugaucuuuaggguuuucuauguauaagaugauaccaucugugaacagagaucauuuuacuucuuccuuuccaauuuggaugccuuuuacuuauuuguuuauuuugcauaguugcucuggcuaggacuuccaauacuguguuaaacagaaauggugaaaguggauauccuugccuuguuccugauguuagaggaaaagcguuaagucuuugaccauugagugugauguuugcuguggguuuuuuuuuuuuuuaaacuuauggcuuguauuauguugagguaguuuccuucuauuccuaauuuguugaauguuuuccucaugggaggauguugaugucaaaugcuuuuucugcaucaauugagaugaucgugugguuuuuuuucccuccguuuugcuaaugugguauauuauauugcuugauuuucauauguugaaacauuuuugcauuccaggaauaaauuggggccuccaauuuuauuucccuuaguuccugcccauuuccacaugugccagggaggcagcaagaaagaguggaaggugcauggcaccagcagaauuagugacaguuccagguaugcuuuuguuagcuguugggccuugggcaauagcauaagccugagccucuccuuuucuaaucuguaaaauagcaguaauaaccaacaucccauggaguugugauguuucuuugagcuaaugcuuguaauguuaucuggugaauaaggugucuuauaaaugacugguguauaacaucaucacaucaucaucaucaucaucaucaucauccccuuugaccaaugugggcagggaacaggaauaugcaacauguaagacacagcagcuccccuuucucuuuugacagucacagauacacugaagggcccaggccugagggacaagaguuccuaucuugauacaucuugccgugaccuccucaacccaaggaggagggaggaacagggccaucuuaggaacagcaccuugguuuugcagaaguccauuuggcccugccugugugucucagggcccaacccuucuagagagauacccugaaggggcccuuugugggaggcaguggcuucuccuugaaugaccuuggugaaggaagaagauugggcauggugaccagaggagguggcugaggaccuugugggcugggccucggucugggauagccgcagcuccuggucucuuuccagcagagacacugugucuucugggcagcggcccuguagccagggaagggcgugaguuguuuucucccaggaacagcagcugucuguugacuuuuccuucucauacccugcccuggugcauuuuccugucucugcuuuuaggugcaucugugugaguggggcacgcagggcaugguggaggcaccuagggcaugguggaggcacccagggcagccgaggccucagaaggaggaggaugacgugagggcuugcuugaugcuuccucuaaagccaauucucuucucucagcagccuccaccucuccuggcuucaccaccugugucccuccuucccauuuuccagcucaguuucugcggggacuuggccccugggccagccucucccgucucgaagccucuuucuuucucuuuccuuugccugccucucccacuuccucuggggcaucgccuuuucaguuucuccuccuccggguuuucucuccucuccugcugccucauguccucugucugucuugcuucugugucucucgugggggugcccucaguuugggccugggaagaugugucccuugcuuuagcugucccagccagauguguccucccugggccacauaucugcagcucuggaugacauaggauguuugucuugaggcaggaaaaggcaguggccgggagccagugucagcugugggccgaggccccuccacauccugugaccucacgaggacccuccacguccugugaccacacgaggacccuggagccuuccagugguuggaggacaauguuaaaaggaagggaagggggaggaaguaacugggcccucucccuagccccuaucucuguuuaucuuuccauuuuccuggaaaagguagaaaugaaggaggaagccaaggacagaguugggcagugauacaguaaugauacuaacaggugaugcuucaccagcaguuacuauucgccaggcugcacucagcuccguccacaggccgucucuuuucauugcaaaugacagcaacagaacuccaucuaauuuaguugaagcagggguaucaguuuacagagccagacucgggaaggguggggcccucuggugugggaacacaggagccugaggcacagcuaggaagcucucugggccccuccucccugccucucuccccugccagcucuguaccugucagcuauuggccgacuucucccccaacagacuccuccuccuuucauccggcaggaugcugaggucuuuccuaccaugucuuuuagcuacagggaaggagcugagauuggcaggcucccauagaccagcaggguucgaguggggacagagcaggcucccuuccaaaaggggaugucauucacagaagaggggacugaugugggcacaaagaccaccucaucugacccucacugaucccgagaugcaugcuguuaggcccaucuugcaguugcagaagccaagacucugagaagccaaguaacgcucccgaggccacagagccacugaguggcagagaggagggagagcugagugcucagagcaaggacccuggagccagguugcuugggauugaaucuaggcucugcuacuuucuagcucuggaauuuggggcagcuuacuuaaucuuucucaccucagucugcccgucuguguaaagggaaugaucguaauaauaguugcuucuuaggacuauuguaaggguagaaugaguuauauaacuauuuagaacaacacuugguauggcaugagcaccuuacgaauguuacauguuguuaucaggguguuuuacaguuuacaaagaaccuucacaccuauuaucucacuugaccuugaucauagccuuggaaaguggacaagggaacggacuggcagauucugcacugauucugcgcugcccgcaccccaugcucucacccucggccuaaucagcuucaggguuccguagccuguuuuuaaaaaucccccacccgaguaaacagcucucuguucaacaagugaguaucaaugcuuucucaggggugagcuggcaggauuguacauucugcugucucucuagcgcacgaauauguaugaagcuagagaugcuggaagcuugguaaauguucauccagaugcgggagccccugcauuguggcucucugcgcagagcucucucagguaccuguaucucgcugccucagccugcuggacugggaugggaaugagaaaacaggguggcagcuaccuagaaaaggugggcccuucaaagagccacagugcagguggccccucauggcucuuugcccccaaauggaugugaucccucccugugagguggggcccaagggcuggaguuuggggcuggcucugggaucgaaggaaaccuacucauagcaggaagacucccugcccuccaccaacagccaggcagacagagcagggcugaaguccagaauccugcacuuauucuccagggcaccucucuuucccuaccucaguuucuuucccuguaaaaugcuuuugacgauaacaaaaggccuucggcagacauggagcccaacuccucacucucucacacaggggagcaagcaggugaugagaauaggccucucccaugaccccagcugugcgguaaggugagcuuggugcagguggcuauugcuguagcguggaucugaguagcguacgaccagacuaaggaugaaaacagggaagcuccggacuaaaaauuaucacagacagacuggucagauguacugggagagaggugggaucuuuauauuccuaagaccuuagcaagucuuacuguuuggaaggaaaauagggggaggacaguuugauuuauuugugcuaagcaagagcuuuuggagacaagggacuggcucugaaggcuuuuuaaggccuccuuaguucuuggauuucaugaaagggccacaggugcacauuaucaguguuagcaucggguuauguuuaaggauuaagugagaauaagcauuuaaagcacuaagaauagugccuggccuguaucauuugucgugauuauaauuauuaccucuuguauccaauacagacccccagacugggccucaaguguggguuuucaucucagaauuuuuaauuccucuuaguuucuucuguggcauccauagaagggcuccuaugaugcaggcugaccucuguguccagccuucugguucaaggccgcugucugggaagugugcagugugagucaggggugugcuuuguaaaggcacaaagaucuccaaccccggaccucccuccucaggggauucacauuugcccgccaguggcuccacaguguccugccgaacuggguguggcuggaccugcggucgggacacacuggcuuggggcgggggucuugcacagugucuaggaggcaggagauguaucucauagccacauaagcaaauggacuuucgagcagccucccagaagggguugaaaaugacacagaaucggccgggagugguggcucacaucuguaaucccagcacuuugggaggcugaguugggcagaucaccggaggucaggaguuggagaccacccuggccaauauggcgaaaccccgucucuacuaaaaauacaaaacuuagcuggguguggugguucgcaccuguagucccagcuacucgggaggcugaggcaggagaaucgcuugagccugggaggaggagguugcagugagccaagaucgcaccacugcacacuccagccuggugacagagcgagacugucuaaaaaagaaaagaaagaaggaaggaaggaaggaaggaaggaaggaaggaaggaaggaaggaaggaaggaagggaaggaaggagagagagagagaaagaaagaaagaaagaaagaaagaaagaaagaaagaaagaaagaaagaaagaaagaaagaaagaaagaaaaaagaaaaugaagcagaaucgacucuccguuuuacaaaaacagaggaugaaccugggccaugacucugggucccuguggcuugggaacuuugacaggagaguguuuagggcacaaaguugggggugugaggcugagugugguccuuaccccuguuuccaagcuggugguuacaugggacccaaggugagaggagaaagcagcccugacauggagagggagugaggggugccgggcucagccaggagggacccugggaaagccccccuggagcucugcucgacauacgucccccaaguggaugacgacuguccuuuuguccuucauuuuccuuuuaauccugcaagagaacuucagccaaagcaucugagacgggaagcagaaaaaggagggacaguuuggagaagaaaaacgcagcugugugugaguggggagguacuuugguuggaugccaagggcaccaggaugcuccagcauggaugggaagcagggggacgcuggaguggggcugggguggggugccaaggaagaucgaggagaagaacauccagccucuccaguacugaggccucucugggauucuuuaucuuuugucugaaagcauuaugaggcuuaauucccauaaaaauaaaacacauuccaaagccaaggccaggguuugggcauucucugcugguuuauacugaccacucccccaggucccguucaugagcauggagaauagagaacugaugguaaggcugauauugugcaggcauggcccuuucauggaaacagagggcuaaggaggccuuaaaaagccuucggggccaguccuuugucuccaagaggucuugcuuagcacgaauagaucagaccacucucccccuauuuuccucccagacaguaagacuugcuaaggucuuaggaauauaaauauuccaccugggccgggugugguggcucaugccuguaauuccagcacuuugggaaguugaggugggcggcucacgaggucaagagaucgagaccaucuuggccaacauggugaaacuccgucucuacuaaaaauacaaaaauuagcugggcaugguggcgcgugccuguaaucccagcuacucaggaggcugagacaggagaaucgcuugaacccggcagcagagguugcagugagccaagauugcgccacugcacuccagccugggcuacagagcgagacuccuucucaaaaaaaaaaaaaaaaauccacuucuuucccaauacaucugaccaguuugucugugacuucccuguuuucauucuuagucuaaccuuacacaacacagauccaugcugcagcaauagccaccugcacuaaacucaccacaucaccuggggaucaugggaaagaccuguucucaucacguauuuacuccccugugugagagagugagcauuugggccccaugccuccagaagacccauucuagacaugauuccaucccucaccuucccugaagccagcacugucaccucccaucuccaauccaaggaggcuaucaguggcaguggcuucccuccugcccucucaugucccuggccaccccauuccugcagggccucgcccucuucccuggcuccagccaggcuaccccccuucccuuuggcauuggggugggcucagccuuccuucccucuguuccuccuggccacugcucugccagcccuguucugcccaccucccaaucccagcacaucaaaacagcagucaagagugggaaaugcauguucugagcccugcccugccccuaaauaacuggaugaaucagguaccucaucucucuuugggccccaauuuucacaaauaaaaagcaggagcccaaucacuguaaccaacugugaugaauucugugaugcuaacuccaucugguagaccucacaucuugguuauacucaauauauacacagucgaaucuuuuuuuaauagacuucuugguugcaaagaucuagauacgucauaggcuaaaucauaucccuuugcauauaauaauagucuaggguaaccauuuagacuaaacuguggggcccaggcauucugcggccucauaaaaggccccauuccgggacguucuguaugaagugagaccucaucuuucuuagcagggcauccugcuaagacccaggcccggugaccccucagagcuugucauccgugggcugagccugcaggaaggcaagcaggugggaugccaggggaggcgagugaagcuucgggagcagggggagggagggaugaggaugagauaaugaaguuucacuguaauuuggagccucugcauuuucaagggagguuguuucugaguuauuuucacaauggaacuggguauucugaucuaccucacugcugcguggaaucaaaaauaauagagcauguugcuauaucaucaacuaguggcuucucuuucugagcaguuuuuacccagcaauuaagugaaauuaugugacucaguaugggaagauaauugccggagaaacucuucugauugcuuucucccgcacaugcagccagcaaccaagcaggaggaucagagaggaaaauuaacauggaagugcugcuuccacccagaaccucagcugcuugccaauauggagauaaacaagagcacagaaaggagaggaaaaaugagcggaaacagaauucguucucauaauacacccuagaggaggcagcaacgugugauugguuccauucuccagauggggagagugguccaaauggucuagaggggaagaguuggggagcaagagagugaagcagccagggagucccccacuccagcagugaugauuucucaggcccccugugcuggcgagccagguccucaggcccccaggcaaagguccagggcccagugcgcagguggcggugcaugcccuguuccugugcccucuccgcucacuucagccuuggaucuccuucccccagugacuccuccuuccugucuuccaucuacuccuuagaaucucucgcccggaacugagauuuuucaccacccagccucuuacccuccccaccccagccagccuccagcagcccagcuuccucucuggaaggagggagaaaggaauguguggucacugggagggugggaggugcagaggggugguauaugagauggaagggaagccaagcugggugcagcagugagacaaaggcauucuguggcccuucaaaaguucuguguauguacuuggccacucgacucaggggcagugccaacguaccaccgaugagauuuuuaaaaauggguuuaggccccccuccuccccgcucccgccaccccgaggggcccaugcugaggugugguugauguagcccaggcugggacagcagcuugcaggaguagagaaugggucacuuuucaaauuugugacaguauuucuuuucacacugucacuugaucagaaauguuuucuuuagaauacaaaggcaggucuuaacucuuuagcuuggcacucaagagccucugcaaucugauuccaaccaucuuaucugaguucucaccacccaccccaucaugcuuuaguccaacuggguuguucacuguuuuggaagauaucuuacacuagaaauggcagcuauuugguagguugcugucacagcccccuccuaggcuaagcagacauuacugguggaugaaggccgucuccuguuggaccucauuuggggaagccacuuuggacaguuacuacugcaugaaaugcguuaaggcucaucuugaacugaucuugaacuugagcugaaucccauuuguuguuccuacucucuguuuccccucucacugcuuuugcucaugcugucuucucuaccggaaugccuuuccucugcucuuuccuucccccugucuaucaaaauccuacccugcucuuaagguuccgcuggaaugucagcuccuccacggaaacuucccuagcucccuguugagcucucugcuccccuucucucugucuuucuggacuauuguugcauggcgucuguaccuguugggaaguucucgucauauuugcugauggaucagagcccuuugccaccaaauccuacuucuccuugguagcuaaggcuguaucuuguucaccuacuuauccuuugcagaacccagaauaguauggcccuuucuaggaguucaguguuggcuuguguaauggauuugaaccugagcaucaauggaggugauuguugggguuugaagggaaggcacagcagcaaccugaacugcugcccauugucccugguggcccagagccauugacaugugcuuucccuauucccagggggcaggaagagcccuauugccaacacugcacucccucuuccggcuagagcuggucaagaggccacugugggaagccugguccauuuguccuucccucucucaccucacauccaauauucacaccauggccccuaagauuugaaggccuuaauguguuguuucaucuaccuuccacaucuugacuccagucucccuccucacuggcuaagcaaggagcagguguaauuuggagaugggacuugggcuaggaagcagcaguaaacuggagaaagaaagagaaggagagagggagggagggagguguuuuacagauagcagaugcucaaaacuuaccuuauuucauacuuugauugaagauauuuuaggacuguaugacugccugaaucauaaggggacuuuccacuuuaaaauaauuaaucccagguuuacuauuacacagcuugguuuaaagaaggaaugaaaaucauccaaucuuaagucaccguuacucuccccacaccaaacacuaccaaaaagacaaaacaaaacaaaaaccccaugagauaacugggccaggcaugguggcucaugccugaaaucccaacacuuaaggaggccgagccagaaggaucacuugaggucaggauuucgagacccagccuggccaacauggugaaacccugucucuacuaaaaauacaaaaauuagcugggcaugguggugcaugcuuguaguuccagcuacuagggaggcugaggcaggaggaucacucaggaggcagagguugcaaugagccgagauugugccacuauacuccagccugagugacacagugagacucuaucucaaacaaaacaaaacaaaacaaaaacuagcacuggaguaugugaagcuuagccagaacuuaagccauaguuacucuuagaaugcacccucauugacauuacugcauucuguaggcuaaucagcauugaguccagcaagguugggaagccaaaccugagacuaccugcaugaagccaagaacccuugagaggggcuaaagugaucucagguugguaucugcugcccccagccuccaugaaaaagcaaagcaaaugcucucugaaagaaagugucccauuuuaggacuaccaauuucccacagauuaaaaucuagcaaauaugagcucacaaucgaauauauuaccaaacacaggaaaaaacaagucacugugauugaaaggcacagaaacaaaaaguagauuuugacccccaaggauuuaagaguuuggaauuaucagauacagaauauaaaauaacuguaagaaauguugaaagaauaagagaugagaacacaaaaugagugaacaacaaagacuaacacaaaugcccaggcaauuucaaaaagaaccagauagaaccuuuagaaauuaauaauaugaccauugaaacacaaaaguaaaugaguggguuaagcagcaaauaaaaacaguuaaaaaggaagucagaaaauggaaaacaaauaugaaauaauuaccuggaauguagcauagagaaggaaguggaaaauaugaaagagcaguuaagcgauauggagaauagaaugaggaugucuaaccugcuucuagucacagucucagaaagagaaaguggggagaauggaggagaggccauauuugaagagauaagaauuuuucauaacgaugaaaaggaugaaccuauagguaaaggacuuucaagucugaugaaacucacgacaaucaguucuauguuguguuucagacuugugaugaaacccacaacagcaaacacaaaaagaagaaaauaaaaggaggcagagaagaaagauaggacaucuauaaaggaaugaugauauaagcagcagacuucucaacagcaaucauggaagccagauagcaguggaauaacaucuuaaaagugcagagcaaaaauaauuaucagccuagaauuguguacauagccaaacuaccuuucaagguuaggauuguauuaguuuucuauugcugcauaacaaacgaucacagacccagcagcuuaaagcaacacauguuuauuauguaaugguuucuuuaggucagaggucuggcacagcuuagcugaauuuucugcuucagcaucauaccgaacuacagucuaggugcuggcuaagguuguggucugauaagagaauugacuggggaaagaucugccuccagacucccucagguugcuggcaguauucaucuccuugugguagaagaacugagguucccaucuucuugcuggcuucuggccaggggcagcugucagcugcuagaggcuucccacaauuccuuauccugugcuucucuccguagccugucucaugacauagcagcuugcuuuuucaagccagcaagggagaaaauucucgagcuccagccugcaagauugagucuuauaugauauaacaccaucaucugagagcuguccuuuugccacuuuugccacauucuguugguuaaaaguguguugcagcuccugccaguauucaaaggaaagagauuacucaaagcauugaacacuagaaggcuggaaugacuggggaucgccguagggucucuugccauaaaggugaaaugaaaacauuuccaaauaaacagaaacagaguuucuaacgaacagaucuucauuaaagaaaauuuugaaagauguucuuuaggaauaaagaaaauggcaugaaggaugacuaacguucaaaaacaauggugaacaaaucaguacauauguuguaaauucauuaucuauugcugcauagcaaauuacuuccaaacucagcagccuaaaacagcaaacguuugauauuucacacaguuucugaggguauggaaucagggagaaucuucagugggugguucuggcucaaggucuuucaugaagccggaagaucuguuuccaagcucacuuaugugguucauggcaggcuguauuucuuagcaggcuuuuggagugaggccaccacaugggccucuccacaggggugccugaauauccuuaagacauggcagcuagcuugacucagaacaagcaauccgagagggagggagagagagagagagcacacaagaggcuguguugcuuuuuauaaccucauaucgaaagugacauaccauuacuucugccauauuuuccuggucauacagaccaacccuggugcagugugggaggggacuguacaaggaucugaauacuaggagauacugggagcugucuugcaggcuggcuacuacacacaugggugaauccaaacaaacauaguuuucaugaaguacgaauauuaguaucuauuuuauagaauuuuaaaaagaacugaaauauucuccaauaauagcauauguaucaggaaggggaugauuuguauuuuuguauuuucaaggaggguauucugccuaauaacuauuauaaguauuaacucugaauuuuuuuggucuuuuuuacauugaauacacauggaaaaauuacaaagaugaccacuaaaagauuaaaauaguuucuauaauuucuaaaccaguagagggagaaaaggaauaagaaaaaaaaaaaucacuaagcuaggggcaguggcucaugccuauaaucccagcacuuugggaggccaaggcaggcagaucaccugagcccaggaguucgagaccagccuacguaacauagugagaccgccccccaaaaaaauaaaaauaaaaauaacuaauccagaaaaaagaaagggcaaggaaagaaaaagaaacaagcacauucccauagggaaaaaacagauggcagaaagcagaccaacuacaucaauagucacaauaaguaaauuaaaugggguaaauuugacaauuaauacagaaagccugacaauacagaauuuuucaaaaauccaucucuuugcuguuuauaagaugcacacacaacacauaaggacacagaaagguagagaguaacauagaauuuaagacagggaggaucacuacauaauucuaaaagacccaacucagaggacaguaacaguuuuaaacuaucuguuagaauauucuaagagacauguuaucggccagcuucaggucuguucugcccacacucaguaaaucucaguaaaucaaucacugugacacagauuuugcaaaagagaaaagauuuauucagaagaccaccaagcaaggaggccggagaacggcucucaaauccgccuccccaaagauaaggcuuagggauauuuacuguuaagggaagugggguggucugaggcauagggaaaggugauuggcaguggggagaaaugaaauggcagauucauucugagcaagcguagucaggguuuguggcauuccacaggacauauguacaggaaaugguggcauuagugugaccugaggguggaguuuuuagcccucugaugucaaaggcuacccuucggagcacuugcacaugcccaguugaaggguggguggucucauccuguuugaacuggacaggagcuagcccaaauuccugaaaaacaacugaaguaaccauuaccagggugaccuaugaauguuaucuguaaaguaaccagugaagguuaaguuucagcaugcaguggcgaggccuucagcuaccgaggccuucagcuaccacggccuucagcuucauggaaaaaggaaaaaaaauaaaauauaauaacaaaaagcaagcgaccaaaagcaagcagugcaggcagaccugaucagauuaaccccucuguuucaaauauggggauacauuuauaaauccuuccacuuagugguagauuuuaaagugcugaucuugauuuuugguaggauaaacagucaaaaaaaaaaaaagaaauuuaaacacaguugauaauguuaauuuauaggcauauagaacuuucuucccaaccaugaaggaauucacaauuuuccaagcacauaugaaauauaauucuuuuaauaacugaccauguacuaggucauaaagcaagucucaacacguuucaaggcaucuguacaucauacagaccauguuuugugaccuuggugcacuuaaguuagaagucaauaacaaaagcaaauaaaaaucacuauauauuuggauauuuaaaacacacacuucuuaaugcauagguaaagcaagaaauuguaaggagguuuaaaguauacugagaacuaaacaacaauccaacuaugauggaguacuuucacccccuuacagaagcuuugaagugugguuauugauuauuguuuaguucuuaguauuauacuuuaaaagcacuuagagggaacauugcagucuuaaaugcuuauauuggaaaauaagaaaagcuaaauauuaaugaacuagguauccaacauaacaagauaaacauaaaaaagaacaauagaagaaacccagagauuguuuaagggcagaauuaagaaaauuuuaaaacauacaauaaaaaggauuaaugaaaccaagaguugguuucuucaaaaaaacuauaagcaucguuaaaccucuggugaaacugaccaagaagaaagggaguugucacaaguaacauuaggaaugaaaaaaacaggcauaacuuuauggcaaaacauuugaaagcagaaaagggaaaauuccuuuaaaaauuauaacucacuaaauuuauuaaagaagaaauagauaucuggagagugccauaaccauuaauuaauugaaugggccauuuaagaucuucccacaaagaaagucccaagcccggaugauuuuacagguuaguuccaccaaacacucaaagaacagauaauucgaaucuucugcaaacucuuccagggagcuagcaggagaguggacacuuguucugugaggccaguacugccauccccaaaccaggcaagguuaauacaauaaaauaaaaacugcagaccaaucucacucaugcacauagaugcaaaaauccuaaacaaaaugucaguaagccaaauccaucuguuuauuaaaaaaaaaaaaaaaauugguuucauuucagaaaugcagggaugauuuaacacuugauaauccauacauacaauuuacuucauugguagauuuaaggacaaaaaccauagaaauagaacacucguucauaauuaacauaaaacagaaacagcuuggaaaccaggauuagaggggaacuuucaaagcauuagaaaaacucuauuuaaaaucaguaguaagacugugugugagugugcacguguugugugcguguguguuugcuauuguuuuuauucugcauuucacuggaauuccuacccaguacacuaggacaagaaauauaaauaaccacaaugagauaccaucucacaccaguuagaauggcgaucauuaaaaagucaggaaacaacaggugcuggagaggauauggagaaauaggaacauuuuacacuguuggugggacuguaaacuaguucaaccuuuguggaagucaguguggcaauuccucaggaaucuagaacuagaaauaccauuugacccagccaucccauuacuggguauauacccaaaguauuagaagucaugcugcuacaaagacacaugcacacguauguuuauugccgcacuauucacaauagcaaagucuuggaaccaacccaaauauccaacaaugauagacuggauuaagaaaauguggcacauauaugccauggaauacuaugcagccauaaaaaaugacgaguccauguccuuuguagggacauggaugaagcuggaaaccaucauucucagaaaacuaucauaaggacaaaaaaaccaaacaccgcauguucucacucauaggugggaauugaacaaugagaacacauggacacaggaaggggaacaucacacaccggggccuguugugggguggggggagggggagggauagcauuaggagauauaccuaauguuaaaugacgaguuaaugggugcagcacaccaacauggcacauguauacauauguaacaaaccugcacguugugcacauguacccuaaaacuuaaagaauaauaaaauaaaauaaaaacuauaauuuucuaaaaaaaaauagaaauaaacagcgugagaauuagaaagaaggaacaauaucauuugaagaugauauaucuacagagaaaacccaaaggcauuucuagguaaguuauuacaaauaauucgggaguuuaacaagauuauuggauuuaagaucaauauguaaagaucaguugcuuuucucucuaccagcaaaaauuagaaaacacauacaaggugacauugaaagcagcaauaaaaaugauaaggcacuuaggaaugaaucuaacagaacaugugcaacaccuguaugaaagcauuuauggaacuuuauugaaaaggaccuaaacaaaucaaaagauguauuuauagacaggggacucaagaucagaaauaugucauuucuccccagguuguucuauagauagguccauugcaguucccaugaaaauccuaacaguuuuagaugaauuugaaaagcuaauucugaaauuugagagcagaaaaccaagaauaaugaagacauuccugaagaaagaggaggagagggaagaggagaaaaaaagaugggagcuucucuuaccauguggcaagauuacuaugaagcuaucauaauugaaacacaguaauuuuaaugcaguacagacaaauugaccaagagacccaaagagauagcccagaaacugaugcacaccaaauagaaaucagauaugugacaaagguggcauagcccaucaugaggaaaaggggaggcagucugccccuggaaccagguuacaguacaaguuaucauuacgggaaaaaguaaaacuagacuccuaccucacaccauacacaaacaucaguuucagaugucaaauagauuuaaauguaaaagacaaaaccuugggguuuuuagaugaaaacucugaccucagggugacaaaggaugucuuaagacacaaaaaucacagcauucaaguauguuaggauuaagaaauucuguucaacagaagacaauuuuuaaaagugaaaaaauaagccacaaacuggaaggagauauuugcuauacuuaaugacaaagguuuaguauucagaauaagaaauuaacaacaauaauaaugucaacucacuuggaaaacgggcaaacggcaugaaaaacauaucacugaugaagaaacaggaaugacaaauaaacacagagaaaaaaguccagcucuauuacaguguaaucacauuaaagccaucuuuuaccucuagauuggcaaaaaugaaaauaucugacaacagaaaauauccacaacagguuguagaguaauggggacagugauaugcagcuggugggauauuaucauggagaugaccacuguggaaacaauuuuaaaucauugugugaaguggacaguuugcauacuauacaacccaaugaaugacuucaguccuaggcucaugucuagaacauaacuguucaaacugccgagugugacccauuaaggagccuggaaauguuuuuuguaaagaaacagaauaaaauagaaaagaaacuaucucauucauaguaaguauuauuuugugauaauugcuucugguuacaugaaucuguguuaugcuggguugcaauguaaaauguauuucuuaugggaguggugaucaaagaaucaaaaaacuguuuccucaaaauucuugcaugugugcccugagcaguaugcacaaaaauguccacaacucuauuuguaauagcauaaaauugagggggaaaaagaaacagacauccauuggcaggagacuagagcacuacaugaucauuuaccugcacaauggaauauuacaccacacugaaaaugaaugcacuauagcuaaauguaguaagucagugaaccacagaagcauaaugucggacagaaaaagcaaguuucaaaagacuauaaacaugauaucauaauuauaaaguucaaaaaagcuacacuaagcaacauaauauuuagauauauguacguguuaaauauauuuuuaagacaaagagcaaggugaauauccauacaguggaauauuauucagccauaaagagaaauaaaauaugcauacaugcuacaagguagaugaacccugaaaacauuaugcuaacuugaaagccagacacagaaguccauguauuuuauuauuucauuuaugugaaauguccagagugggcaaacccauugagacaaaaaguagaugaaugguuucaggguugaagggaaggggagucgggggugacugccgauggauacaaguuucuucuugggaggaugaaaugucuuggaacccgagauuggugacgaaugcauaaguuuguaaauguucuaaaaaucacugaauuguacaguuuaagauggcaaacuuccugaugugugaauuguauauuuuaaauuguggaaagaacacuuacuaugagaucuacccucuuaacauaucuugaagugugcaauucaauauuguuaauuaugcuguacaguguuauacagcagaucucuagcacuuacucauuuugcauaacugaaauuuuauaucuguugauuggcagcuuuuuagaagaagagcaagggaaugauuaaaaauauguauuuucagccaggcgcgguggcucacgccuguaauuccagcgcucugggaggccgagguggguggaucaccugaggucagaaguuugagccugaccaacauggugaaacccugucucuacuaaaaauacaaaaaauuagcugggugugguggugcaugccuguaauccaaacuccuugggaggcagaagcaggagaaucguuugaacccgggagguggaaguugcagugagccgagaucgcaccauugcauucuagccugggcgacacagggagacucagucucaaaauaaauaaauaaauaaauaaaaauaaaaauauauauuuuugggauacuggccaccucugggagagaggcagggggaugggguggagggaaauagaggucacugcagcagucuuuguaaagcuccauuuccuaagcugcugguuuauggguguuucuauuauuacuaugccucauuauauguguauguuacauauauuuuuauacauauaagauacaguguagcauucaaaggaaauacaagugugaaaugagacagcauugaaagcaaauuaccaccuuuugauaaaggcuuuuugaaucaagguuugggccuugacguggcuguggaugcagucguucugaccccugguggccgagaggugaagugcaguggcggcugcuugcucaaggccggaggaagguagugaccgugcugggggcaaucagggucuuggacuggacggauguccagggguucaggccacugccaguuucaccccacauggaaaacagcacccagccuugggcuuuccugguucaggaaaagccucucugucuccucucuggcucuuaaccaugcuccuuuaagcccaggagugagauguguguccugccauugaaaucuaucccugggugccaccucuuggcccugccuccugcuuccaccaggauagcccaccuggggccauccacccagagaccaggacugaugagcuccugagcagagaccuccgcauccucuggggaagcagaggcuggggugcugaggcucguggaaccagccuucaaacuccuuuuguagaaucaaaccaccuuucuggaggauucugaaccaaagccugugggaagagcugacuuggggacuuuugaggugggacguaaaggguaccugaaggagggcugucagcgcuucagggcccaggaaaccacaagucuccucuccacccagcuggcuagacuagagggacacugguuuacuggccccauuuagucugauauuaagagacauuucugaugggguauuggcugucagaaugaacuagggauggccacagaaggguggccuggagagaaggacacaguugagaucuucaaagucacgucccagaggcaacgugguggaggaguuaccaugcuggguuaggaucuaggcccugcuacucacucuggugcaugucagccucauuaagcuucagguucucggccugcguuaguuguagugcuugcuaauuguacuaacucaauugugccaauugaauuaauacaugcagagcauucucuaagaguccaagaaaugucaacuggugguggcucacgccuauaaucccagcccuuugggaggcugaggcagauggaccacuugaggucaagaguucgagaccagccuggccaacaugaugaaacccugucucuacuaaaaauacaaaaaauuagccgggcaugauggcacacgccucuaaugccagcuacucaggaggcugaggcagaagaaucacuugaaccugggaggcggagguugcagugagccgagaucaugccacuacgcucuagccugggcaagauagcgagacucugucucaaaaaaaaaaaaagucaacugcuugugcuuagguuguuugaacccucaccaagucaugagugcagagcaaagcuggggauuuggcuuggccccuggucaggcugacgcuuggagcugacggauggaggcuucuuagccagagaaucauuuuuuccucccucuguccccagacgccauggaguuggugcuggucuuccucugcagccugcuggcccccaugguccuggccagugguaaguaccccucugggaccuggcugugacaagaugacaacccuguccagcccucucugcuggaagguucugggccccuugggacauuagggcugggggacucucacguucuucaugucuagucaggggccucucccuucagucagcagagaaagucguggagguggcagcuauuuauucacagaccucagcacagccugcccccucgcccccuaaggguccggcagggaguaguuuuuaagccccgcaagcucacugcgccucuguggauuuguggccugaacccugggauucagaccugcacaucagucucuagaccauauuagcaagugcuggccucgugcaagucauauguccuuccuuggucucgguuucuccgugugucacaagaggaaaacugacccugccuucuggggaugauguaagaauacaaaggggcaaugaauguggguguugcaugacucagagccucacugaguuucgaugccuucacugaccucggcccuuaggguuccccuaacccccuaacuggcaggcccgcccuaccgugcaccucuaggcaucucuguuuaaugggcccugcuccucuggaauuccuuuguggagacugaggucugugaggcaagguuagauauuugggaaccaguuuguguagcuuucuuucucuugaccaacuguuuguuuuugcagcagcugaaaaggagaaggaaauggacccuuuucauuauggugagcgauggcaacccugggugcaggggucagggggaaugcagcccugccuggcaggagggguagggggaacagacacccucucccuggccccuuccucucucacccuugguuccuuuggcagauuaccagacccugaggauugggggacugguguucgcugugguccucuucucgguugggauccuccuuauccuaaguaaguuuguucuuuugcucacucuguuaagagcaaugacugaggcugcuaagcagguggggacagugugagagccugguuggucccucuccuggagaggaaaggaggcugccugcccuccguguuaucuucacgacccaguagagugcugggcacauaguaagugcucaguaaaacagugacacgggaacaaagaaaaugucauaugacaaugagcauagauaggaacgagcaggguggcuucccagugcugugucuauagggcaugaauggggcagucacggaggaaggagacaggugcugcccuagugugcgagggaugugccuccgaguuuguuguucccacaugagccugaucugcacagaucccucuuuacucacaugaucaagagggcuguggggguguagccauuccagcuauagaauguauuuccuuugccccagaagaagcuaccccauccgagggccacugugugcagcugugcaaacugugcacugcccaggucuagggggugccauuuacauagucccacaaccugcacagacccuuggcccugcuguggccaagccagcagcaugaccuuggaugguuucuuugcuuuucaggucgcaggugcaagugcaguuucaaucagaagccccgguaaggaugccguggcaguggccuugggggggugauacuaggugggacaggaagggaccccuggugugugacccccaaaugggcauucucuuggauucuugucucggaggcagaacguguguguugggacguagggcuggaaguuugaggacugccagguagacucuggggcaaaggagaggucaaaacauugaaggucagcccauccugucucuucugaucuaugugggggacggggaguggacaagaaaguacuggaaccuuuucuggaggcccuugggacaguugagcuugggagaagggaagcagagggcuuccuggccucucuagaugcccagguccucucuacaggaccugcgacacaguccccacuugucaccuguucaugaggcucuuugagcugaauagacacuuggaccuucuuucuacucccacauagaggucauaccccauuaguuuacuauaauagccaaggguagcuuggaccccagaaguccaaagcguguggcaggacacacccaagcccccauguggcccuagccuccccuucccaugagggcugacauugaagggugccuguaaguucccucugagucugacccuucaguccagaccuuucccucugucccaugcaucccacagcagagugagcuccagccccucagggcacugggaggagccugacugcaggcagcugugccccagugaggagcagaacgaugcucucugggucugcccuggagaucucugauggggcugugugucucuuucuccugcagggccccaggagaugaggaagcccagguggagaaccucaucaccgccaaugguaacuguccgugaccaccugcccagguggaaaagagggaacagagagaccccucuguggcucaggaagggacuguugccaggugcauggccagccagacaugcucccgcagugccaggagagugggucuccagggccucugcagcauugcccccucacuccaccaaacaggcuacuacuagugucaccugcuauuuacagagcaucugcuugugccaggcacagaccccauaucauuuaaugggcacacagcccugaaauaggcaucauuguccccauuuuguaaccgagggacugagagagguuaccagguuccuguaagcagcaaguagcagggccaggauugaacccagaucguucugacucgaaaucccaugcccgucaccucuuugcucccccagagucaggcagagacacggcugcuguuggggguggcccacgggggugaggagucuauacacuauaauccauucugguuuucuuuccagcaacagagccccagaaagcagagaacugaagugcagccaucagguggaaggugagaugcucagugccuggauuggccccuguugccaucaccgucugcaucagggccuggacagggguucaggcgggaaggauggggcuagcuuuugcagugggcacagcuuuuauuaugggcccugcccugaggagccuucaggagucugaaaggggcugugagagagaccaggacuagaaacacccgaagugucccacacacaugcaugccaacaccaggaaauggggcuuccacacagcccacuggccgagugcauagggcgucaucccaagugcaacaugggagaauuagaguuagugaaaugcuccuaaucucaaaguagcauaaagauaauggcuuuccguggugacucagaaaguacuuuagggccacuuguuuuuuuaaacaccuuauuaugaaacuucccaacccuaaccaaaaguagagcaaauaguauaugauccuucccucuccacauuuaagggcacugauuuuaguaucuauuuccauuguucaucguagggggcacaggagaguaguaacuggcaaaugcuguacaguuuucagagugccaccacacacacagacucacucgagucugccagaaaaagaggaugggacaggugggguuuagcccauuuuauaggugaaaccaagaugagagggaauagccccguggagagugacagcccggacugugaacucaggccuuugcggcugugguucagcgccacugcuccccucuguccugugcgucucgcuuuaugacaugcccuggaauauccuaagggaaaagguuuguguuuugucagcucacuucugccuuuuuuuccccccauacaaguaaggcauuauagaaagguauauaaguuuaucucacauuguaagguaaaagagguuucuggaugaugaagugcccgaugcaccagcuuugacugugcguaacaauaucgugugccuguguagcauuuaaauucuuuccuaagugcuuuugcauccucauagcggcccgugaugggcagagcagggcucauuacucccgucuucuggauggggcucucgaaggcaagugaucaccuaagugcgaauggacgaagauuccgaucuaggaggcaggugcccuuccugguagcuugguguucugucuauuucaucacagacugagaaucugggaaggcucagaggaggcagccuggaaaugaaaugucuuuucauuuuuuuuuucccaaacuaguucuuucucagaaaccuuuuauccuaaggcucaggacugugagcaaccacuggggagguccuggguuuaacaauuuccuuuccaugucugccaggcuccagcccaccugggagaggcuucuucugagguucaccccuccccugugucuuugucuccuuucucugcgucucagacgaggcugucauaccgggaauuucagugggcaggugcucaaggaagggagagaagcagauaaggauaccagaggcagccgaaguguuuuuaauuuaaauuauccuccuccucagccucuggaaccugaggcggcugcuugaaccuuuggaugcaaaugucgaugcuuaagaaaaccggccacuucagcaacagcccuuuccccaggagaagccaagaacuugugugucccccacccuauccccucuaacaccauuccuccaccugaugaugcaacuaacacuugccuccccacugcagccugcgguccugcccaccucccgugaugugugugugugugugugugugugugacuguguguguuugcuaacuguggucuuuguggcuacuuguuuguggaugguauuguguuuguuagugaacuguggacucgcuuucccaggcaggggcugagccacauggccaucugcuccucccugcccccguggcccuccaucaccuucugcuccuaggaggcugcuuguugcccgagaccagcccccuccccugauuuagggaugcguaggguaagagcacgggcaguggucuucagucgucuugggaccugggaagguuugcagcacuuugucaucauucuucauggacuccuuucacuccuuuaacaaaaaccuugcuuccuuaucccaccugaucccagucugaaggucucuuagcaacuggagauacaaagcaaggagcuggugagcccagcguugacgucaggcaggcuaugcccuuccgugguuaauuucuucccaggggcuuccacgaggaguccccaucugccccgccccuucacagagcgcccggggauuccaggcccagggcuucuacucugccccuggggaauguguccccugcauaucuucucagcaauaacuccaugggcucugggacccuaccccuuccaaccuucccugcuucugagacuucaaucuacagcccagcucauccagaugcagacuacagucccugcaauugggucucuggcaggcaauaguugaaggacuccuguuccguuggggccagcacaccgggauggauggagggagagcagaggccuuugcuucucugccuacguccccuuagaugggcagcagaggcaacucccgcauccuuugcucugccugucaguggucagagcggugagcgagguggguuggagacucagcaggcuccgugcagcccuugggaacagugagagguugaaggucauaacgagagugggaacucaacccagaucccgccccuccuguccucuguguucccgcggaaaccaaccaaaccgugcgcugugacccauugcuguucucuguaucgugaucuauccucaacaacaacagaaaaaaggaauaaaauauccuuuguuuccuaguggc

SEQ ID NO: 15967 - RNA, 1273 nt, Homo sapiens
cacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagag

SEQ ID NO: 15968 - RNA, 31352 nt, Homo sapiens
cuucccagcgaucccagggaaaagcgaaaaccuuuuggcuuugacagccgccgccacaagucuuuccgccuccccagcccgcccgggagcugcgagccgcgagcuggauuaugguggccugagcagccaacgcagccgcaggagcccggagcccuugccccugcccgcgccgccgcccgccggggggaccagggaagccgccaccggcccgccaugcccgccccucccagccccgccgggagcccgcgcccgcugcccaggcuggccgccgccgugccgauguagcgggcuccggaucccagccucuccccugcucccgugcucugcggaucuccccugaccgcucuccacagcccggacccgggggcuggcccagggcccugcaggcccuggcguccugaugcccccaagcucccucuccugagaagccaccagcaccacccagacuugggggcaggcgccagggacggacgugggccagugcgagcccagagggcccgaaggccggggcccaccauggcccaagcccugcccuggcuccugcuguggaugggcgcgggagugcugccugcccacggcacccagcacggcauccggcugccccugcgcagcggccuggggggcgccccccuggggcugcggcugccccgggagaccgacgaagagcccgaggagcccggccggaggggcagcuuuguggagaugguggacaaccugaggggcaagucggggcagggcuacuacguggagaugaccgugggcagccccccgcagacgguaagguggucaggccagcccuuagcccuccgccugcaugagcagaggggagacaggauggggaugccucaagcuagccccugcucaaaugggcugguggggacagcaggagggaccccuccccagccauuccccgggggucacgugguuguuggcagaaguguucccaagcuccccauucccuccucgucuccccuggcugccuaguuccccuugcuccucaucugacacauacgccgucuggaaggauuugaggcaagacagacacaucagcuggggacccugaccuggaggaaggguccgccacaggggcacuauaacaggugucagcccccucugacaguggcccaguccgagucucccaaaucccaccacucuagagguuggccacccaaccuuguccccuccucugauucccaccauuguucccaguaccuccaggaccaaggaauccuggcagcaguugaauaagcaccuugcucccaccaucugggcugccacugguacggcaaagugagguugucgaggccccccugacugcacuccgcccggaagcccuggacaggcuccugccguccccuccuccuccccuucucccucucgcggucuacacuccggccccucccccaccccacaccuccccaggccagaggggaacugaacugagccuggugaaagaacaaaugguaggaaaggagccagagcucccuuuuaagagugggacuccuuccauggcgggggagaggggaguuacagagaaaacacuguuaugcccuccccauccuuccugacaaucuccaagguaccuucaagguggcugguggagguggcacccucugcaccucugugggugagcagcccuccauguggggugcuguggcugaccucugugugcaucugccgccucuguggggcaguccgggcccgggcagcccugugguucuguguaugcuggugcgugucaccuugaaucugauccugcacaucugugagccaccuccggaucugugucugggaagucuguccuugggagggucugugaaggugggaguguguuuggggugggcggaggggacagccacacuuuccugaacuucucagacagcuggaucugggagaaacacaaacccccaccucccaauuacuuuacagaagccagccuuccuaggugcgugcuccccagcccuaccucucagcuagucgaaagccuggucuuccccacuuucucauccucuuuccugugcaccauaacuuccccagcaguagucuccagugggaauuugggagggcaggacagaagccaaauccaggcccugagcaaacagaacgcuagaugauaucgucagggagcagcagguaugcagagaccugggaccuacuccuguuucugcgacugacaugcugugcacacugugcauggaccccauggcacgaugcaggacggggcugcagaacccacacaagcuuugaggucagacaguccacgaaucccagcucuaccacccacagcuuuuccucuucucagcuguguggccuugggcaaauugcauaaccucucugaaacuacugucauaucuuuaaaaugaguaggaaaugagaccuccuuugcaagguaauugugaggauuaaguugugaggguuaauuguucuaggugcuuucacccagaacaauacaccagcauauaaaacugaccuccaacaaauaugaagucacuuuauccuugucuggccuguucugccucuucaauucuaugcaaugaggcauaaaaacucggauguccugggccuccacguuuuacauguauaaaacugggguauccuguaaucccagcacuuuggggggccaaggugggcagaucaccugaggucaggaguucgagaccagcuuggcuaacauagcaaaacccuguuucuacuaaaaauacaaaaauaauucgccgggccugguggcaugcaccuguaaucccagcuacucaggaggcugaggcaggagaaucgcuugaaccugggaggcggagguugcagugagacaagaucgcaccauugcccuccagccugggcaacaagagcaaaacucugucucagaaaaaauaaaaacaaaaacaaaaacgggguauccauugcuguacuucccugauccccugaaauaaugcauacauccugcagcccaguacuuagcagagaguaauugcucaauaaaugucaguuccuuccucguuccuuucuagaagaggaaagugggcuuaaaguucaacaccaguccaggaagcuagugccagggagcccacaacuaaagcaacuguguggcuugcacuaugauuucuaacuaagccugcaucagccagucucugcucucugguggcuuggacucucuccccaucugucuguaagaaggacgcccuuucuuccuaccuggcgcggcuguuguaagugccaaaugagaacuuggauggcauuguauucugaacaagaaaaaguaaaauuuggggagcacuuucucugugcuaggcaauuaauugguggugccugggggcugauccacaaagagacaagaagacauguuuucugcccacauagaguuacaguggaagugaaagggcggaagugacgaguacaaggucauccaugcagauauacucaaagcgaggucggcaaacccucauuggagucagcuaaaaauguaaauucccuggccccaucccugaccucuagagacaggaucucugacaguggggccccguaguuugugccucaaauuugagaaccauuuauggcuggacgcgguggcucacgccuguaaucccaacacuuugggaggcugaggccggcggaucaccugaggucaggaguucgcgaccagccuggccaacguggugaaaccccaucucuacgaaaaaugcaaaaauuaucugggcaugguggcaggcgccuauaaucccagcuacucgggaggcugagguaggagaauugcuugaacccaggagacagagguugcagugagccgagaucacgccauugcacuccagccugggugacagagcgagacuccgucucaaaaaaaaaaagaaaagagaauaauguauuuauaggagugcagagagugagugccacagguguucagaaagugauaaacucauccaggaaagccgcaccagggacaugugcucugagcauggucuugaaggauggacaggaguggcaggcuauucccagggggcagauggcaccauacuaucccacuguacuguaauugcacguuacacguauguccaugucugcuccuucccacccuacccccuuaaaauugggagaguccacagugaaugagaggaugaguuauggauguuagggcuuaagcaugguuguuuaggagacaauagagagccaguccuguuaauauuacagguuuaggcuaagaccagauaaguuuggguaaauaaaauagagccaaauagccauaaagcuuaaaugugagacuauaagguuuggacuuuggccuucagauauaagggaaaaucugaauuuauuggggcaggggaaugacaugaagaaagcaaucuuucaggaagagacaucugaauuuuaaaaagagugggggcugugugugguggcucacgccuguaaucccagcacuuugggaggccaaggcagguggaucacaaggucaggaguucgagaccaaccuggccaauauggugaaaccccgucucuacuaaaaauacaaaaauuagcugggugugguggcgcgugccuguaguuccagcuacucgggaggcagaggcagaagaaucucuugaacccgggaggcagagguugcagugagcugagauugcgccacugcacuccagccugggugacagagcaagacuccgucucaaaaaauaaauaaaaauaaaaagaguaggacugaaagacacaggcacagggggcugucacaacaguccaggugugaggcccucuaugacaaggagggcaugaggcugcaauaagauggaaagagaaaggaagggcaggaugcagagaacgugccagggcaggugggaaggauuuggugacauuggugugaagggaaaggaagagggcaucaaagaugguuuugagauucugaucuggggugaacuggaggauaacaagacugugggaauaggaaagguggcaggaggggauggcuuauaguacuuguauacaaauuuauuugcuuguuuauuaauuacagggucucucucuguugcccaggcuggaguacaggggcacaaucguaacuccugggcucaagugauccuccugccucaggcuccugaguaacuuggauuacaggcacaugccaccagccccagcugauuuuuucaaauugucucacuauguugcccaggcuggucuccaacuucugggcucaagugauacuuccaccuuagccuccuauuaguuuuucccuuacagcaauuccugcaauauauaaaaggucuuuacuucagugagcugugauugcaccacugcaaucuccagcuugucagaggaugacagagacccugucuccaaaaaagaaaaaaaaaaaaaaaggucuuuaucacucacagugucuagcagaagaaaugggguugaaagguuaaaccacuggccagguagaaggccaguaaguuaagaccuguuucauccuuguucuuccuacugugccauuugucuuggggaagaagaaguuaucacaagcaucccucuuccauucucccauuacaccugcuuauaucuccauuacuacacuuguaauguauuacaacuguuuuuguguuuguuucucucauaaaacuucaagcucuggccaggcgcaguggcucacgccuguaaucccagcacuuugggaggcugaggcaggaggaucaucugaggccaggaguucaagaccagccugaccaauauggugaaacccugucucuacuaaaaauacaaaaauuagccaggcgugguggcaggcgcuuguaaucccagcugcucgggaggcugagacaggagaauugcuugaacccaggaggcagagguugcagugagcugagauugcaccacugcacuccagagcgagacucugucucaaacaaacaaaacuucaagcucuuaaggacaaugucuuuuuaauuuuauuuauuuauuuugcaguauccucucuuuguguuauaauaaucuauaacaauaccaagcucagaacauacaccuaaaaaacauugagugaaugaauacauaagcugcaagccucuaaacagaacuguugacaggcaguuguaaaugcagaacuguagcucuuagagaaaguauuuuuauucuuuuaaacgaaagggccagguucagcagcucacgccuguaaucccagcacucaggugaggccgaggcggguggaucaccugaggcugggaauuggagaccagccugcccaacauggugaaaccccaucucuacuaaaaauucaaaaauuagccagguguggugcugcaugccuguaaacccagcuacucaggaggcugaggcaggagaaucgcuugagcccgugagguggagguugcagugagccgagauugcgccacugcacuccagccugggugacagagugagacccugucucuaaauaaauaauaaauaaauaaaaggauguuaucucauuuugauauuaugagcaucacugaccaaacauaggauaauaagguaacuguuaggagugaaauuuggugauagucaauucaguuuaacagauauuuguugaguacuugccuacuguguguagaagagaaaaauaaugccauagucuuagcccuuggacagcucacaaucugaugugagacauagacauaauaccuaaauauuacacaaaaccaaaugcauuugguacaaauagugaaacaguggaucuuggaagugcacagagagaagcagcuacuucugacaugguauuaggcacagcuugcuggaaaaggaggguuuuguuuuguuuuuguuuuugagagggagucucgcccagggauccacccgccucagccucccaaagugcugggauuauaggcgugagccaccgcgcccagccaaaacggagguauuugaaagaggagaaagcuuugcaauauggagaguggugaggaggagcacuucaugaagaaaagcgugaacuguggugagaagccagaaggcaugguggggaugccauggggcugacaggacuuuggguuuuauucugcaaacaguaaggaauccuuguagguauacgagaagagggaugauaucgucuaauuuuaguuccaggaaaacagcuucagugugcagaauaacuuggagagucuagcaucaugacucuagacaugcaaacaaggaucucaggauacgggggccugaaagaggaugguggcagugaggguagaaaggaggaaucagcauucauccaucguuuaaccaguuauucucugcgcuugaugagauguauggggugagagagagggaagaggagaugauggcuuuauuuaaccucucugacuuuuugucagggaacaaagcaacaggggaaagcuuuugaagcacaauauaguuuuuuuguuuguuuguuuguuuugagauggaguuucgcugugucacccaggcuggagugcaguggcgcgaucucagcucacugcaaccuccaccuccugguucaagugauucuccugccucagcuucucaaguagcugggauuacaggugcccgccaccacccccagcuauuuuuuuugguauuuuuaguagagauggggguuucaccauguuggccaggcugguuucaaacuccugaccucaagugaccgcccgccucagccucccaaagucuuaggauuacagguaugagccaccgcacccagccaggaaguacaauauaguuuaccaaaguuuauguuuauuauucugcuuuaauuauaagggauagguauuagcauaucuauuucagggauaaggaaacugagacccagagagacuaagugucuuguccaaagugauucuguuaagaagaacagaguagggguucaaauaccggggccuuuccuuccuguguucuacgaucugggacaugccuuugagaugcuagugggucauccucguggaaguauucagccaccagcugacagugggaaucuggagagaaguuagaacuggacaggcagacaggacucauccacagagaggccaaguuaaaaaauagacuuguucuuugagggaacagagagggaaaggagaaaaaugauuaggaaaagaauauuagguauagacaagggagcaagagaaaaugaucagagcaguagaaaacuaugagggcucagagucucagaaaccaagaaggaccaggugguuuuucuuuuuuuccucuccuucccugcuuggcaggguucuguaaagggaccucagcggugagggagaaggcugggagcagucaacacucuagauccccgcccuuccugucaccaagccauccccauccccccgccccaaaucuccugagcaucccaggauaacuuugcuuuuauuguuuuuauacaguggacuucuggguuauauuuuuuuaaaaaagaguuuuugcaauaaaaagguugaaaaccaucgagcucaaagaaccacccuccaaauuagacaaagccagcaagaccccggcuccauaaguugccuacccagucccugccaccacaacuggcuuuccuggauugggccucggguugcacacaagcccuugcuggagcacucauccugucauuccaaaccucuccucuacuccccagaccaguaaagaagaguuuagcugggagugagggggcauugagaaagacugugcucucucuaaaagcacuaagguggaaggucaggaacccuucuugggccucuccaauaaagggcugggcagaaaauuccaguugaaaauccagaaagaggccaggcacaguggcucacaccuguaaucccagcacuuugggaggccgaggcaggcagaucaccugaggucaggaguucaagaccagcauggccaacguggugaaacccugucucuaccaaaaauacaaaaauuagcugggcaugguggcacgugccuguaaucccagcuaaucaggaggcugaggcaggagaaucgcuugaacccaggaggcggagguugcagugagccaacaucaugccacugcacuccagccugggcgacagggggaagacuccaucucaaaaaaagaaaauccaggaagagaaacaccucccagggaagcccccauaccuaaugacuaacuucugucucuccugggagccuucucuuucaggugccugggcaggggagaguucugggaaggaaccagaacauuuucugaguucuggagcugcccugagauucuccuggcaggaugcgacagcaccugaguacauccuuaguaccgcagccuuggguacuauagccagguguuucccaaaauaggagagcugggcugugcuggggagaaugaggaaaucagcagaacuggggggauucugacgugggggagcugggacuccuagguccuuuuccucaaagcaaacuggccaagcucugccuccucccaugccaacuuauccucugucaccauauuuccugagcugcugucacucuggggccacccucucugcugcgcacuguaggcuggguguccucuugcuuggucuuucaaggucagugaaucucaucacuuagccuuuuuucuuuuuuuuucuugagacagggucucacucuguugcccaggcuggagugcgguggcgcgaucucggcucccugcaaccuccaccuccuggguucaagcaauucuccagcgucggccugccaaguagcuaggacuacgggcacgcacaaccacacccggcuaauuuauauauauauuuugguagagacgggguuucacuauguggccagaauggucucaaacuccuugaccucaagugauccgcccaccucagccucccaaagugcugggacuacaggcgugagucacugugccuggcccuaccacuuacucuuuuccaaggccuguggagguuuugacagguaggacaaggagugaguucuagcaucucccaauggcuugaauaaacaagcccaugugcugagcgugacacaggugccauggucagcuucauuuucaacugaggacagagcaagagaagauucaagccacuguaaccugugggugggacaagguuaaauaacaggaaggacuuacugucugaccaugaaaaacagguggcgaauagcugcugugauaccuuguggagcauggguuuuccagguggguuccgcagaggcuaaaggugcugaagagaugccucaagagccagcacaggcaggggagggaagcagaggaaaucaaaccuccccuucaaacagaacaccucugucuuuuucucucuuguacacuaggauccugcauacaauuggaaaaggggaaaaggauuccgcugcuuuauuuuuuauuuuuauuuauuuauuuauuuuugagacggagucucacucugucgcccaggcuggagugcaguggugcgaucugggcucacugcaagcuccgccuccuggguucacgccauucuccugcuucagccucccaaguagcugggacuacaggcgccugccaucacgcccggcuaauuuuuuguauuuuuuaguggagacgggguuucaccguguuagccaggauggucucgaucuccugacuuugugauccguccgccucggccucccaaagugcugggauuacaggcgugagccacugcgcgcggcugauucugcugcuuuagaaaaaaaaaaguuugaaaauuacugucauaaacucuuggaccaucgacauccaucauucuauuggaguaggaggcacuggcaaauauuaguugagccggguuacaggcugcggagaaauggggcaucccauccaaagggggaaagguauacuagauaagguuuggggcgacccagccacauugggacuccuugaaaaaccagccagaggugggguaaguggcgccagggagccugcuugcucccagguaccaauggccagcuacagccaggagaggcaaguggaaggcagaggaacuagcugggaaaaggaguccauuugcacagggcuggcugauuuguucaaggugggaggaaccuggacaggacccagucgcuggacucugagacaggagcugugugcucuguuggccauaagccccuccccgcugcugacuuuaggcuccucuuguccuuccuugcccccuuuucucagccuuggguaagcucaggucuggaaaucacuuaggaaaagcagaugaagcugacucacaagguucugggacuaaggaggccuggagucacuauaacugcucuaagaaccacaggacccuggguggauauucaccaacauggugaaaccccgucuguacuaaaaaugcaaaaauuagcugggcguaguggcgggugccuguaaucccagcuacucgggaggcugaggcaggagccaagauugcaccacugcacuacagccugggugacagagugagaacccaccucaaaaaaaaaaaaaaaagaauaggaagaguccauagggucauaggaauuaacugcagggaaugaggcaguugcugucaauuaaaaaaaaaaucauuacggagcaucuacucagggcuagguaacaauuagguaauaagcaauacaaaugcucccuacccuugguggagcucauagucugugggacaggcagacauuaaauacaugauuaaaagugugagugguagacaaagaagcacaggugcuacugaggauuugcaagaggaagaaccuaaucuuaucugggcgucaggacaagaccuuugaagaaaggauauuuaaaguguaaugugaacaugagaacagggaaagaaugcugcagacaaauauaugcaaagaugcacaagugagagaucaucgugcuuucgggaaacuucacaagaagccuggugaggaaagggaacuggcaagagauguucacgggguugaccuaugguuggugccuucagggucaaggaccccaggauuuaauucagauaguuugugucaguuaucugaugcuggguaacagacuacuccaaaauuuaguggcccaaacaagaaucauuuuuucaggauuccguguguuggcuuguaauuuuucuacagaucuuaccugggcucacccauguggcugcauucagcugguacgucagcugggggcuggacuaacccaggccuguugggccucugguucugugaagucuuucauuuggaaggaggcaagacugagcuacuucacacagaaucugaggacagcguuccaagagggcaauucccaaugcacaagugcuuaucaagccucuccuugcaucauuugcugauauccuguugcccacagccagucacauggcuaagcccagaaucacugucagaggggaucccacaagggcauguauggggggcagggugguucauuaguauaacaaucuaucacauacuuccucuccaaaugggagagacgggaaggucaaggagaugaaagaccacacuuaaggcuuggucagaaccaacggauucuuguccuagcuuuguggcauguguaagaugggugaaguugcuuacucacucuaggucucacuuuccuucucuguaaaauggaaggcuucuaaaucucaacuuuagcugaaagccuuguuaugcaagaauauaggcgucuucccucuuuagccaugaggcccacacagaagaaaauagacuuccuauugaauaggaagaagaauuggagcuagagcccccacuccagaggcuuuugcaaaagugcuaugaccuugggguaguaccaauaaaggguguggauucuuaauaaugagagaugguucagaauuggaaagagucuccaucucuccaggccacuaaacagaugccccuugaaggcguuuuucauccagaagaaucugagcuaucgcugucugcuggugagagcugaggccaagaaaggugggauuuggggaacaaagagcuuacccuaagcuugccagcuccauaccugccucaucacccaagaucuacugcugagaacugcaggggaacaugcagagugaaaccugggcaggugugccuuucccuguggggcuuguuagcacuucccaugaagcugccuucccucugaggcccccagggacacguuuguuuguuaaaugauugacauugaccuaguucugaccccaggcugcagcucccugggcaucugucuccugggucugccugaccccaggggacaaagacgaugacucccggaucacaggcugcguaaauacaggcaggugucaugccaggggccaggugagaggaaggcaggucuaagcuagagccacaccuauaaccuaaaacacccaugguuugggagccacugagagaucccuccaucccccaccacccaaaaaacaggguagauuagcucuuucaccuuuucuuuccuucaaccauucauucauucaagaaacauuauugcuaggcaccgugauaccuuaguagaacacuaaagacauuuuaauaguuuuaaauucgauaugaggggaggugagauucaguguauaauuacagagugacaaguucuauggaagauuuuauuuuauuuugagacaagguaucacucugucacccaggcuggagugcaauggcacgaucucagcucacugcaaccuccgccuucuggguucaagugauucucgugcuucagccucccaaguagcugggauuacaggugugcgccaccaugccuggcucauuuuuucguguuuuuaauagagacagaguuucaccauguuggccaggcuggucuugaacucuugacuucaaaugaucugcccgccuuggccucccaaauuguugggauuacaggcgugagccaccgcgccuggccuggaagcauuuaaguaagaaaauauaaccuggucucucucccuaaggaagucccuugagcucagauggcaggauguguaggggauaaguagauaaaccugcaaguggagaggaggaugguccaggcagagugaagcugauacaacagccuuugcgagagggaccauggcugguguggggaacugagauaucugaggucaguguggcuggcagcagagcuuuauggguuuuuugguugguuuuguuuuguuuuguuuuguuuuguuuuugagacagaaucuugcucuguugcccagacgggagugcaguggcgccaucucaucucacugcaaucuccaccuuccagguucaaacgauucuccugccucagccuuccgagucgcugggauuacaggugccugccaccacacccagcuaauuuuuguauuuuuguagagaugggguuucaccauguugcccaggcuggucuggaacuccugaccucaggugauccaaccaccucagccucccaaagugcugggauuacaggcgugagccaccgcacccggccagcuuuacguuuuuaauagcaaaggaaaacuguuuacauaggaggguuaacagucaaauuugcacuuugaaaagaucacucuggcugcagugcacaaaacagauuggacaggucaagagaagaugugccaaaagcagcugggaaacuacugugauauuccagggugagcugaugauagcuuggccuagggacagcaaaagaaauaaggaaugaauacauucaagagacuuguaaggagcuuaauuggacaggacuuguugaugcacuggauagagaggugaagaagaggaagguguuaggauaugucugauacugcugaccuacagaacagaugggugaugcugccauccacuaguauaaggaacacuggaaggcagccaccagauggaaaggacugcguugggucagcuugggacauccugaauuugaccuuuuuuuuuuuuuugagacggucuuguucugucacccaggcuggagugcaguggcacaaucaugguucacugcaaccucaaacuccugggcucaagcgauccuuucaccucagccuccugaguagcagggaccacuggugcccaucaccaugccuggcuaauuuuaaaaauuuuguuuguagacauggaggugugugggagggggucucacuauguuguccaggcuggucucgaacuccuggccucaagugauccucucgccuuggccucccaaagugcugggauuacaggugucagccccugcacccagcccuugagguaucuuugaggcacuugggugcgugcgucgggagcucaaaggagaggaaaaagcuggaguuaggagcuuagacaucaccaggaucuagguagauggcuuagugggagagggucguuagagaggaagagggccaaagcucaagccuugagaaaggagccugccaaggagacagagaacacaggaccugagaagaugaaggcugacuugaaaaacaccuucaguguuuggugacaugaagucaccgguaacuguaguaagggcuguuuuauaguggaggaauggaggcgaaacccaguuuuagaauggguugaggaaugcgugggaggugaagaaauggagacagccuggcugagcgcuuugguugugaagggagaggagagaggggacuggaggcggaugugagauuaaggaaguuuuuuguuuuguuuuuguuuuaaugaagagaugagcaucuguaaaugucaacaggaagaauucagauuugguggagauggggccagggugggguggcuguaucuaugugagggaaaagggccaaggaagaggugggugccugggaagggaggagggacuugacuccccagcacagguggcagcucaugaggagccuggaaggggcagccgcaggcagguuggugugguuggcugugggagaugagggcagucucauccccuggcccaguucagugacccgagaggggaacccagcugcugggguucggcggcugcagccccuccaccgcugccucugcccaggccgcccugaacugcccuguuucauaaugagcaagcagugccucagccuugccucgggcccguccuguuaagagccccccccauccccccgcuuggaauggagcagggguggggaaaaggcugccgggacuggccagggcucccauucgaagcgcugaaggacaggaccagaauuacuucucucgggcgggagcacaccgcagagggcagacgggucgacauuugcucgggagagaagcccaacuguuuauucugguuuucuuuuguguguguguguaagguggagaggggaggcagagagcaguggggaccugaaaucguaguauuggggugggugagagggaugggaguggagggggacguuccuuccugggcucggccuggcccccuuugggguggcagggggaaaggcuggggcuggaaggacagcaagagcgcccagggccucagggcuggggugggaguacccugcagagagcucccuccugccucgcaggagaggaagggggaggcagggaggggcagggacagcaggagcccccaggucaaagcuccacuccaguguaaagcaguagccauauuugcuuagaacuugccggauguucccucccuugcacaggccacagagacuuguuguggaggagauccucuuucuuugggguccagugauagcagggagcccuguaauaugaggccagccccccaugcugggagcugaguccugagaauggggaagaggguucguggggagagggugggugaagaagccuucuuaaucauuaaccugguugauuucaucugaacugcugagccucccagcucuauugauuuucucugaaagcacagcaucuggagcugguggcugcccagagaccggggagagagaccacggguagagguaggggaagaggggcagggaggggaauggaaaccaggccaggaguggggggcugggaaggagggaggagacaaggucugagggccgggagauugucagaggagucuuuggggaugugaggaggccaggaggucuaagcaggcacugggggagggcacagucagcacagccacagaggcaccacggagagcaggaaggagccagagaggaucuggcagagaggacgaaacugaaguccagagaagcacagugaucugcucaaggugacagggucagggccugcaccaaaacugaggucaguugauuucacuggacugaggagagaagauacagaaaugaaggccccuggggcagaggagaaccugaggugauggaaagucggcaagaggcgagaugcaacuuacaaauuaccauuuuucugaggguggggccuuuccuuuuuuugccugugaggauauaguagacuuucaaaaaauggcucuggucugacugaagguggggucaggccaucaaaggaggaagaaagggccaaggagaagugaugcuagaggccgggcaugguagcucacgccucagcacuuugggaggccgaggcagguggaucaccugaggucaggaguucgagaccagccuggccaacguggugaaaccucgucucuacuaaaaauacaaaaauuagcccugcgugguagcgcacacuuguaaucccagcuacucaggagacugagacaggagaaucacuugaacccaggaggcggagauggcagugagccgagaucgcgccauugcacuccagccuggguaacaagagcgaaacuccaucucaaaaaaaagaagugaugcuagaaagagcuggacagaagggaacaccaagacaccuguccaucuucacuuagccaaauccagggcccugacaagauggguuuucaccaggacauuuuauggggcuccuggcuccccacuauuucugacaguaggauuccuaggucugugucaccugugagacagaaggggagccacauucugguggcagggacagaaccacacgcauggacacugaugugccauccugguccccacagguccccugaccaguacagcuccuagaauaggucuucucugagcuggaggggauaagccagacugcuuccugggagaauugaaaaggagcagggggcccugaagacagaaucagucagguacacagugagcaggggugaugugacgguagagagacaugggaacagagacagcacacacaccacauagcucugagaugacgcacaaaauguuaugacuccauagacugaagcagacacagcguuucuuuucuuuucuuuuuuuuuuugagacggaguguugcucucguccaggccggagugcagugguguaauuucggcucacugcaaccuccgccuccuggguucaagugauucuccugccucagccucccaaguagcugggauuauaggcgugcgucaccacacccggcuaaucuuuguauuuuuaguagagaugggauuuuacuacauucaccaggcuggucuugaacuccugaccucaagugauccacccgccuuagccucucaaaguguugggauuacaguugugagccacugugcuggccucagacacagcauuucuaaggccauguugagggugccaaaggaaaccaagauauuuuaccccagaauauacuacuuugacguauuuugagucggcugucagagggccagcacacagaaguggcccugcaaaucuggcuuuugagggagauuugcaucugcagagaaucugcauugaugcaaccuggcuuucucugaggcccucccugguccaaaucuaggaaagauuaacugaaagucugacauguuuaaaggucugaaagacacauacaucaccuguuuucucugagggguguuaccuaugagguuucauucauauaaaaagaccacuuuuacuggccuggccuccguuuaucccucccauaacuauuuuugccaaaguccaagucccuuuuuuuuuuguuguugagacagggucucugucgcccaggcuggagugcaguggcauggucucaguucacugcaaccuccaccucccagggucaagugagucucaugccucagccuccugaguagcugggacuacaggcaugugccaccauguccagcuaauuuuuguauuuuuaguagagacagaguuucguccuguuggccaggcuggucucaaacuccucaccucaggugauccaccugccucagccucccauagugcugggauuacagggguaagccacugcaccuugcccaagcucccauucuuucuguaaccucaagaugguauaaaaucaucaaccaucuggcuaucucuuugacuuccuauauuuuuuugacucccuugcauauuaguucuucuacuaaucugccuuuuuucaguugguuuuucagcagaccugcagagggcacaggggaaguguuccuuuggccccugcagcaccacaggaccccagguccugucuguggucguggugguaacgggugccagccuggaccaguccugcaucguggagcuucacucuggacauucuaaggggcagacuguggcuggggcgugagggauaauaaagguggugugaccgaagccuccugucuauacugucuuuucucuccccuuucucugacagcucaacauccugguggauacaggcagcaguaacuuugcagugggugcugccccccaccccuuccugcaucgcuacuaccagaggcagcugugaguccuggggagagcccgggggaaguaccuuuuccaaggauccagggcuaagaagggucaggggagggguacagagagaaagaguugauccucagauuuucuucuugccagggaaggggaagggcgaaaaaaagacagugaccaggagagacagggugaaguggguggugagaggagcuauaccaugggaaagggugaauugagagguagccaggaagugcuucagugcugagacagggcagccuccugugggagggaaaggaagaagagcccauagcucacagaacaaucuuagggggcccauuuucucugccugaauggggagacgaaaaccccacauccccucggugucucucaguucucuaacaccagcuaagucuaagcugaacaggccucagugacggcuccccuugcuguguucuuacccaggggccacucuagguggcuuugcauaguccaaggacaugaaggaaagggucuuucauaaaccccucugccuagaccaguaucagaacugaaagcugaaauaucuccuccaugcaccacccagggugccaccaguuggauucagcuuacuggugaaagggggguugaagaggacuggugaaagugggggacuggugaaagggggguugaagugggcuuuaagauaagaggcagugagggguaaucuggaagcccccuuagcauaaaagcaggaagaagaagggaugagaggacaccaauaucugagacaucagugugugcaaacgugaguagaggcuuaaauccuauccuuggacuuguaggcagcugcaaaacgcaccuucccuguuuccucuaaugucccaaucuaaaagaagcagucagggaggagggugcagguaggaucgaugaaagggcauucacuccaguuccucguuccaguuccaucacugcccccaccacacacagaagcccugguuaguggugugauuaaacacagguggggcugccacauguugagcacguuucacagaagugguguguaauaccaaccugcuuuucugagaugcuugaacaaaccccuucucuagaacuugcuguagagguuccacauucacccugccuggcacuuucucuaccacucggaugguaccacuagguuccaaggcaguaagagagucaaugguuccuuuucucggggagcuugacggagccagagggcggaagagaugcccacuagcugucccugcagcagcagcagcagcaggcacaaugcacaaagcccaggcuuguucuucacagggccugagcucaagaucuaggaauaugagcaauagauaggagagcaagccucaccaaugguucccuucaucuaucugcaagcccacuuuacacucuguucuggguggugagucuagggauguuuugcugagcagccugaaagcagacucuaggauuccccugagaugagauaaggugguguuugggaguaaguuuaacuuagauccuuauaccaguugugguuaugcauccacagaucucugccuucuuuccacagguccagcacauaccgggaccuccggaaggguguguaugugcccuacacccagggcaagugggaaggggagcugggcaccgaccugguaagcaucccccauggccccaacgucacugugcgugccaacauugcugccaucacugaaucagacaaguucuucaucaacggcuccaacugggaaggcauccuggggcuggccuaugcugagauugccagggugagaggaacagggcuuggcccuacacacucuaugcacacugcacuauacagagaaggaauuaggagagagaaggggaauuagcagaaggagggcaacaaucaguuuaaaggauuauuuaacagggguauaggguggcagucuaaauuuuagcccuauagagggcagaaccauagugacagaagcugugauagguacaagaauaggcugugcuuucuauguacucuuaagaucuuuuuuuuuuugagacggaguuucacucuuguugcccaagcuggagugcaauggugcaaucuuggcucacugcaaccuccaccuccucgguucaagcgauuuuccugccucagccucccgaguagcugggauuauaggcgcccaccaugacgcccggcuaauuuuuucuauuuuuaguagaaaugggguuucaucauguuagccaggcuggucucgaacuccugaccgcaggugauccgcucaccucggccuuccuaagugcugggauuacaggcaugaaccaccgcgaccagccacucuaagaucuuuaauaaaggcccccauaaauuugaagcagguuaggcauagggggaucaaagauauaugaaccuggccaggcgugguggcucacaccuguaaucccagcacuuugggaggccaaggcgagcggaugaccugaggucagaaguucaagaccagccugaccaacauggugaaaccccaucuaccccaucucuacugaaaacacagaaauuagccgggcauguuggcgcaugccuauaaucccagcuacucaggaggcugaggcacgagaaucacuugaacccaggaggugaagguugcagugagccgagaucguaacauugcacuccagcuugggcaacaagagcaaaacucugucucaaaaaaaaaaaaaagaucuaugaaucugugaaccuaucaauacuguccuguuugcauugccagggcuccugcuaacccuuccucugccaaaucucagugccuuaagauggucuuucccaaggagcaucccccaagccuucaaauuugccuuccaguuuagacaggaagcuggccucugccuuuagggccguaugaggacucacuccuugucucuuucugccaaagccugacgacucccuggagccuuucuuugacucucugguaaagcagacccacguucccaaccucuucucccugcagcuuuguggugcuggcuucccccucaaccagucugaagugcuggccucugucggagggagcauggugaguagguccucagagaggggagguccuggcauugagggagagaugggugccauccucuccccuuccugaaagcuacaccacaguuuuggcuccgauacuuagaaucaggaggaaccucuuuauauucccuacccuuacuuuauuuuuccauucuuuucuuuuuugcguuauuccagaaaggaaucaaggcaccuaugguaaacuuggaaaggaaggcaauuaggaaaauuucaaaggaaaugaaaauaagaccuguugaauuaaaauuauucaguuugauggucagaaggcagagauauaagaaguuugucuauuuauuaauuaauuagaacaauggugaaugguucuccaauaagcagagaaaauaaaacuuauaauauaaacaaauaaccauucauucaacauuuauuguggcaguuuagauuuaaauaacuuuauaucaagggcuguaugauucugaaacaaauaauuaaaaaucccggaaagucuuuucuccugaacacauuuaagaaacuagaaaucacuuuggguaugauuuguuuagaagcaggaagaugaaaaggguagccuguagaagaccuugccaccccaagaaaucacugaucuuauugcuugguccuugggggacucacucuccuucugugccaggacacggguaccugccucuuuuuuucccuagaucauuggagguaucgaccacucgcuguacacaggcagucucugguauacacccauccggcgggagugguauuaugaggugaucauugugcggguggagaucaauggacaggaucugaaaauggacugcaaggagguaagaaaaccaagggagagccugggaacauaaggggguaggcaguacaaugugaaggaagacucugguuaucauguugggaggaugaggcagagguaauaggaccugcagaaaggguuggaaguugagccuagaacagucaggggcuuaauggucacacagcaggaucugcgguuuggggccuagggacugguagugaaaaaaaaaacauggaacuaguucugaugucuggacucuagucacugccuugcuucguagccuugggcaagucuuuugugagacagggugauagaaugaagagucuugucuuuggagucaggaagacccagaucugaaucuagcucugauuuguacuagcuauguacccuuaggccaguuacuauucugugucucaguuuccuuaucugcaaaacagguaaaaacaacuuucucagaauaucagagauaauguguaaaguguuuaucucugugguuggcaguacucaauaaaagguaacuaaaucauuuaugucuuccuucccuagauucuuauguauguuaaauuagaauagauauaaauguacuaagaaaaguuaaaagcggccgggcguggcuguaaucccagcacucugggaggccaaggcgggggcagaucauuugaggucagaaauucgagaccagccuggucaacauggugaaaccccaucucuacuaaaaauagccaggcgugguggcaggcaccuguagucccagcuacuugggaggcugaggcaaaagaaugguuugaauccaggaggcagagguuagagugagccgagaucacgccacuguacuccagccugggugacagagcuaauacuccaucucaaaaaaaaaaaaaaaaaaaaaaaaaagaaaagaaaaguuaaaagcacuaaacaagguauuuuuauuuucaaguuuggagacuaccugcccacccaagauuaacaagaauaaacauuuaccaagugccuucucucugcugggcacgauucuaagugcuuuacauugcugauuuauuuaauccuuacaauaacccuuugagguaggugcuauuuuuauccucacuuuagagaugaaggaacugaggcacagagguuaacuuguccaagcagguacacuuaggaggugccaaagccaagaugccaacccagcuggggccccagcaguaacccccuacugcccagagcccagcaucaaaaaccuuuugacucuuuuaacucucucuuuucccucuuaguacaacuaugacaagagcauuguggacaguggcaccaccaaccuucguuugcccaagaaaguguuugaagcugcagucaaauccaucaaggcagccuccuccgugaguggacuaaggauggggguaaaagagaugguacagugucagagggaggcggugagagucacauucuucagcaacagccaagaugucugcacuuagacccuucuacucagagcucuuaaaacacucuuccccuagccaggcgugguggcucacgccuguaaucccagcacuuugggaggccaaggugggcagaucacuaggucaggaguucaagaccagccugaccaacagggugaaaucccaucucuacuaaaaguacaaaaauuagcugggugugguggcgcacgccuguaauccuagcuacucagggggcugagacaggagaaucacuuuaacucaggacgguggagguugcggugagccaugauugcgccacugcacuccagccugggcaacagagugagacacuguuucaaaaaaaaaaaaaaaacucuuccccuuuauggcugucacuuugcucaucacacaaucccccgguacaaaaguuugacaucacacucccucucucuuccuguaauccucugguugguuuaccccuccccacuuuagauauuucacuggaaaagcaaaugaagggcccaguuaauguaucugaacaugggaggggcgagaugauaaagaggcuuuuccucauuguuauccccuucuugccaacacagacggagaaguucccugaugguuucuggcuaggagagcagcuggugugcuggcaagcaggcaccaccccuuggaacauuuucccagucaucucacucuaccuaaugggugagguuaccaaccaguccuuccgcaucaccauccuuccgcagguaugucccagccugagucagggggaucucucuuaaaaguacacacugggagacagugagcagguauggcuugccagaacuuggaagacaaaacagaugaguaguguccagcaguaaaggggucucagaaaacccguuagagcucagggaugguaaagggaagggcauagaugccuacaaggcagagauggggugaaggagagugaggaagacacucacccugugauugcuuaccccuagcaauaccugcggccaguggaagauguggccacgucccaagacgacuguuacaaguuugccaucucacagucauccacgggcacuguuaugggagcuguuaucauggagggcuucuacguugucuuugaucgggcccgaaaacgaauuggcuuugcugucagcgcuugccauggugagagugccagggcugaggguuuggggucagucucuccauauuuuccuugucaaacaacaguuaguauaccugggucccugucaguuuaggggaggguaguaacaguugccucaaacccaagucaacaguugugcaaaagcuagugucaaugcucguccuuuuuuuguacugccugccauaaugaccacugccuggauugguaaccucuguuggaaacccagagcagcaagaguuaccuggguaccuugggaagcucuugaugcaaggguagcagacugagucuauagugacccugucagcugccacauggugaggcugaaugcuacuucagaaagguggcaggguuuugcaguuggauuucagcagcagaaaguuaaguuuacuagauuuggcuuuuggucaaggggguggcuuuuggucaacucagaacuacugacuuuuaguuaucacuccuaccagcuggguauacaaggaagggcugcugcucccagugacuugggaagggagacaggccucuaccuggugcuggcuucccagccugcuccuaaauaucuccugggaaggagauuagauaacuucugcaugggcuaauuucaaggccucacuaucaggaaguucuuuuuguuaacuccucuaugacaaugagagcuguccauucacauuugcccucuccccagugcacgaugaguucaggacggcagcgguggaaggcccuuuugucaccuuggacauggaagacuguggcuacaacauuccacagacagaugagucaacccucaugaccauagccuaugucauggcugccaucugcgcccucuucaugcugccacucugccucauggugugucaguggugcugccuccgcugccugcgccagcagcaugaugacuuugcugaugacaucucccugcugaagugaggaggcccaugggcagaagauagagauuccccuggaccacaccuccgugguucacuuuggucacaaguaggagacacagauggcaccuguggccagagcaccucaggacccuccccacccaccaaaugccucugccuugauggagaaggaaaaggcuggcaagguggguuccagggacuguaccuguaggaaacagaaaagagaagaaagaagcacucugcuggcgggaauacucuuggucaccucaaauuuaagucgggaaauucugcugcuugaaacuucagcccugaaccuuuguccaccauuccuuuaaauucuccaacccaaaguauucuucuuuucuuaguuucagaaguacuggcaucacacgcagguuaccuuggcgugugucccugugguacccuggcagagaagagaccaagcuuguuucccugcuggccaaagucaguaggagaggaugcacaguuugcuauuugcuuuagagacagggacuguauaaacaagccuaacauuggugcaaagauugccucuugaauuaaaaaaaaaaacuagauugacuauuuauacaaaugggggcggcuggaaagaggagaaggagagggaguacaaagacagggaauagugggaucaaagcuaggaaaggcagaaacacaaccacucaccaguccuaguuuuagaccucaucuccaagauagcaucccaucucagaagauggguguuguuuucaauguuuucuuuucugugguugcagccugaccaaaagugagaugggaagggcuuaucuagccaaagagcucuuuuuuagcucucuuaaaugaagugcccacuaagaaguuccacuuaacacaugaauuucugccauauuaauuucauugucucuaucugaaccacccuuuauucuacauaugauaggcagcacugaaauauccuaacccccuaagcuccaggugcccugugggagagcaacuggacuauagcagggcugggcucugucuuccuggucauaggcucacucuuucccccaaaucuuccucuggagcuuugcagccaaggugcuaaaaggaauagguaggagaccucuucuaucuaauccuuaaaagcauaauguugaacauucauucaacagcugaugcccuauaaccccugccuggauuucuuccuauuaggcuauaagaaguagcaagaucuuuacauaauucagagugguuucauugccuuccuacccucucuaauggccccuccauuuauuugacuaaagcaucacacaguggcacuagcauuauaccaagaguaugagaaauacagugcuuuauggcucuaacauuacugccuucaguaucaaggcugccuggagaaaggauggcagccucagggcuuccuuauguccuccaccacaagagcuccuugaugaaggucaucuuuuuccccuauccuguucuuccccuccccgcuccuaaugguacguggguacccaggcugguucuugggcuagguaguggggaccaaguucauuaccucccuaucaguucuagcauaguaaacuacgguaccaguguuagugggaagagcuggguuuuccuaguauacccacugcauccuacuccuaccuggucaacccgcugcuuccagguaugggaccugcuaaguguggaauuaccugauaagggagagggaaauacaaggagggccucugguguuccuggccucagccagcugcccacaagccauaaaccaauaaaacaagaauacugagucaguuuuuuaucuggguucucuucauucccacugcacuuggugcugcuuuggcugacugggaacaccccauaacuacagagucugacaggaagacuggagacuguccacuucuagcucggaacuuacuguguaaauaaacuuucagaacugcuaccaugaagugaaaaugccacauuuugcuuuauaauuucuacccauguugggaaaaacuggcuuuuucccagcccuuuccagggcauaaaacucaaccccuucgauagcaagucccaucagccuauuauuuuuuuaaagaaaacuugcacuuguuuuucuuuuuacaguuacuuccuuccugccccaaaauuauaaacucuaaguguaaaaaaaagucuuaacaacagcuucuugcuuguaaaaauauguauuauacaucuguauuuuuaaauucugcuccugaaaaaugacugucccauucuccacucacugcauuuggggccuuucccauuggucugcaugucuuuuaucauugcaggccaguggacagagggagaagggagaacaggggucgccaacacuuguguugcuuucugacugauccugaacaagaaagaguaacacugaggcgcucgcucccaugcacaacucuccaaaacacuuauccuccugcaagagugggcuuuccagggucuuuacugggaagcaguuaagcccccuccucaccccuuccuuuuuucuuucuuuacuccuuuggcuucaaaggauuuuggaaaagaaacaauaugcuuuacacucauuuucaauuucuaaauuugcaggggauacugaaaaauacggcagguggccuaaggcugcuguaaaguugaggggagaggaaaucuuaagauuacaagauaaaaaacgaauccccuaaacaaaaagaacaauagaacuggucuuccauuuugccaccuuuccuguucaugacagcuacuaaccuggagacaguaacauuucauuaaccaaagaaagugggucaccugaccucugaagagcugaguacucaggccacuccaaucacccuacaagaugccaaggaggucccaggaaguccagcuccuuaaacugacgcuagucaauaaaccugggcaagugaggcaagagaaaugaggaagaauccaucugugaggugauaggcaaggaugaaagacaaagaaggaaaagaguaucaaaggcagaaaggagaucauuuaguugggucugaaaggaaaagucuuugcuauccgacauguacugcuaguaccuguaagcauuuuaggucccagaauggaaaaaaaaaucagcuauugguaauauaauaauguccuuucccuggagucaguuuuuuuaaaaaguuaacucuuaguuuuuacuuguuuaauucuaaaagagaagggagcugaggccauucccuguaggaguaaagauaaaaggauaggaaaagauucaaagcucuaauagagucacagcuuucccagguauaaaaccuaaaauuaagaaguacaauaagcagagguggaaaaugaucuaguuccugauagcuacccacagagcaagugauuuauaaauuugaaauccaaacuacuuucuuaauaucacuuuggucuccauuuuucccaggacaggaaauaugucccccccuaacuuucuugcuucaaaaauuaaaauccagcaucccaagaucauucuacaaguaauuuugcacagacaucuccucaccccagugccugucuggagcucacccaaggucaccaaacaacuugguugugaaccaacugccuuaaccuucugggggagggggauuagcuagacuaggagaccagaagugaaugggaaagggugaggacuucacaauguuggccugucagagcuugauuagaagccaagacaguggcagcaaaggaagacuuggcccaggaaaaaccuguggguugugcuaauuucuguccagaaaauaggguggacagaagcuugugggguacauggaggaauugggaccugguuauguuguuauucucggacugugaauuuuggugauguaaaacagaauauucuguaaaccuaaugucuguauaaauaaugagcguuaacacaguaaaauauucaauaagaagucaaacuacuaggguuacuuuuuuuuccucaaucagagucucauuuuauccauuuggaguagaguggcuaaaacaauacugaggcuucuggaggcuuucgguaagcaaggcaucugguuggacagugggugagcaccaggcuuuaaaucugcauacaugagccuuaaggaaauggacuagaggcugagccaaaccaaagcagaauggccuuagagcaacagcagguuccuaggugguuuuuauauuguauuugaaaacagcccugggcagggauaucauaauuucaaggccaaacuaaacaucaucuucccuacaaucugcaucccccaaaggaauugcaagaugagggggaacagacuguuucugcauaauauacauaguuucauuuacgaacauuggaauacagacuuucuauacacacauuaccuauauaauaaaaauguacauggcaugaguauaugucacuguauaaauauagaguuuuagaaaucuugaacccgcgcuuccuguucacaucaguuucucuucuucuuccuccccagucagguccgucauuuaagaguuggacaaaagggacaagugucauuuguguuggucugggcccagaauuugauacacuggaaagaaagaaagacacaccucagguuuaucuggaaaaacaaagggaaggaaggagagaaugccaauaagguucaacaaggccuaagucagaaaaguucuuacacugagguacaagaggggcu

SEQ ID NO: 15969 - RNA, 2677 nt, Homo sapiens
uugacucuuuuaacucucucuuuucccucuuaguacaacuaugacaagagcauuguggacaguggcaccaccaaccuucguuugcccaagaaaguguuugaagcugcagucaaauccaucaaggcagccuccuccgugaguggacuaaggauggggguaaaagagaugguacagugucagagggaggcggugagagucacauucuucagcaacagccaagaugucugcacuuagacccuucuacucagagcucuuaaaacacucuuccccuagccaggcgugguggcucacgccuguaaucccagcacuuugggaggccaaggugggcagaucacuaggucaggaguucaagaccagccugaccaacagggugaaaucccaucucuacuaaaaguacaaaaauuagcugggugugguggcgcacgccuguaauccuagcuacucagggggcugagacaggagaaucacuuuaacucaggacgguggagguugcggugagccaugauugcgccacugcacuccagccugggcaacagagugagacacuguuucaaaaaaaaaaaaaaaacucuuccccuuuauggcugucacuuugcucaucacacaaucccccgguacaaaaguuugacaucacacucccucucucuuccuguaauccucugguugguuuaccccuccccacuuuagauauuucacuggaaaagcaaaugaagggcccaguuaauguaucugaacaugggaggggcgagaugauaaagaggcuuuuccucauuguuauccccuucuugccaacacagacggagaaguucccugaugguuucuggcuaggagagcagcuggugugcuggcaagcaggcaccaccccuuggaacauuuucccagucaucucacucuaccuaaugggugagguuaccaaccaguccuuccgcaucaccauccuuccgcagguaugucccagccugagucagggggaucucucuuaaaaguacacacugggagacagugagcagguauggcuugccagaacuuggaagacaaaacagaugaguaguguccagcaguaaaggggucucagaaaacccguuagagcucagggaugguaaagggaagggcauagaugccuacaaggcagagauggggugaaggagagugaggaagacacucacccugugauugcuuaccccuagcaauaccugcggccaguggaagauguggccacgucccaagacgacuguuacaaguuugccaucucacagucauccacgggcacuguuaugggagcuguuaucauggagggcuucuacguugucuuugaucgggcccgaaaacgaauuggcuuugcugucagcgcuugccauggugagagugccagggcugaggguuuggggucagucucuccauauuuuccuugucaaacaacaguuaguauaccugggucccugucaguuuaggggaggguaguaacaguugccucaaacccaagucaacaguugugcaaaagcuagugucaaugcucguccuuuuuuuguacugccugccauaaugaccacugccuggauugguaaccucuguuggaaacccagagcagcaagaguuaccuggguaccuugggaagcucuugaugcaaggguagcagacugagucuauagugacccugucagcugccacauggugaggcugaaugcuacuucagaaagguggcaggguuuugcaguuggauuucagcagcagaaaguuaaguuuacuagauuuggcuuuuggucaaggggguggcuuuuggucaacucagaacuacugacuuuuaguuaucacuccuaccagcuggguauacaaggaagggcugcugcucccagugacuugggaagggagacaggccucuaccuggugcuggcuucccagccugcuccuaaauaucuccugggaaggagauuagauaacuucugcaugggcuaauuucaaggccucacuaucaggaaguucuuuuuguuaacuccucuaugacaaugagagcuguccauucacauuugcccucuccccagugcacgaugaguucaggacggcagcgguggaaggcccuuuugucaccuuggacauggaagacuguggcuacaacauuccacagacagaugagucaacccucaugaccauagccuaugucauggcugccaucugcgcccucuucaugcugccacucugccucauggugugucaguggugcugccuccgcugccugcgccagcagcaugaugacuuugcugaugacaucucccugcugaagugaggaggcccaugggcagaagauagagauuccccuggaccacaccuccgugguucacuuuggucacaaguaggagacacagauggcaccuguggccagagcaccucaggacccuccccacccaccaaaugccucugccuugauggagaaggaaaaggcuggcaagguggguuccagggacuguaccuguaggaaacagaaaagagaagaaagaagcacucugcuggcgggaauacucuuggucaccucaaauuuaagucgggaaauucugcugcuugaaacuucagcccugaaccuuuguccaccauuccuuuaaauucuccaacccaaaguauucuucuuuucuuaguuucagaaguacuggcaucacacgcagguuaccuuggcgugugucccugu

SEQ ID NO: 15970 - RNA, 31694 nt, Homo sapiens
uuuguagcugaacagcagaacagagcacucugccuuuggggucucuggcaucacuggcagggagagggguggcugggccaggagcccaccucauccccagugcucagagaacuggguccucagaagugguccugcccccacuuuacacauaaggaaacagacgcaaggaggagagggaugcccaaugacgggcacuucgaugaguccgugugaacucuguuccgugugagcugcugcgcgcucagggaaugauugugagaagcggguggaggcuggagugggcagcaaagaacugacauuuugaggucaguuuuucacuccuuggucaagggcaggcucucucccuggucauuaccaggagccuggcuccgggcagcaaagaacugacauuucgaggagcucugcuaagggccaggcaguaugugagggaguucacagacaccgucccauuuucacagcccucugagguugguaacauaacccccacuucacagaugaggaacuccagcccagaaagccugucagcccugagaaaggaagggcagggcaucgggcugggcagcuggccugggaccaguggggugugauaguguuggcucugcuucccgcggguggggugccaguggggaggggucucaccagagagggagccgggggagugcgcuccugcguccauccucagaccagcgugucccucccaaccucugaccccucugaggccaggggauggguucggcuuccuuugguaccucuuuuggaagucucuucagacaaacacuggagagaaggcacagcacccuagggugacaucaguggacaggucaguuuccuguuccuguucccagccaccccugucugucugcccagggaccuaccugccuggcccacuccugcugccaccccucuccaugagugggacuccugagcagugccaggcccaggcccucaggguggcaguugcuggauggggccaggcuucccauucccuggcaggcagacucuuggcucuggaagaucccugggggacucugacuucuugguuacucaggcuacuccguaaggguagccuuacgagagcguaagggcaugaggggaagucgauggguagaccaggugucucugauuucucugaggaaaugcagcuucuuugccaagaacucuugggcuuugguggcuucgucgcccuugccuggggugggcgaguuuuagucucuucagcugcagaccagaagcugagcugaccugaaaagagcuggaguucuggaguucgggcuuccaggccagggccugcuucugggugagagugggagguaaugguugcuugaggcagaggcaguaaacccucacacccgcagcuggacaaaggcaccagcuggcuguauucugugggggcaauguggcuucuggaaggucucuccaguggcucuguagcuggucuuggcaaagaauguucuagaccaaggguugucaaacuacagcucaugggccaaauccagccugcugucugcuuuuguaaguaaaguuuuauuggaacaaagccauguucauuuguuacauauugucuauggcugcuuucacacugcaacagcagagaccauguguccugcaaagccuaaaauauguucugucuuauccuuuacaaaaacaguuuacugaccccugcucuagaccuccaaagaccugguauccucuuuccugguguucaaguucagagaggugucuggaguaggggcugagccuggccuggaugggcagugcugugacaagugucuaggauggccggguauccugcacagagcuagaaggcugccuggcacgggugaaagcagagcugcucccugacccucugccccucccuccuccacccuggccugcuuuagcuuuccccagacauggccaacaaggguccuuccuauggcaugagccgcgaagugcaguccaaaaucgagaagaaguaugacgaggagcuggaggagcggcugguggaguggaucauagugcaguguggcccugaugugggccgcccagaccgugggcgcuugggcuuccaggucuggcugaagaauggcguggugaguggcacccugggcuagggcgcuggggggcuggggugugccacccugugaguccugggccaaucccugagcugacugcuaagcugcguccuaugcccuaugccugguagauucugagcaagcuggugaacagccuguacccugauggcuccaagccggugaaggugcccgagaacccacccuccauggucuucaagcagauggagcagguggcucaguuccugaaggcggcugaggacuauggggucaucaagacugacauguuccagacuguugaccucuuugaagguagagaggaagaggcugggggaggaggugggcaggaggacagggugcugggacagggagagggaaugaccagaauaugccacaacuaggggugugcuugcccgcacacagcagggaugggauaugccgagaauaacacgccacgcucacagggcccacugagaggccucccuugaauuggggacaacucuuggcccugguuuggccauuuuuuugugagagacgggggcaggcccuggcuuggagucuuguuuauacguucuugauguucaucuccucucuccugucuucucacaggcaaagacauggcagcagugcagaggacccugauggcuuugggcagcuuggcagugaccaagaaugaugggcacuaccguggagaucccaacugguuuaugaaguauguggcccccagggagcuugggucuccgcauggggugggagguggcuuguucuaaggagcuugcgggaaggauuaggggaagcagauagccaagaaaggauaaagugagggucugggauggggaauaauggguccuuaauacuccuugaccccucccuuuccacccuccugcgcucagucucccuagccuaugaggcaagcuagauuagggaaaaaaagugcaacaggaaggcaaugggauugggcuaggacguaacagagggaucagaaaacggguggaaaacacacaguucuaccaagucuuuauccugguuccuccucuucuaggaaagcgcaggagcauaagagggaauucacagagagccagcugcaggagggaaagcaugucauuggccuucagaugggcagcaacagaggggccucccaggccggcaugacaggcuacggacgaccucggcagaucaucaguuagagcggagagggcuagcccugagcccggcccucccccagcuccuuggcugcagccaucccgcuuagccugccucacccacacccgugugguaccuucagcccuggccaagcuuugaggcucugucacugagcaaugguaacugcaccugggcagcuccucccugugcccccagccucagcccaacuucuuacccgaaagcaucacugccuuggccccucccucccggcugcccccaucaccucuacugucuccucccugggcuaagcaggggagaagcgggcuggggguagccuggaugugggccaaguccacuguccuccuuggcggcaaaagcccauugaagaagaaccagcccagccugcccccuaucuuguccuggaauauuuuugggguuggaacucaaaaaaaaaaaaaaaaaaucaaucuuuucucaggccuggcuggcagaguuugauuugcccuggucacuuuuguuaugguuucagaucugcgcaggggacaggcaggcaucucgggcuuguauguguuccuggcugccguccucugaaggacccuucaugugccaagauuccaggacagucagauucuuucagaggaaacaggccauagaacaggagagugaaucuuggggaccgaagggaaaaaggagccacucagcagcaugcaguggcuuuggggagacagaggaaaggagagauugcgaguggcagaauuguuuggaagguuuuuauuuuggaaaagcugugcagaaaaaaauucaagaaaauguugcugugaaaagagaaaaacaaaucuuaagcauuaaaaaaaauucaaccaacuagcucagaagaggggagaaggccaagguugagagaagagucacagccugucaggcagauagcuggccuccggcgggaaggccauuucccugagcacuugcagaggaagacagggugguggcaggacuggaguggcaguggcucccaaggcucucuccuccaacaugugcaucugccaucugcucugcaguccugccgcaggauucccuagugaagcagcucaggccugggggagccguguguaucccagcugugccggcagcaucauaccaaucguggggguggugaaggagccagggguucauucaugguugguuucugaucaggcaucuugggaauggauaauggaggcagccgcuuucaggacaggcauguccaggggcuccucccagccucuaccccgaaguccucuucccaagugaccccagugauguuuccauugagaugcgcuccuggcuauggcaggcaccuucucaacuuauaugugggaaggggucccccaugcuugggggaccuaggcagcuggcuuggcccaagagagaugaggauggaggccaaaccaaaggggggcgccaauccccuguccaacaccuucucaccaaaagcucccguuuggcuggaggcagacccuguggcucugaccagacuucucuggcagcaauccuccaccauuuguaucuuaagaaggcccucacccucuuugaguggagucagaggaugccucagauuccagauguaagcaucagaacugcuuucugucaagagcucccuaauuuugggaaagaagagccugucccacacugucaggcccugaggucagcagaucugcuccuccuucccgugcgguacgucuaggugcugaugagggcaguccagggcgcucuuguucugggacaggcuccaguccccuugcuccagcaggucuggggcaaggaggucagagguggugggagggccccugcucucuguuuccacuucgucuggauccuugcugcugcaaaguggcacugauucuagcucugucccuuccuccuuggcuuuccggcuccgauggggccaguggcaggguccacuccuacaaacuugauuggaagccacauuccucuggcucaaauauacuuccagcauguaguaaacaguccagaagacggugaaacagccuaccagcaccagggucuggggccgaggcaagcaccuacgugaggcacuguuucccgaagccuacagccuuucucagcccaggacaaugagcucagaaagucuuuuuccuucuagggacugccuuuuucacccaaacuguucccucugcccccucccccgacaaggccuguccuguaagaguuaggcuagcaggguaggagcaaugcuaugaaaccacugcugggacccaggucuucccaguccuucaccccgcaggucacccugagaaacacacuaagaacuccaucccccagacaggacagucccaucuacccgcagcuugagucuuggcccuaguaccuugaggguguugggggugaugguguaaccaucuuccucaggaauuuucagccccggugggcagggcagggcgaagucaucgugcagguauuuuccacucauggcacucucuaacagccuguggagaagaaaagaggugaggaugccccacugacuaugguuccuauaccaucugcccucacccauuuuccugccuuacaggugaagacagggaagccccacagcaaaaaggagaggcccagacugugaguucccagcccggggcuccaucuaccggcuugacgcuggaacugggaagcacagcugggguucagagggcgaugggcucccuaggcggcccuuccccugugacuggccuucccucugacacaugcggcuuuacccaccuuugucugucccugaugucuacugcacuccacacagagccauauagggucagcugccauugccggaggaugccgaccuggaaugacucauccccuagggcagcaaggggcagcucgugagccacgccccucugucagccaugccagacagcagaggcccugcccgcccugccacccaaaggggcucaggccacauggucugcuccaggagcugccucacugugucccacugaccccagguucugcagaagggccucacugggugcccuuagggauggaaaggguugaaaggcuguacuccaaagcagagucuugcuuuucucucccguauuuuggggguucagcugggauuagaaaaaaaugucuuuccaccaaauuaaagaaagcuuugaaaaccacuggccuagagaauaccuaacugacuggaggaugggaggguggagcucaauuuccagucuauaggcugauacuaaagauauucacaauucauggauauuguggccuucacugauauggugaccuuccacaagucaccucaaaccucugggccaguuuaaaaaaaauggugaaaugaguccugcccuuaccugccuaccggggcuggccgaaggaugguuauacguaaaaggacuugaaaugugguuucgacaaggacuuuuuguugcuauccugaggaaagauggaugggucacuccuccagggaauaugagagguaguauaaaugaacaguugcagagagcaaugcccauuucacggaugggcacacucuuggcaucaacucucuugguccaauggcaacccuauauauugcacacgggacacuuucuguggggacucugagaugcagagggaccagauaacaagcaggaaagguagggccuggugugagggcacgagacucaccgacaucccugaugacaagccuguaggucccucgggcucucuccccccagcaucgcacaguggagaagguccagucauugaagccguugggaucccugaggaaagaacacagcagaaacagguggaaggcgugggccagagagcugaccuucccccagcaacacuuucuuacuguaguagccguggaaacaaccugggagggugccacgagggcuucucaggugccccuuuccccuggggucucauggaaggaggaaauuguguuaacguggugugguggaaaaagcaagcauggagcgcgcacaggcuuggagucccacggaucuagguuuauucuuguucucuugggcacuuacuagcuccaugacuuguuuucuuuuucuuucuuuuuuuuuuuggagacagggucucacucuguuauccaagcuggagugcaguggcaugaucacagcucacugcagccuugacuuccuggguucaagugauccucccaccucagucuccugaguagcugggacuacaggcauguaccaccaugcucagcuaaucuuuaaauuuuuuguagagacagggucucacuuuguugcccaggcuggucuugaacuccugaguucaagugauucuccugccuugaccucccaaagugcugggauuacaggugugagccaccacacccagccaguuuccucauuuguaaaaggagguuacaaagucuaaucuaggggguucuuagaaggauuagagaacauguaugugaggugcagggccuagcgcuugaagaagguaugugacgaaaggcuuccagccgccagggauagccagugccacaguaguuuaggacagugccaggauccacuucuuccauuucuuuucccuggaaaggcccuugcugaaaagguugcucaggccucgggcggguguacauacgaguccaugcugcggggggcgccgaugagggacaucaugccacuggggcagaacagcuucagcuccaagcugccgcgccgugggugagugauggagacugucacugccacaugcuccagggucuucagcccugacaucuccagguccauccugcugacuguagaaagucaggcugggcagcugggaaaccagcccacaaacacgccuucacuucacccccacguacacaaagacacacgcucacugaagccacauacaaacaucuacggcaacccuaacugggaccucgccuauacuaguaaauggaauggagcugcugcucucaaguuuacaacguagcuucgagugcaguugggaagacgacacauacccaagacacaauauaagaauccagcagagcaacuucaaucauucauucauccaaaacauuauuuacuggguaccuccuccauuucaggcacuguacuagaugcugggaauauaaagauaagaugggcguggucccugccuccuaccugcaaguggaaaaugauaugguaugggaaauauacauaauugauaagggaagagaaauaagucagauggguuuaggcacacagcagugagacacacugaaggaaaugaauacagaucgguagacaggguugguagagggcauucuaggcaguggaaaaggcaugaacaaagacgaaaugcacacaucucacugaagaugaugcacaguuaauuuuuaaaaaaugcugguggauaaauuucaagcaaauuaugugagugaaaaaagcaaucucaaaagaagcauauagccaggugugguggugugcaccuguggucccacuaccggggagggugaggugggaggaucgcuugagccugggagguggagauugcagugagccaugcucaugcuaccacacuccagccugggcaacagaacaagacccugucucaaagaaaaaaaaaaaaagaaaaaggaugcguagcacacaauuccauuuaggugauguuaauugaaguaccugcagugauacauaacagauaaaugggugccaggggccagggacaggggaggggauggguguggccagaaagggguaacacaaaggagucuugugauaauggaauuguucuggaucuugguuguggugguaguuaugcaaggcuacaugugauacaauugcauacagcuacacacgcgcauacacaaauauugacagcauguguaucuggugaacuccaaauaagcucuauggauuguaccaaugucaauuucuugguuuugauauuauacuuuaauugugugaaacauuaagauugggagaagggugcacgggacuucucuuguacauuucuuugaaaccuccuguaaaucuacaauuauuaaaacaaaaacaaaaacaaaaaacuacugaagaggaagacucaacuggggacuauuaagaaauuaggcuguaaugagaacgauucuuuuuuuuuuuuuuuuugagacagagucucucucuguugccaggcuggagugcaguggcaugaucuuggcucacugcaaccucugccuucuggguucaagcgauucuccugccucagcuucccaaguagcuaggacuacaggugcacgccaccauggccaccuaauuuuuguauuuuuaguagagaugggguuucaccauguuggccaggauggucucaaucucuugaccuuaugauccacccgccucagccuccgaaagugcugggauuacaggcgugagccacugcacccggccgaauacaauucuuuuuaaagcacccuuucuuccauuaauuuauuccaggccaggcaugguggcucacuccaggcaugguggaggauaacuucagccugggagacaucaucuuuacaaaaaaauaaaaaauuagcuggauauagugguaagcaccuguggucccagcuacucaggagguugagggugggaggauggcuugagcccaggagguugaggcugcagugaaccaugacugugccucugcacucuagccugggcaauagagugagagccugucucaaaaaaaaaaauuauuccaauaugcaaggcagaguacaauaccuugauuuuacagacacaguagcucagagaggcacugaaaguaggggcuggguaaccuagggugggaugcgcuuuaaagauuuuuguuuuaaauaagcaacuaagagcuauuauagaugacugagcaaggacagggguguuuguuuguuugagacggagucuagcucugucacccaggcuggagugcagcggcuagaugcuuggcucacugccaccucuaccuccuggguucaagcaauucuccugccucagccucccaaguagcugggauuacaggcgcaugccaccacgcccagcuaauuuuuguaguuuuaguagagacgggguuucaccguguuggccaggcuggucucgaacuccugaccucaggugauccaccugccugccuuggccucccaaagugcugggauuacaggcacgagccaccacacccagccucauuuucuauaauuccaucugucaccucuucaaagccaaugucccauuucuuugaaaacaaccucucuccuuccacuuuccccacucucuucuugacccccucauuuucccacaaccccucaagcuccuuucuccuaacuggcugagauuccauggcucauccaacauguguguuuacauucucaagcucccuucacuuucuuguccuuucacagcaauacuuggcaaaagucaaacaauggcucagccugauuauccaucuucuuggcuagaccuuuuugcuagcaccuuuccuacuacaaaugaaaaacaaaaacaaauaaacccuuucucaguucuucacuuccugccaccuaccaguguuaagagcaugggcucuggagccacuaagcuuggguucuaaucccagcucugccacuuacuagcugugagaacuguuuccucaucuguaaaauggggccaguaacaguaccuacuucauagguuugagacgaggauuaaacaguuaauauaccuaaagcguucagaaugguaccuagcuaauguuaaggcuacauauguaucagauauuauuucuuuuccuguauugucaaaauucuugagaaagcuguuuagauucacgauggcuacuucuuaccuucccaauuguccuugacauuuuuuucuauuaaaauaguaugcaugaauuuaaauguaaguuggugcuacagugcuuauaaugaaaaaaaaaauucccuaccaccuuugagaucuacuccccagaagcaaacuuuuuuuuuauuguuuuuaauuguuuucuucugggaucuacuuucguguuucuaaacaguaagcguuauggauauuucauggcuuaucaauuugagacauuaugcauugacuuucauuuauggcagaugagaaucuaacaaaucaugcccacaccuuuuccccaguugucguccccuccacauuuacaaaauaauuacaucacaguuuuuuuucuuuucuuuuuuuuuuuuuuuuuuugagacgaagucuugcucuguugccuaggcuggagugcaguggcacgaucucggcucacugcaaccuccgccuccuggguuccagcgauucucuugccucagccucccaccucccaaguagcugggauuacaggcaugugccaccauacccagcuaauuuuuguauuuuuaguagagacgggguuucaccauguuggucaggcuggucucgaacuucugaccuugugauccaccugccuuggccucccaacgugcugggauuacaggcaugagccaccgugcccggccuuuucuuuuuuuuuuuuuuuuugagacagagucuugcuuugucgccagacuggagcacaguggcaugaucucagcucacugcaaccuccgccucccaggcucaagccaucuucccaccucagccucccuaguagcugggaacuguaagugugcaccaccaugcccagcuaauuucuguauuuuuuuguagagacaagguuuugccauguuggcgaggcuggucucgaacucaugagcucaagcaaucugccugcuccagccucccaaagugcugggauuagaggcaugagccacugugccuggccaccaguuucuuugagaaaccuucccuuucuuccuuaguggcaggagacaucucucugcugugcucucaaagcaccuguguugucccuguugcagugccuauaacacugcacuaugccuauaaaccucacugucuucccuaccagguuguaagcucguugaaggcaggaauagugucuuauccccgagucucuagaacuaauacagugccugggaugaaguaggccucgaauauuuguagaaugaauaagucgauugagagauauuucacagaaaacaacaaaaagauuaaauugcaagggaaagggcuggggaagaccugggaagaggcgagggauauuagagggaugaaacacucgcgcguuucaaguuugggggccuagggaacggugacggcacugacacgaaugggaaaaucuuagaaagcaagccagcuuuugagaggugauagugaaaucuaaaauuuuguacauguuaaguguacuguauugguggaauaucaacagcacacagugauuuaggaacagaaagaugauggaaaauauuuauggcauaguuagaggacagcauugauguggcagagaaggggcuuacaggagagaaaugacguuauggaacagaauagaaucccaaaaggaaaagaaucccaaaaggagugcuugucugcguucgcaguguacgcaguggcaugcuacauccauuuacuucuugguguggaugcggacuuggguggcagugcaaaugaguacacuagaacucucucuaccagaacuaaaugaguuaaugcauuaaaugagcuaacgcugcgaacagugauuggcacauaaaaagcaucuuauuauguggccuuugguaaauuggaauuuuuucaacagucacucucugucccagaagacgccaggguucuauuugcccauaaucuuuuucuuuucuuuucuuuuucuuuuuuuuuuuuuuuuuuuuagacggagucuugcucggucaccaggcugcagugcaguggcaugaucucugcucacugcaaccuccaccucccagguucaagcaauucuccugccucagccucccgaguagcugggacuacaggagcccgccaccaugcccagcugauuuuuuuguauuuuuaguagagacgggguuucaccauguuggccaggauggucucgaucuccugaccucgugaucugcccaccucggccucccaaagugcugugauuacaggcgugagccaccgugccuggacuauuugcccauaaucuuauggaagcuaugcucuaguuucuauccuuuccacuggugaaggaucagaauaagagauuuaggucgaggacucauuuguggagaggugguagcuaaggucauaaacauagcuguacugucaaggaggaugauguagagugaggaaaaagucaggaaacaagccuuagaagacacucacaguucaggaguaugaaacaaguaccucaggcagagaaggcagaggagggcuauggagccaagaaggccgccacagaagcuacaggaggagagacguugcaacaaagaccucauuaauagggucagagugacaagaauguuaaaaaggaugaacucugaaccagccccugaaccggucaggaaaggggcacuaugaguaagaaagcaagucuucuguggcagagggagugugugacaaaggggagaaauugcuucaguucauucauuugaaaaguugccugguuggagguagcagggacuugcauuugaaggcagaaaggaagaaucagcagagagggaaauguugguuaaagagggaagaccuggagaggagaaggaacaggacucacugcguaggcagaggcuuagccaguauccucaagacugcaaacgacaacaaaaggagaggugcaaguggguguucaggcaccuuccaaucacagacucucugagugugaauaacacacuccuccagagccccacucucccuccuacccucagguagagauuucagaccagcgucagaucuaaaaaccccaagaggccccaauccccucucccucauaaccuccugucagcggggagagagaaaaaucagucuugcucuuuagcagcacuucucaauaugguagcccuuagccacacauggcuaucuaaauuaaaaugaaguauaacaaaauuaaaauuuagcuccuuagucauacuagccuuauuauuauuauuugagauggagucuugcucugucauccaggcuggagugcaauggcacaaucuuggcucacugcaacuucugccucccagguucaagcaauuucccugccucaaccucuugaauagcugggacuacaggcacgugccaccaugccuggcuaauuuguguguguguguguguauauauauauauauauauauauauacuuuuuuuuuuugagauggagucucgcucuguugucuaggcuggagugcaguggcacgaucuuggcucacugcaagcuccgccucccugguucacgccauucuccugccucagccucccgaguagcugggacuacaggcacccaccaccacgccuggcuaauuuuuuuguauuuguaguagagaugggguuucaccguguuagccaggauggucucgaucuccugaccuugugauccacccgccucagccucccaaagugcugggauuacaggcgugagccaccgugcccagccaauuuuuguaucguuuuuuuuuuuuuuuuuaguagagucgagguuucacucuguuggccaggcuggucuugaacuccugaccucaagugauccgccccugcccuuggccucccaaagugcugggauuauaggcuagguaugagcuaccacgccuagccuauuauuauuuuugagacaaggucucgcucugucacccaggauggagagugcaguagugcaaccauggcuuacugcagccuuggcauccugggcucaaggaauccuccugucucagccucccaggaggcaugcaccaccacaccuggcuaauuuuauuuuuuguagaaauagggucucacuauguuguucaggcuggucuugaacucaugagcguaaacaaugcuccugccucagcuucccaaagggauuacaggugugagccaccaugcccggccaacuggucauguuuuaaauguucaauagacucagaugacuagugaccacugaacugagcagcauggacauggaacaguuccaucauugcagaaaauucuuugggacaaugcuacucuagagucuuagagguauuuagccuccucuucuaucucagggauguucagcucccucugcuuuauaaaaaguucacuuuccagcccccagacacugaaucaaccagguccugguggaaaacaaccauaacuuggcuguagaagggguuucuugacuuccugggacugagcugcucaacucucaauuuuuuuuuuuuuuuuuuuuuuugagauggaguuucccucuucuugcccaggcuggagugcaauggugcgaucucagcucacugcaaccucugccucccggguucuccugccucagccucccaaguagcugggacuacaggcaugagccaccacacccagcuaauuuuguauuuuuaguggagaugggguaucaccauguuggucagguuggucucaaacuccugaccucagguuaucugccucccaaaguucccaaagugcugggauuacaggcaugagccagggcaccuggcucaacucucauuuuaacuggacuuauuucuuucaaccuccaagcaagcccacaaacuuauuuguucuguuuuugucugcucagaggaaaauguggucauguuggaggagaaggcaacuucacuggcucugaaaagccaaugaaaauaguacuuugcaaaaaguugugaauaacucugcaugucaaaauuacucaaggcaaaaaaacaaaaacaaaaaugaaacaaaacaaaaaaucccccaaggagcuggggguagggaaaacucugguaaaacuuuugcuugcugcccuuccaacagguaaagggcuccauuagccaaacucccuaaaucuuucccucccuucucuuaauccugcuuucuccacuaggccaccucccacucuucuccacccaggcaaucuguccuucuuucucuuacuuuuuagugacaagcaagcaguugccagaugccucaaugccuaggguagacauuccguggcaacguccccuggucagcaggaagcagaggaugacgaagcugggaagaccauauuacucuuuuaagucacugcccucauuugacagaugcaacaggaaauagcccuggauagaagguaaaguugaaggcacacuaucucuaagacacgcaagugcaaagccaggggcuuccaaaugaacugcauuccuggaaauguuucugaacuucucugacuuggcugacgcuuuaugcccuuuccaagauaacauuccuuuuaugggaaaugcagugacuggcccagggguuucauuccacauugagggaaauugggcaagugcuggaugugguuaggaggagaaaacucaauucuucucugugaaaccuucaccugagggaagccaccccucauccucccuucugaguaaccuucucuggccauuccuucuccugccauggcucucaauugaucacuuucuaggaggacagaaaaagugaagacaguuuugguuugggcacuaagcauagcauacuuccuuugcaaaaaguaguaaaugacuccaggaaaaagaaucccccaaggagcuggggguagggaaaacgcugguaaaugugcagacagggcauccucugcacaagcauccugauccagcugcacucuccucuagggagggcguccgccucuucgcucaacauaaaaccaggucgcuggcuuagaggauacaaccccuucagacaauccugguucaugcuggccaccauggaggcggaggcagaggaugggucacuaaagccuaggagacuucuacaaacccucuguccauccccagcagaccacaucugacucucucuauuagguaagccagagaaucaaaggaagaaaugccuaacuccuuuacuucauccagacacccgaggacugaccagaguucucuggcaagaucuuagcauggaagucacaggagcuucucugagcucucaccccggucucgccugaccuccccaagccccagucccaugccucccacccgcccuccuccucaguugcucugcugcuccuuuucacuacuaggaacccaggagaaaggucuuguuuaagcagcugggggagccaacucagaagcaguaacauguccuaaaauggucaaagaaaacuccacagguuuggcuggagcucagcuccgaaaggggguagaaucuggcagggaggacgaguuuaacuuccuugucacccggccccaaaccucaggccuaagauuaacccccuuugugcugauuacuuaccauuccacaggaccuccagggaacggggggacugcggaaucgccuuguuuucuuuuaacacgggacugacguaggaugcuaaguaagggacagauguccagaucuaugaaaggaaaggaggggauggcaaaucaacaaacaagaaugaucacacccacauucucacaaacacacacgcccuugucaauacgaucuugaagguuuagcugucuuuauuuuuccacuccucaucaucuuccuucagcccucagcuccugcuugcucgcuggaaugcuccguacagcccccagcuaaggaaccagaggaaacagcuguguccaggguggaggaggggaaccagagcauccugagucccacacauacucaggucccauuuacucuauuaguaguuuggaaacuucagugauagcauugagccugcuuucucauuuguaaaauggauaucagcugggaugaagguugaaguuguuaaaucaaugaacugaaugaacauuuacuaggcaccuaugauaucccaggcaguuuggggcauucagcuccgacccuuggucacuccacacagggcacccugcccugccaacaccuguucaccuuggcugcauucacgagccuccaggcguugaggaggccgaaaccgugcugguggcuauggcugaagccugccucguuggugacccacucugcacggcgauccucauacugaaaggacagagguccugguuagucucuugcauugccaguguagucucaacaaucugacucugguuucccugcuugcccugcuggcugauccaguccacgcucucccacuauggcuacugggaauggauuccccaaggcaagcugggacaaaaggucaaagcccaugaugucaccaccccacuggcuugcuucuagagaaggggccaggaggcacagccagagcuccccuuugcagauaaaaugaguuuaggccuguggucuuugugggguccccacaccuguucuuuacauaugcaacucugaaagggacucugaaagagacuuaguaucuaacauuugggacauugagaaucuaaggccaccugauacccgaacucuggagcaggcugggccaggccacuugucuaccugcugguaucucacccggguggcugugaagacaaugaugugcuggacgucacgccacgugaggcagggccgcaccugcagcauuaaggcuaucaugccagcugccagaggcgcugcagcugaggucccuguguggcccucagugcagccagugcccuucugaaggucccagucaguggucaccuggaagugaaacaggaaaaggaaguagguuagagacugaguucaagcuggggacaguggugugcaccuauagucccggcuaccugggaggcccaggcaggaggauugcuugagcacaggaguuaugacugugccacugcacuccagccuagguggcugagugagaacccaucuuuaaaaaauaaaaaaagaauauuuuuuaaaaaagaagcuagagacugaguucaaaguuguuaugggggaaagguacagggcugguccucagaacaggucucacagguggacccuuccuuuguuagagcugaaucuuugaccagagaaggacccaauagcagggcagggcaaaggaaacccuaacccuccuggccuccuaacagaauaucuggagaacagagacaaagauaauaaaaguuacuuuugagggugugguuguuggcaaaaggaggcagagauaggaaagggcucccauccagugcagauaaggguuucccaacucuuuucuuuuuucuuauuuuuccuugucgccuaggcuggagugcagugguaagaucauagcucaccacagccucgaacuccuggguuccagcgauccuccugcuucagcuucccauguagcugggacuacaggcguguaccacugcaccacacuaauauucuuauuuuuuguagagacagcaucucacuauguugcccaggcuggucucgaacucuuggccucaagcaaucuuccugccuuggccucccaaagugucgggauuaacaggcaugagccaccaugggggggccucccgauuuuugcuccuaauauucuugcucccauuccuaaauucucuaucccaacucccaacuccaaacccuucaacccccacaaccaagcuagacagaggaaguggccaggggagcuacugggcccagcuggagcugggacaacacugacggcacuauucaaggaaauccaauuuggcagcuccgcgacaggggcuggaaugaugucggcgugaacacagggaguguguuccagcaagagaggacuguguccuugcccacccccgagcccugcauggacucagugucuauaaggcccgccugcccggcucuacagcucucaacaggacaagcugccucacugcucugggccagaugccaugaaaccccuucucucugugugguucugagguggggagcgagaauggggcaaggggaggcagugacugccuggcaucgagcucuuuuggggcugucaucaccccuggagacucagaggguuuagcugaggcgggcccugccuaaaucugcuccacucuauggcacuuggaucguuggcccauggugucagugcuaacaccggagaauuucuuucuuccaaacuucucuucugggucagauaccaggguggcgacuucugccaagagcugcccuuucuccacuguacucacugcuucccucccagcuguuagagcagcugccaagagauguaauuuucacccagccauggcgcacucccagaaaaaaaagggaaaagcacucuccaagugguugucucaaugagagugggagccugguuuaugcaagggagcggguugauuuuuuuuccuguuaaggaaacagccuugcagugauagucugaaguguggcugugaagcccacgaacuugucuaugguggcaggagccacaggcaggcauugaaaaguccagagaagcuuugcuuccccagggagccaaauggugggaagcauaugcccccagccucugcccucagaaagacagcucuacccagcugcccuggucauugacuagaaacuggcaacaagaaguuuccauagcaaggacauuccaaagaugggaacucugcuaaacacacucucucuucauuucugggcaaauuacaguucagauggaagaggguggugagggugagaagcugaggugaguuaaaaugagaaaggccagguacagcagagcaagagugacaauuauguuguagaaccuucuuaggucccuggccugggcagggcgagcuggguucccuagaguucugcuagaggguggaguuugguauguuccuguucuuccuccuaacccagccuggccugcagugggugcccucugugcacacagcccagccucucuucccucucuacuuuaguccacucccuuuucucuucucccuggggcugggaggaggggguaguaggggucaacuggcacagagccuuggaacauuguguugaccagaagucauuuauuggcauaacaaaauuuuaguuuuggaaaauaaauuugacccagcaggaagacaaagcagccuaauucccaauggccccagagagaucucccgacucagccacuggagaaauuugauaccaccuggcuccagcccagcuccugccuagagccuccuaugcccacacuauaugguugcgggcaacagggacaggcagggagcucuaggaagauggucuagaggccugccuuaaaccugcugggauggcgcuaagcccagcuggguguaggcgaucgucuucaaauucuuuaaauggguuccacagguuagagaagcuccaugacccugcucgaauuucauuugcuauggcuccaauuauagcuccagagaaagagcucucucugguguugacaugagacauucccccacuccucuucccacucaucccauaaaaacgacaaccagacuagcuuuccuccugaagaugcacaugaccagaacucacaguauuuaccuaagagcugaagggcaauggaauuaggaguuuuuuuuaaguccacagaaauuagcaaaagcccaaauuuuaccaaaggaagacacugcaaagaaguuguuugugcauuuccuugagugugaaaaaguuguuuaauccaugugacacuuaguuucuuuuuuuuuuuugagaaggagucuuguucugucacccaggcuggaguacaguggugcaaucuuggcucacuguaaccuccgccuccuuguuucaagcgauucuccugccucagccucccaaguagcugggauuacagaugcccgccaccacaccaggcuaauuuuuguauuuuuaguagagacaggguuucaccauguuggccaggcuggucuugaacuccugaccucaagugauccauccgccuuggccucccaaagugcugggauuacaggagugagccaccauguuuggccccaugugacacuuaguuucuaaaaauauguauauucguccuaaauccaaauuucuaagauaaaagcauucccaagauguauucagaguccccgagucuacuacuccaaggguggcaugccuuaagacauccagcucugugggggaagaggagccugaguguuggggcggggaagcagggaacagugagaagcgcugugaugucugagacgugaagucuugugggaaaggggcaggccguggagggcccgggaggcacucacaaugcuccgaagcaucuuguccccaccacugaaggugacugccagcauggaggcacauucuucugcauagaaaggcaugcgucccuccucauccacagcuccuagggacagaggagggagauuagagcugagaugcagaggggguccuguggcaggggcuugcuaaugucaguuaucuuggaguuaccauccuggggggcuguccugaguuugaaacaugaucugagcggcccacgucccucagagcaguccugauccucuucugaacaggcagucucaaguggcagagggcauucugugccgcaauaccauucuuucaguaggcucugggguacaacuggcagccuucuaccuucauacccacuuauucauucacaugcuuacuguuuucaacauucauuacccaucuacugugggucacacccgugccaggcaucagggccauauggaaaaggccgcaguccuagucucgaggagccuagagucagguagaagucagguaaguaaauaaacacaugcuaacugggagcacaggcaaagggcacuuaauuuaggccuguggggagucaggggaggcuuccagcaggcagaagguggcccacagaaagacaggccagagcagaggccuaaccagcuguggugggguggaggcagcucggugaucuccagaugauggcuugaagguguucccaggguaugcugacaucuaagaagucccaagguccucugcaagcagggcuaguccuaucugagcccaaagagauuauugugcucacacauuuagacacacacagaagcuaggacaagacgugugaugcccuaacccuucggugacacacacacaggagcacagaaacauugggugacuaccuauggugacgguguagauggaguuggcguagccaucguaguugcaguugucguuguguuggccuccguugccacuggcuaccacaaagaugcucccaaagcccuggcgaccagcaaucaccccauguuguaaggcagccugaggagccaaaacaucagggugucaguugaggaacccacagaaagaccuccgccuaccacaucagucacccucuccaccccuucuagaaacaaagggaaaaaaguucaaagggcacugggcaugggggaaagauuggaagauggaccccgcaugugagggagcugugaguugacccaggauguggggcagcugugaguugaaugaugacugauggacacccucugcuuaucagaggacaggguggggccaggcaugggagcugaggauaagaugaaagggaaacaaucucaaagcacuguuccauuucccucucuaggaacaaacguccccuaggcuuccugccccgacguuagguguucucuuccugaaaggagacugagcguggagguggagugggaagaugggucaacuugcagcaguucucccgggacuguaugaagagggcaucccguuucucagagucuuugugcaggccaguuaccuuuccaagcugaugggggccauccacugucuucccaucgucaucugguccccagcuguugagaaauaaauaccuagaggggacagccagagccaggcugcggcuacccacccagcgccucccagucucagcuggcugcccuuugaccugcagcucuuaacuccucccaaggguuccacuuaaaggcuuccgugauuaaaaggcacaggguucaaagguccauccccucuccaaaguggaaaacagaagugugcuaaggcucuucuuuuccuugugaauguccccauagcccauaguggcagagagggacagaggucacucaucuccugaucuagggaucagagacauguagaccuuuuuuuuuuuuuuuuuuucuccugaaacggcgucuuccucuguugcccaggcugaagugcaauggcgcgauuuuggcucacugccaccuccaccucccagguucaagcgauucuccugccucagccucuggaguagcugggauuacaggugcccaccaccaagccuggcuaauuuuuguauuuuuaguagagaugggguuucaccauguuggucaggcaggucuugaacuccugaccucaagcaauccacaugccucagccucccaaagugcugggauuacaggcgugagccaccgcaccuggcccaacucguaggguagaaggcagagcgcccaugaacuucuguggaagcucuugguucucagguugaggaguucucuauucugucucuaucgggaaguguacccuguggaugaugucauggauuuaagggagguaugucgggggaggaacaggugccaucaaugccaugugggcccccaaccccauuuccuucuuguccaguccagcacagccaugcccugaaggugcagugcauuggcguggggugggggauugguguugggcauucagcuggccuguggauggagaagaaagcccgcuuucuugcagaggccuuaggaguuuagaaaacaaauaaaugugcacaggccagggcuucucauguggcaaucugauuacgggggugacgggggcuuaagguugagugcccaguggcugggaaucuagagaaaugaaggcaauggacuuauuagcugaacccaaugaggagaccccugcuccggccuaagucagcccacugguugggauuuuguuggcggauuugucccaggugcuccaggcucuugcccucucaucugcagcucugccucaccugcagcuguagaugucauugaucugauagugcuuguugaacgccacugccuccaugcugucugugagagguccauccaguacccggauaccuaggcaaugaaggccacagcagcuccucacuaaugcuggucuccuagccggggaacugggagguggggagccauaugugggagacuuauuuuucccuacaugcucuuuguacauuuugcuuuuuuuuuuuuuugagauaaagucuuacuugucacccagacuggagugcaguggcaugaucucggcucacugcagccuccaccuccuggguucaagcgauugucuugccucagccucgaaguagcugggacuacaggcgcaugccaccacacccggcuaauuuuuguauuuuuaguagagaugggguuucaccauauuggucaggcuggucucgaacuccugaccucaagugaucugccugccuuggccucccaaagugcugggauuacaggugugauccccauagcccccacgcccagcccauuuugcauuuuuacaccauguauacguauuacuuguccccccaccaaaaaaauauauauauagagagagacaaagucuggcucugucgcccaggcugcagugcuguggcacuuucagagaagggacuuggacaggguuucuggcuccuccggucucauuuauggagagcuacugcccucugcuggaguauaagaggaauagucuguucagucuguagguucccaagcacauaaggaguuauggugagggcuuccccauucauucccuucaccuuuugccuugauggacagacguugagugugaaagaaccacagaaccaccuccagggaggaauagggcugcucagcucccccaaaaggauggagagcagcccgugaccaucagugggacugggagcuggggagcuggggagcugggaaaugcaaaggcugccaccauagacguaucggaucauagaggaaaaaccgacaagaaggcacuuuguaauuuauggaacuauaaauagaaaaacauguuugaaacaccacugcacugaaaaaucaaugagcugauauguccuacagacaccuauuauaaacucacccuugcucuaugcuaugugugucagcugggcuaugggauaaagauguuucagaguagggaggggugcaggaaaugaagacuguggucacaggagcagccuaccaaggcuaggcuggaggcacaaguuaccugcgaugcggcucccguaggccacgcccacggcacagaagcuguuguugggcacagccgcgaucucuccugcacaucgcgugccauggugguugccauucuccacauccggguggggcauggggucagggucauuagaguugaggucauagcuacccucagggcucugaaauauuuuggaggugacauguggucauucacugguuagaggggaucagguccugggguucagggacagaaaggaaaugggaguuugggaaucgaagcuagggcgauaagcucauuucucaucguuucuguuuuugagauggagucucacucuguugcccaggcuggagugcagugccacaaucucagcucacugcaacaacugccucccagguucaagcgauucuucugccucagccucccgaguggcugggacuauaggugagcgccaccacacuuggcuaauuuuuguauuuuuaguagagacgggguuucaccaucuuggccaggcuggucucaaacuccugaccuccugauccgcccgccuuggcuucccaaagugcugggauuacaggcgugagccaccgcgcccggacccaauaagcccauuucuaucugcaaaccacacuggcuaaaagauaugagcaaaggacacuggggcaaaacugagaagugccacagcucccagcaaacuucucuugcccauuaugcgaaugugccuacagcuccacggcuugggaaaccuggaaaaaaggcagguagggcucccuagaggccacgcuuuagagagaggaaggcacucggauuuccaacaagagggaaguugccugcaggggccacuccuuacuccucagaaaaggacuagaacugagagcaggauuguucuuagaguuagagccaccugcugugccuugacuggcuagcuagggaaaagaagaggaugaaccccaucccaccucccaggcucuuuuauuuggcccaaagaccucuagaaaaggggacaagacugaggcaacaucaagaaggagguaagacguggggagugaggggugucguuccagggccacucacauaguugggugcaauguccuggaugguguguuccacuccgucauccacuaccaccaccgucaccccucgcccagucacauugcguucccacacacccgucacguugaugucccugcccgggcuccgucgguuauucuguaagagagacaggaugggaauacagugacacauagcacagcccagagggagaugaaguuauagcuagcagccccuuuucacccuuggccuccaccaaagagccagacagauugcagaccaauaggucaggugggaacagagucaaggaggagcaggugagagcucugccacagccuuggauucuaggaaaguuugucaucagucaugggggauucgggauaaaaugguagcuagggugaaggguuggaugauacacuucuuuuuuuuuuuuuuuuuuugagacggagucuugcucugucacccaggcuggaguguggagugcaguggcaggaucucggcucacugcaagcuccgccucccggauucacgccauucuccugccucaggcuuccgaguagcugcgacuacaggcgccugccaccacgccuggcuaauuuuuuguauuuuuaguagagacaggguuucacuguguuagccaggauggucuugaucuccugaccucgugaucugcccaucucggccucccaaagugcugggauuacaggcgugagccaccgcaccgggccagaugauacaccucuuaugccaaugguaguaucguaucacuuaugucauaguguuuaccaugugucaggcaugguucuaagugcuacacauguauacauucacuuacccuaaccauaacucuaugagguaggcacuauuacaaucuccacuuuacagauggagaagcugaggcacagaguuuaagcagcuugcccaaaugcacaugcuaguaaguggcagagcuggaccaugagcccaggcagccuggcugcaccaucugugcccugagcacuguagaacaccggccucuagaagacaguagaagggagggagagccuagggaaacaccacagaaccgggaaauggucccucaggcaaaggauggaggugacugaagagugauauagucaaaagcccauuaaagaacuggacuggaaccuacccaccugaaacugcaaacugcaggacuggacucaccaggugccauugcugcggguacuuggggucguugaaguggacgcugcgcuuggcccgccuuagcagccucugcucugagugccagcgcacagcuucaugcccagccaacacagccuccaccugcugccggauggccuccaccuccagggccggccugugcccagcaggcuggacaaagagguagugccccugaagcucuccgaugcguccagcauucaccagcccugcugccugggccaaggcauccgccugcugcuccagagucucuuccuccccgucaccuuccaggcuuuccaggugcacagcccagcucggccccccugugcccuggccaucaggcccaccugucccugccaggcccaugacccagggaaccaguaagaagagcccggcuaauuccagccagaggcaggugggcaggcccaggggggcauccaaguguggcacuuucugccuccccuucggcaucagagcaguggacugcagacaaagaaaaaggauauggaagagaucaaagagcugguaacugcaggaaucugagagggagaugcugagccauccauguguucccccuggaagucccuaagccaugccuuuuaaauugugaaacauuugaucuucucuuuuuguucacauuuaucccugaccaacagggauaagcccccagguggagugugggccagcacuaacaccagcggauggccucccacagcaagacagccaauccucacgacaccagcuaauccagcaggagguccaguugcucacaggcacugcgagcaaccccuguugccacccacagggcucaaagcacacaucgcuuccacaaacuacuggcugcaucgugacuguucuuuagcagagacaaccccuucaccccuacauuuagaggggacauaaaucuuucccuagcugacuccucaguccaguuguccucaaggcuaauuccccauaacagggccccgugcccaccuggauucuacaugagguugagcuccuggucuggcuaaccacgucacacucauguugugcaaauggagaaaaggcaucacuuucacugugaguaguguugacucagcaaaggcuacagaccugugggauccaagaacagaagaaauaaugucccaccaaucccagggcaacaagcugagguuagauaaacuccaggaccagggaccaaagaaacuucauuaauugucauuuccaaagaucuaaaaucggucauagacuggagcagaacugguacggugaggccaaaucaguauaacacccaaaaaacccacuuccugugcuaucgugccacccucuuuucauuuuguuccccagaggccuagcaaaaaacaguuaccaaaaugccucuugaaagaguagguaauaacguccuagaaguccaggugguagcuaacuucuugauuuguauaucccagaaggauaccagggaaagugaaaggagggaggcggcgggggcgaaacggggaaagccagagagugcaaacaaaacagaacaggcaccaaggacaagcgggcaaccaggagagaacgaaugaugagagaaccucacuaagcagcuacuccuguacugagcucaggaggcuggcuucaaggugaggacucagacuccagacugggacuccaauugccuggguuugacagaaccagggaauuggucucaggagcccucaaaaaaaaaaaaaaagagccaaguuagaacugggggacagacaaaugggguggcaggacauguguguaccuaugguggcugggcuccuuuaaaagccuuugcucuccacuggguccacccuggggcagggcuuaguacucagauacacacccaagcggcucuaccucaaagcauuccagaaaaaugggaauuuuacugaaaggcuuccuggaaaggagaacuuaugccaccucuccuuuaccucuaaaaaucuucauacuacauuucuuccucucguuuucucuuagguuuccaggcauauucccucucaaucccucccugcccccgggagccucaauucucccaagauauuuaggugucuuccccagucugcauacucuacuaaguaaacaaacuaacaaacaaaacccuuguuagccagacaguggccccgcuaggcagacuccuucagacucaguagaucccaccacagaugucaggaagaaagagaagcaggagcuccuucugucuacuaguggcaaagcagcauuuuuaucccccaggcuucugggaaaggaaccuuaaaugccuucugaaagcaggucucaaccucucccaacggcuaggccucccuuuacagcucuuaauugacaaggaagaagagaaugggcagccuggaguccaagauccugcucccaagcuacuguccucgcuguuccacacccggcuccuagaagccagcuuggguaccgggucaguuucccgauucucccuccgucggccucgaucgcuccgugcaaugugccccucuccucauuagcacccacauuauccaggaauucugggcccuggggccccaucuccuuggucccccacgccaggaccucaggcacccucugugcagcucccucauccucagacgccggcuucccccacuucuggggcccccugaccacccagguccagccccacaccuaguucccaacucaccggccccgccgcagcugccgccgccucccugcggaaacucgcggcuucccgggagccggaggagcagugacagcagcaucacuuccgcccgcggcgcagccaaucagcgcggcgccugcggcccggcgacccccgcgggccacagcaaccggcgcccgggguccggcucccgcgggcggccuacgcaggcaggggccgugcgggcgcugggggcugaacccgcgggcuccgccuccccgaguccucggggcaucuuccacauggucccucuucagaaggcucuccuucauggcguccucuguaaagggcauuucgguuccgaccuuuaaaagccacucguugcucuucuccuucugaccgccauggccccgacugucccuguaaucuucccagaggggauccugcccacccaggucgccuuccuucucgcagucggcucucccuucuuccccgcgccccgggagaguccacuuguaucucaggggucucccgcagcauccccgugccccggcggcgccagcugucgccgccagagggcgccgucgggggcggcgcggcgccaccgcggccucuccucucgcggccggagccucgcccccuccgcucgugccgccggaagugggaggugccgcgcgcgggccggcgcucgaccccuccccccguggcucggccgcccccuccccccgcuccgcccgcucaggugcgucccgucccucccccacuuuccucccgggggcgcggcgcgggaggugugugcggggcgagcguggguggggguugcggggcgag

SEQ ID NO: 15971 - RNA, 5959 nt, Homo sapiens
uggugucuuuccccaaauauggagccuguguggagucacugggggagccggggguggggagcggagccggcuuccucuagcagggagggggccgaggagcgagccagugggggaggcugacaucaccacggcggcagcccuuuaaaccccucacccagccagcgccccauccugucuguccgaacccagacacaagucuucacuccuuccugcgagcccugaggaagccuugugagugcauuggcuggggcuuggagggaaguugggcuggagcuggacaggagcagugggugcauuucaggcaggcucuccugaggucccaggcgccagcuccagcucccuggcuagggaaacccacccucucagucagcaugggggcccaagcuccaggcagggugggcuggaucacuagcguccuggaucucucucagacugggcagccccgggcucauugaaaugccccggaugacuuggcuagugcagaggaauugauggaaaccaccggggugagagggaggcuccccaucucagccagccacauccacaagguguguguaagggugcaggcgccggccgguuaggccaaggcucuacugucuguugccccuccaggagaacuuccaaggaggugaggagugugugaacgcaccuguguuggagcacggugucccacucuggcggguccccagggccugagcagcagcgauagcccugugacaaugugaagggccacagaacucuuguauuccagucaggggcaaagaguggagacggaaggccuguccuucugacaagcagccccuuccacugucugacagugggaggucacccccacuguagcagagggguggggggcggguacugccaaggaggagcuuuggagugauaggcggggcaggccugggacccuuggucuuucccaaagggugguucccuuucgaaguugcuauuccaaagguagcagugaggauggcacacauuuauguagccaggccacuccuguuuguccguggaguggagaggagccacccuccugcccucucagagguccaggugugcucacuccuauuugggaagagagaaggggcacagcagcccugcaggggccccuggcucugcucguguuucugggcuucugcugguagggggugccaccuucccguuugacccuggacuuucuuucuccacugcccacuuucacccacugggcagcucaggggagggguccuggcaggagccacagggcaggaggguccaugccuguccaugcuguccugggagugucuugagaugccccugggggggccgcccuguaaucauccuccucucccccuccccacuggcucgaaggcaggacucgggaggcuucaucagaggacucuaaaggauuucuggggauucuccacuuuucgacccugacccaggaggaggaaggggaaggaugguggugcugggugggaguggggauggugugugcuucaucccccucugaccgaaauccuaaucuugucucuagaucugggggcugcagcguuguguaccugucacccuuagccuugcugcuuugaccuguauugucuguucugacccuccugagacuggaagcuggggguaggggacacacucuccuuccauccuguuccucaggagcccagcaggggugcagaaggggaaggcagacaugagggcagguggaguggggguagaagcagggccagagacagaagguggaugccugucugggaugguggugcaaaggcugagacagaggcugggguggauggaagccaggaugcagggcuaccaaaaucaccuggucccagcugacuuggggguuuggaccacaguucuuugugcaggaguccuugggugguuggggagcgggggugggacacacagggugaagggagggauuggcuguuuguagcugaacagcagaacagagcacucugccuuuggggucucuggcaucacuggcagggagagggguggcugggccaggagcccaccucauccccagugcucagagaacuggguccucagaagugguccugcccccacuuuacacauaaggaaacagacgcaaggaggagagggaugcccaaugacgggcacuucgaugaguccgugugaacucuguuccgugugagcugcugcgcgcucagggaaugauugugagaagcggguggaggcuggagugggcagcaaagaacugacauuuugaggucaguuuuucacuccuuggucaagggcaggcucucucccuggucauuaccaggagccuggcuccgggcagcaaagaacugacauuucgaggagcucugcuaagggccaggcaguaugugagggaguucacagacaccgucccauuuucacagcccucugagguugguaacauaacccccacuucacagaugaggaacuccagcccagaaagccugucagcccugagaaaggaagggcagggcaucgggcugggcagcuggccugggaccaguggggugugauaguguuggcucugcuucccgcggguggggugccaguggggaggggucucaccagagagggagccgggggagugcgcuccugcguccauccucagaccagcgugucccucccaaccucugaccccucugaggccaggggauggguucggcuuccuuugguaccucuuuuggaagucucuucagacaaacacuggagagaaggcacagcacccuagggugacaucaguggacaggucaguuuccuguuccuguucccagccaccccugucugucugcccagggaccuaccugccuggcccacuccugcugccaccccucuccaugagugggacuccugagcagugccaggcccaggcccucaggguggcaguugcuggauggggccaggcuucccauucccuggcaggcagacucuuggcucuggaagaucccugggggacucugacuucuugguuacucaggcuacuccguaaggguagccuuacgagagcguaagggcaugaggggaagucgauggguagaccaggugucucugauuucucugaggaaaugcagcuucuuugccaagaacucuugggcuuugguggcuucgucgcccuugccuggggugggcgaguuuuagucucuucagcugcagaccagaagcugagcugaccugaaaagagcuggaguucuggaguucgggcuuccaggccagggccugcuucugggugagagugggagguaaugguugcuugaggcagaggcaguaaacccucacacccgcagcuggacaaaggcaccagcuggcuguauucugugggggcaauguggcuucuggaaggucucuccaguggcucuguagcuggucuuggcaaagaauguucuagaccaaggguugucaaacuacagcucaugggccaaauccagccugcugucugcuuuuguaaguaaaguuuuauuggaacaaagccauguucauuuguuacauauugucuauggcugcuuucacacugcaacagcagagaccauguguccugcaaagccuaaaauauguucugucuuauccuuuacaaaaacaguuuacugaccccugcucuagaccuccaaagaccugguauccucuuuccugguguucaaguucagagaggugucuggaguaggggcugagccuggccuggaugggcagugcugugacaagugucuaggauggccggguauccugcacagagcuagaaggcugccuggcacgggugaaagcagagcugcucccugacccucugccccucccuccuccacccuggccugcuuuagcuuuccccagacauggccaacaaggguccuuccuauggcaugagccgcgaagugcaguccaaaaucgagaagaaguaugacgaggagcuggaggagcggcugguggaguggaucauagugcaguguggcccugaugugggccgcccagaccgugggcgcuugggcuuccaggucuggcugaagaauggcguggugaguggcacccugggcuagggcgcuggggggcuggggugugccacccugugaguccugggccaaucccugagcugacugcuaagcugcguccuaugcccuaugccugguagauucugagcaagcuggugaacagccuguacccugauggcuccaagccggugaaggugcccgagaacccacccuccauggucuucaagcagauggagcagguggcucaguuccugaaggcggcugaggacuauggggucaucaagacugacauguuccagacuguugaccucuuugaagguagagaggaagaggcugggggaggaggugggcaggaggacagggugcugggacagggagagggaaugaccagaauaugccacaacuaggggugugcuugcccgcacacagcagggaugggauaugccgagaauaacacgccacgcucacagggcccacugagaggccucccuugaauuggggacaacucuuggcccugguuuggccauuuuuuugugagagacgggggcaggcccuggcuuggagucuuguuuauacguucuugauguucaucuccucucuccugucuucucacaggcaaagacauggcagcagugcagaggacccugauggcuuugggcagcuuggcagugaccaagaaugaugggcacuaccguggagaucccaacugguuuaugaaguauguggcccccagggagcuugggucuccgcauggggugggagguggcuuguucuaaggagcuugcgggaaggauuaggggaagcagauagccaagaaaggauaaagugagggucugggauggggaauaauggguccuuaauacuccuugaccccucccuuuccacccuccugcgcucagucucccuagccuaugaggcaagcuagauuagggaaaaaaagugcaacaggaaggcaaugggauugggcuaggacguaacagagggaucagaaaacggguggaaaacacacaguucuaccaagucuuuauccugguuccuccucuucuaggaaagcgcaggagcauaagagggaauucacagagagccagcugcaggagggaaagcaugucauuggccuucagaugggcagcaacagaggggccucccaggccggcaugacaggcuacggacgaccucggcagaucaucaguuagagcggagagggcuagcccugagcccggcccucccccagcuccuuggcugcagccaucccgcuuagccugccucacccacacccgugugguaccuucagcccuggccaagcuuugaggcucugucacugagcaaugguaacugcaccugggcagcuccucccugugcccccagccucagcccaacuucuuacccgaaagcaucacugccuuggccccucccucccggcugcccccaucaccucuacugucuccucccugggcuaagcaggggagaagcgggcuggggguagccuggaugugggccaaguccacuguccuccuuggcggcaaaagcccauugaagaagaaccagcccagccugcccccuaucuuguccuggaauauuuuugggguuggaacucaaaaaaaaaaaaaaaaaaucaaucuuuucucaggccuggcuggcagaguuugauuugcccuggucacuuuuguuaugguuucagaucugcgcaggggacaggcaggcaucucgggcuuguauguguuccuggcugccguccucugaaggacccuucaugugccaagauuccaggacagucagauucuuucagaggaaacaggccauagaacaggagagugaaucuuggggaccgaagggaaaaaggagccacucagcagcaugcaguggcuuuggggagacagaggaaaggagagauugcgaguggcagaauuguuuggaagguuuuuauuuuggaaaagcugugcagaaaaaaauucaagaaaauguugcugugaaaagagaaaaacaaaucuuaagca

SEQ ID NO: 15972 - RNA, 19478 nt, Homo sapiens
agcugcccagguauuuuuaucugugcuuccuauuuccuuaggauagaguccagaaguggaauuacuggaucaaaggguauaaagcucucuaaguuucuugaaacagugccaaaauauuuuguagaaaaguuuucaccaauuuacacugaaggucaguaucuuucaaugaguuuuguaacugucucugagagaagaggggaaacagcccggcaagcuuggaaagcucggaaggccgucccugcaguuguguggccccucuagagggaggugggaaaggcauggggauuccuccugcagugcugccuccguuuccccuccgccgguagggccaccguccuguuuccuaauccuucgaguuuuucauuuuuuaagauccccggagaaaaaguggcccaggguuggacgauguuaguuguaaaggugguggugggggugggggaauccuuauguuugagcaaauguaagaguuguucagcaagaacccaacacuuggagauuguuaacagaaacaucugccuauuccaacgugaguuucagagauggugaaaaucacgggagagaguuggguaggaguuggagaaggcauugcaagcuuuccccuucagcuagacagcugcagccccuuuaagggcaaaugcgggaccugguccuuuaaaucugugucaguuuccccugacgucagcgggcgggccagcagcccugcuguuuaucgcccagcggcgcagcucacuuuucaguguucgugcgucgggacggcgcguccgcccgcccuuaaagggcccgcaccucggaaaacucgcagcccagcacggcgucggguagcuaccaccuaucacgccccucacucugcgacucgccuuccuccgcggccagcccccgccgccggcucuuccucccuccccuuucccggcgucuccaggcucccggcaaccagccgcccuccuucucacggcccuggcccggggcuccagggucucaggucguacucagccccucgcgagcugggaccccuucccguagccagcauccccucccuccccgcccccucccggccgcccccuccccugcggggacccugggagccucuucggggcucuugggaggggacauuuccuaaucucaggccgggguuaaaguucugguccuggugagaugcuggaagcugcggccgcagccgcaacccgucccggagguguccugucuccugucgccgccgccgccgccaccaccgcugccacugccgcccugccggggccauguucgcucugggcuugcccuucuuggugcucuugguggccucggucgagagccaucuggggguucuggggcccaagaacgucucgcagaaagacgccgaguuugagcgcaccuacguggacgaggucaacagcgagcuggucaacaucuacaccuucaaccauacugugacccgcaacagggugagggcugggggcuuaggggccagaggcgaguggggaagccgacgagggcuaggcgauucugccgccccgcuacccuuuugggaggccccaggaacgagcuguccugcuagguucccaguucccagaaccacacuggagccucuugaccaguccuccuuccuuugccaccaauguuucucugaagcuccagcugggcaguuuuugaaguuggcucauucccaucuucucuuccgcccccauucuuccaucaguuguggucugagcacacauggcuugcucucuacccuaaaccccagaaucugacagcucuguggggucucggugggagaggaaacaggcuuauuacugggcuugcccagaaaaccucaggggaaugagacuggcccagaacugaaaagcucugugcaggcaaguuacaucucagacuccccagggagaugaaugcagggcuucccagcccucuuccugccugggagagccagcuggccuuguaaauugagggugacagagguuuuauaaggccaacugcaaguugggugggaagagaaggggaauuuguccacugugaaaaauccacuucacccugacuucucuuugguuucuucaccagcugugagucccugaguugaaauagacacagcuagugugggaagucuagaccccaggcagagcugagauugggagaauucuugcaaccuggcuguguggucucgugcccgggucucuugcucucucuccaugacugccguuuacugagaagcaauggaguugagaauggggaaucugauuuuuuuucagaacggggagugguuugguuucuguggcaggccaggaucugcccccagugccugguucucugaaguuugaucucuuucugcuuagaguccuuucuuccuuuuuucccauaucuaaaggcacuggagagcugugguuuuuacucuuuugggaaaugcugcccuagggcuuggguuucagcagcccaauaacaagcauuccaagaucgauuugguuuuauuuuuccuuuaagcucccauuguuuauauauguuccuucauagcuccaagggugaagaucacuuuaucuuuuuuuuuuuuuuuuuuuuuuugagaccagucucacucuguugcccaggcugaagugcaguuuugugaucucagcucacugcaaccuccgccuucccgguucaagcgauucuccugccucagccucccaaguaguugagauuacaggcgccugccaccauacccagcuaauuuuuguauuuuuaguagagauggggcuucaccauguuggccaggcuggucucaaacuccugaccucagaugauccuccugccuuggccucccaaagugcuacaagcgugagucaccgcacccggcugucauuuuauagagggagaaguugaggcuuagagaaguaaagugacuucuccacagcccugucccuuggugggagcuaaggauacaacauggccuucaauaccuaccccuccucaacuccucugggcucuggccccagguuagcuguuaacuagagcuuccugcuggcuuccuggcucacaggaagguugaggagcacuucuuguucuccugugucuucgugugugggggcguguguacacguuugugugugcaggccugugcauccugugcacauggauaggaaugggguauccuggagacucgcaaggccuccaccguguuuccuggcagagggugagacccugcgguugcuuggguccugcugcccugcacaugucugccggccaggagcugcacucagcacaggucuuuccuggagucuggggguuguucuggcagaagaagaggcagagaugacucccuggcccgaccaagauggagaaagaccaaaguagcuggcaugaaggagggcagggcucauagucucuggagccacgugucccugguggcagaggcuugagaggcauuuccaugucguucugcagacagagggcgugcgugugucugugaacguccugaacaagcagaagggggcgccguugcuguuugugguccgccagaaggaggcugugguguccuuccaggugccccuaauccugcgagggaugugaguaggaucugggcaucagggaagcggggcagccuaggccaguccuuggcuggagccucaaccaggagcccccccauuucuccuccccuuucccugggcugggaggcuggucaacagcacaagggccgagucccaccagccgggagcuugugcaccucgcagggaggugguggagaccagacggggcgagguggggccucgcuccucuggaggggcaggccggcugggacagugcucacauccuaucucccugcuucgggccauagguuucagcgcaaguaccucuaccaaaaaguggaacgaacccugugucagccccccaccaagaaugagucggagauucaguucuucuacguggauguguccacccugucaccagucaacaccacauaccagcuccgggucagccgcauggacgauuuugugcucaggucugcaggguagagugaggggaccacgggggcugguucuuccccaggcuccgggggugacuggugggggcucuucucugcccugcaggacuggggagcaguucagcuucaauaccacagcagcacagccccagguaacaucucccuguugauugcucgagaggagaaaugggggagcuugaauaugagaaugggaguggccagcggucuuugcuuggccuuuugaauuggcuguuuucuccauggagggcucucuggaaacaggagcucuggcccugacauggugagggacagacagcaugggacuguacagagacauggagucugguugccucucuggcauucugcugagugcccugcugagguugaagggaaugguauacagagaaaggggcugcugugaucaaggccugucuccucggagagccuccacugcccaccccucagaggauucuggguccucgcuuauaggggacuauucccuucuagaggggccaagagagcauccucaugagauggggcucucccuuccuuccugcacccucaguacuucaaguaugaguucccugaaggcguggacucgguaauugucaaggugaccuccaacaaggccuuccccugcucagucaucuccauucaggaugugcuggugaguugccugcccuuuugcucuuccccagcaggcagcagggcugcuaaagagaggggcaggccagguucccauccaucugccucucccgccccucugcaguguccugucuaugaccuggacaacaacguagccuucaucggcauguaccagacgaugaccaagaaggcggccaucaccguacagguaggaaaugcauguggccacgugggagguguggcugggcgauaagcuguguagcuuuccaaacuugagcucuucuuccucugcccauuccuauccuacacacgacugagucuuuggccuuccagucccugugacuuugaguccccugauauauaugagaguuguaccauaaucccaguugcucuuggggaugggaaagaguagaguacccccuucuggcugucauaccuacuucauucauuguaacaauaagagggcugagcgcgguggcucauuccuguaaucccagcacuuugggaggccgaggugggcggaucaccugagaucaggaguucaagaccagccuggccaacaggcugaaaccccgucucuacuaaaaauacgaaaaauuagcugggcaugguggcgcaugccuguaaucccagcuacucgggaggcugagucaggagaaucacuugaaccugggagacagagguugcagugagccgagaucacaccacugcacuccagccugggcaaaaggagugaaacucugucucaagaaaaaaaaggucaggcgcaguggcucacgccuguaaucccacacuucgggaggcugaggcgggcagaucaccugagaucaggcguucaagaccagccuggccaacauggugaaaccccaucucuacuaaaaacauaaaaauuagcugggcguggugauggacgccuguaaucccagcuacuugggagguugaagcaggagaauuguuugaacccgggaggcggagguugcagugagcugagaucaugccauggcacuccagccuaggcaauaggagugaaacuccgucucaaaaaaaaaaaaaaucuugugaggauuaaguaaaauauaucuaugaagaauuuagcauaaugucuggccccagaacaaguauuuagaaaagaaugaugaugaugaugaugaagaagauauuuaucaucaucauccugcagcgcaaagacuuccccagcaacagcuuuuaugugguggugguggugaagaccgaagaccaagccugcgggggcucccugccuuucuaccccuucgcagaagguacauuuugugcccugggccuggcuagggauggggaggucuuggucacuuucugggagcaagaagagccugcguggcugauugguggaccugauaggacauggguuuuuggcuccagucucucaaaggccugaucccacugacucuagccaagcuccaggcaacuaguuuaccacuuugacauuuuacuuccagaugaaccggucgaucaagggcaccgccagaaaacccugucagugcuggugucucaagcagucacgugugagugcugcagguggcugagaggggauggacaagccucucuggcuccugcuuucagaccugggauauagggugugcccugaagugggugaugaggaugcagauaugcuggugggguaggaacggggaguguucuuggcaggcuucuagauggggagggccgggaggugaguuccagugugaugugguacagagaguucaugacuaaagauggaagaacugagguccaguucacuuucugccacuuaucagcaguguaaccugauuguaagaaagagcuuuaauuuugcuuuguuagcauaguuauaaucuuauuuauucugaaggauguuucuuaaucucauauucagaaacauacccuaauuugucauugaaacacugcuauaagauugagucucaguuucccugucucuauaacagagggaguaaaauuuguccaguuaaucucacuaaguuaugagggcuagcacaaaauuagcagauaaaauuagcaggaaaguaccaggccccuacucagugcucaauaaauauuuacugaaugauuaaauggggcccuaagggacugugauaggaggggaaagaaggugccucucuuucuuuuuuugagauggacucuugcucugucacccaggcuguaaugcaguggcaagaucucuacucacugcaaucuccgccucccggguucaaaugauucuccugccucagccuccugaguugcugggauuacaggcaccugccgccaugcccagcuaauuuuuguauuuuuaguagagacggggguuucaccauguuggccaggcuggucuugaacucuugaccucaggugauccgcccaccuuggccucccagagugugggauuacaggcaugagccaccgugcccagccagagggugccucucucucucucucuuuuuuuuuuuuuuuuccgagauggagucuugcucuguugcccaggcuggagugcaguggcgcaaucucggcuuacugcaagcuccaccucccagguucacgccauucuccugccucagccuaccgaguagcugggacuacaggugcccgccaccacgcccggcuaauuuuuuguauuuuuaguagagaaggaguuucaccguguuagccaggauggucucaaucuccugaccucgugauccaccugccccggcucccaaagugcugagauuacaggcgugagccaccgcgcccggccagggugccucucuuacauggauuauuuauucagcaaauauuuauggagcaccuccuauaugccaggugguaugcuaaggcagcaguccuuggugggggcgggguccugucuagaggaacaggaggcaguuaagagcuguggugagcaaggaacaggucacuguggaaauacaggacagagaaagcuuccuagaggacacagucccugagcugugguuugaggguuaagucaagguggaauuuuugagaggccaggcacgguggcucacgccuauaaucccagaacuuugggaggcugaggcagggaaauugcuugaagccaggaauucaagaccagccugagcaacauagcgagacccaaucucuauaaaaaauaaaaaaaugagccaggcgugguggcacacaucuguagucccagcuacucaggaggcugagguggaaggauggagccuaggaguuggaggcugcagugagcuaugaucgugccacugcacuccagcauggguaacagagugagcccgucucaaaaaaaaaaaaaaaaaaaaaaaaguagaagagaaaguucuagcccagggagcaacaugagcaaaaauaggagugugucagaguuugguguauuagaggaacugccaguuguucauacuggcuaggcagggccuuacauuugaggggagaagggugagagauugagcuggguggaggaggacaugaaggccuuugggugccaugaugggaggugguggaagguuuugaccuguccaccuuccuguuuccuccuugaagcugaggcauacgucagugggaugcucuuuugccuggguauauuucucuccuuuuaccugcugaccguccuccuggccugcugggagaacuggagguaaaguggaacugcugggccuccccuggucugggugguuugggcagguguguggggcagaucaccuggcaggaucugagccagccuaggguaaucuacaccauccauagcagaugaugguggggcuguuagagucuguggcccaugagccucucuagaaaccauccccuccccucaaccuucuucccaagcagggagaucccauguugcuccccagccugugaggaacccugggacaaaggguggaggacagggucauagcgaugagaguggagcagagagguagaaggaaagucagccccauacagagugauccuuguccugucccaucuggguggccuguggguucuguccaugcaggcagaagaagaagacccugcugguggccauugaccgagccugcccagaaagcgguaccuccagggggccuggguggggcgggcacagugugcuuuguguuuugggggguggugguggaugguucccuaggggguuggaggaggaagggcuggggguuucuggauguucagauggggguaacacuccacagaugggaaugaggcugggauaugauguccaugcaucccuaacaugcacaccucagaggcugagguguugcuugguuuauuccaugucuagcgauggugucugccugccuugggcaguguggcccacggucucugggauuauuaaccuuuccuucucucucucuuccaccccucccucucuuucuguccucccuccugcgugggaccuucucucuuagcuucucuccuugguaagcuccaggugcugugggcagaggagcuggaguccagaguaggggagggagggugcagcacagggcugucuggagggcucgugggcgggccaguguugucuuuguugcugguaacuuagaugugccuguucuugaacuuucucucuccuuagggaagacaaaggguggugcuguuuccaugggagaggcaggcagggggcuggggcggguggugguggcagcagugggguguguuugccuggauaggugcugcuucucgucugcuggcauggccucccuguggcugucuucucuggaccuuucuuuguucuucucccuggcucuaggccucucucuucguccagugcuaacagaccuugacuucucauugcaggucacccucgaguccuggcugauucuuuuccuggcaguuccccuuaugaggguuacaacuauggcuccuuugguacgugucaaagccagcaccgugcuugcuggggacaugaccuugucuccuuaggccaccaccuccgaggcgguaaagugggagccaccuccuccagcccccacacccucugcagaugcucagagccccuuucccugcggccucuccuuccugccucaccacugaucguuccccacagagaauguuucuggaucuaccgauggucugguugacagcgcuggcacuggggaccucucuuacgguuaccagggugagugggccaggcugggaggggcgguguggugcaggacgguguugucuggguaaaaugucacggugggcgguugccucuucugccagaugcuggaaccugggaagggccugcugucuuccuaaccccucucuucccucauccccuccuccuuggccccaguucccugguaacuuucccuuuccuuugaagggcacgaccaguucaagcggcgccuccccucuggccagaugcggcagcugugcauugccauggguagaccugggguggggguagggcuguuuugccaaucagugccugccggcuccgguugacugccggcuguggggccagaaagauucuaugugcauggcuuccccauguaauuccaguaauugcccgcucuugugucuucugagauagcagcagagcacaggcuccuuuggcuggcgggcuggcgccuccgcucucuccaggcuggacaaucuaguuuaucgucugcguugccagcgcccucacucccuggccugcuuggggagggcucacaggcaugggggucacauucuggccucuggauaaaggagaaaugcucuuucugcaccccaggcccacugggucuuuaacccaguggcagccaaggcagugucuucucagaacccacagggcugggcacccuugaaucagcaugacuugccgaguucaauccuguuguuugugucugcugccuggggucugccuuguguccuggccugggaagcccuagcccaugaggggugccaggaacagagcaaagcuagagcggccccugugugguggccucuucuagagucuaccaucaucccccaggacuuaggagcaccugaugucuccucccagcuccugagcccacuuccaccccaacucugaggcccagcccacaauuugccucuucccuacugccuaauaauuguuacaauugccucagaugggcgagggccacuguggguuuuguguccaccggugcaaccccucccucccugcccuuuccaggccgcuccuuugaaccuguagguacucggccccgaguggacuccaugagcucuguggaggaggaugacuacgacacauugaccgacaucgauuccgacaagaaugucauucgcaccaaggucugacccgugggccuggccuggucaggcguuuccugagaaagggacauucugcguucccgccccagcauguucccacugacguggcauuuagggaagcagaaggaaggggcucagcuggggcagggcagaugccggggaaacuaaccugaccuccaaccccuuccggccugauuggccaaacccucuuggucuaagcggccgcagcagugggauguccuugaacccugccccccugaauucggcccugugugagggaggccccucuuguccaccucuaaccugggggagggggcuucucccaaguagcaguaaguggggcugauuccagcuucuccccagcaauaccucuauguggcugaccuggcacggaaggacaagcguguucugcggaaaaaguaccagaucuacuucuggugagugggcugagugucuggggcucugcuguugguggguguguggcagccuugggugccacccaccucacugccgcccuccugcuccgcaggaacauugccaccauugcugucuucuaugcccuuccuguggugcagcuggugaucaccuaccagacggugagagggcagggcagguucaccuuuccgacagccuaggacaccgccccaaagugcagagccucccagccuggggcccugguguuccaucacaggaccuggguucagaucccagcucugccuucccagccgagugacccagggcaaaucacauaacccccccaacccugagugucaguuucuucaucugcaaaaugggagcagcccgcacuaaagauagccccucccugguuucuugugcggauuaugaaaccaaaguccuggggcuuuguaagcaucaguuucccuucccuuuucucugucccguggggcaagaacuuccaucacggucaugccucaggguuuucagccacgccuaaugagaggggacagcgacugugcugcauggcauccauguucucagaaggaacacgugccugcggugcuguguauucccaccugcuagcugugguggcacuugcuguuuuuugccaaaggggcccggauggcggggcgugggcugaguugggcgugacgacagacccacucccugucccugcuccugcuacagguggugaaugucacagggaaucaggacaucugcuacuacaacuuccucugcgcccacccacugggcaaucucaggugggggucaugcugggaggccccuuguccaggccaagggugaaauggggcagggccuggggcuuugcaaugcccacgugggcuagggaagaggccugggugugagucccaagcagucugccuuguguugccccuucuagcgccuucaacaacauccucagcaaccugggguacauccugcuggggcugcuuuuccugcucaucauccugcaacgggagaucaaccacaaccgggcccugcugcgcaaugaccucugugcccugguaagggagcaccugccugccugccgcagccucagcuccagcacagaccucaagccuuggcuccaggacacccuuuugggcaggccuggcccugccuuccccagcucuccccuccccaguucugucuggcccacccuauccagcccagccugccccacccugcccugcccucccuugccagccugcccaggccagcccaccccugcacacccacacucgacacauaccccaccccuuuuccucuuccacuccucuuagggucccucuuuugggucccuucuucccuuccugccucacuuccucccucccuucccuucucucucuccccaacaggaaugugggauccccaaacacuuugggcuuuucuacgccaugggcacagcccugaugauggaggggcugcucagugcuugcuaucaugugugccccaacuauaccaauuuccaguuuggugaguggggcguccuucuuuucuggcucaaccuacagcagggaccugccugaguccuucacuauccccaagucacccacagggaucgcuaagacaccccuguaggaaacuccaaggcuggcgugccugggugugcacacauccuagccuauggaacaugggcaccuagaugcugcuucauucaucugucaagcuauuccuauguaaaggcaugugccgcagugaagaaaacaguauaauuaagaaggggucccuggccgggugcaguggcucacgccuguaaucccagcacuuugggaggccgaggcagauggaucacgaggucaggagcuccagaccauccuggcuaacauggugaaaccccgucucuacuaaaaauacaaaaaauuagccgggcacaguggcaggcgccuguagucccagcugcucgggaggcugaggcaggagaauggcaugaauccgggaggcagaguuugcaaugagccaagaucacgcccugcgcucuagccugggcaacagagcgagacuccgucucaaaaaaaaaaaaaagaagggggcccuggcugggcacuguggcucaugccuguaauccuagcacuuugggaggcugaggcggggggaucgcccaagguggggaguuugagaucagccgggccaacauggugaaaccccaucucuacuaaaaaugcaaagauuagcugggugugguggugcaugccuguaaucucagcuacucagggggcugaggcaggagaauugcuugagcccaggaagcggagguugcagugagccgagaucccaccauugcacgccagccugggcgacagagugagacuccgucuccaaaaaaauaaaagggagucccugaucucagggugcucacagacuaagacacagaccaaguugucccuguuuucaggagaugucagacucugggugacagccagugggguggcagugugguguggcagguacaacuaaggaacugaaguucaagugccacccugccaccagcucacaccauggccgugguggggcaccagggcucucucuuccucugggauuguuggggccaggaguucucugcuggggcuugguggccauuucugcagcucccuuccgugucccucauccuagacacaucguucauguacaugaucgccggacucugcaugcugaagcucuaccagaagcggcacccggacaucaacgccagcgccuacagugccuacgccugccuggccauugucaucuucuucucugugcugggcguggugagggccugaccugcucugcucagccuguaugauaggaaaggugcacgugcguucagacacguagugcacacccuccgccaccuccugcaugagagauuccugcuccuucccugagaugccuuccugggccccucucagagucccagccuggcugagcagccagccccaggaagggugggccauccgagccacuucccucuccacccucaccgcugcccuugguggccucccgacaggucuuuggcaaagggaacacggcguucuggaucgucuucuccaucauucacaucaucgccacccugcuccucagcacgcagcucuauuacaugggccgguggaaacuggguaagggcacgcccggggcagggccugggggaggggucuggggggccuugggaacccggacgcacgggagacgcucagguucugucuugggggcccuggagucacugggugaggaauuagaucaggccugggcuccucagcuggcacaucccagggguccagcaaaggagggugccccgugccugucagcaccacucccuucucuucgcagacucggggaucuuccgccgcauccuccacgugcucuacacagacugcauccggcagugcagcgggccgcucuacgugguaccugccugguuccccugcuccauucuccacaucuccuuucuucccucugaugggggaguggggcugggcugaggacccaggggagaguggggaccagcuggcugggccuucuuccaccacccucccugccccugcccucagucccugugucccugcuucccuccaggaccgcauggugcugcuggucaugggcaacgucaucaacuggucgcugugaguauggucagcaguaguggccugguuggguggacagcuggggacucggucagccacuggcugccuugggggcuaaggacaacuuccaaauguugggcauaagacaugggggcuaagagagaucuuggccucucuucucucucuuggcaucugggcuucuagaaucuucugugggcuucugaacacagcccaacaucauaauaaaacaugccuaggcagggcaggaagagcacuuccuugcccuugggcuuccugcuucaccacccuucaucccucuugccagggcugccuaugggcuuaucaugcgccccaaugauuucgcuuccuacuuguuggccauuggcaucugcaaccugcuccuuuacuucgccuucuacaucaucaugaaggugaguggggcuggccaagcccccucugucagcugcucugcuaucuggggagagagaugggcccggcagcauugaggggcagugagaaguuuucugucccaucuuugcugguugcggaggggagaggcuaaagccucuugcaugggccccugggagccaacugcagcccaaagaccauuuacugagccccuuccaagggcccuugaaacagguggcauuuuaggcugcaguuguaagugccccuuuccaugcagaaggggcugaggggagguagggugugggccucucaggaucaggugcuuccccagaaaccauccugccuuccacucugauuggagcccccugcauagggagcgccuugaggccagugcacugucccgacacaggguucuggauacauggaggcugggugggguggacaucggggugggggcagguugagcucugugguugugcggaaugguaugaauccaaggagcaguccugaaggccugggaggccaugaggaaagggaaucugggaaaggcugggugggacagcggggugggacagggguaagcccucagacugcugucccugccuggccccucccagcuccggaguggggagaggaucaagcucaucccccugcucugcaucguuugcaccuccguggucuggggcuucgcgcucuucuucuucuuccagggacucagcaccuggcaggugagcacucacccucaggcuccuugugagccaacaaguggccaguccucuuuuuaaacauuggggcugagccugggauuaccuguaaucccagcacuuugggaagcugaggcaggaggaucacuugaggcguucaagaccagccugggcaauauaguaagaacccgucucuacaaaaaauaaaaaaauaaaaauaaaaaaauuagccuggcguggugguauucaccaguaguccuagcuaccucggaagcggaggcaagaagauagccugugcaggaguuccaggcugcagugagccaagauugcaccauugcacucuagccuggacgauaggccaugucucuaaaaaaaaaauuuuaaacaucauuugggaacaccuaccauaggccagcacuuucauagcggcuuccccaguuaauccuccuagcauuccagccuggagauagcuccaguuuacuuacgagacagaugaggcucagagaggccaagugacuuccccagggcacauagccagugaguggcacagcuggcauuugaagccagcaaggcuuggcucucuucucugccuugcaggacaccuaccacaugucaggcuuuaauucugggaauagaacuaagucugacauggucucugagggacucauaaacuagccgaagagggcuagaaggacuguuggugcaugacuguuagugcuguuuacgaugugauacaugaaaugaagggcacaggcaagacggggcaggaggacagaggacuaacgggucucuccgaguuaggaguccaggaaagcuuccuggaaaaagugcgccuuguucugggcuauaaaagucuugggugaggagggcugggcacgguggcucacgccuguaaucccagcacuuugggaggccgaagcggguggaucacgaggucaagagauugagaccauccuggccaacauggugaaaccccaucucuaguaaaaauacaaaaguuagcugggcgugauggugggcgccuguagucccagcuacucgggaggcagaggcaggagaacggcuuggacccgggagguggagguugcagugagcugagaucucuccacugcacuccagccugucaacagagcaagacucugucucaaaaaaaaaaaaaaaaaaaaaaaaaaaaagucuuggguaauggagaagagccccauggcccagaccuacugugaccuuaguaaugauacaggggcagauuuggaggucagugaaugcacucauuugggagccaggcagacugugagcucccugaggguggggcaggucuugguuaugucuguggccucagcauguagcacagacagacacagccuggaugagcuuaugggauagagcuuaugaguagagcagggaggaccuugagugccacagguuauggcuacugucccggagcagguguguaaccugacaguagugcuuuggaaaaaacaaugagccugcagaaagauuagagcaagggcggaguccaaggccgggaagugggugagaaggccuucugccaucucugagcugaaggccuucaagguuguugcaacccugugcucuuaggucaagggaagagaaucagaaggaaggaggaggguaagagugaaagaaaagggaagagaagccagugaacucagggagaaguuuguaaccaaaggccauuuguuagaucgggaagggguagggacaaggacaagggacaggucagaauugcugcuguccugccuggggcuggagagaggggugcccaggagcaagauggcagaugggucuggcccuugcccugccagagcagggucauucggcaguuuuucuuguugcuccccaagaaaaccccugcagagucgagggagcacaaccgggacugcauccuccucgacuucuuugacgaccacgacaucuggcacuuccucuccuccaucgccauguucggguccuuccugguaagcgggccucccggccgagccggguggguacgugaagguagcagcugccuccuucucuguggcugaucuggcguccacaccccagguguugcugacacuggaugacgaccuggauacugugcagcgggacaagaucuaugucuucuagcaggagcugggcccuucgcuucaccucaaggggcccugagcuccuuugugucauagaccggucacucugucgugcuguggggaugagucccagcaccgcugcccagcacuggauggcagcaggacagccaggucuagcuuaggcuuggccugggacagccaugggguggcauggaaccuugcagcugcccucugccgaggagcaggccugcuccccuggaacccccagauguuggccaaauugcugcuuucuucucaguguuggggccuuccaugggccccuguccuuuggcucuccauuugucccuuugcaagaggaaggauggaagggacacccuccccauuucaugccuugcauuuugcccguccuccuccccacaaugccccagccugggaccuaaggccucuuuuuccucccauacucccacuccagggccuagucuggggccugaaucucuguccuguaucagggccccaguucucuuugggcugucccuggcugccaucacugcccauuccagucagccaggauggauggggguaugagauuuuggggguuggccagcuggugccagacuuuuggugcuaaggccugcaaggggccuggggcagugcguauucucuucccucugaccugugcucagggcuggcucuuuagcaaugcgcucagcccaauuugagaaccgccuucugauucaagaggcugaauucagaggucaccucuucaucccaucagcucccagacugaugccagcaccaggacuggagggagaagcgccucaccccuucccuuccuucuuuccaggcccuuagucuugccaaaccccagcugguggccuuucagugccauugacacugcccaagaauguccaggggcaaaggagggaugauacagaguucagcccguucugccuccacagcugugggcaccccagugccuaccuuagaaaggggcuucaggaagggaugugcuguuucccucuacgugcccaguccuagccucgcucuaggacccagggcuggcuucuaaguuuccguccagucuucaggcaaguucuguguuagucaugcacacacauaccuaugaaaccuuggaguuuacaaagaauugccccagcucugggcacccuggccacccugguccuuggauccccuucgucccaccugguccaccccagaugcugaggaugggggagcucaggcggggccucugcuuuggggaugggaauguguuuuucucccaaacuuguuuuuauagcucugcuugaagggcugggagaugaggugggucuggaucuuuucucagagcgucuccaugcuaugguugcauuuccguuuucuaugaaugaauuugcauucaauaaacaaccagacucaguucuuggggcccuuguuugcacucccucuggguggagcuguu

SEQ ID NO: 15973 - RNA, 2342 nt, Homo sapiens
aaaaaggaagaaaggacucuaagcagaaagagaucaaacuucagagaaccaggcacugggggcagauccuggccugccacagaaaccaaaccacuccccguucugaaaaaaaaucagauuccccauucucaacuccauugcuucucaguaaacggcagucauggagagagagcaagagacccgggcacgagaccacacagccagguugcaagaauucucccaaucucagcucugccuggggucuagacuucccacacuagcugugucuauuucaacucagggacucacagcuggugaagaaaccaaagagaagucagggugaaguggauuuuucacaguggacaaauuccccuucucuucccacccaacuugcaguuggccuuauaaaaccucugucacccucaauuuacaaggccagcuggcucucccaggcaggaagagggcugggaagcccugcauucaucucccuggggagucugagauguaacuugccugcacagagcuuuucaguucugggccagucucauuccccugagguuuucugggcaagcccaguaauaagccuguuuccucucccaccgagaccccacagagcugucagauucugggguuuaggguagagagcaagccaugugugcucagaccacaacugauggaagaaugggggcggaagagaagaugggaaugagccaacuucaaaaacugcccagcuggagcuucagagaaacauugguggcaaaggaaggaggacuggucaagaggcuccagugugguucugggaacugggaaccuagcaggacagcucguuccuggggccucccaaaaggguagcggggcggcagaaucgccuagcccucgucggcuuccccacucgccucuggccccuaagcccccagcccucacccuguugcgggucacaguaugguugaagguguagauguugaccagcucgcuguugaccucguccacguaggugcgcucaaacucggcgucuuucugcgagacguucuugggccccagaacccccagauggcucucgaccgaggccaccaagagcaccaagaagggcaagcccagagcgaacauggccccggcagggcggcaguggcagcggugguggcggcggcggcggcgacaggagacaggacaccuccgggacggguugcggcugcggccgcagcuuccagcaucucaccaggaccagaacuuuaaccccggccugagauuaggaaauguccccucccaagagccccgaagaggcucccaggguccccgcaggggagggggcggccgggagggggcggggagggaggggaugcuggcuacgggaaggggucccagcucgcgaggggcugaguacgaccugagacccuggagccccgggccagggccgugagaaggagggcggcugguugccgggagccuggagacgccgggaaaggggagggaggaagagccggcggcgggggcuggccgcggaggaaggcgagucgcagagugaggggcgugauaggugguagcuacccgacgccgugcugggcugcgaguuuuccgaggugcgggcccuuuaagggcgggcggacgcgccgucccgacgcacgaacacugaaaagugagcugcgccgcugggcgauaaacagcagggcugcuggcccgcccgcugacgucaggggaaacugacacagauuuaaaggaccaggucccgcauuugcccuuaaaggggcugcagcugucuagcugaaggggaaagcuugcaaugccuucuccaacuccuacccaacucucucccgugauuuucaccaucucugaaacucacguuggaauaggcagauguuucuguuaacaaucuccaaguguuggguucuugcugaacaacucuuacauuugcucaaacauaaggauucccccacccccaccaccaccuuuacaacuaacaucguccaacccugggccacuuuuucuccggggaucuuaaaaaaugaaaaacucgaaggauuaggaaacaggacgguggcccuaccggcggaggggaaacggaggcagcacugcaggaggaauccccaugccuuucccaccucccucuagaggggccacacaacugcagggacggccuuccgagcuuuccaagcuugccgggcuguuuccccucuucucucagagacaguuacaaaacucauugaaagauacugaccuucaguguaaauuggugaaaacuuuucuacaaaauauuuuggcacuguuucaagaaacuuagagagcuuuauacccuuugauccaguaauuccacuucuggacucuauccuaaggaaauaggaagcacagauaaaaauaccugggcagcu

SEQ ID NO: 15974 - RNA, 9742 nt, Homo sapiens
cccuugacgacauuguuccccgagugcccggagucugcggcuuuuuuuggggugguggcagcuggcggaagugacgggagagggguggggccgcgagagcggcggaaguaggaagccgaggucugaauugcgcgugguggccauggcggccagcggggcuguggaaccagggcccccgggggcugccgucgccccgucgcccgccccggccccgccgccugccccugaucaccuguuccggcccaucagcgccgaggacgaggagcagcagcccaccgagaucgagucgcuaugcaugaacuguuacugcaaugugaggcgggggcgcggccgcgagcggcggguggguagggcuugugccgggacgagccgggggucagacccagccaggugggcccggccggggaccccgaggagcgcccggagauaguagggcggggaaagggaguuucauugauuuuuuuccuuagcuacuuucuacuucaccagggcaugacgcgccuccugcucaccaagauucccuucuucagagaaauaauagugagcuccuuuuccugcgagcacuguggcuggaacaacacggagauccagucggcaggcaggauccaggaccagggagugcgcuacacuuugucugucagggcucuggaggugagaggaccucagagcagguaccucaguauucuagagagagauucgguacuggggucagagcucugguccaggcggucggaucuuaaauaaaucccccuaugucuccuagccuuaguuucuuuuguaaaaugguacugguguugucaucagcucaagugagauaagauuugugaaaaugcuuuguaaauguugucugaggguaugaaaugagcaguaguuguuaugaauaguauucucaccauuuggacagccuggcucacaccaccuguacuauucgaaaggagcagucuggacccuguggaguggcgagagggagagacagcugggcugcggucugauggaaggggacggucugguuauuacuugaggagaagcuguucugcagucucuuuguacugaacguauucuuuucuucccaggacaugaacagagaaguggugaagacugacucugcugccacaaggauuccugagcuagauuuugaaauuccugccuuuagccagaaaggagguaaguuuaagaucagaguauuugggcuguucgcauguagcuagaaucuuacccucuuucuugcaaaacccccuggugccaggucuagugguuuguguauggguucuaccauguaaucauugugaucuucauuaguuaaucaugaguggaaagcuuagguaaaacagcucgagaugguagaaaguaaugguaauaccauaguguguuuauuguagaauuuuagcaucacuauuaucagacaugaauggaaccuugcaccuggccuucucauuuuacagaugaggaaauuaagacccagagaguucaagugaauugcccagggucauacagggacuugauagcagagcugaggcuaagucacacuugucuuuuguucuuguucacaagcucugaccacuguugaaggauugaucacccgugcuaucucuggccuggagcaggaccagccugcacgaaggguaagcugggguuuucugauuguagcagcucaaggaauaauugcuuauauagagugucccaugugucugaagagucucugacuaaguguuggaaacuugcuggguaagcauaugguggugcuggagcugcuagaauguugcauauguuauaauuauugucuuuuccacuucccucccucaguauauauucaggccucaucagacaauauaacauuaccucugaagagccuuuccuaauccccuuggguuaucuguguuuccugaguauuccacugcaucuuauauuuauuaugacagaaguaauauauuauagcugcaucuuuaguuauuugucuccuuaauugguuggggagucccaugagaggacugauauauauacuauuauaucucuaacguggcaugagugccugggcuaaaugguugaaugagugagaaaaaggaggcucaccugucaccacccgucaacuucaggcuuguuugcuacaucucauugugaagccugagucacucuguuuccacucacacugagauagguggugacuuccuaauggaaguaacaugggcaugacaaggggcagggcauaagguacaccaccagggcugaugcuuuacucucuguucauggcaggcaaacaaagaugcuacagcugaaagaauugaugaguucauugucaaacugaaggagcuaaagcaaguagccuccccuuucacucuggugaguauugagaggcuggaguugcccuugauuaggggaggagggaccauuaagacugcugggauuuuccacugugaugccugcguggucugauaguaggugauguaggauuguuuaugauuuucuuuugcagugacucucucuucucccauuuguuagaucauugaugaucccucagggaacaguuuuguggaaaacccacaugcuccucagaaagaugaugcccuggugaucacacacuacaaccggacccgacagcaggaagagaugcuggggcuucaaguaaguggacugaaggauccagaagaaugcucuggaauuaucgcgcacucuggauugcuuggagucaguggaacuuauuuugcugcugcugcucugugugcccuaucucagcuuguuugugcuucucaucuugcuuauguccaggacuuggguaaacuucacagaaaggauggcaguggcugugauccuaucuuaaguccuguucuuccuuugguuggggcuuuacuuugugguuucucuaacugaugagguggcaccugacauaacugaugagguggcaccugagcauuucucccacuccagggcaggguguuggggacacugagguauaccugccaacuugcgaccugcaucuuugcuauuuuaggaagaagcaccagcagagaagccagaagaggaagaucucagaaaugaagugagucacauuggcuacuggugaggaaggagcagaguugugggcugagacugaugcuguucagcaucugucuuccuugucaccaacauagaugaccacuagcauaccaacugagugucuuuagccugaacaucccaucugggagggcucacccuuuguccucauguuguguuccaggugcuccaguucagcacaaacugcccagaaugcaaugcccccgcucagaccaacaugaagcuaguacguaucuuuugccaagcaguuggguugcucuucaucugacucaggcaugaagauuauaaucaggcugggagcaucccuuucaaggaaaacacaugcuuuauacccagugauaaggaagauauuaucuuugauuagacuguguaccuuggguuuuguguucaaagagaaaauuaggccauggucacuaggcugugugugugugaccugagccaugccuucaaaugugugaacagggauugccauggguugggaacuugcccucuucuggaggacucugugggcugccucuugugaauauuuccugcaguucugggaccagcauauguuugugugggguuuggcuuuguuuuuccccagaugguggucuuguucgccuggaaguagauuuccuuaacuccguuuuccagaaaucccucacuuuaaggagguuaucaucauggcuaccaacugcgagaacugugggcaucggaccaaugaggugggugggcgccauuauuugggaagaagacuagcuuaaggguaacccccuuuuaacuaucauucuuccuaaguacuucaguacucgggggcaggggguguagaguagcuugggucuuuuucuuaggucuagugcagggugaugagcccuugaaggaaugggaauuagccuagagaagaaaaguuagagauucuauaacuuguuuaagacauauuaaagguugaugauauggaagagagaagucuuuugacccacuccucagagguguggaaguucagggaggcagacuuugacuucacaaugaagaacucaauagagcugucugaaaauagaaugagcugccuuagagaauuauaaauucccuuccccugaguguaucugaguauaagcuaauuaaauucuuuaaccagaauauuauaaaggagacccacacauuggaugcaguggaugaaaggacugcaauaaaugcuuaaaagucucuuucaaccccaaaagucuuuuuuuuuuuuuuuuuuuuaagguaaauucagaguuuauuggcaauuugggauaaguuuuggcacguuaccaggguugggcacuguuccuggccagcucuugguguuuuugguuugggcgacugcuguuuagaaggcucuuucuuugguagcuauuaauggcccuaacugauuggauguccaagccuacacuccaggucuccuggguaccaagugaggcucaggucuucucucuguugcuccugacuguuaucgaugcaggugaaaucuggaggagcaguagaacccuugggcaccaggaucacccuccacaucacagaugccucagauaugaccagagaccuccucaagguaacagucugcuugggaaagucacuguuguccucauaaguuagauaaacugucucuaucuaggggaaguugucuuuuagaaauaauguucagggacaugagguaucuccuacuucccuggcuuugaggaccccugagcagagggaguuaaucuaagauuggaauugcagguuuagaaggugacccuguuagcucuuucugaugaccugguagcuuuuuggccuccagugucuaucuggguccucuucucugucuguccccuagugacaggauaccugacagcucgaagcuaugacugaguuucccuuuauuaaguuggaucuauucccgugguucagauggacaggagugagucucaagcuuuaacaagggagucagagaaaacugagacagcugcccuuguccgcagucuaucacugcugguauuaauugggcaggaggccucugguuggcuuucuuugcuucugacuuaaagcuuaaacugaccucucauuucacagucugagacuugcaguguggaaaucccagagcuagaauuugaacugggaauggcaguccucgggggcaaguucaccacacuggaagggcugcugaaagacauccgggaacuggugagucacuugaguaguguguaaaccaccuuugagcaauuuggcugugugaagagggacuggaagacuucagacauccuaauuuucggugcugguaacuguggguuucuuugccuuaaagcugguuuaagagacuuaaauauuacuuuggauggugaagacaaguuuaugggaaauguugaauggaaauuccaggccuaacuuugggacuuuauaguuauuuuguggucuuggacaagucauuuauuuuacuguaaaguuaggggaugaggguccuucuagcaccuaaaacuucccaacauaaaaaacauacauguauggguugacuuagcccaaauguuuaucuccuugaugaauuauuucacuugauucucuguugggcauuuuguauuuguaaauuguacuuuuucuuugcauuucuucuccaaauuaguaucagagaucauauucuaagaacauguuucgauuuuguuuuacauugccaguuuuguuaucuuggcacauuaucccauagacuccuaggagugacugccuuggucagaaagguggugugggcuaaauggaaaccaaguuucccugacagggcacccacugucacccccugccuaguuuauggucaggccuaacaaauauaaagccaguauucacauaguuuggauuaucauuuauugcaggugaccaaaaauccuuucacacugggcgacaguuccaauccuggacagacggagagacuacaggaguuuagccagaagauggaccagguaagaggucacuggccagucaguacuuagaauccuggggcuccagugaacaggaggcugcaugcucaugucuugccacuuuuugaacaucuaaccaucauguuggggauucuucuucugguuuucuuuucuuuuuuuuuuuuuuggagacagagucucguucuguugcccaggcuggagugcaguggcgugaucucggcucacugcaaccucugccucccggguucaugcgauucugcugccucagccucccgaguagcugggauuacaggcgcacaccaccacgccuggcuaauuuuuuguauuuuuaguagagacaggguuucacuauguuggccagacuggucucgaacuccugaccucgugaucugccugccugggcuucccaaagugcugggauuacaggcgugagccaccgcaccuggcccucuucugguuuucuauauuccacgucuucuuucuuguuuuucucccuuauuuuguuagagcaucuucuccaguagcuuccugggaaaaagugcaugggaaauaaaauuucugggaccuuccacaucugaacaugucuuuauucuguuaucacacuagagugauuauuggcugggaauacgauucuaggauagaaauaauuuuuuaucagaauuucgaagacugcacuauggucuuccaguuugguaaagacauuguacuauagucuuccacuuuggcuauugagaagucugaagccauuugauuccuggucuuuuauaugugaccuagucuugugaucucuucguuuccuuugaugugaaauuucagggugugccuuggugugggucaguuuucauccacugggcuaagcacuugguagauguauuuuuucagucuggaaaacucaugugguucaguucuaggaagcuuucaugaauuauucuauugaagauuaucuuuuuucugauuuuuuuuuucuguucuuucugaaaacuccuggguuuuagauauuagacuuacuugucuggucuucuauaauuuacucuuuuuuugguccuauuuuugguuucuugguuuuuuuguucuucuuugggagauucccucaacuuuauuuuccaacccuucaauugagguuuucauuuccacuaaaacuuuuauuuuccaaggagcuuuuuaaaaaauagcauccugucuuaaggauguaguauuuuuucuucuugaggauuauuauuuuuuaaauuuuuucagcaugcaguuuauauagcacuuauugauacugauguuggaucuuuuuugacauuuuauucuccuugcauccuuuuuuuccccauuugauuucccaucuuucaguguuaagggcuuugcucagaugucugauaaucauugauugucuucuuacaaguagcgggcuaaagaccugaguagggggugagccuuguugacauggggcuuauuacaggggaauuuaacuuagcuguuuugcugagguggccuccaaugccagaauuguuaggucuuuccucuugggcuagucagacaaagaggcuaugccugccagacaagaaccaacccaauuuauauuacagaauccuccaaaguuuuaagaauuggugaaauuagguagcucugaaaguagaggggaaaggaucuaaaauaaggacuguuagaaaagccaacaucagcaagcuguggaccagggggugcuggcccaguugaagguagagggaaaggacucaagaacaaggagguuaaaugacuguggcugcuccauuuccuggccugaggguaaaggcuuggcuggcaguguucugagagcugugggaagggggcugggguguguauguauucuguuucccauaagcuuacauucauuuaaccuacuuguucuugauuccuuucccucuaccuucaacugggccagcacccccuaguccacagcuugcugauguuggcuuuucuaacaguccuuauuuuagaaccuuuccccucuacuuucagagcuaccuaauuucaccaauucuuaaaacuuuuggggauucuguaauauaaauuggguugguucuugucuggcaggcauagccucuuuuuuuaaaaauuuuucuuuacuuucauuuauuucauuucuuuuuuuauuuauauauauauuuauuauacuuaaguucuaggguacaugugcacaacgugcagguuuguuacauauguauacaugugccauguuggugugcuguacccauuaacuagucauuuacauuagguauaucuccuaaugcuaucccuccccccucccccgacauagccucuuuuuaccagggguuauguaaaauuuacuugcuguguucucucucuccuuuagaucaucgaagguaacaugaaggcccacuuuauuauggaugauccagcaggaaacaguuacuugcagguauaguagaccuucccugauguuucauagagauacauuuucugaucuuccuugaauauguaucauuucccuagaaacugaaagacuugauucuaaauggacugcuuuuuaccaaggaggcagaaguuagaagauacauaagggagaaaagaggggggugugggaggggauuuuuuuuuuaaguguauguaaagaaggaaaaaaaaaggauacucugaggccccuuuuuuuucuguagucaagcucuugucccaguucuggaguuuucauuuugcaaaucugauuauggauugaggagaaaugguaccuuguccggaggccaagauaggaaacugauaggcuuuaaguugacugaggagagagucuggugauugauguaccuuuaccauuuauuggauacuuaccaugggucaggcaaaacucuucuaaguucuuuccaagauuaagaccauuugucauacuuuucauaagaaggugcagauauaacaaaauagguggauuguucccugauucuggggcuggggucuucuaccccuggcccaugugggcucuguugcuacccacuaguucagucuagccaugggaaauuggaggccaauaaaaagaaaaaaacccaaaacucauucuguucuugggaaggugggaauuggaagcugccugcagagagggggaguggcacagcggcacugauugucucuccuugaccuugcagaauguguaugcgccugaagaugauccugagaugaagguggagcguuacaagcgcaccuuugaccaaaaugaggagcuagggcucaaugacaugaagacagagggcuaugaggcaggccuggcuccgcaacgguagcaguggguggcucaagggccagccuccagcgcugcucuuucuguagguuauuuauuaguauuggaugaaggcgaaggcugggagugucuuucccaccagcccuugcccaugguggggaggacaucuggucugagucagagaucugugcacacuuucuaaacagcuugugaugcaagugugagccuauuguguuacuugaccuuauuuuggaaguuuugaauuggccuaggaggaaacccagaaaugaaccagggguaugucaucacuuuuuucauaucaaguccucacccuccuuccacauaaugcucuauccucuaagguuggaacucugaaguuggagaagguggaauaaaguuacaccuggaguuuguuguugguuuugaguauauaaaauacugacuuugaacaggaaaggagucuccugaggggagaccgaguccagcacaagugaaggaguuaccauugaaaugaugacuuucaaacagcacuggccucuguauugacccuauccuuguuugauaucaugcuguuaga

SEQ ID NO: 15975 - RNA, 9742 nt, Homo sapiens
ucuaacagcaugauaucaaacaaggauagggucaauacagaggccagugcuguuugaaagucaucauuucaaugguaacuccuucacuugugcuggacucggucuccccucaggagacuccuuuccuguucaaagucaguauuuuauauacucaaaaccaacaacaaacuccagguguaacuuuauuccaccuucuccaacuucagaguuccaaccuuagaggauagagcauuauguggaaggagggugaggacuugauaugaaaaaagugaugacauaccccugguucauuucuggguuuccuccuaggccaauucaaaacuuccaaaauaaggucaaguaacacaauaggcucacacuugcaucacaagcuguuuagaaagugugcacagaucucugacucagaccagauguccuccccaccaugggcaagggcuggugggaaagacacucccagccuucgccuucauccaauacuaauaaauaaccuacagaaagagcagcgcuggaggcuggcccuugagccacccacugcuaccguugcggagccaggccugccucauagcccucugucuucaugucauugagcccuagcuccucauuuuggucaaaggugcgcuuguaacgcuccaccuucaucucaggaucaucuucaggcgcauacacauucugcaaggucaaggagagacaaucagugccgcugugccacucccccucucugcaggcagcuuccaauucccaccuucccaagaacagaaugaguuuuggguuuuuuucuuuuuauuggccuccaauuucccauggcuagacugaacuaguggguagcaacagagcccacaugggccagggguagaagaccccagccccagaaucagggaacaauccaccuauuuuguuauaucugcaccuucuuaugaaaaguaugacaaauggucuuaaucuuggaaagaacuuagaagaguuuugccugacccaugguaaguauccaauaaaugguaaagguacaucaaucaccagacucucuccucagucaacuuaaagccuaucaguuuccuaucuuggccuccggacaagguaccauuucuccucaauccauaaucagauuugcaaaaugaaaacuccagaacugggacaagagcuugacuacagaaaaaaaaggggccucagaguauccuuuuuuuuuccuucuuuacauacacuuaaaaaaaaaauccccucccacaccccccucuuuucucccuuauguaucuucuaacuucugccuccuugguaaaaagcaguccauuuagaaucaagucuuucaguuucuagggaaaugauacauauucaaggaagaucagaaaauguaucucuaugaaacaucagggaaggucuacuauaccugcaaguaacuguuuccugcuggaucauccauaauaaagugggccuucauguuaccuucgaugaucuaaaggagagagagaacacagcaaguaaauuuuacauaaccccugguaaaaagaggcuaugucgggggaggggggagggauagcauuaggagauauaccuaauguaaaugacuaguuaauggguacagcacaccaacauggcacauguauacauauguaacaaaccugcacguugugcacauguacccuagaacuuaaguauaauaaauauauauauaaauaaaaaaagaaaugaaauaaaugaaaguaaagaaaaauuuuuaaaaaaagaggcuaugccugccagacaagaaccaacccaauuuauauuacagaauccccaaaaguuuuaagaauuggugaaauuagguagcucugaaaguagaggggaaagguucuaaaauaaggacuguuagaaaagccaacaucagcaagcuguggacuagggggugcuggcccaguugaagguagagggaaaggaaucaagaacaaguagguuaaaugaauguaagcuuaugggaaacagaauacauacacaccccagcccccuucccacagcucucagaacacugccagccaagccuuuacccucaggccaggaaauggagcagccacagucauuuaaccuccuuguucuugaguccuuucccucuaccuucaacugggccagcacccccugguccacagcuugcugauguuggcuuuucuaacaguccuuauuuuagauccuuuccccucuacuuucagagcuaccuaauuucaccaauucuuaaaacuuuggaggauucuguaauauaaauuggguugguucuugucuggcaggcauagccucuuugucugacuagcccaagaggaaagaccuaacaauucuggcauuggaggccaccucagcaaaacagcuaaguuaaauuccccuguaauaagccccaugucaacaaggcucacccccuacucaggucuuuagcccgcuacuuguaagaagacaaucaaugauuaucagacaucugagcaaagcccuuaacacugaaagaugggaaaucaaauggggaaaaaaaggaugcaaggagaauaaaaugucaaaaaagauccaacaucaguaucaauaagugcuauauaaacugcaugcugaaaaaauuuaaaaaauaauaauccucaagaagaaaaaauacuacauccuuaagacaggaugcuauuuuuuaaaaagcuccuuggaaaauaaaaguuuuaguggaaaugaaaaccucaauugaaggguuggaaaauaaaguugagggaaucucccaaagaagaacaaaaaaaccaagaaaccaaaaauaggaccaaaaaaagaguaaauuauagaagaccagacaaguaagucuaauaucuaaaacccaggaguuuucagaaagaacagaaaaaaaaaaucagaaaaaagauaaucuucaauagaauaauucaugaaagcuuccuagaacugaaccacaugaguuuuccagacugaaaaaauacaucuaccaagugcuuagcccaguggaugaaaacugacccacaccaaggcacacccugaaauuucacaucaaaggaaacgaagagaucacaagacuaggucacauauaaaagaccaggaaucaaauggcuucagacuucucaauagccaaaguggaagacuauaguacaaugucuuuaccaaacuggaagaccauagugcagucuucgaaauucugauaaaaaauuauuucuauccuagaaucguauucccagccaauaaucacucuagugugauaacagaauaaagacauguucagauguggaaggucccagaaauuuuauuucccaugcacuuuuucccaggaagcuacuggagaagaugcucuaacaaaauaagggagaaaaacaagaaagaagacguggaauauagaaaaccagaagagggccaggugcgguggcucacgccuguaaucccagcacuuugggaagcccaggcaggcagaucacgaggucaggaguucgagaccagucuggccaacauagugaaacccugucucuacuaaaaauacaaaaaauuagccaggcgugguggugugcgccuguaaucccagcuacucgggaggcugaggcagcagaaucgcaugaacccgggaggcagagguugcagugagccgagaucacgccacugcacuccagccugggcaacagaacgagacucugucuccaaaaaaaaaaaaaagaaaagaaaaccagaagaagaauccccaacaugaugguuagauguucaaaaaguggcaagacaugagcaugcagccuccuguucacuggagccccaggauucuaaguacugacuggccagugaccucuuaccugguccaucuucuggcuaaacuccuguagucucuccgucuguccaggauuggaacugucgcccagugugaaaggauuuuuggucaccugcaauaaaugauaauccaaacuaugugaauacuggcuuuauauuuguuaggccugaccauaaacuaggcagggggugacagugggugcccugucagggaaacuugguuuccauuuagcccacaccaccuuucugaccaaggcagucacuccuaggagucuaugggauaaugugccaagauaacaaaacuggcaauguaaaacaaaaucgaaacauguucuuagaauaugaucucugauacuaauuuggagaagaaaugcaaagaaaaaguacaauuuacaaauacaaaaugcccaacagagaaucaagugaaauaauucaucaaggagauaaacauuugggcuaagucaacccauacauguauguuuuuuauguugggaaguuuuaggugcuagaaggacccucauccccuaacuuuacaguaaaauaaaugacuuguccaagaccacaaaauaacuauaaagucccaaaguuaggccuggaauuuccauucaacauuucccauaaacuugucuucaccauccaaaguaauauuuaagucucuuaaaccagcuuuaaggcaaagaaacccacaguuaccagcaccgaaaauuaggaugucugaagucuuccagucccucuucacacagccaaauugcucaaaggugguuuacacacuacucaagugacucaccaguucccggaugucuuucagcagcccuuccaguguggugaacuugcccccgaggacugccauucccaguucaaauucuagcucugggauuuccacacugcaagucucagacugugaaaugagaggucaguuuaagcuuuaagucagaagcaaagaaagccaaccagaggccuccugcccaauuaauaccagcagugauagacugcggacaagggcagcugucucaguuuucucugacucccuuguuaaagcuugagacucacuccuguccaucugaaccacgggaauagauccaacuuaauaaagggaaacucagucauagcuucgagcugucagguauccugucacuaggggacagacagagaagaggacccagauagacacuggaggccaaaaagcuaccaggucaucagaaagagcuaacagggucaccuucuaaaccugcaauuccaaucuuagauuaacucccucugcucagggguccucaaagccagggaaguaggagauaccucaugucccugaacauuauuucuaaaagacaacuuccccuagauagagacaguuuaucuaacuuaugaggacaacagugacuuucccaagcagacuguuaccuugaggaggucucuggucauaucugaggcaucugugauguggagggugauccuggugcccaaggguucuacugcuccuccagauuucaccugcaucgauaacagucaggagcaacagagagaagaccugagccucacuugguacccaggagaccuggaguguaggcuuggacauccaaucaguuagggccauuaauagcuaccaaagaaagagccuucuaaacagcagucgcccaaaccaaaaacaccaagagcuggccaggaacagugcccaacccugguaacgugccaaaacuuaucccaaauugccaauaaacucugaauuuaccuuaaaaaaaaaaaaaaaaaaaagacuuuugggguugaaagagacuuuuaagcauuuauugcaguccuuucauccacugcauccaaugugugggucuccuuuauaauauucugguuaaagaauuuaauuagcuuauacucagauacacucaggggaagggaauuuauaauucucuaaggcagcucauucuauuuucagacagcucuauugaguucuucauugugaagucaaagucugccucccugaacuuccacaccucugaggagugggucaaaagacuucucucuuccauaucaucaaccuuuaauaugucuuaaacaaguuauagaaucucuaacuuuucuucucuaggcuaauucccauuccuucaagggcucaucacccugcacuagaccuaagaaaaagacccaagcuacucuacacccccugcccccgaguacugaaguacuuaggaagaaugauaguuaaaaggggguuacccuuaagcuagucuucuucccaaauaauggcgcccacccaccucauugguccgaugcccacaguucucgcaguugguagccaugaugauaaccuccuuaaagugagggauuucuggaaaacggaguuaaggaaaucuacuuccaggcgaacaagaccaccaucuggggaaaaacaaagccaaaccccacacaaacauaugcuggucccagaacugcaggaaauauucacaagaggcagcccacagaguccuccagaagagggcaaguucccaacccauggcaaucccuguucacacauuugaaggcauggcucaggucacacacacacagccuagugaccauggccuaauuuucucuuugaacacaaaacccaagguacacagucuaaucaaagauaauaucuuccuuaucacuggguauaaagcauguguuuuccuugaaagggaugcucccagccugauuauaaucuucaugccugagucagaugaagagcaacccaacugcuuggcaaaagauacguacuagcuucauguuggucugagcgggggcauugcauucugggcaguuugugcugaacuggagcaccuggaacacaacaugaggacaaagggugagcccucccagaugggauguucaggcuaaagacacucaguugguaugcuaguggucaucuauguuggugacaaggaagacagaugcugaacagcaucagucucagcccacaacucugcuccuuccucaccaguagccaaugugacucacuucauuucugagaucuuccucuucuggcuucucugcuggugcuucuuccuaaaauagcaaagaugcaggucgcaaguuggcagguauaccucaguguccccaacacccugcccuggagugggagaaaugcucaggugccaccucaucaguuaugucaggugccaccucaucaguuagagaaaccacaaaguaaagccccaaccaaaggaagaacaggacuuaagauaggaucacagccacugccauccuuucugugaaguuuacccaaguccuggacauaagcaagaugagaagcacaaacaagcugagauagggcacacagagcagcagcagcaaaauaaguuccacugacuccaagcaauccagagugcgcgauaauuccagagcauucuucuggauccuucaguccacuuacuugaagccccagcaucucuuccugcugucggguccgguuguagugugugaucaccagggcaucaucuuucugaggagcauguggguuuuccacaaaacuguucccugagggaucaucaaugaucuaacaaaugggagaagagagagucacugcaaaagaaaaucauaaacaauccuacaucaccuacuaucagaccacgcaggcaucacaguggaaaaucccagcagucuuaauggucccuccuccccuaaucaagggcaacuccagccucucaauacucaccagagugaaaggggaggcuacuugcuuuagcuccuucaguuugacaaugaacucaucaauucuuucagcuguagcaucuuuguuugccugccaugaacagagaguaaagcaucagcccuggugguguaccuuaugcccugccccuugucaugcccauguuacuuccauuaggaagucaccaccuaucucagugugaguggaaacagagugacucaggcuucacaaugagauguagcaaacaagccugaaguugacggguggugacaggugagccuccuuuuucucacucauucaaccauuuagcccaggcacucaugccacguuagagauauaauaguauauauaucaguccucucaugggacuccccaaccaauuaaggagacaaauaacuaaagaugcagcuauaauauauuacuucugucauaauaaauauaagaugcaguggaauacucaggaaacacagauaacccaaggggauuaggaaaggcucuucagagguaauguuauauugucugaugaggccugaauauauacugagggagggaaguggaaaagacaauaauuauaacauaugcaacauucuagcagcuccagcaccaccauaugcuuacccagcaaguuuccaacacuuagucagagacucuucagacacaugggacacucuauauaagcaauuauuccuugagcugcuacaaucagaaaaccccagcuuacccuucgugcaggcugguccugcuccaggccagagauagcacgggugaucaauccuucaacaguggucagagcuugugaacaagaacaaaagacaagugugacuuagccucagcucugcuaucaagucccuguaugacccugggcaauucacuugaacucucugggucuuaauuuccucaucuguaaaaugagaaggccaggugcaagguuccauucaugucugauaauagugaugcuaaaauucuacaauaaacacacuaugguauuaccauuacuuucuaccaucucgagcuguuuuaccuaagcuuuccacucaugauuaacuaaugaagaucacaaugauuacaugguagaacccauacacaaaccacuagaccuggcaccaggggguuuugcaagaaagaggguaagauucuagcuacaugcgaacagcccaaauacucugaucuuaaacuuaccuccuuucuggcuaaaggcaggaauuucaaaaucuagcucaggaauccuuguggcagcagagucagucuucaccacuucucuguucauguccugggaagaaaagaauacguucaguacaaagagacugcagaacagcuucuccucaaguaauaaccagaccguccccuuccaucagaccgcagcccagcugucucucccucucgccacuccacaggguccagacugcuccuuucgaauaguacagguggugugagccaggcuguccaaauggugagaauacuauucauaacaacuacugcucauuucauacccucagacaacauuuacaaagcauuuucacaaaucuuaucucacuugagcugaugacaacaccaguaccauuuuacaaaagaaacuaaggcuaggagacauagggggauuuauuuaagauccgaccgccuggaccagagcucugaccccaguaccgaaucucucucuagaauacugagguaccugcucugagguccucucaccuccagagcccugacagacaaaguguagcgcacucccugguccuggauccugccugccgacuggaucuccguguuguuccagccacagugcucgcaggaaaaggagcucacuauuauuucucugaagaagggaaucuuggugagcaggaggcgcgucaugcccuggugaaguagaaaguagcuaaggaaaaaaaucaaugaaacucccuuuccccgcccuacuaucuccgggcgcuccucgggguccccggccgggcccaccuggcugggucugacccccggcucgucccggcacaagcccuacccacccgccgcucgcggccgcgcccccgccucacauugcaguaacaguucaugcauagcgacucgaucucggugggcugcugcuccucguccucggcgcugaugggccggaacaggugaucaggggcaggcggcggggccggggcgggcgacggggcgacggcagcccccgggggcccugguuccacagccccgcuggccgccauggccaccacgcgcaauucagaccucggcuuccuacuuccgccgcucucgcggccccaccccucucccgucacuuccgccagcugccaccaccccaaaaaaagccgcagacuccgggcacucggggaacaaugucgucaaggg

SEQ ID NO: 15976 - RNA, 25170 nt, Homo sapiens
ccgucucucugcccccgccgcugccauggcggcagcuccgccgcuuuccaaggccgaguaucugaagcguuacuuguccggggcagaugccggcgucgaccggggaucugaguccggucgcaagcgucgcaaaaagcggccgaagccuggcggggccggcggcaaggggugaguugguaccggccggggcggggccugcgacgucuagccaccccuucccaacuccgcccucggccgcccggcaguuccuucccucuuggcgggucucucggcuucuccgccgaccccugcucaugcucagggccccacucacaucgcuugaggccccccgccuugccucugccgccccgcuuacaucucgagccucugagcaguagcgucagugcguuaaagccgggguguaacuuugauuacucuuuucccgccuugguagacuuccguccucucccauagagaaugaauauugugccucgagaauaauggagcggauucaaagccucugugcuuggaucuuuagggcccgguaccugccuguggggauucccagaucccaaggacuugguucugaaucagagaccuuugaucaccuccuguuacucuuaguaauaguccuaacgugagaagcuaacauuuauauaguuauacuuuucuugccaggcaccauuauaagaaauuuaaacauauauaaguuuauuuaagccucaccacacuaccaugaaguggguauuauuuucauaugggacaacuuuguggcccaguguagugggcccuaccaaaucguuuuccacccagaaccacagaaugugacauuuagaaauagggucuuuggagauguaaucaguuaagaugaggucauacuugauuaaggugggugccaaauccaagaugacuguuugccuuuuaaaaagagggaaguauggauacagacacagcaacaaaggaaaaacgaccaugucuagaugaaggcugagauuggauuggauuuauguugccaaaagccaagguaugcuuggggcuaccagaagcugggagaggcaaggaaagauucucugcuagagacuuuccagggaggauggccuugcagacaccuggauuucagauugcuagcuuccagaacugcgagagaguuucuguuguuuuaugccacgcaauuugugguacuuuguuacaguaacccuaaggcacugagauacccagugaagucacauuguucuaaagaacuaguccaaguucuuuucugguuuggugcuugccuuauuauugucuucgucuuucugccucgcugacuuguguggauccuuuggaggcagugccaugugaugaaaguagcuugaguguuggagcagcacuggucagaguucgaauccuagcugugccacuuuauaggcuguguacccuugggcaagguguuucaucucacugagcugcaguuuccuuaucuuuaaaaugagaauaauaauaauaaugguuuuauuaaguggugguugugauuagagggauugcauuaagugacccuggcuuuuugaauaacuucacaucauggcagucauuguuauuauuugggcucagcuauauaguuuauccacguaacaaacauuuauugaauauuucguauuccaguuacuguaggguguugaggaugccucugugaacaaaaaaaacauagucccuguucuuguggagcuuauagauuaaugggaauacaggcuuuaagcaacuaauuacacaacuaaucgauauauuuucuuuaugauaaaugcaaugaaaguauuccaagaguuuuuaacaaggguucuuagucuugagugagugugggauggugagggaauugggugaagcagucaagaaaaguuugccaaaggaaguuaaauuuguguuaggaccugaagaaugaggaagaguuuccuggaaugagaaagaguuuccuagcacuuugggaggccaaggcggguggauugcuugcaucuaggaguuugagaccagucugggcaacauggugaaacccuguuucuacaaaaaauacaaaaaaguagucaggcacaguggcacaugccuguagucccagcuacuugggagacugaguagggagaauaacuuaaccccgggaagucaaggcugcagggagccaugauggugucccugcacuccagccugggcagcagugugagacccugucucaaaaaagaaaaagacuagggccgggcgcgguggcucacgccuauaaucccagcacuuugggaggccaaggcgggcggaucacgaggucaggagaucgagaccauccugacuaacacggugaaaccccgucucuacuaaaaauacaaaaaauuagccaggcguggcaguggucgccuguagucccagcuacucaggaggcugaggcaggagaauggugugaacccgggaggcagagcuugcagugagcugagaucgugccacugcacuccagccugggcaacagagcgagacuccgucucaaaaaaaaaaaaaaagaaaaagauugaaaagaguagaucaggcagagggaaggaacugcauaugugaaaacugaugugauaggaacuuggcuccuuucuaagcaccaaaggaugaccagggagguguucaaccaaggaaguagcaguaggagaugaaguugaccuuguagacaaagacuggaccaugcaggauccuguaggauuuugaacuuuauuuuaaaaccaauagauaaauguuuuuaugcugguauccuagaaugacucuuuuugaucuucuuauucucauuuagaaugcggauuguggaugaugaugugagcuggacagcuaucuccacaaccaaacuagaaaaggaggaagaggaagaugauggagauuugccugugguauguaucuuuggggcugucaggauuuugaaaugaagcaagcuucucaauuuccuuuuuuuuuuuuuuuuugagacggagucucgcucugucacccaagcuggagugcaauggcaugaucuuggcucacugcaaccuccgccucccggguucagaugauucuccugccucagccuccugaguagcugggauuacaggcacccgccaucaugccuggcuaauuuuuuuuuuuuaauuuuuguagaaaugggguuucaccauguuggccaggcuggucuugaacucaugaccucaggugauccacccaccuuggccucccaaagugcugggauuacaggcgugagccauugugccaggccaagcuucucaaauuuauuuuuccagcuuaggguagauuuguagggggguuaguugagaacagaaaagaggugacaguuuccaaagagcuguuuaaaauaguuuucuuugcugaugccuauacaccaacuugucucuuuauggaggguccaucagccuagaaaugagauggaucacagagagaggacuucucgacaucaguguuagaguaaugaugagacuuagcugugguucauuuuguuggaaucuuucuuaaaaacaaugcugagguucaguuauagggaacuuuuuauuugcuccuuuuuucagugcuuuaacuaagcuuucaaauuguauauucuugccuaaguacuggagauauguagauuaauagaacauagcuguauuuuagagauuauacccuagaaugaaaaacugaauuucagauaaauuucaacaguaugguaaauguuggggauguuucacauacguaccaaguaccauuagagcccggggagguagcauacuuuguauucuguugggagauauccugaaagauguaaauacugaguuuugaaggguaaguaagagccagguggacaaaaucauaggcaaaugaccucccagugguucaugaaaccauugcugagaauuucugagaaacaaaguggaaaggagagcuguagauaggcugaauuccacuaaaguugguaaagauggauuccagugaguauuuaauauuaauucccagcaaaauucuuuuuuuuuuuuuuuuuuugagacggagucucaccguguugcccaggcuugaguguagugguaugaucucggcucacugcaagcucugccuccuggguucacaccauucuccugccucagccuccugaguagcugggacuacaggggcccaccaacacgcccggcuaauuuuuuguguuuuuuuuuguauuuuuaguagagacaggguuucaucauguuagccagguuggucuugaucuccugaccucgugauccgcccaccucggccuccugaagggcugggauuacaugugugagccacugcaccuggccaauucccagcaaaauucuaaaauagauuauuuaaaagagggcuugcuaguaauuagaagggaaauagugaucuuagggagccaauuuaguuuuggucagaagaaguaaauauuaacaauguuuguuguuuuuuuuuaauuuuauaaaagcaaugcauauuuauuacagaauauuugggaauuaaaaaaaguuuaaaguuuuuaaaagaauaaacacuugcauguuaccauccaaagauaacugcuaauacuuggaugcauaucucuucagguuuuucucuuuagagauuauacacgcuuguauuuuauuuuuuugaacauaauugggaucauauuguacauaggguuuuggagucuacuccucugcuaaauaauauguuguggauacucugguaagaccuuaaaauauucuuugaguguaugauuuuuaacgguuauguaguaguucaauauauauauuuuaucuguucuguuacuggauacauggauuguuuccacuuauaaaauaucauacaucguuguacauaaaucauuuguagaaaucaguuuauuucuuuauucccauaaaaugaaaugaguggaucaaaggguaugguucgcuuuaguuauauucccauguugcuuuccaaaaggugcuaccaauuuacacucccacuagaggugaugagaaugccaguuugccuacgucgucaauauuagagcacuauuauuauuauuauuauuauuauuauuauuauuauuauuauuuuugagacagggucuugcucuguugcccaggcugaaauacaguggugugaucaugccccauuguagccucuaccuuccaggugcaagcaauccuccuaccuuaguccugcacguagcugguaccacaggugcgcaccuccaugccuggcuaauuuuggguauuuuuuguagagaugaggucucuguguugcccagucuggucuugaccuccugggcucaagugauccuccugccuaggccuccuaaaguguugggauuacagguguuagccacaugccccaccaauauugaaggauuauuaacaaaacaaaaccaauagcaaaccuaugcugauuuagcaagugaguaaugguauccaguuucuuuuuuuuuuuuuuuuuuuuuugguggagucucacucuguugcccaggcuggagugcaguggcgugaucucggaucacugcaagcuccgccucccggguucacgccauucuccugccucagccucccgaguagcugggacuacaggcaccugccaccaugccuggcuaauuuuuuguauuuuuaguagagaugaaguuucacuguguuagccaggaugaucuugaucuccuaacuucaugaucugccugccucggccucccaaagugcugggauuacagacgugagccaccgugccuggcccaguuucuuugaacacuagugaaaugaaucauuuuuuauauguucauuaggcuuauguuguggguguauuuuaucauuugccuuuucacuuaguucauaauuguuuuuauuauuuuuuuuuuuugagacauauucucacacugucaccaacgcuggagugcaguggcucaaucuuggcucacugcagccucugccucccagguucaagugaaccuccugccucagccucccaaauagcugggauuacaggcgccugccaccaugcccagcuaauuuuuguguuuuugguagagacgggguuucaccguguugccuaggcuggucaugaacuccugggcucaagcaauccacccgccucagccucccaaagugcuaggauuacaggaaugagccaccgcaccuggccauuuucuuuuauaauauugucuugcuuuuaugauggcccaaaaaccuaaacaaaggaggcuuuagugccacugcucucugcauugguuaaaacagaucuugauuacugaauucauuuuuguaacugcaagaucaccaccaccaccaguaauaaugguaaaacgauuaugaugauuacgauagcaguggcagcacaggaauaauuaauaggugucauuuauugggcauuuaucauguaccaagcauggcuaagcuuacgugaauuaucucauucaauccuuauagcaauccuuugaaucccacuuuuacaaaugaggaaauugaggcuuagaauaauuuaccaaagguuacacaaaugcuaaguggccgagcugggguuuagaucuuaauucaucuugcccgaaaccugugcuuuuaacgcucagugagagaucucaaaacuggguuauaugaagaaugaugguaggauuuugggagaaguagagggcuauuaugaccuggauuuaaauuccaguucugccacuuguuagcuugugacauugagaaaguuacugaacuucuccgaaucaguuugcuauucaguaguguggagccuuucuuuacaggauuauugugagaaucgaguuagauuauaugaguaaaccacaaaacacaguaccuugcacauaguugcuacucuguaacuaggauuuauuaugccagcaaucuugaaaguuugucauguggacuuacaucacaggucagaacuagaaugaauucaaagaaguuauaggaaggcagauacgguacuaguaaaacuaagaacuuucuaacauuuuugaaaaaugcaguggacuguguuguaagauaaugaguuccuugucaggaagggauugggcgagugaccacuuauuaggaauacuauagagaagauucugauuuguucagaaguuuagaagauaugaaaugugguuuuagcucuuaaagauuaaugauucuguguacaucucaguggcucuuuuugguuguauucaagaaaaccuaucacugugacuaccuacaacaagaaaggauucauagaaacccaaaguccuugauuagugcuaggcaugauggggggagccaccuauguuuccacuguuaauguagaaguaaaaguguaaaaggaauuuaguuguuaguuuacaaguggcuguuguguaccuagcagguuaauaaaaagguuuguaaugaaaaaaauuaaccuuugcaggguaauugauuaauuagagaaggaucuacaauuaaaccaauacagugacaaucagauguuuauggagcaaacauaacugaagaccccuacuuacuucuucaugaccauuuuggauauauguacgcccuuguguuaggaaucggaaugguuguaacuucagguucuugagacagugcuucuuggcuggauccuguggauuuccuaagauaggaaaucuuuacucucacagguggcagaguuuguggaugagcggccagaagagguaaagcagauggaggccuuucguuccagugccaaauggaagcuucugggaggugaguuccaacaauagauaaaucuaaauuuccauuaguaggggagaucuuuuuuccuuuucuauacuuuucuuuagaggaaugcauaguuuguuuuagcaugucauugauccugaaaaauaaagcaggaaaaaggaaguuggacuucuucagagguaguaagacauaggaacuuauagaccagauauuccucuuucucuuauauuuuggcauuaggauuacugagguuggugacuaauuuggaggccuuugagcacccauuccucuuugacucagaauaggagagcacuugguguauaggcaagacuuugggaggaguuuacaagaaacaggagcagaauuuggggacuuuagcuaccacuauccucuuccacaaugaagcaacucauuucuggggggucaaggaccaguguauuuuguucuguuuguguuaguaaauuucucucuucuuuccuuaaguauugguguuuuauagugcauuacccuccacuugcccacuuuggacucuuccuaagcuaauaaucuuaauuuaacucucuuuaaaaaaauuugaguccuugagaauuggauaaaaagcauuuguuugucacaucuguuugagcauagacuagucuuauuugccaugauauuccccuaucuagcacaaggagcuaccuuuaauaaauauuuguagaauuguuuaauugcuaguagguauuugauuuuuguagccuaaucagaauucuuuuccaaagagaaucuuuuggucuccaugucuguuugucuaggaagacacacagacacacacauacacacggugccuuuucuuguguaucugaauguuuagaaggucagucacacacacacacagucacacucacacucacucacuccuuuucuucugccuugcuuucacucccccaucccaauuuguuauuggaaguacgcuuaccaaucucugacccuugcuuccuucagauuuacuguuaggccccccacagacaucauacuuuucucuguggaguggauuccaaucagauagggcuguuccccaaaguaaaggaguugacuugguuuaauucauccauuuaacaaguauucaucaguuccuacccagcuuuuauuuguauuugggcuguggagcucaaugacaagaaauagagguagaggaagaacuggauuuugaaacuguuccaguugcuauagauauuucauucuguggugccuuugaauauggaaggucucaaacuauguauuuuaacuuuaaagcuuuacauauuuuaaagauugcacauggacucuggagucaaauagagcuggauuuaaauauuccucuaccacuuauuagcaauaugacuuuggcaaguuaaucuuucugaguaucaacuuccucaucuauaaaugaaaugacaguauuuauguccuaggcuuguugugagaauugaaucagguaaucucuaugaaacacuggcacacaguaggugauugguaauuacuugcuccuuucuuuuuuauggugauuuuuccccucucuaagaaagagcacagugaaauggauuaaauaguuaacagcauuuuauuuugauauucaccguuuuagucaauuuaccuauugaaagaagagugaguacaaacuauaaaguaucuaggcaaaauaucaguaggagccacuagcugggaacucugcacaaaugagguuuuagaaagaacauuggacugggaguuagaagacuuggauucuagccugugucuucauuuuaggagcugugaccuuagguaagaaaucacucagcuccucagcugaaaacagaggcuguggccucuguuuucaugcuguaauacaaggguaccugcccugcuuaccuuaaaggguauaauaugaaaaaugugcugaaaaugcuuugcaaauuuaugacuugguaggcggagggguuauucuuaagauauucaugaguggugguuugcugccccuaagcaagaaaacugugcaggccuuuugggcuuucugagcaguucugagguaugugcuacuggagcaucuuuugaaacuggguguggggguggacagagggacagagcauuugugggaaucugacucuuuguuauuuguguuuaggccacaacgaagaccuacccucaaacagacauuuucgucacgauaccccggauucaucuccuaggaggguccgucaugguaccccagauccaucuccuaggaaggaccgucaugacaccccggauccaucuccuaggagggcccgucaugacaccccggauccuucuccccucagaggggcucgucaugacucagacacaucuccucccaggaggauccgucaugacuccucagacacuucacccccaaggagggcccgucaugauucuccagauccuucucccccaaggaggccucagcauaauucuucaggugcaucuccuaggagaguccgucaugauucaccagaucccucuccuccuaggcgagcccgucaugguuccucagauaucucuucccccagaaggguccauaacaacuccccugacacaucuaggaggacucuuggcucuucagacacacagcaacucagaagggcccgucaugacuccccugauuuggcuccuaaugucacuuauucccugcccagaaccaaaagugguaaagccccagaaagagccucuagcaagacuucuccacauuggaaggagucaggagccucccauuugucauucccaaagaacagcaaauaugaguaugacccugacaucucuccuccacgaaaaaagcaagcaaaaucccauuuuggagacaagaagcagcuugauuccaaaggugagcauaugacuguccaugagagggauguauguaucccugggagcuuucuuuuggccguuuaguugauuuauuagguauaagaauggaauuucuuugggaaaguuuugaaaagugagaggcuggguuugggagaguugaacaauuaugguggcagggaggaagguuuucauaugucuuuuuaugugcucgcuccaccccauauaaaaguacaauuuauuuguugcagaagcuuuggaauguacagaaguauauaaagauaaaaugugacacaaaauucugucauucagaggcaauuauuguuaguguuguggccagggucaucuuagucuuuuuugguuugcauuuuuuauauaguugagcucuggcuguguagaacauuuguauugcaugugcaaucuugccugcuguccuuucuuaacguagucuuccucaggccauaaaacaucuuuauguuaguauaauuuuuaauaguguuuaauuacaaauuuaaccauuuuccuaauaaugaauguuuuugguuauuucuaaguuuuuucuucuguaauucuauaaugaacauccuuguacauaaacuguuguccccauuuuggauuauuuccuuaucuacuucuagauagauuuccucgaaauucaacuacuucuauauaaguuuccuagaaagcugagaaguugauguacugggucagaagaugugggcguuuuaaagacugucgauacauauugcagaaugcccuuugggaggugacuugugaugcuuauacagucgcuagaacuuaggccugugcagugaaauuuuuuacucccucuuuuguuccuaggaacuauuuuaauuuuaaaauuaaaguacuuuguuauccuuuaguccaaggauaucagacuauauuccagguauuucugacuuuugccacacuauggagagcugacuacaaguuauuuugucuuuccaugggugggguuacugacauagaggaguguguggagauuuuacacaccaguuacagucaguggucacuugggaauagaaugccauauucuaccuguuggucuuaaaaguuguuucugacuuugcucuucuccugugccauccauacuuauguuuagguuaaugauaauucuucauaggaaaacuaaauaaauauuguacauuagcuugguaaguuaucuuuuuagauucuuccaaggggauuaaagaacucuuuggccaggcaugguggcucaagccuauaaucccagcacuuuggaggccgaggugggcagaucaccucaggucaggaguucaagaccagccuggccaacauagcgaaaccccaucucuacuaaaaacacaaaaauuagcugggcgugguggcacacaccuguaauuccagcuacuugggaggcugaggcacaauaauugcuugaacccaggaggcggagguugcagugagcugagaucaugccacugcacuccagccugagacugucucaaaaaaaaaaaaauaauaauaauguaaggaauucuuuaauuucuagguucuucucccagccauaggagauuucauguaaguucuucaccuagaggacaucagagucacacagauucuuugcuccuauccaggugacugccagaaagcaacugauucagaccuuucuucuccacggcauaaacaaaguccagggcaccaggauucugauucagaucugucaccuccacggaauagaccuagacaccggagcucugauucugaccucucuccaccaaggaggagacagaggaccaaaucuucugauucugaccuguccccgccucgaaggagucagccuccuggaaagaaggucaggauuuucaggagccauguccuucuuuucgugugacucuucucucucagcuuuauauaugucccagagaaucaagccaagaagaaggauguagcucugagaaguguaguaaaucuuaguuaaaaggaccuuuggaggucuuuccuucugaaggcaaacuggcuauaacccaucccagauggacuuacagauaccagauuucccaaguagcuucugcguuuauagccucuuaauucuacaaucucauuuuaacaggucuagaaaaacuuccuauuuucuuaggaauaaaccgaggacuguaauuugcagagugaaguuuggagcacaagcauugugucaaacggaucacauacagaaauucuccuucugccacuuacugucugugagauuugggcaagaugcuuaauaucucuaaaccucaguuucuuuaucuguaaauuguggauaauaguaguaccuacuguguaagguuguuaugauaauuaagccaguguaaguaaaacucuuagcacagugucugggacaaaguaagcaucuaguguuagugauuuacuaguauaaauuggacuauaggucucuguauccagagcuuaaggagaggcacuuaaaauaugaaaccacuuuuagaaaucauguugucugagaagucaaugguuuguuuuaaauucaugauaaggcuugaugaauuagccaaaaaaccccaaaauccauaugaaccuugaguaauuauauuguaaagaacauugguaguaguaaaggaaucuuauuuguaagugguuaagaaacagaaugauagagccugugaugugcauuuuucuccccagugcagacuuaucagguaaaucuugucuguagaagacucugagaagacugguccuggcaggguagaccagccuguucuuuacccaggaagugagauucuucuuuuuuagggaaaaaagaggucucuguuucagcuggaccucuuggcauuuuauauauccauuuaguucauggacaacuuaauauuauuccaauuucguugcugaaggauaucaagauauacugugugcuucauucgugggcugauuugcuaucuugaugcuaaguggaaauuagcaaaaaguuuucauuuguuagaucuucuguuauuaccaugaaauauauccacaauuuaaggaucuuagguuugcuugaguuuguacuguaaauggaauauuuuaucaguaugggucucuaauggaaggcuuagugcuuuauacugguuucugaucagaugaccugagauagucuucaugugugcaguuuauauacugaaaagucagaaauacaaaugcguagcccuccauuuaauauauuguuaguguuucugcuuauucuuaaacuugaugguuuugaugaugguuuucuuuuauaguuuuugaauccuaugguaauuauugagaauauaaagcuagaguuuuagguuuaauuauugcuggucauuagacacaaaugcaacuaacuguguacccauggagccuacugucacaucaucucauuaauguuggaugcucccuuuuccguugcauaggcugcacacauguauucuggggcuaaaacuggguugguguuaacugacauacagcgagaacagcaggagcucaaggaacaggaucaagaaaccauggcauuugaagguaaaaauaugaaagugcagagaccaauuuaggcucauacuguuuuuuuuuuuuuaauuuagcuuauuguaccugauauuuugaacuuuuaauugcuaucaaauuucagcucugguuuuaugcauuguuguaauuucucagugaaucccagugcuucuuuccuucuugaaaaaugccauuucgcccaggcgcgguggcucaugcuuguaaucccagcacuuugguaggccgaggcggguggaucagcugaggucuguaguucaagaccagccuggcuaacaugaugaaacccugucucuaccaaaaauacaaaaaaaaacuagccaggcaugguguugcaugccuguaaucccagcuacucaggaggcugagacaggagaaucgcuugaaccugggagguggagguugcagugagccaagaucgcgccacugcacuccaaccugggcaacagagugagacuccaucucaaaaaaaaaaaaaaaaaaaaaaggaaaaugccauuucuugggcccagugccaauaugcaccaagauguugguaggaacuacuuuggucuggcugcagaaguucuuaucuagcauuagaaucccaagcgguugauuugaucucuuagaauguuauuucugauuuugauccugauauuugaguauaauuuuccuuugcagcugaauuucaauaugcugaaaccguauuucgagauaagucuggucguaagaggaauuugaaacucgaacguuuagagcaaaggaggaaagcagaaaaggacucagagagagaugagcuguaugcccaguggggaaaaggguaagggaaccacugaaaggguaaacaagauggcagugacuggaacaagucauuucucugcucuucugaucacucacuuucuuauuaugccuucagagcuguuaucaguaaugggaaauuuggugugcugaaucuucuuccuaggauauugauauauuccacgcuucuaguggguauucugggaauuuuacccugcucaguauuugcccuaggguacuagaaagaggagauuguccaaacuuagcaguaugguccaucucguguagaaguggaaaugucauacaggauagcaaacacucuugguuccuuuuugcccaggcuugcccagagccggcaacagcaacaaaauguggaggaugcaaugaaagagaugcaaaagccucuggcccgcuauauugaugacgaagaucuggauaggaugcuaagagaacaggaaagagagggggacccuauggccaacuucaucaagaagaauaaggccaaggagaacaagaauaaaaaaggugggacuucugggaaucaucagcuggaggugacuugugaagagagaaucauuaggaugcugauacauagcuauaugcaaagaaggauuucccaaauaauuuaaauucauuguauuugugaguuuagauucaacucaauuggucuuucuauauaaaaauuuuuccaggccaggcgcaguggcucauguuuguaauccuagcacuucgggaggccgagguggguggaucaccuuagaguucgagaccagccuggccaacauggugaaaccccaucucuacuaaaaauacaaaaaaaaaaaaaaaauagccggucaugguggugcacgccuguaaucccggcuaguugggaggcuaaggcacgagaauugcuugaacccaggaggcagagguugcagugagcugagaucgugccacuguacuccagccugggcaacagagugagacucuacuaaaaaaaaaggaaaauuccacauugccauccagcucugaauuaaacuaugucauuaacugaauacuuuuuucuuacuccucucauuagugagaccucgcuacagugguccagcaccuccucccaacagauuuaauaucuggccuggauaucgcugggacggaguggacagguaagccuggguauuucuuacauuuucuaccugacuguaaccuucccuaaccacucguaaguugcuccacacuuuauuucauucucugcuuuaaucacaaggugaaaaauaugcacuuugcuugcuucuuuuucugagguccacaaauccuauuucucaugcuuggaacacuccuccuucuguuuccuuuucauaauacuuuuuaaagcucuggacaaacaccucaggugguucagauaagacacccuuuguuuuggacauugguuacuuuuaaugauauuuuguaagguuuagagggguugagugaugaguuguagucuggagccuucuaccugauauaucuuuaaaauguagccucugaaucuuuauucacuuuaugguuuuaggaggcagucacuuuuaaugucuuccaguccucuaccccaccucaucugucuaccuaccaacaucuguacccacguacucuaacuuccuguuaugauggaugaauauuugcuuccauccaaagucaguuuguauacucacauauuagaucccaucuccucuugccuacuaaaggacauuguuuuaguaucuagcacaauaauucuuaaacuuuuuaaucucaggacccuuuuacagucuuuuuuuuuuugagauggagccucgcccugucgcccaggcuggagugcaguggcgcagucucggcucacugcaaccucugccuccuggguucaagcgauucuccugcccuagccucccgaguagcugggauuaccggcgcccgcugccacacccagcuaauuuuuuguaucuuuaauagagacggaguuucaccauguugccaggcuggucucaaacuccugaccucaggugacccgcccacuucagccucccaaagugcugguauuacaggcuuacaggauuacaggauuacaggugagccaccaugcccaaccacucuuauuuuuuuuugaggcagagucuugcucuguugcucaggcuggagugcaguggugcaaucuccacuucccggguucaagcaauucucaugcuucaguggccugaguagcugggauuacaggcaugugucaccauauccagcuaauuuuugcauuuuuaguagagacgagguuuugccacauugaccaggcuggucuugaauucuugggcucauaugauugucugccucgauuucccaaagugcugggauuacacgcuugagccaccgugccuggccuacgcucuuaaaaauuacugaugaccucaaaaagcuuuuguugauguggauuauauauauugauauuuaccauauuauaaauuaaaacucagacauuuaaaaaguauuuauucauucaaaaaaaaauaaacuaauuauguuaacauaauuacuguauauuuaaaugaaaaauaauuacauuuuccaagugaaaaaacagaaggauggcauugauuuacauuuuugcaaaucucauuaaugucugacuuaauaauagguaacuugacucuguauuugucuguugugauuuguucaguugaaguauagaaagaaaauuuagccucacacauagguaguuagaaagagaaggcauauuauauuucuuaauguuacacaaaaacucaacaagugcugguuucuuaaaggugagcuauguggaaccugaaaccagaucaaagaacuuuccuuacuguuauauuaauuuuuuuaauacuuugaguggaucuuuuacccaugcaugauuuuauaacaucaugcauuggucauuuguaaaauauugguuugcugaguuguucagaccuuccaaauguugacauauuuccacuauacaauaucagaaaaucacuuuuguuaacaucacuuccggucuuaucacaaaacucuuuaaauaaugggaaguuaaagaguucacaguuuuucagaauucuaauuuacacuugaaaguuuaaauguuaucacuggcauuuccauugcuugagcuauuuccauuuaauagcuuaauuucucugcugagauuucccaucuguucauuaugagauauuuuccucuucuugaaaauauuugugauauguaauuggugcuuugaaguccuuccugucuguuaauugcaacauuggauucaccacaggauugguuucuauauuggcagcuuuuucuucaguguguauuacauuuuccuguuuauuuaccugucuggucacuuuuuuaaauuguuacuggacaucaugaaugauauacuguagagacuuugaguucuguuacacuguauugucaguuguuuuccuucagguaaagcucacuuuguacaauagcuuuuuauagauuccaucagauuuuguaccuagagggucuuccaucuuugcauacaguuuaauuucuuacuuuacaaucuagaugcuuuuuguuucuuuuccuugcccuguugcauuagcuagcacuucagugcagauguugaauagaaguagugagagcagacaucuuugcuuuguuccuaaucucaggaagaaaacauuuaguuuuuacaacacauuuauuaaauguguuguagcuguauagguuuuuuguagauauccuuuauggaguuaaaguucccuucuauuccuguuuugcugagaguuuuguuuucaggaauguauguuggauuuuguucaaaauauuuucuaauuauccuuuugguuuauucuuugcuccauggguuauuuaggagugcauuaauuccaaauauuuggacuuuucuagauaucuuacugcuauuuacuuauaauuuaauuccauuuuggucagauaauauacuguaauauuuugaucuuuugaaauuuguuggccaggcacaguggcucaugccuguaaucccaacauuuugggagcccaaggcagacggauugcuugagccuaggaguuugagaccagccugggcaacauggcaaaacccugucucuacaaaaaaauacaaaaauuagucgggcaugguggcacacgccuauagucccagcuacuguggaggcugaggugggaggaucacugagcccagggaggucgaggcugcaaugugcugugauugcaccacugcacuccagccuggaugacagagugagaccauguaucaaaaaacaauaauaaaaaugaaauuuguuaagguguguuuuauggcccaguggauagucuaucuucugaauguuuccuuugcacuugaagagaacguauauucuguagcuauauaagguaguguuuuauaaaagucagugaggucaagguguuuagaucuuagaucgccuguauucuggguuuuuuguguuuguauuuuucuaucaguuacuaucaauuguggauuuuuuguuuuagcugguuuauuuuguuuuucaacucuaaaauuuccauuuaauagcuuacauuucucugcugagauuucccaucuguucauuaugagacauuuuccucuucuugaaaauauuuaugauauguaauuagugcuuugaaguccugucugcuaauugcaacauuggauucaccacaggauugguuucuauugacagcuuuuucuucaguguguauuacauuuuccuguuuauuuaccugucuggucacuuuuuaaaauuguuacuacgcaucaugaaugauacacuguagagacuuugaguucuguuacacuguauuccucuuaaguguguuaguuuuuauucuagcagguaguuaacauagcugaacuccaaacugucuccuuugcaguggacggcagcuacaaucuuugcucaguucuuuuaguuucuagcugccauuuuuuuaauuggccugaugguauuuucucugcacaugugucauuuaacaguuagccaaggauuugacuaggguuuguauguagauuuugagguucaucucuuuuguaguuccuucucuuccaagauuuccccccuaauuuccuagcuguucugcccacuuugcacuaauuccucaagccaguaagccuguggcuuucugccuucaugagccaugcuguuugggaaguugcccuccagcaaaucucuuuucacauauagacuucauccaguucauacuuacuuuuggucacucuuccacaccuucaaauaccuauuuuuuuuguuuugucuagguuuuauaguugcuaacugaggauagguuagucuguucggguuacucugcaaugucuagaaucugucuccccaccuuauaugggccuaaggcguugucuucugucccucggggugccgucaaaauccaacagccaggugugguggcgugugucuguaguaccagcuauuugggaggcugaggcaggaagaucgcuugaacccaggaguuuaaguccaggcuaggcaacauagugagaccccaacuccagaauaaaaaaauuuaaggcucuucuuucugauauuggcagauaucuauaaguugacuguaguuccucaucuuggcagauaucuuuaggguagcugugguuacaggcuagcuuacuaguuccguuugcaguucacuguauguaggcuuuuugguagaaggaggauuuuucagaacacucauuugccauacauacagccagaaguagaucuuuuuauagcacaacccuacagauguucccugcuaccgaguuuuuguuuuuuguuuuuuaauuuuuggacccaaaacuuagaauucucccugaccuaguuuuuuuuuacuaguauuuaauuugucuucauuuuucucaguugcuuuuuuccacuucuuguucugauuuuauccuagauuucuucucuuauuucccuuugucacccuugcuuucuuuuuguuauucaucuuucaucaucuuuucuaguuuugucucuuuucggccugcugcaagggaauauuuccggaacagauauauaguaucuguuggaaaaacccauaagauaauuacccagccucucuuaauugaaagagaaacggggccgggugcgguggcucaugccuauaaucucagcacuuugggaggccgaggcgggcagaucacgaggucaggagauugagaccauccuggcuaacauggugaaaccucgucucuacuaaaaaaaauacaaaaaauuagcugggcgugguggcgggcgccuguagucccagcugcucggaaggcugaggcaggagaauggcgugaacccgggaagcggagcuugcagugagccgagaucgugccacugcacuccagccugggcaacagagcaagacuccgucucaaaaaaaagagaaacugaggcccaauaaauaagcaguuugccuagagucaugcaauuucccugagaaagcuggaauuagaacucugcguuccugauucucugguccaaagcucuuuccacugugaguucuccugcaauuuguuuucugauucugcuuaggauuugguguuuguuauucauauguccuuuguauuaucauauuaguguaacucucuuaagaccuuauuuccaagguaaaaaacagugguuuccuuggugcuuuggaauaccauccaugcuucuaagguuggagaggaugccauuuauaauaagcuucccuucuuuuuuuuuugagacggaauuucgcucuuguugcucaggcuggagugcaaaauggcacgaucuuggcucacuggaaccuccgccuccuagguucaagcaauucucuugccucagccucccgaguagcugggauuacaggcgugagcaccacgcccagcuaauuuuuguauuuuuaguagagacaggguuucaccauguuggccaggcuggucucgaacuucucaucucaggugauucaccugccucggccucccaaagugcugggauuacaggcgugagccaccauguccggccaagcuucccuucuuaaagcccucuguuacucacuccacucaucccuuaagggaaagucuuagcauacauguuauaaguguaagcagcuagguaguagguacuagggauuccaugauuaaagagagauagccccugagcccaggagcucacuuucaaucuagaauagaagacagacaguuucaacgcuguuugguuaguguuacuauagaagauuuucaagauguuuugggagcacaaaggaagaguaaguugagccuuaggaggaugugagugaucaggaagugcuuccuaacggaugaaaugugggagcugaguuuuaagggauguugguaaccagccaagauaagaaggaaaggaaggauauuaaaggaagaggguccuauaugugcagagucauaaggcuaugagacaccaugguguuaccagguggugggggucccuaaguaauuugcuguuguuggauagcauaaagcgugagauggaugagagagguuggcagaccgugaucacagaaggcccuggaagccuaucugaggagcuuggucuucacccuagagguaaaggggagacacggaaggauuaaaaacagcucugcauuuuagauagacaaauccauuauagcaguaauaugaaggauuugaaagguacaagauuggaaguagaacagauacaaggcuuuugcaguagcucaggcugaaaguaaugagugucugaacuacgacuugcaggcagugguaguaaggaugguuaguaagagaauaggaaguggggauguggucaggggugagcuggugggaccuguuugcugauuuggggaagaggaaggaggagucauuggauuuggcaacaaggaaugucagugaugaccugaaagggcuaguuccguuguguagugaaacaauggccagguucuaauguauuaaggagugaaugaaaagugaggaaacaaauagugaauacaggcuuuuuaagaaguuuagauaagaagaccaagagaaugcaugguaauuaaagggauuugagguccacucacuaccuccuugaaauucaccccuguauuguuuuccaugacacccuacuccugguucuuuucucugaucauucuuggccaccuuugcaaacuccucuuccucugugcaccucuuaagucuuucccagggcuccauccauaauuuuuagcuguucucacucuaugugcucccucuggcugauucuuaccuagucauguuuucaacuaugaccuauauguacaugauuuccaaaucaguauuugcaucuuggucugguguauuuagcuguuuguuggauuucucuauugauuuagacuugagagauuucaaaugcauuguauucaaagcugaacucaucagcuucuacuguaagccugcuccuacucuugugcucucuaacuugccuccuccuucuuuguccuuguguaccuaaucaauuagugcugcuaauuagucuuacuaauuuugccuccugugucuucucucuuccgucccucuuuaucauugccuucaucaucuguugccuggaccauugcagugauuuuccugccccagauccccuccagagugaucucuuugaaaugcaguuuaaguucuugcuuuaaacccaucguuucuggaugaaaucuaagcuuuuuaccauggccuacgcagcucauuaugcauuggccucugcgccuuuccaacuuugacucauggcuguucccuuugucauacuucagguuccagccauaccaguuugccuuugguuugcugcacauaccaggccacuucuuauuuccgugccuuuguucuuguugcucauucuguucugaaaugaccuccagacccuuucuggcccuuccauccccagugcuguaguuaacacagagccuuuacugaucauucuugcccaacccucaugucaccuuuuuaucauaccucccccaagcugauuaagauacccauucuguuuccaugacaccccaugcguauuucuaccagaguuuaugcuguucuuuuaauuuauuuguuuaaaugucucucucuuccacuagucugggaguucaucaggacaggugcugugucauacucauuuucauguagugucuaccaugguaccuaguauauaaugaaaauucaauaaauguuuguguaaugaauggauaaaauauaagauguggacaucagcugagagagaaccaggcuuuuagaguggcaaacguuugaaauagcugucagagugggggaagggugugaacaaggacuaagaaaaggaugaaugauauauuuugucccuuugauucuauugcauaugccuuaaauauuuucuuuucuuuuuuguuucuuucuuucuuuuuuuuuuuuuuuuuuuuugagacagagucucugucacccaggcuggagugcaguggcacgaucuccgcucacugcaaccucugcuguccagguucaagcgauucuccugcgucagccucccgaauagcuggauuacaggcaccugccacugcaccuggcuaauuuuuguauuguuaguagagacaggguuucaccauauuaggcaggcuggucuugaaugccugaccucgugaucuacccgccuuggccucccaaagugcugggauuacaggcgugagccgccgugcccggccaugccuaaaauauuuucauaugacuccuuacuuuccccccuuuucauuauauugugaacucuucccuuucuuuugaaacaaaugccccuuucaggguucuagcugaauaguaugucucuuuugauugcagauccaauggauuugaacagaagcgcuuugccaggcuugccagcaagaaggcaguggaggaacuugccuacaaauggaguguugaggauauguaacuuuccugaggcuguggggguggcugggcugugguagugggcauaggcagcgagauauccagugguaacaguugucugugcuaauaauuggagcccacacagaccagcaacuuguugaaugccaguuuugaccacagaagaauauucgagaccugauguuuggacugagguaccuguacuucuugggugugacagcaccggcuguugcuggcuuucagaggaagcauugauuucucauugaccaggguuuguucuugguaggguuuuucuuuuucuuuuuuaaauaaacauguauuuauuuuuuuaaaauuaucuucuuaacuggguauucuguuuugggaagaauacaggcuaauauugaaccuguggggauuugggggguggugguugaauuuuucacuaaucuagaaagcagugugaguaaaaacuuucuuagugauagauccuuccucugagaaaacaggaauuaguacuaaacuagacucaggaauagacacacagauauuuggagacaugguguaugauaaagauagugucacaaguuaguagggaagagauggauaauagugcucagaaaauuggcuuauuauauggacaaaaauaaaguugaacccucauaccauauaaaacaaaaaucccaaagugauuaaagaccuaaauga

SEQ ID NO: 15977 - RNA, 7651 nt, Homo sapiens
gauggguguccugcugcaucacuccgcuucccacccagccaggcuaaugcaugagaauguccuuuuugucauucacaucccucuugcauuucaccacugacucuucugcuccggccagcaccccucagcccugccuaauuugaccacggcucacgcugggagaucaucaccacggaaagggugggggcagucccgcagggcuucccagcugcccgaugcugcaaacuucccccagcuuggcagagcccugcaagaauaaaucucuggagaaauagauuuugaagaggaauuugguacauagaucuucugucagcggagcagacuccggcucagcuguuuuucaaguucgcugcuuauccagagauacaucuauuuuuacauggaucucuggcgagauuuccucuucccucacaggguaggaggccuuugagggagcccaagggcuggcagcggugguagccauggggacacggggcagggggagccagggaggggcuggugcaguccugggcuuccuccaccugcagcauccucccucggcccuucugcugagcaaugggaccggccucccugagccucuaucacugcacuggccccucugcgcccccuccacccacccaaaggccccagccaucuccgugacccccaagccugaaguccccugaggaggccaagggcugggcugagcuguggacaaguguugggcguggacacauacaaaugugcacacuggaggguccccaccaugugcccacaaagacuggcagggccugcccacugccccagguucauccuggaccuaccuguggagcugcugcaaacaguaggagccagcucugagcugugccagaggagaaauggcuggcaggggugccaagcagggugcucuggcaggcaauuaggccccagacaauggcccgcaaaugucagaaguggcgggaaggcuggaauucacugaggccuugggcauauggaggagcacauggaagggcacagggaugaccaugugccgauggagccaaaagccauggagcugaugcuuuccugcuccccauagagcccucuggcaggcuggacacccuuaugcuuccucuucccaaguccccucgaaaaaauccccucacuccaggaagcucugugcugugaggcccagccccccaagauaaucagggaagagaagauagucccaggauaggaaugaccgcacagugacuacaucugcugcccggccuggcucugucccugcccagcucuaucccugccccuuccccacaggccggccuccaccuccagaggguucuguuuccaagaugcccagagguccagacccagccaguccugcccaaguacccaagcccugggggcagacuuccagccaggaaguagcauugggccaggguacaaaccuccaccucguagccagaccagcagguccuccaugggcucagcacuacccagcaaugaucauggauccacccuuggucucuucccccugaagcuuccaguuccauucucagccucaucagcccauuccccugugagagccucgucccugaaauuguaucgccucucucuucuuccagcugugccagucucuuccucuacccugcuuuccaaugccccacgcccgccccuucucucccuacaugcugacacacaguuccugugggcccuguugagccuuuuauguguucuuaguccuucucucccuccuuccuuggccccugcacucagaaaugcacauucccaucacuaccaaccaucccaucaccagcucauggccuuuguacacccuccugccgggccucugcucuucagcucucccuggccucacagaugggaccucgccuggcuccucuccuuccugggccugcucucucucucuuuacucuucuuccucuuucuaccuuuucuuuggucauccccuauggcucuugcccaauuuucuuucuacccucucuccccaagccccaaaacauugcugccaugugaaugucucacacauuuguaucaccaggugugacauuucugguguccucaacugcuccuaagauaguuccagguuggcaggaacucuccuguuaucccuaagucauccugucugcaacaaaugcaucaucuacccucaauaaccagcuccuuggcugggcgcaguggcucacgccuauaaugcuaacacuuugggaggccgaggcaggcagaucacuugaggucaggaguucgaaaccagccuggccaauguagugaaaccucaucuccacuaaaaauauaaaauaauuagcuggacaugguggcgggcaccuguaaucccagcuacuugggaguuugagacaggagaauuguuugaacccaggagguggagguugcagugagccgagaucgugccacugcacuccagccugggcgacagagcgagacuccaucucaaaaaauaauaaaaauaaauaaauaaauaaauaaccagcuccuccuccuagagugacaagugagguuuuuucucuuguuuccucaccggauccuagguuuacuccuccuuuccccuaacucuccugccccucaccaacgcacccauguaaccaaucaucauccucuaguugucuuugaaaugacucagcaccugcccaagccauuccauucucauuacaccccagguucuagcccuuauuuccauucaucaggacuauggcaggugcugccuaaucugcccugccucauacaguaggcaauacugccucucccgcaaaaguccaugcccuaauccuggaaccuaugaauacguuacaugacauagcaaagaggguuuugcagauguaauuaagguuaccaaccuuaaaauacagagcuuagccuggauuauccaggugggaacaccuaaucacaugagcccuuaaaggcaaagaauuuucuccagcugaaaucagagaugaagcaaaagacaaagugccaaaggaaauguggcagaggccgggcacaguagcucacaccuguaaucccagcacuucaggaggccgagguggguggaucaccugaggucagaaguucgagaccagccugaccaacauggagaaaccccaucucuacuaaaaauacaaaaauuagcuggguaugguggcgcaugccuguaaucacagcuacucaggaggcugaggcaggagaaucacuugaacucuggaggcggagguugcgaugagcugagaucgcgccauugcacucuggccugggcaacaagacuaaaacgccaucucaaaaaaaaaaaaaggaaagaaagaaauguggcagaagggaaagccagagagcuugcaagcaugagaagaauuugaugcacugaugcuggcucugagauguaggggcccaugugcaagaaguagaagaggccucuaggcaauaaggguggcuccagcuugcagccagcaagaaaaugggaucucaguccuacaaccacaaggaaucugaaugaauuuggaagcagauucuucccaaagccuccucauaagagcccagccagcugacauccugauuucaguccuguauaaucuagaguggagaaaccagucaagccaaccuggacuucugaccugcagaacuguuaagauaguacauuuguguuauucucaucugcuaauuuugugguaauuuguugcagcagcaauagaacacgaauugucuucguucauuccugcuacuguaacaaaaaugcuuugggcuaauuuuuuuuuuuuuuuaccaauuccuccauuacagacugggucauuuauaaacaacagaaauguauugcucacagucuuggaggcuaggaaauugaagaucaaggcaccaacagaucuggugucugaugaaggccuguuccucauagauggcaccuucucuguguccucacguggcagaaggggcaaagggcaaacaggauacaucaggccuuuuucuaagggcacuaaucccauuuaugguggcagagcccuccugagcuaaucaucucccaaaggccccaccucuucauaccaucacuuugggaguuaaguuccagcauaugaauuuuggggacacccauacucagaccauaacacuaauacaccuuaccaucauccauuccgcaaacugcugcuauaagucaccuugcacccccggaccugucagaacucccagcugcauaccauguaugccccaaacccucagccuggcauucaagggagucagccuccagauuuucuuuuuagcucaucugccccagaaaccgccacuuaaaaugcacuggccaccuucacauccuccagaauugccuccagcgucccaccuccaggucugugcucaugcuaugcucucaucuggaauuccuucuccuucccacccccucccccaaccucuccaucaauccaaauccgcccucuguuaaagccuccugugagcccccuccucccagaauccccccugagcccuccagccuccagaggccucucuccccucuggucucgcugccucacccacuuagcucucggugcacacagcuuuguguuagauucuguuucuccucaagacaaucuaauagcaagauccacagcuuuuacuucucuuauguccuccacgaugucuagcgcaguucuggauauagagcaggggcaggagagcaacagaaagagguugagcuacaaauaaaaugaaccugcuuccagccagugcccuguggagcacuggguccuagaugugacaaucugagggcccccauccggccagggccuggcugccagaggccaggagagaaggcagaggccucaggccaggaggcuccacugaguguggagagggggaaaggggcaagaacaauuucaaaccacauagcagcucccugagaaggauaaggggccucugaaccaggccagaaaccaaccugagccaggagcacugggccgagagcacauccaggucagacacaagaaguucagagcaggagcggacagaagccgauggaaauaggcaagcuaggcucagagagcagggcggaucagccuaccuaucuggcagugagagggacaaugugggcucucacacaaagcgacagacacccaugaggaugagggcaaggcuaagcgggggugggggagcaaagagagaagagauuaagaaggcagggaaagggagggcuggagcgggagggugagagaagacagagaaaggguguggggaggagaggagaggcggggauuucucccuugacagccaccguggaaauaccacaaucccuagaugacuccuagcccaccaggguuaaggugaggugagaagauggcaacaccccaccccccuggccaccacaacuaagaaauuauguagaguaauuaaucaaaagcuaaugagaaauguguuuucucucccagccuagccccacaucauauucuuauuagcugagguuauuacaauaguaaucaugcaugcuccaggugcaaauuggguuuugugcuccacugccaccaauuuagaaaaccauuaauggcaagauaaagcccccauggcucccgccaggcugagccgaaucaaccuccugcagguuccuugcucccagggccgcaugcccauuguccagggggcgcucuucugagcaucccaggaaucaggaggccugcaggcaggagacaaacacugagggugggugggacaggggcugggccugggguggaagaucuuagaccucucucucucucucucuguccacacacacacacacaccgguguaguugcuagggcagagauagcuccaugaaacaaaguauaaagccaggucugccugggagguccaaccuucccaauuuucucuugagcccuucccccuugugaaccugcccucuggaaaggguuaacuaaaucugugguucccaaacacagguacacaaccaggggcugcccuugauaaaguuuccacuaguaaaaagaagggcaauguaguacauuuuucacaaagcuaaauguacucaauuuuauagauguucuuuuucuuuuuucuuuucuuuuuuuuuaagauggcguuucacucuguugcccaggcuggagugcaaaggcgcagucucggcucacugcaaccuccgccucacggguucaagugauucuccugccucagccuccugaguagcugggauuauaggcgugcgccaccaugccaggcuaauuuuuguauuuuuaguagagaugggguuucaccauguuggccaggcuggucuuagacuccugaccucaagugauccgcccaccuuggccucccaaaaugcugggauuacaggugagccaacgcacccggccuagacguucuuuuguguacuuagagagcauugugauaguauauagauguucuuaauucugaaauuguccuuccuauuuuguuugugguuuuauauccauacauauacuuguguguguguguguguguguguguguguguguguguguaagguauauauauaaccuuaccuuauuacucaggacucauucagcugcagggaauggauuuaaaauuauauuguaaaauuggagauguauugguucacauaacuagaaagaacaugggaaaagcagaagucagaugguguugucaggccucucuccccuucuccagcucucuuugcauuguccuucuucugucuuacuaaauuugagcuuccucccuggggcagcgucauggaaagaauggccccugggcuagcauggccaaaggcugcucugggguacauugucacugcuuaagaucucagagaagagagagcuuuguucucccuccacacccauggaaaaguucagggcagggcuccgacggucucaccuugggccauauauacauucuaaggccaaucacugugggauuggcauguuggccagaucugagucauaggauuacuccugagacaagguaacagcucugcccuucugccccacuagaauagggcaacagucagugcucuagaggaggcaggaauauggucauugaaaaacagggguaagggaucccgggcaaagaccacagacauccacuauacccagaaaauuaaaauaagaagaagaaagucuugggagcuccugggucaaacacugagccaccacgaaaugucagagacuauuuugcccaugcaaaucucccaggauucacauagaagaaaguuacauuacacuaaccaaagcaaugaggugccaaugguaaguucucagcaaacucacuaguugagcugaauaucagagggccugucugugacagcagaacauauuggugauuccuccaacccauuccagauuauucugcacagaaaaccaaagugucgaucuagaagauguucauagccauagugcgaugagaguaagcagagugguggagagcaauuucuuuacagaggaaacauuccaggggcccaaagaccucauggaaauccagucaagacaauauuuccagaauacuaagcccuugggcaaaaugaccuccccauggucccacagagucagcaugccuauggcucauccagucaauagaucagaaguaugcucagaacauccuucucuuaaggggugcugguuugguuguuucuaucauuuauuauuauuuaguaguuugaaccuguuaccugcauaagucuccccaauuaauaaacugcccccauaggccugacuuugaagucugucu

SEQ ID NO: 15978 - RNA, 330977 nt, Homo sapiens
uggcgcgggcgcgccgccgaacgccagcgccagggggcggggugggggagggagcgaggcccuccgagagccggguugggcucgcggcgcugugauuggucugcccggacuccgccuccagcgcaugucauuagcaucucauuagcuguccgcucgggcuccggaggcagccaacgccgccagucugaggcaggugcccgacauggcgaguguagugcugccgagcggaucccagugugcggcggcagcggcggcggcggcgccucccgggcuccggcuccggcuucugcuguugcucuucuccgccgcggcacugauccccacagguaggugugggcaccgaccgguuggccccuaaaucuccgaaggcaccccaguagccuuggccacagaggggggaaacguuuccaugacaaccuccccccacuuccuacauccgaagcggagggaguguggagaggaaacucagggcugagagggaaggggcugagggcaucugugagccccuucuccccugcccggcuaagugugaaugagaguccccagggauggcugcacccacaccuucucuccccggcuuggcgcggggugcagaguggagugagaauggggggcccgggggcuguaaagcaugggggaaggggaugguucaaagacaaccucaacccuuccggacccuucuaaacucgccguucuccccguaacuugcagguccucccaccucccagggcuguccauucgcccccaccucuccagagggcccccccaguucuccauccccgaagccuccugguggcugacucccagccgcccgcggcgugauuucuccccgguccccaggacauccccagacuugucugaucuccccugccccuucccccaacgcgcucugccuuucuccccuguccccaaacugcacgccucucguguuucccuccggccguucgcagcccuccgcccccucggcucugcugcgggucuuuuuggcccggcuccaggcggggaaaguuccccggcccggccccgcggggggggcggccgcugucgccgccucugcgggaaggcgccgggagcccgcagcccgcccgccccacagcguccucugccacgaguggggacacgggauuucccggcugcccguucuuucggcggcccgaggguggcggagggggcgucgcggccucugcggccaggcgggcacccugcgggccuccgcgcgcucccugcgugaagagcagucuugggaauuugcccaggggcggcucugcacgcccggugccuucccugaagacaccgagcacucggcuggagcccgauguguggcugcccgugugccgggcgcguuggcgcggucgggaaagaagagggcaguguuugcuuuugcuaacaaaagggagccggagcucuuccucagcggagaggccggcugugcugcacccagccucccuucccgccaccucgccgcgcuuggcagccgcgcggcguccucuggccccugcugcaggcuccaggcgggcgccgggaccgaguggcacggggccgcggggugcgagcggcgaugcaggaggggaugcagcagggcucugagccugcaaagccccuccuugcagcuccagagcugcaggacccgggagcaacaaguggcggaggacgccgagagcucagcccccaccugcggagccccaggcccgggcgggcacagcguuggggccacggugcugcuucaggggcgccucuccgcuugggcugugccuuuuguuuacacgcuagaggacacacaguuauguaaacaccgcaggagacacgcuguaggagacgggggaugugugggggugcuagcuugagauuugggggacgccggguuggcugcuugcccccaaaauaggcuugcaaaggagcucggcuugggaaaccuauuggggggcgucuggcagcagcgucaauuccagcgcugaggguuuuuuuccuccaugccacugucuccggauguuguuuauguguuuuuccucugugaauucuuaauuuaugaguuacgagauaauuggguucagccgaugccggugugguuacaacuucauuucaggugaugccucugacuggauggguucaauaaaauguuccugaaagagaucccucgugcugcugcauuguaaaaagcgccagugucaguuaaacgugagcgugaguaaaggcucgguaacuggcgcauaauagaggcaacaauagacuuguauuggcugcaaaaaaaaaaaaaaaaaaaaaaaaaaaagccggggggcgguggaaagcuguggucggggauauugcuuuuugacuaaaaaugggagucgugcaaugacgcuuggcagcagaaguaggauuagauuaugccuccccugucaagacugcucauugaaggcaccggguaguagcaacgguacuauauuuguaacuaucucgcggugagaaguugccuucccugcgagggauauaugcugacuuaggagcggucuggaacucaaccgugcaugucaaagcuacaugaaaauucuguugccaguuaccauggaagcagcuucuugcucuuguguacaucccuguuuguaugcugguuaucagauuguguucaaauuagaaaguaauuggguaugauuuguagugaggagaugagaugacuuucuuaauuuuuuucucuuaaugcauauauauauauuucguggugaguuugagaggaggucuuggcucauuccggggucccauaccccagggguaaauuucaggugggcaccaagggacuuuuccuccucaguucuguuuaagcuuucucagaggccuccaguucccacucccaggguuaaagaaaccuguuggugcaucugacuucauuaggcuuguuucguuuacauccuugcugggaaagcgaauuaggaccaucgugcguggguccugguucuguuuucuccuguaacugaagccauccaucccccgcagaaaaucuccucucauuucuccugugauguuuggaugaaauggauguuaaugaaaugcaguaaaaauggguuugcuuaagcucacuccacaguguuaaucacgccuguuauacguucaaggugcaugcaugauguuguuuacgaucccgagugaaccaguagcugaucaccccccucuuaucauuuucaggauuagagaagauggcugguggaugggggauuuaugguggugaugggaaggaggggggcugacuuuugcuugcuuuggccuguuggggcuugcaaaccggggauagagacuuuacaaaagugccgcccuguuauuguugccuuucccugcaucagauugaauagccgcaguagggacuugcacuugucugugauagauuugauaaaauaucccucauuaaugccacuuuauauuuacagugugucacuggagacgcacaaggcuucauuuagugacuugugugacgagacaagcuugcauuauuugccugggacguuuuggaggaacaagagacccauugagcaaucuuuugaaaugaacaaauacgaaaaagggggggaauaaaagagcaggcaguucucuggaacaaagagcuuuauucauauggauguuguacaugcuuuauccaguuuuccccaauggcccuccugguaaaggggagugggacagggaagacgccaacaggcaggacacuuucguuuccucucucacuuccugacuucauauucuuaucggaguugguccccggcucacugccugcucaucucucuccacacucucuaaaaucccagaagguaacggauuccugggucuccacagagagauugugaaauccuuucuuccagcucuaaauuucaacagaagacaaugcuagcuaccuguugagguugauguuguuggaggauauauugguugaagggaaagagaugucacuuuucuaugacaugugucaagaagugguugauagugaaugucagauugguaagaugucuugcaauuauaacauuagccuuauuauuuauuuggaaagaaaugcugugaaaaccagcauccaaaaauuguauucuuauugauggugcucuuggaguuuuuagugacuuuuucccacaccugguacauuuuagucucauacauaagugaauuuuuauuauuccuuggccuauauugcuaaaugauuuuuaggcuuuaaaaauugauaagauugcuaugaauauaaacugucucauucucuugggauuucuguacgugacauuuuaaugccuaauuggucacuuagaauuuacauuuuagaaaugauuuugugugugugugugugucuguuuuuagcaaaaggugcauuuuaauguggggauucucuuaaauugggccaaacuaaucaaugcuauaauuugaauggaaauuuaccagcagaugaagaaaauucaaaauaaauccaaaggauucaaaugcuguacguuuuucuugggaagaauaguuuugaccauuaugcugggcauuuuuaacugaaaauccagcacagaaaggagaaaucacacagcgacaucuguugcagaauugaaaauuugcugcuuugaguuggaagcaauuagucccauauaagcaccuaaugguaucaguguguguguguuuguguguauguauaaguagugauacaaauacauacauauacauacuuauauauacauauauaugcacaggauacaaaaacuugcccacauacaauauucauauucacauuaaaaauuauguaauagaaaauguaacauuuugggacuaaagcuguuuuuaaaaauauuaccuuuugaggaauuagagauucuuauaaucauggaauuuuugagaggggaaagauauuagaaaucaucuggugaaaucccauuuugaaguaaaguagccgaaggccagggagggaagaaucuuacucugcaguugaacuaaggcuagguuaacgacagauccuggauagggacaggucccuugauguccagccaguggaccuucuguuccgccuccuggcaaggaugccuggucagagauauggaucaugaauagacacuaucuuggcuaaaaauauuuuguauuuugaaggcagcaagauuaauuguugcucuagguaauaaacccauggaucagaggagugaccucugggaagaaaggaccaguucuugguaauauugucuuugguguugacaaaugauccugaaaccucuggaauuuauuuggcagccgcaacagaaaugucauccaaagcaccuucauaggggagaaaucuggauuugugucauuggaauaagucugauaugcaaaaaccaggcuucugaaggcucagauuuagauuucuacaguuuuuuauuugucuuuucaaggauuaauauuagcaguagaacugguucuguauaacuaaggaaaaaaggaaauguucuuaagaacaagaacagagcuugauuuucuuaccaggaacuugccucuuuucaugaaaccaagaaaaagcugagaauuuuuuuuguuguuuuuuaaagaaaaaaaaguuuuauuuucgaaggaugacuuuuuuuuuuacauugaucagauuuuucuuuuuucccauuuuauuauggaaaauuucaaauauguauacaaagugggaagaauaccauauuuaaccaugcaugcaaaucacccaguuucaauaauuauccaccccuggucgcucuauccccucugugcuucuuccuuuccucagauuacuuuaaauaaauccugaacauccuaucauuucuuccauaauuacuuuuagaaugauuucuaagauacagccccucuuuuuccacuccuuaucacaguauuauuaucuggccguacgcacaguauucucaccuggauguaccgaauuuuugccuuagcuuuacugaggaagagagaaugaaggcuuguugcaguuggugaaagcaaaggcagaggccagagaagcuacagcacgauuauugcuucuacugaggagaccuucuccuaugguuugguuuauuuugagcaagguuuuguuuggaucggauaagaugaguuuuauuguugugcaaauacaguuguguaaauaugcaguaauuguagcuagucccucaacuguggcgugcgcuggaaagcaccguuggcgagacuggccauuuccaauuguucccauaaugauuaccguccaugugaggacuucuguaggaaaggcucauguuaguuugaugacuaugagauaccccauucguauauuugucuuuaaaggccuccaugguauaaauaccuuugcauuuugugaauauauugcuuaaaauaaaaaugucucuuuccauuucgaacuggcuaagugcuaauuucagccgcuauucuguaacugaagugaucacaaaaugccuucuuuggugugggaaacucaugcaucaggcuguaaguauuugggccuuauuuuugugggaugguggugaaggaugguggggagagaaaagguuacuaccuuuacuucuuaauauuugcuccauugauuuaaaaugugaauuuuuaacuucagcuagaaauguuggaaugcuucaguguuaauuucaaaaagucuuugguuuuucugaaaauuguuccguuuuccaagguucaugaaaugugaggguuuuuuuuuuuuuuuuugaggcucuuucucaaaaauuucauuaaauauggacuauaaaucugaagcauuuaacauuugguuuuuuuguuuccagacaaacagggaauuaugcaugagaugauuuugagggguccgaauggcccuggacaggugaaaaccugcccccugcaccgcccccucugaguugaccaggccacaagaaaagcacaaaggaaugccuacauucacgauuuggggagcaccagcaaaaucgaauaaaaagccuuaguuuggaaaccaucaaugaaggaaggaacccacuggaauguuuguaauuacaaguggcaccuccuuguuuaaauuucagaagccacaguuucuuuuucagagauuuaaauugcaggcucuagccagcagcugcuguugugguuaaugggcaguuucucuuugaagaucuuccaagugcugguucucaaaagcuuuggugcaguuggccuugaacuaggguuagaaaaaagggcgauguagauauuuauacaaaugcacagcucaaaugacguguggccuuuauuauuacucaaaagaaacuugguguuaagguugagaaaaacccagcacugagaaaaaccuguuaugacugacaggugucuugaaugaggugauuaucuuaagggagauaaggugggagaaauuuuuucuuuuaguagauguuuuacuggaauacaggcauuugaccuaacauuuugaucuagguauuucagaaauguuaaauaggcuugaaaugaaagugcugugauauauauuuaaaugcuacucaguguuugaaguugauauuccagugacauagacuuuuaaaaaugccuagaauaaguaucuugcucuuggcagacuuccuugggaagguaggugcucugauuccucguuggcuguccagcacuggacugcagugucuaguuggaauugaguuaugccgucccuagaggaggugggaagaaucugccugaaaacaaaggguucuccaguucccugacucccauugucugugccauaucuccacuuggcugggauuaaccuaaaaguuaacguuuaaaaaauuugaaccuuuaaucuuuuugcaguagguaucaacuuuucucaaagucuccauuauuaccaaugacaccauugacauccuggucuccaaggccccuaaauuuggagucuuuuuuccccuccuuagcuuuccugcuugcacugaaauaaaauggggcugauuguuucuaagugacauucucuggaaacaucagugcccucuccaaacuguguuuugcuaacaggaggcuccuagccaguucccccuacucuaguccucugcuagcuacugcaauucuaauucuuuucaggacaggaucauaacauuucccauucagaaaccuaaucucaaauucuuacuucuugcaucagauucaaacuccacacuguuuugucuuuagguuguucuuccucaauugcucucccacucccucucuauugcccucauuucuuauuacuuuucagcuuaauccugaugggacuggaagacugaugauucuccagugaaacugaggaagaaagugguucugccuaucagccuucagcugguuaccuuugcauaaaauacucucuuuaucuuuuuucccuuaacuaacugucuugguuuguagguguaggauggcugauuucucuuugccuacauugagaauaaacaccuuccuuuuacaucuuucauuuuaacuaacacauacuuaccuaaaagguaccucaacccacaaguuucuuucuugacuucacagguuuauacaugauuauguuucuugaugcuaagccaaacuguguugauauuauggccaugauuuucgugaaaauuuaaaacaauacauucaugaaaauguauugucuccauuugguaguuuguauuugaauauggggauuuccuacagcaugaaaauuguguaauugacuaaacaaauuacaagcugucaaaguaagacuuucagacaaaaagugaaguccuuuagaaguaggaagacuuuuuaagggucacagucagagggccucauguggaacugcugacuuggggugaaugagauuggcuccucugaagaugauccaagagauaccaccaccuuagaggaguauuuggugcuugugucuggugcguguaguuaccuaguuaccagaaaauaauaaauaaaauaaaauaaauccuaaaaaaucuacccagagagauggaagggaagugcuuuaaaacccaggccuuuauuagcuaguguuuucaacacguuugacuuugggagcagagcugccuggcuaaaugaaguuaccgccaucagucacugccaggccagcaucgggacaggucuaggaauuuaguuacauuuugcauuuugguagauaacauagaggguggauuaucacuggcucaagaaacaaaaaaaugaaaccuuucuuucucagucuaccugcuaaauuuguuaucguaaggaucuuuucaaagccuuuaucugggagcaauaucugccagaguucuuccuuccuuuuuugcuugccugacacccuucccuucagaguucaguucuugcuaguagaaaaaggcuaugcagcaugauaauacagugauuuuaaaaguugauuaucuugaaguauuuugggacaguuuuggggaauggguuaugugguauauauuuauuuggcucuuugcugaauauggcuguauaaauccagccuccuggauguuacaagucauccccuugauuucuucuuuugaauaaaaaaggagcauugcuucauuuuucuugcagaaacccuuauuuaaacaaugaaaacuucaaagauagggagaaaaaaaccaaguuaauuuaguacuaaauuacugcucaaaugguuuuaucuuuuaaaagguucaaguagagauuagcuuaaauacacugaauuucacuuuuccuuguacguacauaucuugugagcaaacuucauugugaagagcucucugucuucuuuaguuuuguuaguaaucacauaauuguuaguugcuguuuauuucccuuuccugaagcaaaucucuccaucucugggccagguuggcaaguggaauacccaguuaagauuacaggauaguaaaacccagugcuuuaaucaaacugcuuacuuuacaagauggcaaaaauaaaauaauauauaugaacacucuuaaguaggaaguguuuucugccuauuuaccuaucucuauuuaucaaucacuuuuauuaaaacagcaauaccuagugguggggguuauuucucuggcuacugcuaauaauaauaacuuuuguaagucuuccacauuagggaauacugaaaaagaaaauacuauguaaaaaggauuaauucaggauguacucagucaucucuaaggugaaacugaagaacaccgugacagcaagauccuaacuggaguugaauguuuuuugauaaguaaauggaaucauuuuguaaucuuggggaaacugacaaugauuauaaucucuaauuucugggucuucuaauacagaaaggacauauuguuucaugcaguuuuuuauauuuuauauacuauguuuaauaaagaaaugguguuucuguagcuaacccauaagacauuugguagaaaaaugagcauuuaaaaaugacuuuaaaauugaguaucugcuuuuauaccagacacuguguuagguucaucuuugucuuucagaagguucuagucuauuuuucccucaacuuuuauuucaaaaaauuucaaaaccacaggcaacuugaaagaagaauacaaugaauacuuguauuuacuuuaccuagauccaucaacuguuaacauuuuccccauuugcuuucucucucucucucaauaauguauacacacauacucaucuuuuuucuucccuaagccacaugaaagcacauugcaucaugaugaauacuucagcauguagcgccuaagaauaaagacauuuuccugggcacacgcaauaccauuauuacauugaaauuauauagucuauguucauauuuccccaguuacuuuguucucucugcugcagaaucuaucagagaucacacauuggauauggucucuagucucuuuuaaucuagaaccauuacccugcuugccaccuguuuuuucuuuaaggaguuuuuaagggguaucuuuuauggcauugacauuuugaugaauccaccugcucuuuuguagaauguucuguaguucuacaaauuguuugaucauuuccucaugguucaguucagauuaaacaucuuuugcaagaacccugcauagcugauacugccaacuuccuuguaacacugccucaagagggacauaauaucaguuugcccuauuacuagcuugauccuugguucaagauauaaauuuaguuacugaguguaggugaauuuguaggguucuccauuuuugucccuuuauaauuaauaaguaaccuuguguauacauaucuugugagcaaacuucguugugaagagcccucugucuucuuuaguuuugagccugaagaucuuguucucuaauggcccuuuacuuaauggauugagcagcauugguaaaccuugucugaaucaaauauuauguccgugguuauaaaacugugauuuucuaauucuguaauuccucuacuuggguagaggcauuucugaauaaagaagagcuugccuucccuacucuucccccucuuuuuuuuuuuuuuuuagaaaauuacaauggguucaguaugguauguuucauuaccaucggauuuggccagugggaaccccuucagaguggcuccuguauccuuuuaauauauucucauuaauuuuuaagcucuuuuguauuucaugucacaagaagauaucuauguuuacauuguauuuuccugcccccauaccuggaaucaguuauuucuccaaggaauccugauuccuuuuagucaaagaaugauauuuagacagcggacacaucuaagaauugugcucauugcuacugacuugucauuguuucuaaacuuuuccgugagcaaacaaggguguguguguguguguguguguguguguguauaaaauauccuuugucucaaaaaaaaguuauaugugaauuuucagcugcauggggguaggggcccuguguucaagggucaacugugugaguguauuuuaaaaauguuuauucauuuaaaucacaaugucaugcuaauacauucaauuccagucuaacaucugaggguacuuucucuccaucucccauuccuuauuuguguuuucuuucucccauggugaaaacucuguuucccagugauagcaacgucuuuuuaguacaaaauaguuuuggaauuacuccaccaagaccauuguagacaacaaaucuaccaaguagagcgcaggauuuuuugccacucuuuuugucuuuaaaauagaucccacugaggguagaugaguaucauguucacaaauuuacagauuaguuuuuuuguguguguguuauguaucaauagguauacaguuaggaucauuuauuucuguuuauauuuuguuuuaauuucuuuccuaucauuguugauuuauaauuugaacauauaacucauuaacguggcucaaaaucaaaacuguccauucucauuucguucccuauguuuuuuguaccauucccacccaacuuccuauaguugccaauuucauacauuucuuguauauccuuucaauuuuuccuuuugaaaauauaaugaguaguguucuauucucuuaaacuuucacacagccuuuguuaauaucugccuauaauauguauuauuugacaaauccuagguucucguauuuguuaugaugaccuuccuccucauuuggcuguauuuuacuuuagaagccuuuuguuuuuauuuauuuaauuauuuauuuuuauuuuacuuuaaguucuaggguacaugugcacaacgugcagguuuguuacauagguauacaugugccauauugguuugcugcauccauuaacucgucauuuacauuagguauuucuccuaaugcuaucccucccccugccccucaccccauuacagguguaugauguucccugcccuguguccaaguguucucauuguucaauucccaccuaugagugagaacaugcaguguuugguuuucugucuuugugauagguugcuccaaaugaugguuuccagcuucauccaugucccugcaaaggacaugaucucauccuuuuuuauggaugcaugguaucgcaugguauauaugugccacauuuucuuaauccagucuaccauugauagacauuuggguugguuccaaguuuuauuccaaguuuggguugguuccaaguuacuauuuucacuuuucucccauuucuuccuuccaaguucauaguuuuacuuggauaguggaaggaauucauuuuuuauuuucuuuuuuuuuugagauggagucuugcucuguugcccaggcuggaguacaguggugcaaucuuggcucacugcaggcuccccgccgccagguucaugccauucuccugccucagccucccgaguaggugggacugcaggcacccaccaccuugccaggcuaauuuuuuguauuuuuaguagagaugggguuucaccguguuagccaggauggucucgaucuccugaccugaugaucugcccaccucggccucucaaagugcugggauuacaggcaugagccacugcgcccggccuuuuuuuucuuuuaauucaucaaguuacuugcaagaaaauaaggauugcccuuuucauacaauauaacgugucucugauauuuaauaaccaugccuuaccuugcuucugaucggcugucuuuuuuuaacccuucuccuuauccaauaaguuggcaaauaaaugccucaaaccccaauucuuccaacuuuuuuuuuuaauugcaguauaauuuacuuuuaagugcacaaccaagaugucuuuugcauuuaaaccucagacuauguucuaaaagugccucuuggacaucucaguccggauguuccaguuaucucaaauaauaugaaugacaaaacagcaguuauauuuagugucuguauucaugaucucauuuaauccucacugucacccuauaguuaccacuguugccccauuuuacagaagaggaagaggagaggacaguaauaggucccuuguccaagaaacacaaaugguaaguaucagaaccaggaucugaacuauaucuauguucaaaacccacaguuuuaaacacuuaacugcauuuuccuaaaauucaagacgucuaaaacugaacuucacaucuguucuggccgggcaugguggcucucgccuguaaucccagcacuuugggaggcccaggugggcggaucacaaggucaggaguucgagaucggccuggccaauauggugaaacccugucucuacugaaaaauacaaaaauuagccgggcguggugguaggcgccuguagucccagcuacucggguggcugaggcaggcgaauugcuugaacuugggaggcggagcuugcagugagcugagaucgcaccccugcauuccagccugggcgacagagcaagacucugucucaaaaaaaaaaaaaaaaaaaaaaaaucuguucuucccacaucucccucuauuccauguuuccuauucugaugaaggguaccaccauccauccaaugaguuaaauaaaccugggaguccucauagagaauucccuccuuuguuaucaucucccccuauauuagcuauagguccugccugucuucauuuuacagacgaggaaaguagacuuacaaugguauaacagccccuuaauuguuucauuuacugcuagccucauuccuuguaaugcauccuuaacacugauucuagaggaaucuuccuaaaauacaccuuagaugucacuuucuugcucaaaacuuuaaauguuuuucuuggcacccuaaaggugaggcuuacccucuuucaguguguccugcaguguccuucaugcuuggccucgccggcucuccacaccauuguuuuugcuuuaggacuaccagaguaaauguguccuggaugcaccaugcucucccaugccucucugcuuuuuauaugcuaccuccucuaccuuaagcaccuuaauguauauggcuaguuccuacaucucucucaagauucaccucaagcacugcauucugaaaggaaacuuccaugauuacucaggcugguuagguaucuuuucuuugaacccuucuucuguacuucccuaagggcuacuccuaacuuaucuuccuccuuccuaucaaacagacuucucugaauggccugagucucuucuauaugcccgcuacacauuucguccaacuuguuuccaccaauagacauguccuauccucauaccuuccacguaggcauauuuaaaucccauguauauguaaagaccgaaguccaguguuuuuaagucuuacauaauuucucagcuugaauauguuuuccuuucaacuucugucacaacuucucuaaccauuucaugacauuuaacauuuuuuacacaauuugauuucuaauauguauauauccuauccuuuucauuucuuauaaauacugguuguugggauacagaauaugccaaggccuuagugucuaugaauuuaauuuagugguggucuuauuaucagcuuuuuuagggcuauaauucuuaguugaaguuguuuguucucccauaaugaaugaagagcuaucaacgugccugacuuuuguaucuugaaggaaugacuucuaguguguuuguucauacuugguuguugggcaucauuaaagagauuuagucuagcaguccagauaagagaaucucuuuccauuuauuuaaucacuucacaguccugggauaccuagacuuugagucauugcugaggcuauaucgucacuuuagaguugaagcaacaaaccaagaaacuuaucucugaggucaucuguuccucuucaccucagcuuucaugagaggcuugucuuaaaacugagauauauauauucuuagaagaggcauggugaacauacggaaauuuaaaccucaggguaacaguuuuccuuguacaguaauaaagauguaucuggagucaguggcuacaggaucaaaaaauagaucacaguaaucggaucaaaccugagaaauggcuuuuugcuguguuuaaaaaaaugacauggguaaggcagucuguuuuguggcgaugcuuccacuauuugugugacuauacagucugugaaauaggacuggcaaaguuaagcuuauaaaguuaauugccuacaacugaucuagcuuuaaacagaaaguagguuuccuuuuggucuuguguagaagaggggagagauuucauguguaggcagagagaguauguguuugcuaacauuaccuuuuaauuuaggagaaguuuggaguuuguucuuuccugugaauauagagguggaaccacucuaaccagaguuuauugcuguaauauuuuuuaaaugcguuuguaacacugauguaucugugaccuugugaaggaguuuuugagaggaggggguggcaagcccuuuuucucacugucauaagugaugccuacucaauaacucuaacuuccugacauuauugggagggggaggagggccucucauaacuuguuuuuguaugacuuaguucuaaaguguucccuucauagucacauccauccauuuagacuucccuuuucccugccuaaggcuugcauccagccuagucuguguuugguacuuuaaaugcuuugaauuauggagaaucuuaguauuuuauugaugcuugccuuguagcuacauagcucuauauugucuuagguuacacagcuugcauuucuuaggcauugugaguggauuauugcaauuaguugaaguuuugagaggaaugcuaugucuuccuugauuucuaccaagugccauauucuuuuucuugguagauuuuuuuuuuuuccagggauugccuuuuaaaggaccuuuuaaguuagaggcauuaaccuuucuuuccaucauaacucucagcagauauaucuuuuucagcaugaccuacugucaaguaaauaaugauuugauggcaauguucaagaaaaauuguaucuuugaaauacaaauuuuugucagugucuuaauguauaguauaugauugguauuauccaagaagaagaaaagaugaaucaauuucuucuagaauuagguggcuaaugcuucaagcauccuauuuaaaaacaauuacauguaggccugucggcaggauugcuuauuucauuauucuggucauuugcaugaaaacaaguugaugauucuuuaaccacuguucaguuuucuuuuccuuuugaauuauuauuccucaagcauuauauuccauucaugcaacagcaugaaucagaucuagaaaguuagaauuucagacuaagauaguagcagauuuuuuuucaccuuuuuuaaccgaaaaugaucucccauuuucauauuaauuuaccugugauuacaucucuuuauccuuguuucauaaggugagugcauagaguuauguuuuaauagaauauuuuucaagguuuuaggauuuuuuuaaaugaggucaucaccuucaagauuuugaccugaacuuuucaugaacuaaaggagcaagaaaaagauaaauuuuuuaaaaagaugaauauauaauguacuuauaauggaauaacugaucgaaguuaaauucauuugauaacguuuaucuggugcuaguucccaaagcacucuaccauuucaacaagagaaacuccauguucauacauuggaucucccccauaagauucucuuugaaaaaaguguuuuacuuuuuuaaaaaaugguuuaaaaaccacuggacuuaaugaaucuuucaauuuccaaacaacaaggcuggagcaaaugaagccugguuacugggagagcacaucagggcuaagaccaaagccguaggcaguaacaaagaauacuuauuugccugaccuuuccucucuucguauucuccuugggguucuggaaggugggacuguggccacagcagagaacugguucaggagcugagauuucagaucacgggcaccucuaucuuuccauuagagggauauaaaggagggagcuagccuggaguggggaugccuagaaggcuuuccauuuaaacaaagucucgaaaauaugggaaggauugcuauugagaaagaggugagaaggaaaggcauuccauguugaggagaaccaugugaauaaaggcuuacagguaggaaaacuaaaauggcuagugagagaugggauuagcaacagauaguuuggggccagacuguggaaaaacuuugaaugucagguuuaaaugaaauucaaggccagguacuauggcucaugccuauaaucccagcauuuugggaggccuaggugggaggauugcuugagcccaggagcuugagaccagccugggcaacauagugagaccccgucucuacaagaaauaaaaaaauugcccggugguguacaacuguaguccuagcuacuugggaggcugaggugggaggauugcuugaaccugggagaugggggcuauaaugagcugugauugcaccacugcacuccagccugggcaacagagugagaccugucucaaaaaauaaauacauaaacaaauaaauaaauucaagaggucauuggggagucuuaaauuuuuugaacagugaaguaacaucagguugguuuuuuaggaauaugaauccugcaaugauaagaaauugagagguucaugaguccuacaaugauuagaaauugagaggaucuuccauuagaaauggagagauugguuaggaguauaauaguucaagcaagacaacaaaaacuugaauuagggcagugaaggaagaauaggagguagaauggagccuccauugauggcugacuagagaauggggauugagggaaaacaaauaauagaaaugaaggugugcuuugauuuuggacuugaaugacuaggagaaugacuacucuaaugaacaaaaauguaaauguuauauguggguuuaguaagggaaugcaaugaacuugguuuuggauauguuaaacuugaguuaucacuggaacauucagguagaaauguuuagaaagcaguuugaaauaagaguuuaguagaaagguugagagcagcgcugcagauacagauuugaaagucaucugcaaagagaugugucuuagcguucucacacugcugguaaagacauacccgaaacuggguaguuuauauaaagaaaaagagguuuaauggacucacaguuccaugugacuggggaggccucacaaucauggcagaagacaaaaggcacaucuuacauugcagcagagaagagacagaaugagagccaaguuaaagggguuuccccuuauaaaccaccagauuuugugagacuuauucacugacaagcaaacaguaugggggaaaccgcccccaugauucaguugucucccacugggucccucccacaacacgugggaauuacaggagcuacaauucaagaugagauuuggguggggacacagccaaaccauaucaagaugguagcaaaaguuuuacauuaugcuuuuauuuaguuacuucuuuaauacacauuuauucaaaggcccagugugugccaaucauuguauuaggugcugaagacaggcagaaguguaugagagauccuuaaggggugcugcagagagguugaaucuuaaggaagguguguugguaacaagauaaacagccugugaugaaugccagaaaggacuagucagaggacuggaaguuaaaguuguggaagaaggagggagucaguaccagguggaagaugggcaggauugguguggggugaaagccuguuaaccaaggugcagaagaaucaucgaaggugaguguauugucuugaaagugaaugaacucuggggaagagguuauuuaagcaaauggauucgacuuagagauuuagccagucacaaagcuaggauauggcaacaccggaacaagauuccagguuguuuuuucuuuucuuuuuuuuuuuuuuugagacagagucucgcucuguugcccaggcuggagugcaguggcauaaucucggcuuacugcaagcucugccucccgguuccacgccauucuccugccucagccuccugaguagcugggacuacaggcgcccgccaccacgcccggcuaauuuuuuguauuuuuaguagagaugggguuucaccguguuagccaggauggucucaaucuccugaccuugugauccgcccgccucggccucccaaagugcugggauuacaggcaugagccaccgcgcccggcccagguuuuuauauuggaguccauuucucacuguagcauaccaguacgccaaauugugucuuuaccaugguauagggaacuagaaagagccaguucagccuguccauauuauuuaaaauguuuaauuaagauacuugaaguuguuggauacagagaaacuuaauaaaccucacgacuauccuuguauuucacaugaccaauggcagcuuuggcaggcuuaagcauggagggaggauagauggaagcuguuuuucuggacaugugcagcuuuuaacaaguaccaccagagagcaaaaacaaauccuaguguagcacagggagcacuuuccggauggcaggaagaaucuaggucagcuuaauggcaacuccuauucuuuagguagauuaauguuugcccccugguuuucagcaugcuguacgacauccagaaagacugugcaugguuccuuagcccauauuaguuaguagggggucaugaaugaaauugaugugugggagccuuuugauuuacaguugagagaguguagcucaggccuaauguggaaacaugcugaguuguagucugcauuuucuuaacuccuuuauguaaaggacacauccuuguggacauuuugcauguuaccuuuaggagaugacuggucuccuauggguaggaugaccaaaaagugcucaguugaucaguagagcucuggaaccugggcuggcuaguuuggcauccuuuuucuggcuaugccuccagugcugucuaauagaacuuuugugaugauggaaauaguccauaucugugcuguucaguauaguaaccacuagucacgugugacuauuuaguacuugaaauguggcuagugugacuaaggggcugaauuuuuaaucuuaauuaauuuauaggucaguagccauguguguuuaucggcuaccauauagggcugcauagcucuagacuaaaaaacauuuaaaaagccaaauucucaugcucaucgguauuuuuaacuagugagaggagguuggaagaggguugaguuauauugauauucacuccaaauuuaguagguuuauauugaacauuggacugagcuauugugggcuugugaauuuuucuugacucuccucuugcuuuucaugucuaaaagccuuuggaauaucuuaauaguccuuuccucauuugaagaauuaccccuuuuggccuuagauggguguagcucaucuagugcauagauuaauagcucuagcuuuguccuuaggaagguaaaucuugaagguuacuguuacaugacucuacugccguaugccaauucacauuguuauuuuugugugugugugaugcugaaagugagugaaaugugaaaaaaacauuauucauuuuaaauaguuuugacugccagguuaaugcaacucuuaagcagagcuucaugaggucuggccauaguaacugcuuuuaacuugauuuaaaguucuuaaacguucugaauugcuucaccuaaucuuuuuauacugaacguauaauuuucagacucgucuuuauuuucaaauccauaacugacagcugcucaacaccucauucaaauaguuuuaagaguuuuagagaaaaguugggacagacuggauuuacugacaucaguuggauugagauauuguggauuuaaagaugauagagaaggagagggaaaaguaugaaauaauuauuccguguucacugcuugcccaaugacagugauuuaaagccuaauaacuaacaaaacugagagauggcagaaggacauuugaauuaacuuccaaaucuuaauauaaggaaugaguauuuucuuugaaaacaaaauuuucauguguaguccuauucguuuuauuauauuuuuaaaaauauuaaugcacagaaaugcauauaugccaaaaccucacuacaaccuuuuucuuggcguauaucuuccagauucugugagauugucagcuccuuaaaggagcuaacucuuuaggggacuccaugaugucuagugcacagcaaacauuuuccaaacagaauuaaccaucuuauaagagaaacacguuuauaaauaccucuacuuccaaugacaaaugaaaucaucuugugauucaacucaagaaggcucugggcuacagugaauauagagaagcuucaggaaguacuguuuaagaguuaaaauuaaugugacuaaauuuuguccucauccuuuugagaaaaugcaugcaugucuguguguguauguguuuguguguguguaucacuuacuaugugcuagacacugauaagcacuagguuuacaaagaugaauuauauaggcucucuuccaucaaggaacuuauauuuuagauguuuuugcaggacacaguaaaaauaacaauaccaugugccaagaaccauaauagauauaguucaggagugcuguggaagcauagaagaggaaugucuaacucacuauggagacuuagagucaggaaagacuucuagggggucucuugaguugagccuugaaagguagguaggagauagccagauagagacgguauuagaggaguuuuuccagguagagagauaaugggcggaaagacaaaagcaugggggauucugggaacugcagauaguuugcuauggcugaggggaauagccuuugaaggagcaccaaaauaugaagcuggagaggguacacaauugucaaaucauacaggaccaacuugguaauaaagagaagucuggguuuuauuccauggagagugucaaugaggggagcgggagggugcaggacgaaucuggaggauuagagacucagguaggagagcaguuagggagcagcuguggaaggccagcugaaauuuugagggccagaacccagguaguugcuaggcagcuugggaggaaguugguuucaggauauguuuaggaaaguagaauuucauaacugaucaagagagugggaagaggaggagucuagguuaauggucagguucuggcuuggcugccuaaguaggugauggguguaguaacuaagacaggaaauuuagaaagcagacaguguugggauuaaagaggaugugcuugacccugcagaaguugagcuggaggcacauucaggugaagauaccuagcagcacucuguggcacucauuuggagacauggccauggaugagaucuccuaagaagaauguauauggaagaggaagagaagcuaaggacagaaugucaggaacgucaacaauuaaagguaggcagaagaagaugaacuagugagaggagugaagaaggggcugucaagagacuuugaggaaagccaggaaagccuuuuguuuuggcaucuaagaaggugagugagccacagugucaaaugcuacagggaauucagauaagauaagggaggccaccauggcuauagaacuuagguauucauaggggaccucuaccuuacaauuuuagugcagcagugagugugggaaccagauggcaaugcguggagcaaauggaagugcagaauaggaagcaugcuguagacacauguuugaagaggcuugacugguaaagguagggugagggagaaggggacuggaaauaaggagguguagaacuuagagaaauuuuaaaguauguauuuuuuugaauuagggaggugugagaagguuuauauauaucauaaaauaagagauauuacagagggagaugaaaaauaggaaagugagaguugaucacugaccaucaagggccaugaugaggcucaggaggaggcauuugcugagaggggugggggcaagagaccauuguuuucuucugagguggagauaaugggcaaggcuuuaagaaggaggguggauguagauaagauugcacccugcagggcugaggccuggagggagggagaaccuucuugggaaaguaggaucccaugcuaaaccuguugauggugagauggagcugugcagggugagaaacugggaagguuugaaauguucucccuccaggagaacucagaaauucuaggaagcaaccagcugaggcuggaaacauuacguugcagugacccaaggccccuugugugcugauuauccuugucugagcagcagacugaaaugucacucuucccagagaccagucugagauguccuugauaucuuccuucccuuucagagggaaggcaggucaauguaucauggaaauuuagagcugaaggggacuuuagagagcacacagaacucccucaucuuguaaaugaggagaccagcucagaaaagugaaugacuuauucaaguggauccaaggccagggcuaagaccaggccugacuugcagcucaggguuuucuuuguuguucccuugcuaccuccuugauaaggauuauuaguaaaucccacucauuauaaaugcucuuaauuucccauuuuguacacugggaauucuacaccauuuucuuucucuuccaguuuuuuguuuuguuuuguuuuucuucuuuguggaguucaagcagguauaacaguauucuaggaugcuaaaaauaaauagacuuagguaucuuuucuuaaguggagaugauacuggauuagaugagaauauuauuugggaccuguaaaaagguaaaacuuaaaugcugaaauguuuggaauuucuguucuuacaaacuuuauaauuuuaaagauaaguagauuuauucacacauuuuaaaauucuuucauuccauauuucaagaggauuuacuaggugaugaugccacagcaaagaauuuccauaucucuccuguugucuguugagaauugaugauuauauuaauagucucuccaucuagaguguuaagguuaauauuguuaacuugugaaugcuucuuugggaucuaccauccauguccuuagccuagacaagaacuaagaagcagaaaauagaaugucuuuuggauaaacacagauuugguaggagugauuuaguuuggagcaggggaaccuuaauuaauuaucacuguuuauaauacauuuuuccccuuuguuuccaagaaugagaauaguucagcaacacaauugauaaauaaaacauaaaaggacaguuaugguugcccugguaacuauauuucucagcaaguauuuuguuugccaugaaauguguccaggguuauuuauuggaaaucagacuccaaaugucaugacuuuuuguauuugaauuucuuauguacucauuuaggagggacaauuuuguacguuuuuuuggguuggguucugaagcucuaugugugauggggauccuuguguguuuuucuuuuuuuggaagacaaauaggaaacugugauuacagugaaucuauuuaagaugaauuuccaagucuaaagugggauuuaaaaguauuugaaucauuuuggggauacaugaaauuucuuaaaacuggaauauuuuaauguagaauuugaacauaagauacuuucugaucaaugaucaggaauauguuaacauuacauuuugacuuaauuccuaugcaauuaauuuugaguagaauaaauuauucucaaaaaagucuuaaagauaaaaaucaaaauaauuaagcaauuagagcaauugccacuucuagaugauuuaugguagugugaauuaaagcuaagugaauaauuuuuuauacguuuauuguauucuuuuacccccaaacaaaaucacuucagucuacagacauaguuuuacaagugcacaaauauauacguagaaagauguaacugcugcauagauuuuaauagcaaaaaauuggaagcaauccaaauguccaucaguaagggacugguuaaauaaauuaugaucuguccauacaauggaauacuugguagccauuaaaaagagugauguagaucuauaucuacugacaagagaagacuuccaggguguaucaguaggugaagaaaagcauacuguagaacacuguguaaguauuuuauauauaauuaaucuauaaugcauacuaucuaauuggcauauucauuuaaaaugugaagaaucaacagaaagcucuuaacaauggcuaucucuagagagugagauuaugaaggacuuuuacuuucugaguuaacuuugcauauuguuuaaaauuucuguagugaauuuggguuaccuugguaauuagagaaagagagaagauacaaagcuguauuuaaagggucuaaaaagaucaguugaaaugggugugguauguaaauacauuaggcuuugcaguaaucguuuauuuacucuuuguuuuugucuagauacauaggaguuuaaagagguauuuauauuuaugucuuuugaaacaucauacagauuuuuaagccuuuucuagauauuuaccccuuuuuuucuucacauuuucaguuauuuucugaauauauccuuuacuuuagauuaucacuuugcaagguaaccuguuuuauuuacauuuuaguugcuauugaguaugcuuugauggacuuugucuuuuguuuaaagcauuauugcuggccugauuacuagauuuguuuuauuuuaaaauuauaugaucuccauauacaauaccagaagauuuaggaauuuuauguauaauuuauaguuuaaaaguauuugaaugauuauugggauacgugaaauuucuuaaaacuggaauauuuuaauguagaauuugaacaaaggauacuuucugauuaaugaucaggaaugcauuaacuuauuaccuuuuugacuuaauuccuaggcaauuaauuuugaguagaauugaaccucuuauccaaaaccucuuuaaaagcauguuuccacccuuuucccaaggacaagaauagaauggaaucuguauucugcaggauuucaucuggaugcaauuuucuagauucugccuccauugcacugaauguaaaguuuucuuguguuuguguguguuuggucccaggcucugccuggaccccagcugcagcagcaaucuggagaagacacuucuccagugcagccaguuuguuuuuuugcagaggagucaucaaugcaaauaggauuaggaagaaaaugcacauggucuggccguuuauugccauuuucaauguauaagcuuaguuuguuagcacacagaguggagcagaaaucacuauuccagacccuugcugugaaguuuacuguuucaauacagugaugauaucuguuaggagaaagcuacaaagugagguagacuuuaggucacaguguugacauuguggauauauuuuauggaucuguugacuuaaugcaaguuuagaaaacaggcuuacauuuuuaauuuucuuccugucugcuuugguuacaugaagcuggauaggcaauuccucuucuuagaaauaaccauuggauucuuguccuugggaagagaauggaaauagccuuuaaagagguuuugguuaagauguuauuauaccuuggauaagauuuaaggcaguguuuaauuuuuuuuuccaugauccaugcaacuguaugcacaauaaauuuauaugguguauuuauccuuuacugcauucuguguaccuugauuuuuuucuucauugugcucucauauuuccuuuccuuucccuuuccuaucaauccaaaccuauccacuauauccuguccaccuuaaucugugcaccauccuauccugucuacccuaugcuauccugcccuauccugcccgacucuguucuguacucuucaguucuagucuauuucuuuucuuuuuuuuaaagaaaugcuggauguggcccauuauauuuauuuuaagauuuaccauuugaaaaucauugauaugaagguggcagauuauaauaaauaaaauuaccaaagggcuuggauguuauguauuucuugagugucaucugucucuuucaguggacgucagcaugcuguuaacucucaguuauuaugugugccccauggcuuguuugcuggcauaguaggaugacaaaguuaaguaccucauuaugagauauauacgguuguugauuucuaaguuaucguucuuccaggagaguuuuuaacuaggaagucuuuaucacccugauucucuuaucauuguguaaauguugaguagucuguuuguguauccggugaugcuaauaaggucugcauuuucuuaguguaaauuaugcccuacagaauguuuaauucuaggaucauguucuccuaccacgcagcgugcuccuggcccccuccugcugccaucuccugaugcaugcagagagcaugcaaacccauuguaacacuggacuaaguaacaaaggguuuccaccucuaaguuaagauaaaccugccucagaggaaaaacaaacaaacaaacaaucaaacaaacaaaucaccaaucauucuaguauaguuacaaaccacauggaaaugaucguggauuaucuggucuuggucaucuuuuaguuuagauacuuuaguauugacuuugaccaagauaauuuuauaacugaauuuuaaccuuuguuuuuauauuauaaaauuagaauauaaguuauauucuugagacucuugagaguacagauacuauauauggcuuguauauauuguagaagccaacucugugccaggacauaauugguucuugauaaauauauugauuuaauuugaaugugaauugcauauuaaauacugagacuuugguaauaccauaauaauuaaaaauuuugcuaagugcuuacuaugagcaaguuacauucaucauuucauugaguucccacuacuauuuuauaagagugaaccuuuuugcuagcaguaauuuuaauuuacaccuuuaaggauuuauuuuuaaauuuacauaaacugaaauuuacuuuuuuuggguagaguucugugaauuuugacacaugcauagaauuguauaucuacuuuacagugguaugauuaccacagucaauauacaguuuccucacucacccggauccccucauggugucucucucuagucaaaccuccuuccaacugcuaaccuuuggcagccguauugaucuguuugccguugcuauaguuuugcuuuuucuggaaugucauauacguggaaucauacuggaugcaauuuuugaauguagcuucuuuuacuuaauauauugcaucugaaauucaucaguguuacucuauguaccuaucuaucaguuguucauuucuuuuuauugccaaguaguauuccacugguguauggauguacuauagucuaucccuucauucacagaaggacauuuaggcuguugacaguuuuuggcgauacgaguaauguggcuauguaucugggugcagguuuuuuugugagccauaaguuuucauuucuauuggcuaaaugccuagaaguagauugccaggucauuugauaaguacagguggcucuccauauccaaagguucugcaucuguguauucaaccagcuucagauagaaaauauuugaaaaaauaaaaauucuuagccuaagguagagaggaaaaaaaauaaaauuaaaauauacaacaauaaaaaaugauacaaauaaaaaauauaguauaacaacuauauagcauuuacguucuauuagguauuauaaguaaucuagagauuuaaaguauacaggagaguaugggcagguucuaugcaaauaguauaccauuuuauauaagcgacucgagcaucugaggauuugggugugagaagggguccuggacccagucucucaugaauacugagggacaacuauacauguuuaagaaacugccaaacuauuuucuagagugacuguaccauuuuguuuucccaccacaauauauagggauuccaguuucucuaaauccuugucaacacuauauugucaguauauguguguguguuuaguuguagucauucuaguaaguauguagagauaucucauuaugguuuuuuuaauuauuauacuuuaaguuuuaggguacaugugcacaacgugcagguuuguuacauauguauacaugugccauguuggugugcugcacccauuaacucgucauuuacauuagguauaucucuuaaugcuaucccuccccccuccccccaccccacgacuggcccuggugugugauguuccccuuccuguguccaaguguucucauuguucaauucccuucuaugagugagagcaugcgguguuugguuuuuuguccuugugauaguuugcugagaaugaugguuuccagcuucauucaugucccuauaaaggacaugaacucauccuucuuuauggcugcauaguauuccaugguguauaugugccacauuuucuuaauccagucuaucauugaaggacauuuggguugguuccaagucuuugcuauugugaauagugcugcaauaaaugacuacugauguugagcaaguuuucacaugcuuauuugcgauaugaauaucuuggugaagugucuauucagauauuuugccuaauuuuuuuuuuuuuuuuuuuuuuuuuuuugagauggagucuugcucugucacccaggcuggagugcaguggcgcuaucucagcucacugcaagcucugccuccuagguucacgccauucuccugccucagccuccagaguagcugggacuacaggcgcccaccaccacgccuguauuuuuuguauuuuuaguagagaccggguuuuaccauauuagccaggauggucuugaucuccugaccccaugauccgcccaccucggccucgcaaagugcuggauuacaggugugagccacugugcccguccauauuuugccuauuuuuuaaaaacuaggccauuuucuuauugucaaguauugagaguacuggguauaagccuuucaugagauauaugauuugcauacguuuucucauagacuguagguuuucuuuucagucucuuaauagugucuuuugcugguucuuaauuuuuauaaaguccaguuuauuaauuuuauauuuuauggguuguguuuuugaugagguaacuaagaacuuauugucuaacccaaagucaugaagauuuugucuuguuuuuuuuccuaaaaguuuuauaguuugagauuuugcuuuuuggucugugauuuaucuugaguuacuuuuuguauaaaguauuagguauacauugaaauuugucuuuucugccuauaaauguucauuuguuucagaagcauuuguugaaaagacuauucuuacuccuuuuaacugacuuugcaccugugucagaagucaauugaccauauuuguguaguucuguauuuggauucuuucugauuaaagcuugucuaucuuucugccaauugagguaguuacuuuucuuuuugagacaggaucucacugugucauccaggcuggagugcaguggcggcauaauggcucacugcaaccuugaacuccugggcccaagugaaccucccgccuuugccucccgaguagcugggacuacaugugugugccaccacgccuggcgaauuuuuuaaaauuuuguagauagggggccuugcuauguuccccaggcuggugucaaacuccugcccucaagcgauccuucugccuuggccucccaaaguguugggauuauacacgugagccaucaugcccggccugcuuacuuuuuaaaccucagauuacugaugaggaaaaggagucuuagucaaauuaaguaccuugccuaagaugauucagcuagcaaaugauugcauuaauacuuaaacuagggcgaguuuucugacuaugaaacuugugcugagaagcuauguuagcaccuguucuuaccuuaguuauuuugcuucugguugaaauguuugguuuuaagaaacugaacaguaugguuuuggaagaguacauaugacaaguagaucacagaaaauuaucugaaauaagaaaucuaagguuuuuuuucgcuuucuaggccauuaauuaccagacauaauuaauuuucaauaucuuuaacaagguauaauauucuuuucuaaauccaagguagcuguauaucauuuuucuuuauuuuaaauagagcaacauaaauauauguuccuuguacagcaaggaaaggauguuaggguuugugcaugugagaacacagaugggcuaagagugauuugcauccagagggcucaugcaaggaacuugguaagagguuacagagugacacuacuguggcagugaauaauaaauuaacauuucaauauuggcaaaccggagaauuuugaagaaugucauauuuaguuaauuucugauuauuacaaacuaagccuguacauugauuuguuaauaacuaggcaugcaugugcacgugcaugugcacucucucucacacacacaccccccccuauauacauauauauguuuuuugaggggcaucuuuagugauuucagccuggguacucuguucuaauauaugcucuuccuucugagaacccauuuacugucacagauccaacuuucuuccaaaggcaaaugacuccaaacccauaucuguguugugauccacuguuaaacuuaauuucccucccugggcucugacaucuacuuagcuauaggauacaauuacuaggaugaccuuuugauauugguaacuuauacacaaaacugaguuccguuucuccucauccucacaaauaagcaaccauucucaguuuccccuuuauuuucuugaagauagacuugcucuuuggaaccucagaaucauuuuugacucucucuuucugggacccugguguggucaaaucuguagucaauuucugcugauugucugugccugguugguuuggaccuagcuccucuuuccccuugcagugccugccauggccccuugcccucuucuuccucccuugauuuacguucaccuuuuuaaugccugcuagcuucuguacaugaacucuuugcaugcccaacccaaucuuucuuguuuuaugaccacuggucuugcuauucauuccauccauggugucuuccuucucccccacuaucucugcagauugaaagcuaaaguauagcucacugccaucucacguuugaaacccuccaguucacuccagucaacaaacuccaucucuccuccgaucucagcccauauugugcccaggccagcagcgucaacagaaucugggaacauguuagaaugccccacuccagaccugcugagucagaaacucuggggguggagccuagaaaucuguguguaacaagccuuuggggucauucugacaccagcuaauguuugagaaccaguguacuguguaaacccagauucacauacucagugugaaaggcugaguagcccuaccucucuucagcccacuuccauugcucagccucugugagcuuuuucauuuugaauaccugcaucuccuuuucuuagucacuucuaauuccucauuuaaaaugucagucccaaaauucacuuccucgaggcagucucaguucacuguuugagcaauaggugcuugguuuauauucugcucuuuucuccuuguugaucauguuuuucuguaaggacuuugguugacugcuguauguauguucuguccuuuugacagacauguguucccccaaaauggcacaggcuauauuugguacaaauuuuuggucugucaauuucacuaauaggucggagaaaaaaaaauuuaacugucaacacagcaaauaugucccugaguagaaaggaaaauguacaugaauagccaagaaugaagauguuugugcuagggcagcuuuuggcuaugucuuaggcuacucaggguauucauuaauucccucuccucugauguuggaggguguccugguuaaaaagucuggggcaccucugcugacacgaggaaagggagcacguacugcagagagggggaccaguuuugacuucgggguccuucacuucuuccagugauugauucccauuguuugaccuuaguuuccugauaaaaaauugggauaauacugucuacuucauaugauuguuauauugcaaggauuaagugagauuugguagguaauguccuuguacaaucccuguccuacauuaggugcucuauaaaugguagcuuuuauuaacucuaccaggacagcacacuuaaagaaaaaaaucauuccacaaaagcaguucuauuugcugcauaguaggcccuuaguaaauguauugaaugauauauauauauggcauuucaugguucuggucugugcaaauguccuaauuuguacagggcuucaaguuuuagugcuuuauaauuguuaaugaaugguaagaaauauuacuugacuuuuugacaaaucuauugcauuucuuaaaaauuuuccauucaacuuuaguuuuaauggaugauagcuuacuuucuaauaguaucugaaagguuuuuuuccaguagaauaaauuaggcugguuaaaugggcuuuuugacacaaugcccucccaagaauguuguuucauugccaauggcuaguuuaaucaguauuauugaagacaguuucaaacuacucugcuacuugguucuuuauuuaguuuuuauucuuuuccuaacacaccuaauuaauggaacuguccaguggucuaacauggagaaggagagaagaugacauuaugaaaaguuuaaucauuauaauagcagcuaacguuugucuggcauguuguaguuuacagaauacuuuaacaugcauuguaucauaucucacaguguaggcauuacuauuauuuuuauuuugcugauaagaguaaaaaguaggcauuacuauuuuuuuauuuugcugauuagaaaauugcugcucugcuuaaugaccaaggucauggaagcagaagguaaaauaaaagccccagggcugggcacgguggcgcauaccuguaaucccagcaauuugggaggccgaggcgggugggaugaccugaggucaggaguucaagaccagccuggccaacauggcgaaagcccgucucuacuaaaaauacaaaaauuagcugggcaugguggcgggugccuguaaucccagcuucucgggaggcugaggcaggagaaucucuugaaccugggaggcggagguuacagugagcugagauagugccacugcacuccagcuugggcaacagagagagacucugucucgaaaaaaaaaaaaaaaaaaagcccagaaguugaggauaguaugguuauguaaaaguuucacuuccucaugauuaggaaaagaauaaaaacuaaauaaagaaccaaguagcagaguaguuugaaacgguuuaaugcauguagacaauuuacaguuucaugucauccuaaagcacugccucccacagcuuauuuauguggaacaagagacugaccaccugguuucacaccuugauucugccacuuccuuucuacaugaucucagucagguuguucaaucucuuugagccucagucuuuccauuuauaaaauggggaaggauaauggcauccaccucauagaguuguuguauuaaaaugaguuaauauauguaaaacuauuagaacaaugccugggacauagaaggugcuagguaaguagguaaaugucagcuauuauuauuuuuuauagaggaguggcugaagugcuuuauaugaaaggugaguauacuuagccauauuuauaauuagagaaguagaaaucagagcuucuauaagaguucaauagugcagaauguauauuuugcaucuuagguauugaugugguguggcuguguccccaccuaaaucucaucuugaacuguagcucucauaauuuccacguguugugggagggacccggugggagguaauuuaaucauggggguggguuuuuuucuguacuguucuuuuaauagugaauaaaucucaugacaucugaugguuuuauaaaggggaguuugccugcacaugcccucuugccugcugcauguaggacguaacuuugcuccuccuuugccuucugccaugauugugaggccucccuggccauguggagcuguuaguccauuauaccucuuuuucuuuauaaauuaccuagucucagguaugucuuuauuauuagcaugagaacagacuaauacagguaucaugcccuagucuggguuuuccuguagacuuauguucauuuacuaaccuugggauaaaugaaaauuuggagcaugccuguaugauuucucuuucuaaaaacucaaaacccacaaaacuacaguaaggugcugucccccuuccauuauccauagacccuuuugccuuucuuaaaaaacacaugcacagcacucacacagacacaccccuguaagacauaagguaccuuggccauuuucaugaaacuguuguuaauuccuuucuuuaaaauugaagucuuuuaggauuuuaacaaauauccuauucaugaaguuuugucuguucuuuucuucuggauuucacaacucaccuguucuaggagagucuucauuauuuuggagaaggcuucaaaucuacuaucuucaagcuuuuuucuuuccagugcacccgucucaucucauguaacguggugcugggaauauaagacugagauugugaugcucacaguuuuucuucuuuguaauuuucugugucuugauuuuuucccccaaugaacauguaucuauuucacaaaaucuauuuuacuguuaaauaaaauuuugguaaacacuggaaguaggaaauuaaaaugugcaaaauuguaaauuaucauuacaguuuacuuaucuuucuuguagauaccagauacagaaugcuuuuguuuuauuacaucuuuuucuauaugcaaaccguaagcugaguguagcaccugguuaugaaauuuuguacuuauagaauauauucacuuuuauugguggcuauaaucaagaugaaaugcuuuucuuaauaauuaauguuaagaagagaaauguaaacuuuagacaacuuuaugacuucucuccagaggauguauggaugugacuggguaugugauuuaaaaaauuuuuaaaguucuuuggauuuuuuuucuuuuguuuaaagguccuuaggcguuugccuuggcuugcugaagaguaaggagaaaacccuguaaacucauucacucagaauaggaugagaguauuguagauuucuuuucuccuuugagacaauuuuaaaauuacaauggucuuagccuaaguggucccuguuacggcuucucucuuuuccaugcucaacacagccuuugaggaggggcugagggacacgccaccuguuuucaaguguauuuauuucuuuaugccuuaauaugccuagugcaucucagaauggaaauguccuggaaauugaacagcuucauaguuggguggccccaugagcauuuaggaaauauuuugugaaacuguuguggucaucuuguguacugguucugguacuuuaauccaucauuuugggaucauagcucuucugaggaaagagcagccuugcaccuucaagccuuucuaucuucaaucaguuggguuugcguauucgagcucauuccaguucaugauuggcaguuuuuguguuagguacccacucugaaguguucccuaucguuuagaagguagaaguagucaucagugacugaagccuaauuuagauucuuaaaucgaaaucauuguugaagaauacugcuccuccacuacagacgucuugugcauaucaugagugucuucaucagagaacaagcucucacccggucucucauaauauaaaagcauuuuuaaucccucuuaacaggugcugccgcaguuuauuuauaacuaaugcauuaaaaugaaaaauacugaaaggguccuaaguggaagguggcuauugaaauauugccauauuuaaauuauagaauuuugucaggcugauuuguggaaaggacgagucaauguuggcugguaagugauguacucacagguuuccuguaaguucggguggugcuuuccgcaguguauauaaguggguugugcaaaaucugagaccuacgauucaauugauuuuccuuugcauaaucauaaucauauucauauuuggucagcuuucaugcucuuugauauuucugauccuuaugaagcaugacaaauguuagaacucuuuuggccuucuagacuuauugcagcacaaaaacucgagauccuaauugaaagaauuuugaagaguguuucauuuaacccuuuucuuccucguccaaauuugaucucacacauggggaagguaaaugcacaccuuaauauuggugcaacauguuauucugaagacacgugcuaaacauuugaaagucuuguugauuuauauuuccaccauguuuucucuuuccugaaaaaccuuagccagcgacugaaguaguuggguuguauuaauggauguuuauguuguccugugacagcugguuuugcuaauuuguuuuuacagggcaguuuguaguaaaugaauggcaugcugaauauuuuacugagauuucagauuaucuaaagaauauuuuccgguuuacuaauugguagauaaugcugaguacauugauguugacaugagcaaauggauuuaaaaugauuugaagugagcuucauuaaaagaugcucuaaucacagccagcaggaaaugucaaacuaguucugccuucauucacucugguggacaggaacuguugcagacuuacgaugcuacaagucauugcaguuuugauuuuggggugccacagggugggggaaaugguggaaguuuuuuuuucauagcuuuuuuggcucaucaugucuuuaccagaaacuaaauaacaaauuacuaauuaccuguauggcuaaaugaacauucucugaaaaucauagucacauugcuggagucuuauaauccauuauggguugaauacauggaagucauguuuguugcucacucugaacuagaagucuguaaauuacuuguuauccauuuuagcagaauucuauuauagaauuaaagccaguggugcucaucaaaacauuaagaaaaaccuaggcaaaggcauuccaaauucccagguuaaaacuuacaacacugguucuacuuuuccugccuguaaaaaguuauagaggcuguuucaucaaaauugaaugcuuggggaaaaaaaaucuaagggaggcagauucugaaguaagucucuucaggauuaaaaucugucuuuuucugauaucgacugugcgacuuugugcaaguaaccuaaccugccugaaccuucguuuucuugucuguaaaauggggauaauaauaucuaucucaugaggucaugggacuaucuuuauaucuauaugcuuuucaugguagaagguacuugguaagggcucuauuaguguuagcuauuguaaccuaaauacauuuauuuccuucuuuuaauaccuggggaaagguugugggugucauaugccaagacauuaacuagacaucuuauuucuacugauuguaaguuuacuaaacaccucucaugucacucagaacagagcuaucuagaaccaguaaguucaucauauggagcuuuuuggaucuaggauauaaugagacuagcccaaauucaugcaguaaguuauuggguaaucuugcugcaguaaucuuguuuuucucuuugacuguuaucaaaaugucuuuuucuucaagcccggauguaguaugcugagguaguagcacucauaggcagagaucaacggcucuaauuauuucacaauaaaaauaauaugaugcaggagucuguauaaugcuaaugaaaucuagguacauggcaagcaaccuguucuuuucagcuuccucauuagcaucagauuugccuagaugcccagauaagugguuguacagguuguguauauuuuaaauagcauuccucugggucagcccaacaaugcuguaaacuugaugcccaguagauaggagugccuccuggaaauuucuugaaaacaugguaccagauuaggagaucgauaaaggaugcugauacuggcauagaauguucuagaauaacugagcaacaucuuuuaagugaucugguauuguugguucaaagcuucuggcuguauuacauauaaauuuggccuaugugguugagaagaaauugcccuacucaucuauucagucaggguucugcaagacaacuguaaauuguuuucuuuuucucuuuuuauucccccuuaaugccacaguguguuuugaagagggaagagugaaaaacaaaaaaguuccacuugaaugacccuauuagcuuuacacugguuucuguaaaccaugccagaaauauaauaaucuaugaggucuuugaguuuaggacacagccucuguugacaaauauaaaaaauggcacaccagacugcagauguggauuguggguuagucuggccuucccucaucaauggggaaauggagcuuaagucaggcuuagaaaaugagaaaaaugcuuaagggacaugacuaaugucuccaacgugcaguacacuacauaaaccuauuaugcgcuuuaauuuaauguucuccauaaagauucaggaccugucaguagaaggaaagaaacaagcaauccaucuuuagugaacugugaauagacuuuuauauuuuuuaaaauacacacgcaccuauaacauacuuuucccuuccuucgguuuucuccacaucugauccauuuccugucuugaacugccacuaccuaggcugcuuguggauuguuuuguucagugaaauaagacuaauguguuaaauauuuaacauugcuaauugguucaauguaaaggaaaagggaauagaugcagauugucuccagucucugucagcagacuucagcaaacaagacuggaaggucugaauugaagauguuucaucucagggacuuaaaggccuaugggauaauauagcauuucuugcaaguggcaauugggccaaaauugggagaaaaauuaauuugcaccuggcagcuggaaagcugaggaucuauuucuauagaaaauuuggcugcaccccgcccccggcccaaaaaaaaaaagcuuuuuguuuucaggcuccagguguagauugaaagauaacaaaauggaugugacauuuuacuggucuuaucuccuuugcagguugggagcguuaaaacacuuagcuguacuucacuaaagcaagcugaaauuugcagaugauuguaauugaugaguaaggaaguagaaaccccacugggucagugagaauuuuuccauuaugaaaacauaaccuuucauaggagaacccaauggcagugaaaugucagauaccuggauuuuuacaaaggaaaggaaggcaaaucuguauuguuuccuauaauacaauucugaaacaggaauguacauauauaucucauucucuuuugagguuguuuuguugucugcugugucuaggugaaaagaacucacagugacaucaguuuuugcuuugaauugauuuuuucuuuaaaccagaggugaauggcaccuaagaaauuauuuaaaucaggauauaaaaauauuauauguuuuaacaaauguugacauugguagcuagucugagcuguucuuuuuucuggaggaaagacauuaguaaacugagguggggauagaauuguuucaagggcuguggucagaggugucuaagugcugaaaaaauaaguuugaugaguuaaagcagagggcuuccagagugggguccauaggaucaaucaauagccuucaggagguuggugaguccccagaaauaacaugcaauauuuugcaugcauuuuuuuggggagagucuguguuaaaacuagauucuuaaagggguagagaccaugcugaaguaaagcuacuccugccagcuaucuccaagugccuauuuuacaggagcccaugagcucuagcucaauuuauuucuccccuuucuucccagucaccauccccuucccuagugggcaccuacuacuucaucccucuucauccugcuucauccccuuuccuucuuucuccccuuucuauucuugaucccacugccuuucuuauguguggaccuuuuaaaagaggauggucuaggugcuagccauauagacugccacgcaaacuggaagggccucucuuaaaccuuccugccuugaaagucagggaaauaggcucccagccucugccuggacagaacaauuaagucuuguugugauuauaacccuuaccucguugauauucagauacuuuucaacauaaucauguuuuucuaaugucccuuacuuuccucccuccuccuccuccacaucaaaaauaaauuauuuguggaauauuuaauagguucauggggcucugcucugguguuaucuguuuuaauucugugugagaugagaugcggcacuugucagcagaggccgcugaugaugucgguacaccuuacugagcacaggucacgguggccugcaagccagauugggugauucagccaaaggagcgucacucugucgagugggagaacucacagauaacccgaggugcucacauuuagcccuguauguagugcaggugauaugcaaggcgguuccuuuccgguuuaacucucgccucuuccugggcugcuuuucagccauucauuuguccggcggaagcagucagcuuucugaaauagaucacgauuuaauugccgcugccuccgcuguacugaaaugaaacuuucgaaggucaccaagcaucaguggcccuuaguuaagcauuaucuucuuugcccgccccacaguauuuggcaccauuaacuucuguuuccauuuaaaaauuccuccauuuguucugcagcacugccuguaccucuuuggauagcauuauuuggcagcacuugggcuagcucuuuuuucucccucuaccggcuaaauguuucccaguguuuuguccucgguuauuugcuucccuuuuuccauggguucucuuugguguucuagaucuuauucccucucacaacuucaaguguugcuuuucccuacagcccaacuuuuuucuuuucuuuuuuuaaauuccugaacugcauugucaacuaccugcuguuccugcuaccccugggagucccccugcccucucaaacuucccuguuuaaaaaagagcuuaccuccaacuauucacuaucucacuucccaagcaaauauacaaauauacucaaaauacaaaaccccaaauuagaaaggcugccccuauggccaucaccaaaaagcaagucccucaacagguucauccauauucauuucuuuuuccuuucauagcucaccgccguucaccuaggcagccccugaaccuaaaucucugcagacaucuucaucuucuuuucaugcuucaugugcaaguaguugccagaucuuccugaccuugguaauaaaacauugccuacauccggacuuccuuuugcuuugcucagggucaguuucuuauucccucauggcuguggucuauaccauuccccguuagcugcucaccuguuuuccuaacuugcgauucuccacaguuugcaguuucucaccuuuaagaauuuuguucagcuuuuaucuucucccauauccauucuuugagauauuauuuacccuuuaccuuccuauaugaagaugacaccuucccugacaaccuuugcuuuaucucaacuacauuauuauuuuuugugagauguauacuauccaauuauguuuagaguuuuaaaucacccuacuaaaccacaaauauugacagauugggagcuuuauuauauauauacuuauuauauaauacaaguauguguguguguguguguguuuccauuuccauugcacaguaccagguacacguuaggaacccaguaaaucuguauugaaugaaugaaugccuacacugaaauuuuacuucagguugguuagcaggcuuagaagaucucuuccuacuaaagaucuuuugcuaauuguuuuuggagccuuucuauuuagccaugcaaauuagcauggguucauaggcccagaaccugaaauaaauuaauccguacuugaaaggaacaaggcuguggcuguauauggauuucaggaaaaagaaaaauggaaaacauugagccaguguccaguugauauaagugcuuccuuguguuuuuuuuuuucuuucuuucuagugcauaggcaguauaaaguuacuuuuaccuccagugacccaggccagaaucauggcaguacugucaccagagcugagaaaagggagaauaagagguacauuagagaaagaaaguaugaugcuucaccauguuaauuacucaauaaauaacuuuuguuauuauuagggcuguuauuaucauuucuaguuccauuauuuauugccacuuaaaacaauucuggugacagugcauuuagagaucuucagagaaaauuauguaaauccaguagcgaaagguuaaugcaugguuuuuggcccaaguauuucuauagcccuugguuacuugugggagaggauuuugucaagcuaguaaagcuguguguaguugaguuguauuguuuugggcuauuuguaaauauuguauugugugacauacuucuagcaccugaaaagccuggccuuugggacugauuuuaagagcuguucacguugugugaaccaauacccauggccaaagggaaaagguuugcguuagagagcaaacugaaauuaaaagggugggugugcgguguccuucaacccuuguguagacuagcugugcggcagcaauugcugcccagaaguaagacugagaagcuuacgauagccuaaaccucaggagaggggguuuggaagguaggggggcuuucucuagaaacagaaucuuuuuugugagucuaccugccaacuagaaaaaaagggugcuagguguucagaucugcuuugcagguuccaaagcaccuaaguacauuuucaguuccaaaauuuaaauccuguuugugggaaaucaguagaggguuuaauagaagcuuaaacaaauuauauauaaacacacagaaguagucuggccugaguauggaaaggccagaaagucugaguguuauggugaaguaguaggagguaauuuauuuuuaaaauuuauugaacccacugaagcauaagugugugaggauaagagaaaaccauaugcacauaugguccagaaugaaauucuucagauuucugagaugguugcaaguagugacuaaaccauuuugaauuaacuuugugugugaaagucuuuucaauccuuccaauuuagucucuucagguucacuagugguggaaagaaucaacugguccaugccaccauuagacuggacugccagcagggaaguaagagccuccuuaucuuugcucagaguaugcucucucucuuuuuuucacuuucuucucucuuucuuuucuuucucucucucucucugggaagcaaaggggaugggugaagaucucuacauuucuuuucuugagagaaaggcaggucugagugaaaauuuauucauagcuuuuucauuucucuuuggaaaauguaauugugacauuguagcuauaaauucaauguuuaaaaaguauaaaacucuaucaagggaauagaauauuuucaccuuaguuauuugugaaaguuaggccuuuuguuggguggggagaacacacguaauacacugauaguagagaguaaucugcaguaagaucuaaucagaggaaaaucugaaggaaucagaccagagacagaucacugaccggaauacagaagugcauugugcagcaauaacacuccuuuccauucauuauugcaguuauaauuauggaacccaacauauuuaauuggcacaguguacucuucucuggugaauagauugcauuguuccuguuuuaaaaacccuuaugcaucaugaauccaugcacauguugcucuuuggcucucgagagguuucuuuguuuacaugaugagugauuaaccgaauugugaagccuugcuaugcguuguaugcaaagaugaagugaaaagggguaucuacucuguucuaacuuugaagggcuuugauuaauuuaaaaaaucuauuagaucuuugugaggauguaugccuuaacuuagaaauauguaaauggaaauaucaguugaguuugauaucugggcuagucuuuuaucugauucuggaggaccuguuaauggaaauuaugucuggugggauguuauugguacaugcauuagauuacaagccacagaagugguauuccugaagagguaugugguuacugaaccccuagaaaugagaucaaugcuaaauguggauggggggaaaacacucuccccuuauauaggacuuuccaguggauuccagggacuuuugucuagcuugcaagauaaaaugcuugcauggacuaggggcaggguauaauguaauaauaauaauaauaauaauaauaauaauaauaauaauuacagcuaacauuuaggaauaccuacugccugccaagcacccugcuaaguaaacauuuuacauuuauugucuuaucuaauucucaccccuauucuagugucuacuauuauccucauuuuacugaugaggaaacugagcauuggauagauuacauuuucuuguuugaagaucacacaccuaacaaagcugggaugugaugaucucaguugcuuuucacuuuugcugcuugcuguagaacauauugguaaagcauagcucauuguuuuaaagccuuuauaauuauaguuacguuguuccucacuacauaugagcauuuauacuuuugaaaauuaaucagagcucaguguaauuagagagagagagagagagagagagacuuuaguaucccccaaacaucagcuuauugcuuccacagcugagacccacaggggaaagagaagaguacacccauaaauauuuucuguaaacgccacagguagucaugcugcucuuggaugcaaaaggucucuaguucaauuuccugcuggaauggauucuucacaaauaaggauaaucccucauuuuauguuuacucacauguauuccuucuguauuccauacuguccacauugggcuuugcaguuuuuauauauucuugccagaaugcacuuauucauuagccguuuuuauuaguguuacgguugagaugacauuuucccauucuaaacuccaauuuucugugacuuuuaauuuuacaaaacaauuaccuaucaggcugaaacuccuuaggcugguuuucugcucagaaaggagguauaggggggagguuuuaaagucuguuccacuuuucuuggcagccuagacauuuagauucauguaagugcucuuuaaauaaaguugcaauugcuuaauuauuuaaauaaaugggagcugaauuauuuaaggauuugcuggcaagacaaaagguucuggguuuucucuccuaccccucacucagaauuuucagucccauuuugugcuggcuaacuaagaaugaauuucucauuuguauuuugauauaucugcaaauccagcaacaucuuuuggaguucuuacccuggcuaaguccauggauuuuaaaagucaaguuugaaauuuuagauuguauccaaauacuuugaguaaugucuuuuuauguauauuaugguuaaaaugcacacuuuuaccagauucgacuuaucgagcaccucuaaugugcagaggaaaacagcagaguggaaagaauacaguuuuggaauuugaaagacuggauuuggauucugacucugccacuuauguggcucugucaccguugcaaaguuauuuacccuuucugaggaucaguuuucucuuuuguaagccaccucuuaggguuguggaggagauuaaggaaauguauguagaagcccuuaauauauaguaccuggcaauuaguaggcacucaguaugugguaacuaugaagucugcacuuagguacuauguuaacaaucaggaauuaacagguggauaagacagagguuccuguccuuacugagcugauagucuggcaguggcaaagcauuuuaagcagagggaacagcaugaucaacaguagguuugaaaucuagaaagugcuugguuauuugggaaccuguuaauguuccagugucccuaaucuuaacauuaauauaauuggaaauauuacauugauaugguguuuuugagguuuauaauacacaugacauacauuauuucacuugauccuugcaaaaauccuauguggcagacagggauuacugucucuauuuuauaagggauuuuagugauuuacccaaaaucacacagcuaguggaagagccaggauuaaaguccagguuuuuugcauuuccuauccagugcucuuucuacuguaacauucaacuaguccuaugucuuaucuauauauacaagugcuaagccuuuaaugauaauuuaaugagacuuuuauaauguucuuuuuacuuaaacauuuuuacucaaacucaucugacuuaagauaaaauuauauaaaaucaaauugagguuguacuuuagccucuguauauaugucacuugugacuguaauuaaaaaaaaauuaaaguguaguuauucuccucccugacccuaucaaguauguagaaucuaaauguuaccuccuaauuuuacuuuauaugcaguuuuuuuuuuguaucagugucuuuuaaaaugucuuacagaaugguuaagucacauacuuuuauguauauucauaucugguaaguaugcaaguaauugccucaucuacccaguucuuacuguuuaucuccuuuaauggcaauaaugcaucuuuggguguauuaucuuuaagggcccacauuuguuuuacuauacuugauucaaacauguuggauccuugcuggaaacuauuaagauuauggcuccuuuaccaucauuaauuuuaaaaaguuaagugcucaggagagaaacuaaucaccucaggacaucaacuuccauucuuuuugcucuuuagaacugugccacuaugccaguuguaggauguucagcaugaaaggcuccacuucucagagggaacuuauuugaacccuggaguugcuucuggaucccgccaguuauuggcauuuccaaauaagaaugcagagcacgcaacacgcugcugucaacuugaucuuugaauacaaaguuguggauagaaaugcuaaugaaccagcgauuugugaaguacuucaccauguuggccacauagcaaauuaacagguucuuuccucuuagggggaggagcuuuugaagggacugucucuuuuuguuuuuuguagggaaguuauuuuaaaguuguuuuguuuaguuagggacaaggcucaucaggugugaguguuggcuacucuggccacagaacaugugugacuuuccuggcauauucagagaauuucuuaagaaacuugacucuacuggaaucuuuuccacaguugcaauugucacugaacauuccaggggcuucaucuacauuuugaguucuuaguacauuacuauuuagagauauauaugggcauuuucuaccagagaccaauauuucucucucucucuauauauauauaugauuuuuuuuuugccuuugaaguaccucuuuucuuagagauacuuuugccaccacccuccacuuuuuuuucuuuuuuucccaaaacucacugaagacauccaaagaaauacaugaauuuuucagugggaguugcacgugauuuuuaaagcaucuuuuaugcggucuuuuaaguuucuguuuugauuuugcaauugguuggaaacgaaggaaaccucaagcuaguagcugaugagauccaacaaggacuugccauguuaauaacaagaaucugaaaaaagaaaagaauguaucugauaaagagucuagaaaggauucacugccacuccuuugaggcuuuuuccagucucaccuauuagagaaguuauucacucuaucauuauggauugaaggaagguuuagaaauuuccucuccagcacuuccaagaaggugaaaguucuuauuuuaugggcuggcaaggaaacugggagagaaagggaaaugauuucuuucuaaaauaccagaagauagggugccacacuugucccuuaagauagauggacagauauacaauauaagcuccuguacgaggcacaucuuuuaggaugaaauugacugaagaauugaucuuugaccaaauccuguuugccugaccuaaaaugaacucuuggaaagaccaaagccuuauuggcugcaccaagagaagauaggaccuugcccauggaugggagaauccuggccuuuagucagagacagcagguauguauguuaaguccauuugguuugccauuuugccaguagcuuucaaagaauuuggaacuugauaugauguaggaucuucacauuuuaugagauuacaaugaaacucuuuugacccuauagcaaaaccagcuuuuaagaggaugaacguauuuucaaaaauuuagcccuacaguaaacaugaaauguugaaagagaaaugucugucuggcaaauugugauucugucccaagaggaggaauuuacuuccauuuugauuuaccuggcaggaaaguaucuuuugcaggcacuacugaaguuuuucuuaaauuccucugcuuugaauugugucucugggagcuauucaucuuugucaccuguuuuacuucugcuauuuuuagccaagugccaaagaccuuacagcuuccucaagugaaagauaaagaauuaagaucuguuguaaacaaaagcucaucacuuuuuuuuuaugcugcaagagcucccuucaaguuuuccuuagagucaacuuuaauugcuuagacuuagacucuccaaaagagagaccuuuguuaauuuugcuuccaaauccaugaagaggcaaggcuuuguuuuuuuuuuguuuuguuuuauuuuuuuuuuaaagaacauuuuagaaaaaaugaccaaugaaugaacuucucuuucaucucuauucucaugucaaaugauaaggcauaaagcaaauggaggaccuucuagaccuagaaggauauaucuuauaagugaauccauucccaaaagugccagugcuuguuuagcugagucaguuaaucuugacacuaaggaauuauuacaguguuuaaauuucauuuuuuagguuguagcauggcaggaaauacuugaugaggcucuaccucuuugacuuggauuugugauaagaaaguaaguuuugggagggcgaggugggcagaucacuugagcucaagaguuugagcccagccuggccaacaugguaaaaccccgugucuacuaaaaauacaaaaauuagcuggguguguuggggcaugccuguaguuccagcuacucuggaggccgaggcaggagaaucacuugauccugggagguggagguuuuagugagccgagauccugucacugcacuccagccugggugacagagcaagacucugucucaaaaacaaaaacaaugacaacaaguaaguuauuuggccuaacucauagccacuucuggagaaaacaguucaaggcacauagcccgugauaagugcugcuguuucuuuucuuuucuuguuuuuuuuuuuugguuuuuuuugggggcgagggggguauaggguuucacucuugucacucaagcuggacugcagccuugaucuuggcucacugcagccaugagcucccaggcucaagcaauccaucucccaaguagcuaagacuacaggcaugcaccaccacacccgacuaauuuuuguaaauuuuguagagauggaguuuuaucauguugccuagguuggucucauaccccugggcucaagcggucugccugccucagucucccaaagugcuaggauuguaggcaugagccacugcaccuggucgagugcuuccuuuucuaugaggccagaauguuucuaucacaccuagacuaacuaguaauguaauuuuaucuaccugguuaguuagauaaaauuuaucuaauuauauauauuuauacugcaaagcauuacaugcuuauagguuuggcuuuucuuucaagaaagcaaugauaccuccugaguauuuucuuccauccccaugucaaucacucccacccuuucuccuuaaaaauuauuuuggagaccaaaguauaauagauuuuacccagaagugauauuucucaccaauguaaacuuuguacuuuaucucuuaaaagguggaaaaaaaguauaguaaaauauuacauaugcacagagccuagagauuauauuuuauucuauuauucuuccaaguugaguuuugugcuggucuuauuuuuaucucuccaucuauguuugcagggcugccuguuucccccaaguguuaauguaaacacauuuuauuuugagacagaucagcucacuucccucuggaaauccaucccuauaaugugguaaaccucaauauaacucucugguccgaaugacauuucauaacuguguacaaaucaaacauacuguugauauuaaaugacaacuuuuaaugccuaugucaacaauucacuuaagucucauuucauuaaaacgcuucugaucuggggagaagcugcuugucugaguagauaaagcacuugacuuucaccucuaguuuccggguuaaagugcaguuggugagcuguaauucaaauggauuuuauagguucugggcuaggagacuggaacaaaagucugguucacauaaucagaggaaaucuugggucaucugaacaagugggugucaaaaccagugauuuucacuuuauuucuuguguaagugagcuugucuuuguggaugauucccagcccccccacccccccaccccaccaccccaccccgcuggccccgccaaaccuuagaaauuuuaaaaaagaaauuaacguggucaagauaguuaacaaguaaauggaguaccuucuagaccugggaggacauaucuuguaaguuaauccauauucauuccuugaauaguucucccucgguuucucuuccagaaguuacagccagcuuuggguccuccauucuugccuugaggaaauuuccaaaaaguuuuuuuuuuuccccuccagccccagaugcucuccugacucuuuccaggacucucuaggggacuggcuuuugaugguuuccugaguguaauccuaauuccaccgguguuuuauacauauugacuccucugauuguuucccuguaguuaggaaagaagcccaggcugguuaggaaccuccucuuauaugccuaaauuagcaaggaaaacuguuucccccauuuccauggucauggugucucuacuucaagaacaaucucuguggggauugcucaugucuuaaacugaagccaaugacuacacuauaccuguuaaguggucuguaggggauguuugaaugaauaacaguaguugcugcugcuacuuuaauaaugucauaauguuuuuguuucauacaacuuacugaaguuuaggacuugugcacaaauugcuaccuauguccuuuuucgccugggaccuccuacuuugugagcccucagcaaauguaggauaaucaagaaggggaaauuagccuuguggcuuuaacggguaucuucaaauggcuacacgugguaaaacccugggauugugcugaauucuuacauaccuguaucaaugcagaaagacccucaaaaaaauuacagcccuuuccauaguggaacaaucguaauauaaaauaaguggcuguuaggcuucuuucaggucuugauaacuuaggcaaggcagauaauuaauacaaccaagaugacaguugacuauaauuggcugcuuauuaugaaguuuagacauuuuccucccuucuaucucugggagaaggaaauugcucuagcauauguguguagaagacauaaaacuugcuacagcaguauuuuuauuuccagauuauucuuaaagcuauuuaaaagucaccacagaaugagcuuuacagaagcaauguaauggcuccuuuagguuuuuguguaaauucagauaacugaaauguuagccuugauugaugauuaaaaaggaaggagguacaccaaagcugauggugagcucuggauacaggauaaaggaauugggguugugggggaaagaucucaccauagucccuuaaguucuuuuauagaauuucuguugugauugguaacguaaggagcauuugaaagaugaucguuauuugagaaauguuucugaacuagaaacuugcaagcuuugaauccuguuaauacucacuggcaaugauagccauuuuccauuccaugagaucacuuuggaacuugagcauaauuuuauuucugcuucacaguucuuaaaauccuguuuggaaaugucauuaggaggauaagggauguaaugaaaaauacguuuucucauguaccaaaucaaaguguauaguuauggagcuggcuaucuauacugaacaacaguuaacaaaaugaauuggcugcuuuccgcauuugaaguuguauaguguaaaauucaaugaaacguucaauaacuggaaagaucacaucagcaucaaggaugcauuuagcagguuuccuccuaccauauuacuaagauagaagcacaguuuuagaacuaggaauaaaggcuaugaaugaaguuaaaaacugugggaggccuggaaguagaaagauaaguaggagugacugggccuggaaacuuggauuuggaugcaagugaaggaaacagaaagaugggccugugcggaccaguauuuuaugauuggugcucuugucaguaucuuccacugaaggcugaaaguuauuucuugaaacuagcaccugucacaccccuccuuaaggcaaaggaccuuauuuuuggugguugaacuugcugggucaaacagaaucacuaugccugauucucauguuguauggaaagacauagggaggggugaaagcagcuuuuuuuccauucagcguuuuuagcagguuuuuagagugaggaguuauuccaugagugaaugaauggaaugaaugaaugaaaaaaaaaauggccagguuuguuuuucuuggaaagguuuuauuuccuauaaagagauauggcauaauuguguuuucccuggcauaaaaugaaaaauaaaaucuagcaaaaugcauacuuaagggaugugugugcacauguguaugucacuauaauauauaaugagacuguugaacucucuagaauguuuggaacuauaaaguuuagcuguuuugaaauauuccucuguuagacauuggcuuagggaaauacauguuuucguauaaaacaccgaaagcauuuucgguggcauugucgggaaaugcaccuugccuucuaaagcaguagaugcaacuuuuaagaaugcaaauuugaaaaacugacaggggaaaauuacaagaagcuuacauauucuugaauuuucuccaucugaguuuuaaguaggcugguguuaggcuggagcugcuucugauuaugacucuucuagggggaaaacacaguuuuacaggacugaccuuaagugcaaaauggauaguaauucaaagcccugagggggcuuaagaaaugaagguggcuuauugguuuuggcagggaaaggguugucugguaagaccauugagccucuuagcugaaaaugcugacaaguugagcagagagcaucugugcuauaccaagcacaaucauuauuuucauuggcaaaauguauugcucacaguuuuggguagucuguccauuuugucaguaauuuaaucuagguugaaaaaggcaugggauauaaaccgcuauuguugagcaucccugcaggcauaccuggcagguuccauuccaacuuuuaaugaggagucuugcuuuauguugggguccgcugguggcuugcaauaucuauuuuggggcguuuuaagauggggguuagcucuugaaauuggacaaggugccugcauaaaagaugaugagauauuuuuucccucuuggucucugcuccuuguuaaauugguaauuaggcgagacuuucagacagaaguaaaaauacagaugacaugggauugugucuaaggugauagcuuuucuuucaugggaagaauaauccugaggauugaaauaaagaauuugaaguagaaacuuaauacauuugagaucuucuauauuuuuauaguaauuuuauuucacaauaugugccaauaauacaugacaccuucaauaauguauuuuuauacuccuuuacccaagaauuaagcugguacauuugcaagaggaggaaauacauguugacuuugugauauugcuaguaaccccauucuuuuucuuuucuugggaguggcgcuccaccccaccccacccccuccuaccccccaacacacauuaauggguuauucuuggcugggaaauguucuguuuucuauaauuuuucaaaauauugcaguuuaugaguugaaaaaugagaaaaaaugguuacuacuuaauuuuuuaauguuuuauauauuaaucaauuugauucuuuagaucauuuugggaauauccuuggcaagaaaaagcaggcauuuucacacauuguggcauugucuuuaggucagacaagcaaguugcagaaagaauuuucuaagcuguguguugaauaaggagacaguuaauucugaggcagcccucauuuuuuuucuaaucagauuuauagcagaaacuauuggaacuaacuuauucacacuuuucccuaacuuauucauauucuacuuauaccauauaggaauuuugauagucaaaauacgcccauauucuaaucaaaacagaaugagaaagggaaacaauugccuuuuaagaauagggaugagagguacucaaucauuuauaguuauucuuaugauaugugcuguuuauggaauacuguaugccaggcacuggucuagaaaacuguauuaaucugugugcagucgagagaggaaccacacaguaauuugaauagggaaagcuuacugugacucguuaacuguaacaagguauuggaauaaugagggacuugcuaguaagaaguaaagagaauuguaaagaauguagaaacagcagaucuaaugagcaaccauuacccugugcuaagaaagagcaccuaagaaagaacaccuuucccaagcugagauccagguaguauuggagaggacacagcuauggcucacuguggcagagaaguugcuguggugcugugaaacuugcuggaauuccacccucuaauaugcuggggaaaaccauucaugagaaggugucucuuuggaggcacucugauacaaaauugucugaggagggugccagcaaagcuaccagccaccguuugcuccuggcugcucugcucugcaggauccaggcacuggggaaucuguguguaccuggagauggaugcuagagaagcucaguucuguguguaccuguagauggaugcuagagaagcuucagugccuccagcaccaucuacugauaaagauuaaccuuguguccgaggguaaaggaaaaacauuugaagggcccagauccauuuucacagagcagacaaaaagggugauuuugaagcugagaggcaauaaacugaugaugggcacagaagucuuugcugcugcuuuuuuaauccuaaagagacuagaaguagugaaaugggauuauauaucccauuuuacaggugaaaagauuucuuuaagcuuacagagauuaagugacuuguucagggucauauacuuaauaaauggcagguucacauuucaaaauuagauuugcuauuuucuaaggcccaugucuuuccaucagccuuuuuggaauacagauacuaacaagucuagaaacuggcaguugugccauauguucuugucuagguauuauacuagagaucacuauuuauucauuauuuaguucacuuccagcugguccuacagaugaggggaguuaugcaggugaguaccuguuauguuuguaccauauaucagauucugaaacuuaaaggaauaguuuguaccuacuuuaguggagucccugaaaccucuuuuuuucuagcuguaccuuagcuguguuauuaucaguuacaguucaggauucauaccuguuugcucauuuggcagcucccaggggucucaaauuggguucccuggaggguaggggcagacgaugauggauccugguuuuuuauuugaaauguuacuuuuucucaaccuagcuucucuccucagggauaccccuccaggacaugcaacccuugguugucuccuagucgaggcugaggguacagccuugcucuuucgaaagagcaguggcccuuuuaggcuacauagguuuaucucacuuuugaguaauagauucauaccucaaauuuuuguaaaagaagugucauuuucauacugauuuacacuauaacuuuuagaacuccuuuaucacuugacuuugggugaguuacuuaaccucucugggacuuaguucuuuuauccauucuuuaaucuauaaaggggaauggccuuuauaaagcuccucucaucuuaaaaacacucagugccuauuucuaguuuaacaucuuuuggcagcaguuccaaacacgugagccuucaguugcugauccugucccuggcaaguaguugcuggauuacaaauaaauggaaggcagugugaugugcuagugagaaugugacuguggacucagacccaaaaggguuggaaucuuagcaccucagaacuuaguaguuaugaggccuuaggugaguaauuuauuuuucugugucuuagccuuuuccuuugugaaauaagaacaacaaugccugaccccuguauucugaugaggaguaaggaaaaugauaauaauauguaaagcacuuuguacacuugcuagcacauaguagguguucuauaaaugauagauauuauuauuccccaugaaauuguaagcuccuugaaggcagggacucugucuuagucauccuuaaauuacugguaguacuagauaucuaacaggcacuuaguaauaucacccuuuugaacugaaggaaaguccuuuccaaguugaaucuuuauaaaguaaauacuuuuuauguaaauaaucacccuggaguuuaucuauuugauaaguuuggauugcacauauucuucugucuuaaagcaguacauuguuauaauuguauuaccucucucucucguuuuuucuuuuuugacaggucucacuucaucacccaggcuggagugcgguggcacaaucucggcucacugcagccucggccuucccgugcucaggugauucuucuaccucagccucucaaguagcugggacuacaggugcacacuaccacgcccagcuaauuuuuaaauuuuuuguugagacaggguguugccauguugaccaggcuggucucaaacuccuggccucagguaauccauucgccucaaucucccaaagugcuggaauuacaggccugagccacugaaccuggccccuuaaauuucuuguuaguaacuuucgggcuacacgguucuuugauuuuuuuuuuuuaaacaaugauugcaugguauaauagugauaguauaacauuauuauggauuuacuaugugcuagucauuauuccaggcaauucauacuuacuaauuucuuuaauauucagagccuucucauuaccucuauugucuauauaagaaacugaggcacgagccaguuaaguaacuggcccacgguccugagcuguaaguggggaaguaguggucuguccccaagccgacugcuuaucacugcuauguuauauugcuuaguucaacucuaguuuugagacacuuuacuagacagagguuauugaugaaaacccagucaaacccaaaucagccugagucuagaaugaaagggaaggcauauacuucaggacagguugacauaaaucuauuuuuagucauuuaaauacauuuuugagaauugcuuucccccuuccaaauacguucugagaucaggaugagcaaaagccaaacacauauuuuuuauguuuugagauuaaaacuguguuugucacuauguuauagucauuaguccccuacugugcuucacacauagccucuccucaccccuccacgugccugcccccugcaaauaugucacagcaacaacaaacuuuagcuuuguacaucccaucuuccuuacguagaagcuaugguugauuucucccucuaguguuccuaaucugcuuacugaccuuugcuauuuaagcugacuuuuaaacaugaggaagagaggcgaauugauuuucuacuaguaaugugaaaaauuagcgauuuaauuucacaauauuuguaaauaagaaaaugggaccaauggccuagucucagauuacauuauugacuucccagaaguuguccucuagccccuaccucuagucguguggacauacagaacagagaacuauggaaccugaaugaaguguauguucagaugccaacagaugauuccauuucucccuuuaguuuaguaacaacauuauuuucacuguucggaaaaagauuggcuugguagacguaaggaaccacuuuagucaguguggauaaaugaaaaaacacaagugaucagcuuucaucaugacaaauggaaacugucauuuaauuuuuauccccaauuauacagcuccaggaccaauuuuucagguggaauguuggagccauuaaaaagaaauaaguaaacuauaccauauuccaucauuuuucuggcagcuaaccaaugaucuguagccuuauuacauguacguuuuuauagagauauuuuucucuuaaguuugcagaaggcuuuauuaacucuuuacugauuucuucuggaaugcauuuuuccaaaugaauuccuuuuuucuuuuuaucgcugaguguugguugggauuuacuuugguuuucucuggaagcuauacucauuuucuucuuuuauguuuuuuuugauuacuagaauugcauggagccguauuucuuuaauuccaacugaaguuauauuagugguccuaauguugauuacagacuauguuaauuuggauuucagaaugugauuuauuagaaauauaggacacacaaaaagacccgaccaaccaccuuuugucuccugccuuaaagugauacugaaaaaguuggguauccccaaaagucgugcucccauagcaguuuguccguucuucuaauaggucauguuguaauuugccggacuucaucuucauguuccccaguaauuugaaaucuugguacuguggauaccuuucuauuuggcugaguuaucuuugcauccacaaauuuagcagacugcuuggcacauacuggguaugcaaaaaauguuuuucgaaugacugauucaaugcuuuuuaaaauuuccuuuugggacuauuuguaauuaaaaauuauuuaacaauauugaagucuagucucuucugagaacacuaaaacccuuuacaauuauguguguaguuuuauuuauuccauauagaaaaauuuuacaugcaguggguagccuuugaauuuuccaggugggagaaauugagaucaaagguuacuaaugauauuaagaacuccagagagaggcaaugcugugauuggaaccauugacuucuggguuccaagcccuuuuuucuccccaggcuacacagcuuugggucuuucugcuuauuguacaaucugccauuacuuuuauuaucaaaaaaugucacugauuuauuuuugauguauaauuaacacagagagugguggugagaaugauggucagaagaucgguuguuuugguuuuggagaagcugguuaauggaugaggucuauuagcuguguagaucuauguacagauuuuuuuuucucccuugguguucaaauccuuuccccuucauucaccuaauuaguaauucacaggagccuuuggcucccagcccaagaauauuuguauuuacucgacuuuagcuucagaauaaacuuaauuuucaaugaaagagguacugaaguacauuauaaacaauaaggcaacauuuucuucagauguaugccuuggcauaugcuuagaggagaaaugauacccucuuguaucuacuuauaaaacugucaucugguacuguugccauuagaauaugcaaguaagcuuauaaacauacugaugaaaauggauucuuuuggcugggaaccuuguuaaguaaaagguguuaaaucauguaucuuguccucaggggugguggacugaacagcugcgcuuauccuuauuaaugacuguagucuccuguuucagaagcagcaaauagccuuuuguaagaguuguuauaauaucaagaguuacuuuuagucaagcucuuuacugggaauauuaauauauagucuagcuuggcaaacagcaaaaaacccuagcaguuugcaaaugguuuuccuaguuucuuucccaggagugauaggaggaguaaacucaaugaaauaaacacacguaauugccgaucugucauaaaucauucuuugugguagguaucuacuuuuaaggcuacauuaggucuuccaaugggagaagagcucucggauuuggcuaauguaccugcacugauggagagaugaugauuuucugucuauucgcuugugacauaaaugagaacuucucuugugucauuuuguuggggguggaguguugggauuugggauuggucagucauagaauugcagaguuagaagggaccuuagggauuggacucaguauaguacaacaucccaaagcuuuagagugagcccuuucauuuuggguagcuguaauauuagaaugcuuuuucauauauuaugauuguauuuauuauucucugugauguucacucauuggucccuugccuugcuucccagggucuaauccuuguuugucaccauccaucuagugugacauccuugacugugcaugcccuugacucaaccuggcccucucucccaccacuuagcacaugccuuuuaucuuucuguacuuuuuauauaccauauuacauuuccuugguguucacuuggcuccaugcugaacugaauucugugaagguagggaucagaucguaaugcaucauagaauuuugggugccuaguacaaugcccaguccucaauaauauacauuauugaauguguauuguucucaucagcuuaaaauagaacuaucauggguuuuuuuuguuuguuuuugcuuguuuguuuuuccuauagguauagcuguuaggaugccugauuacacauugaccauugaacuuaagaucaguugaaacucucagggcugucaagaguugccugaugcaggguuuggggaauuguaaaauaacggaaggggcuagaggugucccagaacaacuucucauugauuucagaguccauauuucuaucuggauauuagccuguagcauccaagugauuggcgugaguaagucaguaccuugcucauuuucuauaaaguuugaucauauucacaaauuuaauagcauagugauaaauuucucacacaaaaauuccucaauguaucuuuauuucaugauagaaaaccaccuacuguuuccaagcagugagcuuaaucuuuucuucaguguuuuugcaguuccacauaggaguuacaguuaucauuauuaaaugucuuggguagaggugaaacagcauucugguuuuuuguuuuugaaaucuguguuugucuuauauucaauaucucugcaaacuuuacacauuuuguauuugaaugguuaaaacuucaaggcuauugagucaucauuuucauuggugugucccaucauuucugugagauacaacacaccccacccuuuucauggaaugggagaagcccucagccagcauguauaugauuucuaagccuauagguacaagcaugagcaggcaggacuucacuccuuuggcccucgucauuaguuuuacuuuuuuuuuuuuucccagaagaaaaaacaccauguccauauugcuaaaaucagugauugauaaaaucuugaacuaaacuugacauagguuucuguacuugaagaagaggugguaggaucaccugaacccaggaguuugagaccagccugggugacauaaugaggucccgucuccacacacuauuaaaaaaauuaguuagguguggugaugugcaccuguggucccagcuacacuggaggccaaggcgggaggauugcuugagccaaggagguugaggcugcagugacucacguucaugccaguguacgcuagcgugggcaauggagugagacccuaucuuaaaaaaauaaaaauaaaaaugaaugaaagccaaagcgacugaguauccacaguuuucucagauacucagaaggaaaaugucaagaacaaggauaaguugggugauuauucaaaugguggccuguggguccuguugaaucuaaugccucccucuguggauucagugguguuuccuccaaacuccccuuagcugucuguguguacuuaauacaugaaugcuuauauaugaggaggaacaguucuuaucucugaaguaguaaagcaucuuauugcauuuguuuaaugacuuugagaucuaucugguaaacuccagguuauaauuucuuucuuugaauuugauugauuuucucauucaaauauuuccggaaguauuuagugaccaucuaucaugugcuaugcacaaugcuggagauugggaaauaaugguucacaagacagauaggaucccuguucaagagcuuagcaucgagugggaauacaggcaaugaaacaauuacaguuuaucacgugugguaaguaaggauagggaaagccucugucaggagaugaaauguuugcuguuuagcguauccauacagugauuauguauucugagccaaaauuagagcacaaaagauaaugccaaaaagaugauuaugccaacuaauuuuuugccaagaccauguguggauggaaauuuuaaagauacaguuuggacauuaaaauauaugaauuucugggacauuuaaguaauuuaugaguauaaacggguagaauauuugaaaucaagccugcccuggcaaauccuggauaaauguuugcuguacuuucugguuucugccacuuguagagcugaauuuauggagcuguuaauucagggaacagauuuuaaaaagaaauuuauuagcauauaauaaaagcauaacagaauuuauuaaaagucugauuuacuuuagaaauucugagcccuacuccaauguuuugaugggaaaaaauaaaccaggaaaaaugagcaauuguucauguucucagugcagauauuauuaaaagaccuucugugcuacuggaguguuauggauucucucucucaaaacaccacuuggcugugcuuugucacuaaagucgaccugacaauuucccguagauaacucugaaauggauguacauucaugacuuugcauaauaauuuaugccuucaauauugcuguggucagcauguggacaucucugcaaaacauuaguuaaguaauugguccuuuucagcugcagucugucaacagcacacguccuuugaggccaugagaaaauacuugcaaugcuucaguguacucaucuaugcaaauuggugauucaugggccaacaagggcaggauagaggaacuaggaggcaaagauguuugaaguaauaaaacaguugcuaaaacagggugggauagcuaguauaccuccucccugcagucaagacuauacccaaaccaucugagauggacaccuaucuaggcucuucuugaaaugccaugacaugaaacguuuaggaacaggaauuucuucuguauguccauaauauuaucuuugccuccacuuacccuuuuacauuuugggccaguuuucucuuuggugguaauggauaccugguuagccuuuacuuaugacaucauuuuacuaaaagcccuuugcuggaaguaggucugggggcucagaucgcauguuucaaaagucuuuuugguuugggugaaguuuuguagcugcugugcguggcagguagaagacccagugcaccccucccagaguggguucucugaugauaaugcuucaccuuuaagauugcuugacaggauuuaaccacauaugcaacaaaucaaugcagucuagagaacagaugcacuugaucuauauuguuugucuuuuuuuugacugaugcaggcaaaagaaaccaucagauagcuucucgguuaauauagcuuuguucugaaaaggaggcagugauauauuugaggaugcauauggccaaggccugaaaugagguggauacuuaccaguugggacaacauauaaucaauauccaacuaaagcauucuauaaauggaccuuuuuuuuugaucaaaccauauuauguaaaaguucucuaacaguuuauuaguaucauuagaaaauguagccuacuaaaaauucuaaaugaucauuuuaaugaaagcugugucauuugugaguggcacuugccuauaaauuuuucuagagcuaugaaaauaaguuagacaagaggccaaugguuuuucuuucuucuauuuuuuuuuacauuucccaaagcucugugaacagcucugacugucugauuuguuucaucguugccuuccacugccuguagaacaucuguuggaaaauaaugcuuguccugucaguuuccagaaucagcagcaaaccgaagugugcgcacaagguagaugucagcauuauacugcugcugccaccaggcuacugaaagacagaauuaauccugggcugguaagauucauuaaaaauaaaaaaagaucuggaaacccuauucaggaauagaaugcuuaucccaaaauggaccaagcagaacacaagcaaaguggugauuuugaacuaaaggcacagauauaggaugauuauugccuguuauuuaguggaugacucuuuguucugagacuagguuauacuguuuugcuggaagcucacaacagaucaauaguaauuuuguuaugggccagaugucaaaacagaaaugugcuuucaaaucccacugacuugcugugacaacuaguaugcuaaaauacauucgcucagcaaucaggcguuacacggugcuccuggaguucuguuuucuuucauguggagccuuaaagcuacguauuguuagcugaguuucccugauuuuguaguucuuucucuauuacauauguaccucuuuugguugagaauagaaacacuuccucaaauucuccccuuuccucugccuugauaaugagcuggguguaaagucuacaccauaacuuccuguuacaaguaucauuuuuaugguaauaaauaaaaucugugguaggaaaauggucacgaagaaaagcaaaccagcaagaagcauguuauuuuuuuaguuccucuguaguccaacuuuggaauuuuaauuuuggucuggugaagauuugggagucaaauguuuugugaugaaagauaauuuaagggauguugauuugcccaucgcuuugguaucuucccguuucuccugcuucugugaaacuguugguuaccuaaugucuuuuggaugagauuaggauagcaugccauagugagaaaaugucuuccugcgcugauuuguuuuuguagaaauaucccaaauuaaucagagggaaacaacuggcaguuuuuggcugaugugguuuggaaguguaauuuuaaaugguguuaguuucuuaaguccagagagaauuggacucaugucuugucuaucuaggcccagcugucuuccccguuuucuccuuaaaacaggaaaagaaaaagccuuuccuuuucagaccaagaaaggauugaacaagcucagaauuauguauucaauaaugugauaagaguuuuuuauuccaccucuggggcaggucuugcauuucuuaccauuacccuaucuuuuguaguagaaauaucucuaagugagaagaaacauuucauccaagcauguaaguucucuuagaacuuauuacucugcuggauuuuguguauauuagucuauauaauucuugaugcugcucagauuucucuaacagacguuuuacucacuuacaaaaagaauuccuuggauucuguuguucuuuccuaucuguauugccaaugcuuuucacagaacuuuguucacuuuacucuugucagcuucaucaguaaaaugaacagaguucaaaucagauuaaguaccuucuguagcagcuuucauuuauuuacugaccacuggaagaugccuuuuuucaacaaaaauuaaauacacuauugcugcauuccagacuauguuacaaguggaagaggauugcagauuaguaugucaaagccccacccuuucagaaacuuauacacauagaaggcacagcucucauaccauaccauugagguacaacagaggaugaauuugcaugugucugcccucauucucuuaguugauucuccugauagcuaagugcauaaauugccaaaucaugggagagagaagcuaaccuguccacugagaauuaaguggacagaguaaaccacauauuuuguuguaauuguuauuaccucagcuguauuuucguacaaaagaaucacaguucaugacaagggaacguggaacauagagcagagagucaggaagagaaugccagguggguccccccaaaacaaaauccaguaaauuaggagggggaguugaauaugagaauugcaauuauuaucugagagcaaagcagcaaagaaacucaagaaggugaauuguguuuucaggaacacuuuuggaaaaaccucuagauuuuucuuaaauaaaaauaaaaucuuacauaaaaaucuauaaaagauaccagaauuagaaaaaaauggagaacuugggauccuuuugcuucuuuacauucuauguuggacauaaagugagcauuacuuuauguggggaauauguauguauguguguauuuauauauucuaauuuauuuuaacagggugaagugggucagugaguaagaugcaauagaacaguaguuaucuuugucaauuaaagccccugucaccauggcguagguuaguguaagcucucuugcagagugucuuuguagagauacucaaguaauaccauguguaguuuugcagagauuuuguagguuucuuagauguuuaccgucgugugcuaagcuuuuuccaagccaaaaaacauugaucuaggccagauacuggcaaacuuuuucuucaaagggccagauaguaaauauuuuaggucuuguaggccauauaaucuccagcaaaaucacucaggucgguuguuguaaugcaaaaacagccauaggaaauacauaaaagcuuggcucuguuccaguacaacuuauuuuauuuuauuuauuuuuugagacggagucucacucuauggcccaggcuagagugcaguggugcacuuggcucacugcaaccuccaccucccagguucaaacgcuucuucugccucagccuccugaguagcugggacuauaggcaccagcugucacgcccagcuaauuuuuguauuuuuaguagagaggggguuucaccauguuggucaggcuggucucgaacuccugaccucaagugaucugccugccucggccucccaaagugcugggauuacaggagugagccaccacgcccagccccaauacaacuuuuauuauggacacugaaaauuugaauuuaauauaauuuuuaugugucaugaaauauuauucuuuugauuuugaucaagcauuaaaaaaugugaaaaccauuccuagcuuuugggcuggcuuugaccuguaggccauaguuugccaaccccaguuccagacccuuuacugucuaugcuuucuaagccauauuguugcuuaauuggaagcuuuaccauaucauaauuaaauuugguaguaacugugugagaaagugaaacauuuacaauaauccuaagagggccaggcacaguggcucacgucuguaaucacaucacuuucgggggccgaggugggcggaucaccugaggucaggaguucaagaccagcuuggccaacauggagaaacccugucucuacuaaaaauacuaaaauuagcugggcauggugguacacgccuguaaucccagcuacucuggaggcuaaggcaggagaaucgcuugaacccaggaagcggaaguuguguugagccaagauugcaccauugcgcucuagccugggugacagagugagacucugucucaaaaaaaaaaaaaaauaauaauaauaauaauaaaauaaaauacuuagagaacugauacaauugucagaauucaacucuccaggaaaacuccuacagagaguauaguucauuccauuuuauuuggggcugcgguacgaauucucaguggccugaagaguggcaagggggagaggugaaaaccagccacaggaagggcugauggugaccaaguccuugcugaaugccuacuacacccugacgcugggguaagggcuguacccagauuaucucccuuaguccucacaagauuucuaugaagugagaacuguucucaucucuguuuuauaaaagaaaccaguccugguggguuaagaaacuuguugaagauagcauaauaaauggcagagacuagauuucaacccagucugucugacgcugugagguguguagucagcgucgggcaauguaagucaguuggcugauuaacugcacuuagcuuggugccuugcauaugguagguccuauauauguauuacuguuuugucuguagcaaaaggggaggguuggggugaaguaguauuaaagcauuagggaccaaagaguaugauaccuucguuagaguuucaguuggaucuuguaaucaaccugugucuuaaucaagccagaauaugcuuuugggaaccaaagaggagugauaaaaaaauaaaagaucagagaaacucaugcaguuaaaaauguggcaagucauagacauggggaagccagugugaaaguccuuacuacugagcucaugaagcucaugaacuuccacuugacggccagagugucauguuucagaagacuagaggaaauuuuuuugacuuacugccaaucauuuacauaaacuuaaaagaucuuagcauuaaaauuacuuauuugaagugcuggcagguuaauaaauucagggggcuauuugaaacauugucaaucuaaaauguaauccuauuaaaauaauugaguauuuucugaguggagaauucccuuguccuccuguccaaggcucacaagagaacaacauaaaaggcauccuaaaauguccucugaacaucauugaaccagccgacguguuugcacaguguaaugcucuuucgcaaagaauuuccucagcucuuccacuuuaaaaggcagaaaucccaacauaauggcaaguuuauucuaauaugggaaguggggauuauauuugaagugauaccuuauauagguccugggaaccuucuuggucuguuugugcucauuucuguaugugauugaggauccuguguaacucaaaacaugugcguuugcuuccuucuguuccuuucuugggcuccuuuucauccagcagcuuggguuaccuugaauuaaauugguuuauggcaugccguuuucgguaaaacucccugaaagaaauggucacauaacucaaaaagguuugcccuuggagugauuuagucaugcuggaugauagcuaaggaggcuuauugacuuugagcucccuuuggaaccaaauucagaaagcugugcacuucuguggcaccugugagacacucacuugaauagagcuacugagaaaagcauuucaguuauuggcauuuuuccuaaugcauuuuguaugugucuauaccacagggagaaaugugugguuauuguugaaauauuaucugcauggcuuuguagaagaagaagaagaaaagucacuguacagcaaucagcagaggaagucucauagugugugugugauguuuggguggggggguggucugugucuucccccaccaccaaaacuccaaacagcuguguggcuguauuuuaagacuuugugacuuacacaucuauuaaagggaucuugaacuugacaaguuggauguugguaaccaugauuuggaaugcuauuuaaauacgagcauuccuuuuguucaccugguugugacuaggaagauaggccuugaucauuugaguaacugugcucugugaauccgagaggaaaacaaacucucagaagugcauaaaaguuaaguuaauuucuuuuucuuuguaagccgauagacucuuguuuaaauacaaauuuguguggacagauuuucguuugucaugcgugagcuggguauguugcauuugucuaaagggagcaguuuuaaguagguggauguguaauacccguaggcuaucagaaccaccauuucaauaaaucccuucucauauaacaaccgugcaggaaguuuggguaauugauucuccugagcaauacaaauauugaaauucuuaauuauuccaagugaugggcagagcuacuacuuuuauauuuuaaaaaauucuguuuauuauucuuagguguucauuaaacacuuauugaucagcagucuacagccaggcuguaggcuagaugcugagaugccaagugggcaaaagggagaauccuugaccucauagaacacuaaggaaugcugaucccacauggauaauuauaaugcauaaguucauuaauucaagagauuuuuguuuauuuaguaugugcuagaugcugggcauuggggagggaaagacuugugggauggggagaaagggacaauggugagcgaaagcagacuuggcccucaugcuccuuauggucagggaucaguuauuaaauauauuuagggccgggugugguggcucacgccuguaaucccagcacuuugggaggccuaggcaggcagaucaugaggucaggagaucgagaccauccuggccaacauggugaaaccccaucucuacuaaaaauacaaaaauuagccaggugugguggcgugcaccuguagucccagcuacuagggaggcugaggugggagaaucacuuaaacucaggaggggcagagguugcagugagccgagaucacgccacugcccuccugucuggugacagagcaugaaucugucucaaaauaugguauuauauauauuauauauaugguuuuauauauauauaugguauaauauuuauuaaccaaacagucacacaaauauacaauuguaaaugauacaagugucauggaggagaagcccaugguacaaugaaaucaugcaccaaaagcauuugaucugaucagguaggccagggagggcuucguggaggaagugaagauugagcugagauaugaagggcuggugugaccagguugaaaaagacaggaagaacuuuccagagggaacagggugccuuaaaggaauugaaagaaagccauuagcuggagucagagaucugggcagagaggagagaagagguaggaagguucagacugcuuaaagcccuucagguugugugaaggacugggggccuuguucuaagaguuauaagaagccuuugagggucugaagcaauucaugagggguaacaugacccuagauguuuucuggaaaaaaaucacugugguuaccuuguagaggggcuugaguggcugcagacagguacaaagaacuacugucuggacaagagguaacaguggcuuguauuaggguggugguggguuugagcguaggcauggagagguagguggaauugaaaaguguuauuuaggagguuaaaucuacaagcuuggugaugggcuggguaugggccguuaagaagaagauaaggauaauauaguuaugaggccauauaaaugacauaccgacauuaaauaacacgaaauaauccuuauuuugcgucuucaaaguuaaacuuugcauauauuuuacaguaguugucaaucuguuuuccaguuuuucugguacuuuuuuugugccauuuaggaaggacauuguaguucuuacccuuuuuucuccuuuuaauguaauuaagguggugaaaguacucaguugcaacucuaauaagaagugcaaaaagaagcaguuccaagccagaagauaauaucaaacuaaaauauuuccagcaauaucagcaaaauguaaagacaauaucggaaacaaacauuugcugccuccuaccuucucugucgauuuuaauucagaaaauuuaagugauuuuucucauaucgaaaaugaguuaaaauacuagagagucuuuuauuccuuauaaacuaagucagaguaauuuauuuuaucuggaggagaguauuaaauuagcugucaaccgugcuauacagguggaugguaacuauugaaugaaaugaccaaaucucugguccugcggcauucauuuuuaaucucugcuuuccauugaaaaaggcaaaacaugaaauauugagauaauaguacuaaaacuccaaguaauugcuuuuguuagcucaacucauguuuacucauauuaauuacugaaauuugauaaccccuuuguuuuuuacuuagccugauucugaaugcaguggacagagcuauaaaucagguaggugguucucacuaaggcaggacucuuuugcuuugauguuggcagcuuaaggcuaauucuccaagcuugauagguuuauaauucaagaagaugugauuuaauguugauggaauuuauuuuugaaacacauuauaggaagaaaaccuuucaaaguaacaaaugaaguuuugagguaaaucuuaaauaaauaaagauugucaggaucucuaaacgcccagcguuagcuaucucuauaggauaguuccuccaccuuuagcuggagggaaauggcuggaggagaaugagaaagugaagagacaagauguggaagcuauagagccuuaugaauaagucaugcauuuaaagacauuacuuuuuuguaucuucuccucuuucuaaauuuacuugacauuaccuucuuuucauaauguuucauuugcgggguuccuuacaaguuauuuuuccaaagguuacccuauuugguaugauuuuuuuuuugacauuuaauuugcacuauaggauuguagaauguggagaaauccuggguucauuucuuuuuccaguuugcugauacauaaauuucauccccccucacgcccucaucuuauuuguaacacucauccuuucaagaggaguacaugccagacacugcuccgggucugggggauguaagcagggaacaaaccacacugaguuuucucauggacaucccugcuuuggacacuacuauuacuaggaccaccuaaaaucacauuaucuacuucuaauuuuuuauuauuuuuuguaaccucauggcauuguuagcucaguagagcucagcagagcuuagugcauacuguuugaagaaaauuauucuaaaauauaauacacaauucucugccuuugaaaaacaauguuugauuucaauguuacuuaaauaaaugacuucggcuucuauuuuuuuuuuuuuuucugcucuugugcccaggcuggagcgcaauggcacgaucucaacucaaccucggcuucccagacucaagcaauucuccugccucagccuccugaguaguugggauuacaggugcccaccgcaacgcccagauaauuuuuuguauuuuuguaguagaaaugggguuucacuguguuguucagacucgucucgagcucaggggauccccacccgccucagccugccaaagugcugggauuacaggcaugagccaccgcgcccagccaggaucuuuuagaauaauaauauauguugcauauagacuguuauauggguuuguuguuuuguucauucugcauucagagagugcuauuuuuuuuaguucucagcaauuuuuaauaaaucauuuuuuucuguuucuuugcucucugcuuuuucccuuuuuaaaaauuuauuuugauuuuauuguaguuuggaaaucaagguaaccaagauuauuagaagugugugaaaaguauguuaauagaguaaauggugacagcucgucauccuuucccaugacuucaguagcacuuacauggaaccaagacauuugagugacuuagauacucccuuguagguucucuggcacucuggagaguugggcuugccacguacugggccucaaacgugagauguuacugaaacuaucuuguccaaaauauuuuccugugaaauccuuugaggcaguaaccuuuuuauugcaacauaguacgauguuuuauaauuuuauccuuucuggauuuccuagucugcucauaugcgcacacacguacacacacacacacacacgcacacacacacugcuaguuuuuuuucucuauagcuaagcuuuauugagugaaaccuuuaaaaugauaucucuacauucugucagugguauauuaagaauuauaacaaggcaagaaauagugaaaauaagaauugaggagcuuauagacaauugcaaggcuucuagacuggaugcuagguuacaugaacacacaacauauugauuuggggaauaagagcuauauauaguuuagaugcaagcuaugacagauggggguucaugagcaacaaaucugaugacuucuaggcaucauuccaaacucuuaaaaaaaaauucaccagaugcaaggacucuugccuuucuuaaugaauucuuuuuuauauaaaugagucccauuuauauauuuccucccauggccaauuauccugagggcauuauaagaauuaugauuuuauuauuauuuuuccauuuaguggauguauugccacaugguaguaggguaguuacauugguaaaguugacuuuuuucuaaaggaacccauaaauaucuagauagcaacccagaaaugucuagauauuuuaaaccuauauaagauuacaaucuaaugauacguuuuuucauaaauauuuguaccuuugucuuugcaaugcuuuucaaaauuaucucuuuuggaggagguagaacagguucaucuaauagcccuuugccaacauuuggaagacucagacauauuuucuuuaguuguggacauccccuuuaauuacauucuuuuuuuuuuuuuuuuuuuuuuuuuugagauggagucuugcucugucgcccaggcuggagugcaguggcaugaucuugauucacugcaagcuccgccucaugggcuuaaggauucucuuaccuuagccucuggagcagcugggacugcaggcgugugccaccacgccuggcuaaguuuuuguauuuuuaguagagaugggcuuucacguguuagccaggauggucuuuauuuccugaccuugugauccacccaccuaggccucccaaagugcugggauuacaggcgugagccaccgugccuggcccuuuaauuacauuguacuucauuauuaauauauuuucuuuuucuuuaauuucuguuugucgauuaauacaugaauauauuccccuuuacaaaauguuuuagauaaugcuaaagucuccacugaugaccccuuauccauguuagcuaacuucuguauucuucuauguuugcccccauaucuaucaucuuaucugucaucuaucaucuauccaucuaucuaucaucucuacuucuagauagaggcauaaacguaaaauccauagaaacccuaugggacagcauacguaguaucauucuguccucaucauucuacaccugcugucuucagccagcaguguccuagaagccuggccauguugcuacgugcugauuuugcuuguuccauuuaaaugcugccuuguuuuuucuucagcacacauauaccucuguuuguuuagcuguuccccaauugauagacauauggguuguuugaagauuuuuccucauguaaacuguucuucagugaagauucuucugcgugucuccaugugcacaugugugagaguuucuuuaggauacacacccagaaauggcauugcugggccauagagggugcacauuguaaauuuuaauuuauaucugcuaugcuuggcugcuggucauuuuaaacuuuguuucgggaacuagguuuuugcuuuuuuuaaugaacagaguugaaccaaguaauguucuccuauggaacaaaacuaaagaucguuucauuauauccuccuguauuccuguggcauuccuaucugcaccuuucauggaguuuuagaacagauuaagugaaauuuguuaauauacaugccaggaaacacagcaaccugucccuggcucuugucuuacccaucacaugccucuuccugcuucaucuuaguucaucccugugaauggcagagacccaguccugucauuuuaacggaaauuauccaaauuuuaaaaagaaccaaaaugagcuaaaccauccaagcuguggaggggcccagaggggguaaagggggaagcaggggagggugggugaagaagagaguauuauggaugaaacucaacuggugcagcagaggaugcagugagugaccuugucuuagcggaaagagaguaaagggugauucuccagccacagguguuucugcgcuaaguacaccuacaagaggaucuggaggcaaaauccuuugaacucuugcuucucagagcacagggguaaaaauaaaaggggaaaggcuuucuuuacaggcuaagacuuaguuaaggccaguggucaagcuacagugugcaccccacuuccccuacccucugaagagauggggcagcccuacucugggugacauggaagcgacugaaaucaaaagucucugugaaaaaggggccgggggucagagucugguccugugucuuguuacuacuacuaauuguaauuaguuucuucaauuuuauaucaucugugagagagaucauuuuaacccacuggcaagaggcgauauaacauuuuucuagcauccacuaaucauguaggauaaaacauuccugaagcucaaaagaaaauucguguuugggagaugccuggugcugcugcuaagauuuauuuucuuuuuaaaaugucagugucugcugccuuuccugcagguagcccuccugccuccuugucaccugaguccuucagugucuuaggucgggcugcaucuguucccgcagagcguucccuuccuccagcagaaagcugguuuguuuggcugacagaugggguucccgcuuuggccuagaugcgccuaguuaaaggguuucuguuugaagcccacaggugaaggccaacuccacacagaccccugcuuacaaaguucccuucauggucacguaaagcaguaaggaaguuuuuaauugacauugucuacuguuaagagggcauaguguggacaucuuuugagaggguuuacuuugucuuucuaugaagugucaagcuauuaauucauuggauaaugcaguggguuuggaagagagguacauauuauuguggcuuaucuuuuagaaacuccgcacaucaaaauccccucagaagcaacaaucccacaaaccuauguugcaaucuaacccaaagcuuaaacuguuugagugauagguguaguuaaaauaacaguauuuaaugcccaaagcacauuaaauuugggugaagaggaugcauucugcauaaugccuagagaugucucguuacgaugcgguuaccuagcaacaaguggaaacuguaugaaaaugaggcgcuuaucuguuguugaagugggugcaaugaaacuuauuacgcuagccuguuuggcuuggcauguuauuaaaaucacagcuaauguggaaagaacuggagccuguucucauuugauacagaagcacuguuaaaugcugcuacuguaaaauggcaauacuuugguuaggaaaauagaaacucgcagccuccuuaagcacucaacauugagauguuagaguuugauuuauauuaucaaagacuuauuaauaaaagagcggacagaaucuguaguggugacuuaagaagcagccaguuauuuagauuuuuaaaaacauucagggagccauuuaucguuucaucuauaauaauagcuuaguacggcccuguuucuuguagccaaauugucuuuaucugcugagcuuauugaauucuaaccacagucuucuuaaguuuguuuaauuuacagaaucggggugcauugucaugaucuuuaaagguucucuuuuugucuagucacauuaaaacaaucugcacauauuuuauacuauauacugaugcauauuuugaugggaauagaaaaucuucuuauccuuacuggaucauggguuuuguuguuguuguuguuuguauauauagaaaaguguguuuucuggcugggcgugguagcucaugccugaaaucccagcacuuugggaggccgaggugggcagaucauuugaggucaggaguucaaaacaagccuggccaacaugucgaaacccccucucuacaaaaaugcaaaaauuagcugggcaugguggugcacaucuguaaucucagauacuugggaggcugaggcuggagaauuguugaacuugggaggcagagguugcagugaacagagaucucgccacugcacuccagccugggagacagugcgagacuccaucucaaaaaaacccaaaaaacaaaacaacaaaaaaagaaaaguguguuuuccuacagguuugucuuacuacuucuuuauguauaguauauguagcuucauauggaagucuaacuucacuacauuaaaaacaacaaggucaaacugagaauucuaccaaaauauccucuguggguggccugugauccuaacaugauauagcaccuguuauccuagagaugaagaaaaguucaaguacuuucugugcuugucagagaccugugaugacacacagaaaucuggcauacaggacccgacucuguuagcuguauucugacguuacuucuggggcuuuggaauguguuuauguguagcagauggagcuauuaguuagcugugcuaucuugaagaauugcuuucccagguaaucagcucugcucauuuaggaugucguuuccccaccucgauaugucagcucaagaagcaggaaugauuaauugcugcaacuggacagugcacuagaauaaggggaaccauccccugguacucccauucaacagggaguuugaagugcuaugaggcagagcaaacaagauggaaacgaugaccaggaugcuuccugaagcuuaccugucaguauauagaguugcuguggcaaccugaagauuugcaauucauaggaagaguagagcgagacaaaaccuuaagucauggcugucauuacaguggaaugggugccaccaacaccuggcaaccucuauuacuucaacuuguuucuuuucacgcuuggagaaauaaaaugcauaaaagauuaauaugcauaguaaaccuuuugguaaaacauguauguguucugcauuucagaugaguaaaaacuucaagaguuccccucuacuuaaaucaauauuaccuaauaagguucaaagugagguuaccaucagacucuugauaaaauaagaacuaugaugcaaggauaaagaaagcauauucucuuucaaauuuaaaaaagguggggggauagauaacaguguauuuuuaaaauuguugccccuccuggaaaugcuuauaauguauuaauguaaauuaugugcccucuuugcagcuuucucugucaccaugcauaguaaggagaaaguuaguucuggguuuuguuaggucuaaaugguucuuuuccauuucuucuuguuaaguaacggguguuuuaaguuucuccuggggcaaguacaagccauagagaugaauguuaaaagcacuuaguugaggauuaucuuucuggaggggggaaacucaaauaacaaaauuacugugguuuguaaauacggucacaucauguaugcauguucugugauuuugucacuuaauggaaauguaggauuuccagcaucaaacuaacauuacaauuguccucuucagguguucacucgaauguugaagguugauggguauguaaaucaaaacucauuuaaauuuuauccaguuggcacuaaggccucgacuuuugucuuugcucuauuaaaaaugcacaaacauuaaaaaaaaaaacagaccguagcguuuucuagguuuauauuuuacuguguucaguaacuuucuuuucauuuuuuguuguaggagaaaguguuuuccaaguauauauuuuaaaaacaguuaaacugaacuucgcuugggguuuucugacaaacagaaucuugaaaaucuuccguuucugagugucagaaaaauguacaguuucaauaaaaucauagcagucaguuuccugacaggugcaucaagucuagaauuaaaucgaaaggacugauguguuaaaaacacauuaaauauuuaauguuaaagaucagcuuauaguuuuucucuuauguuuucaaagggcacagcgaacuaucugugcuguuccaaagaguugcacuuguaaaagggucuauucaauuuagaccaggauccagaaauguagguuauggcuaagaggaugagauaacaaauagauguguucagcuucuacaacugacuugguaguuuaguggccauguugucccuguugagaugggaaagcuuucugauugguauguuacagcucaccgcugcaucaggcauuucuucaaaccagcauaguguuguaauuggagaucaucuucuugaagauggagccuuuuauuuuuguggcuuucuggggaguuguaaugccugccuguuuuuccuuuuaaucagauguuugagagcugcagcuucgggucaaacgaacauauucacaccugauuuuuacaguauuuuuucagcaacuugaguauuauguuuaaauggaaaacuauccugaauaguccccuuuuaggaaauagucugucugagagcggcauuuuccagcauuugguggauuugagagaaggcacugacaccuguaauuuguaacccaguuaaacucguuuaucuugccuggacacaccuguggacaagaagcaagcugcugauuuuaaguucagcugcguaauuuuacuuguuugcucagauguccuuuaauuuauuuucuggggaccugaugacaguagcaagauuuuaaaguuaauugcuagauucaaggacaagucccaugaaugggcuggaagcauacccuuagggcauaagccugugugcggaucugugacaaagcccuaauuuugaguuuauguaaucaucguaccgaaauauuuaagaugggaaucuaucaagucuuaucuguugagacgugaucccuuuuauaucuggcaggccucaugcaacaaauuuccuuucuuuuaagugaucuccaaagcugucaaguucauuugagugaacugugcuugagagaaacauguacaauuuucucuggcaauggcaugcugcugaugacauauuuuuagaauuagcuuuuucucucccccacccuucuagaaacugaacuuuuauuuaagcucccugcuguuaacauuggaaagaaaguuuccugugccaauguuugcccaaauggaagaaaauguuugcauuuuguaugcaguguucauaaacuugaugagucuaacaguuuggcaccgcuggugagcgcgucugcuuugaguucugaagggcaggcagaaauaguguagugaagcacugcagcuacugugaaaagguguggcugagcugcuguguugagaugcgacaggucgagaauucagaauucauuuuuccuagugcuuugaaggucaguaguuaagagagacaucucccacuugucaaguaguuguaagcaaaagaaucauuucuucccucauucauuugguuaagguuagcugaaacacuggcuugcuuugauuucucugggcaagauuguuuuagcaaggccguuugacucucuguuucugugcuuuugguuuuaguuucaaagaucuugccaaacuuugccagggcgcauucuggucuucaaacccuuuguucugaaagcuggugccaccaaauugaauaaugugcaacauguuauagacccacuguagaaaauaauugcaguuuguuuuaacauuaaguuaaauuuuuucuguaugcaaugcaaaggucaaggaaaaaggcauuaaaaaacaucccugcacaagugagucauuugcauagaaaaugcuccacuggaugauagaguaugaaagcaguagggaauuaacugguaaguguauggcaaaugaccuagccaaggauccaagcaagaaugauuuguuccaagaaccaguguaagacgauuuaggaagaugcacuuuucuuuggcccucauccuacagcagcauugaaucaggagaacgaaacagccuuggcuuuguucaucaucaguaagccaagaagaucacggcaugggucauuaagauuuacagcucaaauguaaauaauucaggacccacaaacaauaauuaaaaaaccaacugcggcacugcauguagucagguccucugggccucuuugaaguaggaaccucuccuguuuuggcuggagaccuguccaucuggguacagaugguuguaagagcuuuuuaaugaccuuuucuaaugcuggugaaugugucuuuggacaccaucguaaccaauggaugaggaggguggaaacagcaggaugguggcagcugaggaauuaaauguccugaauuuguuagacaucugcagaaacaugcaauuuguugggcagaaaauuguaaacaaaacagacugagucaauuaucaauacaccugugacaccccgggaugccagcuuuggcugacagcuuuuaaccagcugaggagcaggaggaaguucacaaugaucaggagcaagucaauuccaaguuuucugcuauaacuuguccccuugcuuguguggugaucuccuguguggacacgucuuuccuuguuacacuauacacauuguucuaaauucuaagucauugguucuuaaccagugguauguuucagaggagcuuaaggagaaaaggagcuuaagaaauaugccugcuucuaggggcuuuugccuggagagucuaauucaguaguugugggacccugggcaugugcauauuuuaaaaagcaccccagguauacacaccugguugagaaauaaucucacaugugucucaaguuaacaauggaggagagcaugagguucuggaccaggucaugagaaggcucgaacugaauuuauugaucaagaaaucaacucauuaugcagauaaacauucagagcuugggcacagucaagaugaaaguggcuaaggacaaaaaugugucccguugauuaauuucuguagaaaggccacugacuuuggguuuggacaucagccacuuccugauuuuagcaucuguucccaacucuggauuuucccauuuaagguccauucugucaucguguucacccaguuuaacuaaucagauuauugagucucaggggcucauuuucggguucacggucaaagauuucuuaauacuuuagagaauucaguuaauuuccuacuuuaaaagacaagaugggguauuggcuuuaugaaccugaaaacagagcuuucaccaacugggagacuuuugcaaacuggaaauaucugauaauuguaauuuguaauaauuguuaaauguaguuugaacuuaaagacucaaaaggauuaugucucuuuaugguguguuucuuaaaggcaggggaggggcaucaaaagggucacaaacaaacuuuuuggauuuuuaaagaaucuucuacugggauugaagaagaggggaaaaggaagaaauguuuucuaaaguuacuuguguacuucagaguaugauggauugaacacuguugugagaagggaauguggagaggugacccaaacaaaggggcagucuauuagaagcaaaugguuagaaguuauuaggaacuagagaaaagcaaaaacuguguaauugugaacagcauaaagauggguugaaagaggaaggaaauucuaaguauaaaaacuucuaaguggucuuucugggaaguagcauaugcuucuguagcagagcauagcaaaauuagagacccauuuuaguuuuugugaauacauuuacauuuucuccccuuauugaucaucaccugucuucaaaaaaaccuucagugugcauucauuuaugggacccaauuaacaguucagauuccuuuuccuuucuucuguaauauuuguauucuaaauuaugauucaaugggcucuugaaucuuuuaucuuuaguagacuaugauguuauauaguuuauguaaauauuugucuugacgugcuuuaaguacuugcucuuguaaagucucacauuugcauuguuuuauugcagucauucuguguaaauuaaacccuaaucucuucaauucuauugucaaggccucacucuuggcuuggguguaauggagauaggauuugguugguccuuuaaugugguauauuuaauuuaauuuuucagguagugacaaacauugggguuugggcuauaggcucuuugacauuaauauguauaaacucugaccucaaauauggaacaguuuaaaguguuacacugaaugcaauuugcagcacgaauuuuuuuuaaauauauaaugugaaauaguauuucugguccagauucugcuguagagcuuagcugaagcaaacccccaauggcuuaugcuuuccugaggcuaauagaauuuuuuuggaagccuguaaggguaguaguuugauauuuaucucucaguucucauguacuauaggauuuuucuaaauauagccaucuugacuguaaauagguuacaugaagcaguagacuaguagacuggccguucuuguuaaguguaauaaucuuaaccacuugcguguuccacuccccuuauacccucgggcuauacuauuaaagaaguuucauuuucuuuuucggauuaucaaaauauauagagcauaaccauugagccacaagugacuuuugcauuccaggaugggcaaggcaaauguucucucucuuacuguaagaucacacuuuguugaagaaagacaucuuuuaaugugcaaaagguaaaagaggaaggagagcaaaauuuuucuucacgucaaguugaauuauuuuguuauucauuaacauugcuucuuauccgcaucugaauuagauguuauauagucagacccaaaccauaaugugagguaaucagauccacacuauaauauaauaaggauaaaugcaucuucacuacaggugucguuugcuuuagggugacuuguauguuaaaauuugaauuaaaucuaucaggcaugaucugcaguagcccccgcuugcccaugguuucacuuuuguugguuucaguuacccauggcaaacaugauccaaaaagauuaaauagaaaauuccagaaauaaacaauuuauaaauuuuaaauggcucgcuguucugaggagcauaaugaaaucucaagccaucccacucugucccacuggguugugaaucauccccuuguccagcaucuccacaccguguacgccaccugccugguggucucucacuagccgucuugguuaugaaguugacugugagguauuucagugcuuaugcucaagucaccuucauuuuacuuauucuguuuuaugauugguuauuguugucagucucuuauugugccucauuuguaaguuaagcuuuaucuuagguaugauguauaggaaaagacguaggauauauggaguuugguauauccggaguuucaggcauccacugggggucuuggaaguuauccacugaggauaaggaggacuacuuaguuagguacuuuagcauagucaugaauuaguuuguaaagauucaccacaaguuucccguaaacggugagcucccuuagucauguaaugcaugauucaauuaaaaauguuuugauuugcauuuaacuuugcaggaauugacugucaaggugauauaacaguuuaaugagcuacugugggaaauuguguaguccccagccagacaguuuucaagugaguugaaaucuauuuucccuuggaugguuaaagaaagguauauauuggcccacauuucuuccuaaaugucuccuccucuccuguguuucuuaaacacaccuauacuuccauauugaauuaucauaaaaucucuguuuacauuuaauaaauauucaucucaaaagccccucaacuuacugaaaaugcuuuuacuguauugguuuagagacuguucccucuuuuuaaucucuacugucaauuaaauucagugcccuguggcugauucgauucagucuaaacaauaauuauaucaauaguuugaaaaagucaaaauauuauuuagagcauuuucuaauuuuccuuuuuuacuagcuggucaugucuuguugcaugccugaguuuuuacacugugaguacaauaucuaucuguguguguguguguguguguguguguguguguguguauuuaauccuuacaacugaccagcaugaaggggguuugaggcuacagucuuggaugguaaacucaacaaguuaguacugugacuguaugcugagucugaaaauaagccaucuagguuuguguaggacagaauacuaggauaccaggaugccagaugaauuuaaauaguguagugugcuuuaucugugcuuguucugucugugcugcuuaaauacugauaaggagagucuacaagaauacuagaugugauuugugcuacuugaguuuacuguuacccagcagauuuauucauuccauguuuacaaucugaacaguucacuucauaucaggguuuagugauucugaugggcuaaaauagaaauauauuguuucauauuuuuuucacucuggagauuuaauauaagaaagcagcggacaauuggccaaagauacucagcuuugaauaugauuccugcuuuucacaaaaauaugucuuugauuaucuuuucauaaaugcaugaccuggagcuaaaauuuucugucagugucuucuguggaguuguauauuaaugguuugacuuggcauuaucagcggaagagcuaugccacuacaguauuuaaacugcaugccagacauggcagcugguacaguagauaauaaugaauugaaguuuucacaagccuugugguguuuucuuaccauuguuuguuuucgguuuuccuuuuguaugaacacaaaaggaguaggaugcaccaacuacagugaggcagauauaaggucuuucuacccuaagaucaccuuggccuuuucuuucaugcagcuucuuccaggaaggcuacuuugauuaucccacuuagaaucaaagucuuuuuuuuuuuuuuuuuuuuuuuuuuuuuggagacagucucacucuguugccugagcuggagugcaguggagcaaucucagcucugccucccagguucaagugauucuccugccucagccccuugaguagcuggaacuacaggugcacaucaccaugucuggcuaaauguuguauuuuuaauagagacuggguuuugcauguuggccaggcuggucucgaacuccugaccucaggugauccacgugccuuggccucccaaagugcugggauuacagaugugagccacugggccuguccagaaucagucuuuuuaaaaauuuuaaucguuccuugucuuuauaacuguucugucauauuccuuauuugccuugcauaugucuucucuuaacuuuugaaaacuuguaacucaagcagacucuuuaaaacaucucuuuuuuuagguuuuagcuaccggccauaggaucuaacaggugcaacaaauaaucaguauauaauauaugaaugaugaccacuuggugaaauuaacugucaguuauauagagaaagggugaugaauuuaagaauagccaacauuugguuagccauuuauagauuagaaauugcucucauauguguuacuucguuugcucucauguguuaucucauaauaguacuaugagguagggaauaguucacuuuccagguaugaaaacugucagagguuaagagauuuucccaaagucacugcaaccacuccauauuuuaacugggauuugaaaccaauuuuucaagcucaaaacucuucccucauuagaccacucugcuagaagauauauaugcuaguucuuccucauccaagucuaaagucguagauccuuuuaaaaugcugauccuccuuauuaggggauaauugaugccuagaaaaggucaccuaagugaaucuacuuaaaucaggcaccggaauuucacaguaaauagagaaaaagagauuugcuugaacuucauuguggaagugaaacuaauaaugaggaauaccuuuuauauuuaacaacauuuaaacuauaauugcaucuaugugccaauucuuagaaugagcaagaaugaaguguugauuguuuuccagggcaauuuuucugacaaguuggaugacaaaugccacaguguccuucccuuuauuguaaguguuuagccugaauuuauucuugugacuuuuccguucuagugguucuuuggucuaacuuuacuagaaacucuuuggcucaugauuuggcuuguuauucaagcugucuuaucaucacuuucauugauuuuaccaaauucuguuccuuugaugagauuuacaaauuuauuauuuauuauuuuuuuuuaagaguugcacuucuauauugcagucuguuuucuuuguauaugugguauagaaucguccagagaccuacaaagaauauaacucuguggacagagauagacuguuguguuaauuuggguggggauuaauuuuuuaagugguuucuguguuacuuuuaugaugacuuuggccuucuaacuaugggggcuuaaaugaugaauauuaagauaacuagggcucccugaauuaguaaaaauaucauauugauguucuuuacauaguugaaguguuggguguuuuuuuucuacuccgcaauuaucuacuuucaugaaaauaaaaguccauugggcuaaauauaauugauguaacaaaaaauaagcaaaugguucuagaagagggcuucauuuuaaggcagcauuugccuuaguuaacagauuaacaauuguaugcuuuguguguguguguauauacuuauuuaagcaguauuugcauaaggaauuauuccuuaugagugugauaucaugagacugaugguggaaaucagcuugagauuaauuuuagcauaaugguuaagaacugaacuggagccgggugugguggcucacaccuguaaucccagcacuuugggaguccgaggcggguggaucaugaagccaggaguuugaggccagccuggccaacauggugaaaccccauuucuacuaaaaauacaaaaauuagcugggcaugguggcgugugccuguaaucccagcuacuccacaggcugaggcaggagaaucacuuaaacccuggaagcagagguugcagugagccaagauugcaccacugcauuccagccugggcgacagagcaagacucugucucagagaaaaaaaaaaaaaagaacugagcuggagccacacucccugggauuuuguccugucuucacccuuuacuaccugugugaucauguuucaagucuuguaaucucuccaugcuagaauuuucuuguguugauaauggagacaguuaucauaucuuccucauagaguucuuucaagauuuuaauguacaaagugucuagaacagugccagacacauaguaagcacucaauaaauguuaggaguuauugugauuugauuuuuguuuaagaauuauuaugaauauuauagggguuuugcagaagaaggaaaugugaagaaaacugcuuuaaguuggcaugagaauguuaagucuucuguuguuguugucaacgaaguaauaaucucagaaauauuuguugaaggaaaaaccuaaguuugcuguugaaugauauauaaaaaacuaauaauauuuuugagcaaauauguuuaggucuucuaaccauuuaaguguauuaaaugcuucuuaugcacacccucucuucccuccugugucucuuuauucccagccccacuccuguggguaaauaaaccagauauuucuuuagguuuuuacgaagaaaccugaaaguaaauaauuuaauggcugaaugaaaugguacuuuuaaaugucuuuucucauguguaaauacagugaaauugcagugagaauuuaucuuucaguugauuacuugcuucagguuuuaggagugauggugacagaugaacaguaauugaggugugaauaaaauuuuggaaaagauaaaugauaucauuucuuguggaaaauauugcauucuuccauuauggugcguggcuguuuauuagcugucuuuaguggggaaagacccuugaugcuuguaaaacaccuguaguuuuaaauuggcuuaggauagauuaaugguaaaugauuagagaccucacuggauugacaaccacauugcauuuguaacuccagugagguagucggcacaaaaguggcacagcccuccuguggauuauuaucucucagggaaagagagaaguacagucuuacugcuaaaauuugucuuauacuaaguuccuuauuuuagaauugguuggaagauugcauuguuuuccuucauauagacaagcaauuuugaaucauuuuuaaaaagcagauucaggggcugugcacaguggcucacgccuguaaucccaacacuucaggaggcugagaguuucacuugagcccgaguaccaggcuagucaaggcuagccugggcaacauagcaagauccuaucucuaaaaaaauuuuaaaaaauuagcugggcaugguggugcuugccucuagucccagcuacuugggagguugagguggaaggaucaccugagaccagggagguagagguugcagugagccaugauugugccacugcacuccaaccugggcaacagagugaaauucuguucucaaaagcagauucaaaauaauuuuuuaaaauacuuaaauuugcuucauaaagcuguuuauaaaagcagauucaggauucauuuuuuaauugcuuaaguucgcauuauaaagcuguuucuaugcuuucucacaucaacuuaguuuugagaauaaaaagcauauauugcuaagagugaacuagcauauuuucaagcuuuauguguaaaaaaaaaucuugaagucuguuauuagugguuuuguaaaaauuucuguuuuuagucuugucaagaggugcuucauaaaaaccaggcaauuagaaugaagggaauuucagucuuaaguuauuugaguucaaagccuuuccuguguuuuaauuuacuuuguauuuguuuuuaucaaacucugguccuauuuggagaaauaaaaccacugacuuagggaguuccagcuuaccagugaggguauuugaaauuagaggccccaaaucguugauaacugagauugugccauugcacuccaaccugggcaacaagagcgaaacuccaucucaaaaaaauaaauaauaaaaaaaaauaaaauagaauuuccacuuucuuuggccacaaagaauuguacuuuuuucuuaguuguuuauuuuaggggugaaauucagucagagacucuacagggucccuacuggguaggccuucuuuugcuguuuagauuucauguggcagauuguaguaaggcucuccuaauucuuaacauauuuccaguuuuuauuaaguuuaaaaauuuaugccuuuccuaucauuccauaacuaaauauaguaaugaaauuuuaucugaagucaggaacauuauccaaaucugauuugauguguguaggguacugcacauucauugagugguacagauuguguuaaaugggccugaaauaauguucaggaaagagaaucacuuucuguucuucuugacacaaacaguuugucacagacaugcauucaucucccuaucuuguuaguguagucguuauauuuuucauuacaaguuuuaugcaaauccucuaguuuuccuugauuagguuuacaugaauacauuguaauuauagacuggguguuauuaauauaugugauuaaacauguaauuaauauguguaauuacauagagucauggcagagcugggcucuaugcugauuuauuguauaggugcugcuuacacaaagacacaguuaggauuuuaugcugaauauuuucucacacuguaaaucuacggugguuugucaccaggguauauaugcuuuuucauuuaagaauccuuuuuauggucauggcagcaaauggauuaugauuguuuuuuacuguggcuauaucaaauacuccacccagagaacccauagaagaaaaguuugucaugguucuguguaugcgagcaacacugcuguaugccagccacacccuggaaugcacagauuuuacucauuuguuuguuuguuuauuaaauguguuaagcuccauguuaaacucaucuguuaaauaaccuuuuucucuucugucucuuauguguuugguuacuuuccuucuuagcuaaauuucccuuuuuuuaaacaucgaagagcaccuuucugcuuuuuuugccgucaucuguaugucauguucuuguccaucucaucauuucacauuuuuuaaagcucuguaaacagacauaaugcacccucugcuuccuuuucagcauuuauucuguugcucuuccccccacccucccauucugccucuagacuuuguuuauuuuucuuagagaggaauucuaaauuaaacaaugcaagaaaaugaaaauggcaaggguacaacauuauagaggacuaaaggggaauagaaguaaguuacguuauugaaaucucagugugagggaauaaugaggauaacacagguuaauuuuccgauguguccuuuacccacauaauuguccaggacauagauguuaucggagagaagcuaagaagcacaauuuguaagagucuuaaaaggguaauagaagacacacuuaggcuuagcaucguuaaugggcagagagguucaggucauaguugauuugagucugcucaaaacauugugcagcauguuguauucaguguucugguuaggauguuggggauggcccaagggcccaauaacuaacaguguauaauuuugauuugagugcuuaaguagauauguuuuccugaaaaaacaugagcaguaaagguugacuuggauuuguaugcggcauguuuccaagggggaccugggaacagauguguugucuguucugaaagcauugggaugcauccauguuuugcguacagacccccuucugucuggugcacucugcccucuaaaagcuuccugaauugcuuuguaaacaaggcagcuacuacagcugcaacuguuggguuuggacuuuugccagcuugaaauuuaucccugcccuaaugcuauauaucugggagcaggcaguggaauuuuuuuuuuuuuuucuucaagcuuauggaagcauuugcugaggaagaucgucuugagggucaaggaacccagauuccuuaaaacugcaugcauucuccguggauuauuuugaccaccaggucagauuucagcaccuuuccugaacuuuucuccaguuacuuaguuggguuacugcuucauuaaaaacccauaauuccuaugucuuuuaucuuggugggccacuuggauucaagaggacuagauucagccccuugagugaaugaaugaagauuguuucucaacauuccuuucuuugguaugcuaauauuuaacaaugaaagaaaagaaagacaaaacaaaacaaaaaaaacgaaaaauaagggauaaagugaagaacgggaauucuuaagaaaucuccuuugaggauuagcgcuaccuggcaguugcuaaagugacucugugcugcauggauuuuacauugucuuuguguguuauguagagagguguugugaugucuucuuugagugccugaaaugccaguguucuuguagaaauuggaguugugcuuuauuauauucuugacuuguugaugaauuuuccauuuaagccucuuucuucuuucuuaucuggcuuuugaagucuccugcacagguggauuccuuuaugccuucucacuagaucaggauuuuaaaaauguucauuguucaucucuucauauacguuauagcugccugggcucccuuuuugaccuccuugggcugaugaugugugacaugugacacugugcaacuagaguugguauuugccaaucuguaugcuuuugguuuauuucauauuaccggauuaaaacgaaaaucuauuucauuccaguagcagcagaaagcacaaaaucuugagguuccugccaauauucucuuuuuggaacacuaucaaaaauguaacuuuucuguuggaauaaguauuuuucuggccaacaucucccccucugccccuggcuucugugugaugaaauaacauuggcuucuuuuagcucaagauuuggacuauuuaggagcccuuucacauaagaaauggaugucuuaacuaauuuucuuggaguagaguugauuaugaauaaguacuaggaggaggggcuauguagaaccuuuguaauguaauauggcauaguaaaagcaggacuaaaugagauuucucaggauugggaugggggcauauccuuccuaugucaugugauuuuaggucaguaaccaacacaguugggaacuucuccacagcuuuuggccgcuccacaucuuugaagagugcuggccugcauagugggauagaaauccaggccuucauugauuuauuccuuuugguuucagucccagaucuugaacugugcagggauuuaaacugaucagggacagccaacuagcuguaguauaaagaaaugagcuguugugcuugggggaaaaauuguuugaagaacuaaaaaugacacauuuccuuuaggcagaggaaaguuaauacauuggaguguuacuauuuuuuaagggggacgucauuccauucucauuuccaguguucacauguaaaaauaagaaagaguggggcuuuuguuuaagcuguugccaauaccaacauuuaccaccuccuuuagaguuuuuuuuuaaaacggcucuguuugacugaaaauuugcuuagggcugaaacuugaaacuugucauuuaguuucugagccuacaggcaaauuacuaccaccccccaacacccagcccuuuuagagcaagaagacuuuuuaggaauuugauaauuaaggagcuuuuuuggcauuuaaaauugcuuaccuuucuucaauacacaaaaacucaacucaacucugccuuuuuuuuuuuuuuuuuuuuuuuuuuuuuuuuuaaaugacagggucuuacuuuccuucugucacccaagcuggagugcgaugguauggcucacugcagccucgaacccccccaggcucaggugacccuccuuccuuggcuucccaaguugcuaggaccaaacggcacacaccaccauaccuagcuaauuuuuaaauuaucuguagagacagggucucacuauguugcccaggcaaucuuccugccucugccucccaaaguguugggauuacaggcaugagccaccguuccuggccaacucugccuuuacaugauagcucauccuuucgaaguuaaauuugaaauaaaagugguccucuuggcuggauuuuugaaaccuuccuaauguggaauaucagauuguugggugcauaucuaggcauuuuggcagcacuuaaugaaaacaaaugcuccagccuuucuauaccaagaugcugcuggcccacacaccauaccugugcuuugguucuuucuccuuauggugaugguagauuugcauugaacucauccagcgguucagcuucaaagaccaaaagccaagguuagggaaccauagaacuaaauuauuuugccuugugaaauuaauauuucagagaaauggauucauuguuaacauuaucaaccaauagcacccgcagucuuggaaaaguucagcgaagaggugaauggggucuuuuuuagccuucgcccaaaccucuguagcaugucuauggcuagaguauguugaucuuucagguagugaaucauuacaguuaauccuggugaaauucagcagcaaucacacuuaauacuuuagugugauaugggaaagugccucucuuguacauacacccgacacuagaugauuacauuuuaccaugcuucaacugugggggcauuuuaugacuauauaucacuuuuuuucuuuuuuuuuuuuuuaagacagaguuucacucuuguugcccaggcuggagugcaauggcauaaucucggcucacugcaaccuccaccucccagguucaagugauucuccugccucagccuccugaaguagcugggauuacaggcacccaccaccaugcccagcuaauuuuuuuguauguuuaguugagaugggguuucaccauguuggccaggguggccuugaacuccugaccucaggugauccaccugccucggccuccgaaagugcugggauuagaggcgugagccacagcgccuggccauaucacuucuuaacauacaaauugcuuaguaauauauaaccuaauauuuauucuuuauaaauauuuuauuauuuauuauaauaagguauauaauauuauguaauuauauaaguauuacauuauauaauuauaauguauaaauauaauauauaauauuuauaaauauuuuguaaugcagaugccuuuuaaaaguguauauuucacauguauuuauucuuuaaauuuauuauggaaaugggauuuuguuaguuuaaucuucaguaaaggcaucuuaaaugaucuggauuuuuuuuaauuguuuuguuuuaaaaaucaaaccucuuuaaaacaucuuaacaucuuuuauauauucuggggucuagcauacuccagagggauuugguuaaaauuuuucugaauagaaauccuuaaggaagcgagugaauauaugaauaaugagggaggaaguauuuggauauuuuuaaggaaacaaaaaggcagcccuaauuuuagcauauggggucuaaagauaccauuuacauuuuuauaccaauauaaagucaaggagaaaagaaauauccccaugagaaaacugaagaaaccaaaguuaagcaaaagcuaauugaagaaucauuuaagaguaaaggccuacauuuuaugaugcagaugccuuuugaaguuguauauuucacauauauagaaaagcuuauagaaccacgccuagcuuugucacaucuuaacacuaugccguguuuggacguccucucucgugucugcccccucccucaccuuacuccuuauccuuccuccuaggauugaacuauaauccugaauuuacuguuuaucaaucccauguccauuucagucaucuuccuacgaacauguuugucuguaggguguaguauuuuugcauguuuuagauaaaauauuaaacauaaugauauaaaugcuguuaugcuguuguauucugaaauuugcuuuuuaccuucauacucauuggugagauucaucuugaugccuguggcucugguacacuuauuuucacugcuauauauauuuuauguuuugugaauaucgcuguuuauuuauuuauucuccuguugauggacucuuucuuguuugcaguagacuguuacauccagugaaaggaugaccauucuuauaugugucuuucugugugccuucuacuuuugaauguggguaggaauuucucuaggguaacaccuggaaguggaguugcuuuggacaucuuuggcuuucuuggauaaagcucucccacgugauugugcucauggcugguagcauaggugcugugggagaacucucauagcuucguaucuucuucaauuccaguacugguauugccagaaaauaaaauuuucauugauuugaugguagugaaaacauaccuucuuguuuuaaucugcauuucugcuggacacacuggcuugcaccuguaaucccagcuacuuaggaagccgagguaggaaguuggcuugaggccaggaguuugagaccagcaugggcaacagcaagaccccgucuuuaaaaaaauaaaaauaaauuagccaggauugcaugccuguaguccaagcuacuugagagacugaggugagaggauugcuugagccuaggaguuugagaccaaccugggcaacauagugagacacugacucuuuaacaacaacaaaaaucugcauuucacugacuuguaagguugagaaucauuucacauuuauuggccuguugaguuuucucuucucucaguuuccuaaugccgaauccuuugcuguuuuucuauuggauuauuuuguuuugucuuuuuuuuuuuuuuuuuuuuccugaggcagggucuuguucuguugcccaggcuggagugucucacugcagucuugaccucgggggcucaagugauccccgcaacucagccucccaaauaacugagaccacaggcgugcaccacagugccuggccuucuugauaauguggaaauguggaaauucuuuauguucugaauacuaauccuugcggguuauaugcaauuaaguauauggcuuguuuuuuuuuauuuuuauuuauguuauuuuuuguuuuauaaaacuuuuauauuaauuuuaaugcaggcaaacucaaucuuuuccuuuaugguuuugcuuuuugcuuauuuaaaaagccuuuccuacuucugaggucauaaaagguacuuucucucccuuucucuuuuuuucuucuaaaaguuugcguuuuacuuuuguuaaccuaucuggaauuuuuguguaugauaugcaaaugggccauauauauauauauauauauauauauauauauauauauauauuuuuuuuuuuuuuuuuuuuccgagacagauucuugcucugucgcccaggcuggaguggaguggcaugaucuuggcucacugcaaccuccaccuccuggguucaagcaauucuccugccucagccucccaaguaucugggaguacaagugugcaucaccacacccagcuaauuuuuguauuuuucauagagacaggguuuuaccauguuggccaggcuggucucgaacaucugaccucaagugaucugcccgccucagccucccaggguguugggauuacaggcgugagcaacugugcccagccuaauuuuauuuuuuuucuaugaggauaucugguuguuuccaugcugcuuugaaaaacacacauaaaaaaauacuuuuuuuuuuucuaaaaacugacuuuuguuuuugaaauuuuaaaaccaauuugaacuuugaaaaacuaauuucaggccgggcacaaugucucaugucuguaaucccagcacuaugggaggcuguggagggcagaucacuugaggucaggaguucgagaccagccuggccaacauggugaaacccugucucuacuaaaaauacaaaaauuagccagguaugauggcacacaccuguaguccuagcuacuugggaggcugaggcaggagaacugcuugaacccaggagguggagguugcaguaagccgagauagcgccacugaacuccagccuguaugacagagggagacuccgucucaagaaaaacaaaaaaaauuaaaaacaaaaaaauuaacuauuuucagacuuaccaaaaaaaaaauugcaaaaacaaugccaaaaauucccauagacguuucaucuagauucuccaaauguuaacaucuuacauaaccacuguagaaccaucaagucagaaaguuugcagugguucaguacuauuaucuaaucuccagacuuuauucaaauuuucuuaguuguucucacuaacaaccuuuugcugcuccaggauucgauucaggauuacacauugcauugacuagugaugucucuuuaaucugugacuguuuuucaguuccaccuuugucuuuuaugaccuuccuugauaguuuugaagaguacuggccagauauuuugaagaaugucccucaguuuggauuuuuuugauauuuucucaugguugaauuuguuaugcauuuguuugcaagaaugugauuuguguccucaguguaacguaugaggaagucuauaauacccauuuauccuguuauuggcaacguuaacuucaaucauuuggcuaagguggugucugccacguuucuccacagugaaguuacuguuuuucucuuuguaauuuuagcaugcauucuuuccuaugguguuugcuaaaugauuucuauucccaucauccuuuccacauuuguuaguugcaguucuaucaguaccauuuauugaagaguccaucauuucucuagugaguuauguuuaccucuguacugauuuauaaaucuacuucuacaucucugcuagcaccuaacucccuucauuuagaguuuuauacccuuuugccuucucaccaguaacauacaaaggugcuauuuccccucagccucauaaacggaguauguagucaaacuuggaguuuugccaaucugaucagugaaaaaaaaaauguuaugucucuuauuaugaauaaaguugagcaucaguucacauguuuugagccauuuuugcuuauucuucuguauacucccuguuuauguccuuugccuauuuuucugugggaaugcugguauuuuucuuuuagauuucuuagaagcuuuuuuguuuuguuuuguuuuguuuuguuuuugagacagagucucacucuaucgcccaggcuggagggcaguggcaugaucuuggcucacugcaaccuccgccucccggguucaagcuauucuucugccucagccuccugaguagcugcgacuacaggcacgcaccaccacacccagcuaauuuuuguauuuguaguagagacaggguuucaccauauuggcuaggcuggucucgaccuccagaccucaugaucuguccaccuuagccucccaaagugcugguauuacaggugugagccaccguaccuggaccuuaggagcuuuuuauauguuaggcauuauaauucccuugucugugauagguugcgaacauuguuuuuccaaguauaucauuugucuuuuggcugauggcauuuuguuuuauuuugcuaugcacaaggguuuuuauaaaauacauuuuuauguacacaaaguuauuuuuuauuauuucuggaucugccuuuucucuaacuuuauaacagacuucaaguuuucuuucaaaaguuauguggguuuuuuuuuguggggguguugggcuuuuucuuaaaaaagacuuaauuuuuuguagcaguuuuaaauucacagcaaaauuaaaaagaagguacagagauuuccuuguccccauacaugcauagccuucccuguugucaacauccucuaccagcgugguacauuuguugcaguugaugaaccuacacugacacaccguuaucacccaaaguccaugguuuacaucaggguucacucuugguguuguccauucugucgguuucaacaaagguauaaugacacauauucaucauuauacaguauuuucccugccuuaaacaucaucugccuucugccaguucauuccuucuucccuuauaucccuggcaaccccugaucuuuuuguuguuguuguugcugagauggaaucuugcucugucaccuaggcuggaguacaguggcacaaucucggcucgcugcaaccuccgccucccggguucaagcgauucuucugccucagccuccuguguagcugggacuacaggcgugcgccaccaugccuggcuaaauuguuguguuuuuaguagaaaugggguuucaccauguuggccaggcuggucugaaacuccugaccucgugauccacccgccucggccucccaaagugcugggauuacaggcgugggccaccgcgccuggccaaccccugaucuuuuuacugucucuguaguuuugucuuuuccaggauguuauauagcuggaaucaugcaguaugguugcuuuuucaguuuggcuucuucauuuauuaauaugaauuuaagguuccuuuaugucuuuucauggcuugauagcucauugcuuuuuaacgcugaauacuauucuauugucuguguauaccacaguuuguuuauugauucaccuagugaaggacauuuugguugccuacaaguuuuggcaauuacgaaugaagcugucauaaacaucugcgugcggguuuuuguguggacauaaguuuucaacucuuggguaaauaccaaggagcauuauugcugaauuguaugguaagaguauguuuauuuuuuuaagaaacugccaaacugucuucaaaaguggcuguacuauuuugccuuccugccagcaguaacugagcauuccuacugcuccacacccuccccagcauuugguguuauugguguucuggauuuuggccauucuaauaggcauacagugauacaucauuguuguuuaauuugcauuucccugaugaaaucugauguggagcaucuuuuuacaugcuuauauauaucaccagcaaauaagcauauauauauauauauauauauauauauauauauauauauauauacacacacacacacacacacacauauauaugauacauauauauaaaagauauauauuauauauaugagagauauauauauauauuauauauauauauauaucaccaccauauauauauguaggucugauuuugacaguauucugauauauaaugugaaguaugaaugcaauuuaauuuuuuuccauuggcuguccaguuguccaaauaucauuuauuaaaaaggccaucuuuucccacauugauuugagaugugacgucucaucauauaccaauuuucuauguauacuuuuuucacuuucugagcuuuuuguuuuauucuauucuguuucuucacgcagcaaaaccacacucuuucacuuguagaagcuguauaauauuuugaaauaucugguugugccugccucuucccuauccugauguagaacacagacacacacguacacuguuuuucuuuuuuagguuuucuugguaauuauuuggucuguuuguuuuuaauuuguuuaaguuuuuauagccaacagaccuaguuggcaucuaaguagcuagcauuucuuugcuauuucuagagacuuucuuugccaccuaguaucgaccaauucuuuguugauaugucauuuauucugaaaaagaaugagcauuuuauauaggcugggugcagaauuuuguauguacaucacacauuucuggaaauuuaaaguuuuugugggcuucuaaagcaaauuaugcagcauguguaagauucagggauauccuacagccugcucucaugucauguucaucauauaggucaguggguagaccgcagguggacugugaacuggcuaacgcuaugugaaagaggguuucuauaugugauuuuucuggagagaagauacaugaauuuuaaagauguuuuaucaucacaaaaaguuagacuguuccagguaaaggugagaaaaaagacuggaauuuaaauacucuguuaaaaaaagaaugaggauggcuuugaaaaauugaaagaugaaaaaaaacagcucuuuuuauacuauggugcucaggauacauugacuauaaaauuaaaguguguuuuaauauauuaguagguaaaguuucugagaggugaaugucuacauuuacaauaaugguguuuucucucauauuucuuuuagguaagugacaaucuuaugcuuggauacaucagcuucaaaauggauggauuuugaggguuucauuccucuucucugaugcuguagcaguaagucauacuucucaugugugcucuguucuggucuggucugggccaggggauuggcuugacaaaagaaacuagauaauuucuuguaaacacuuugcuucuuuuacuugauauacguguuuuguuaagaacucuuuguauguguagucucugagauugcacagaagaauaaaaggaccagcuuccaacuuucaagaagacuggauuuucguaaggauacaacagaaagaacuuggguuuuggaguuguauuagguuugaauuucacuuuuucauuacugugugauaacucaguuggauaucuuuuucuucuucuauuuccucauuuacucaauagguguaauaauaacuacguaucagauuguugggaagauuaaaucagggaauaucuauccuuaucacagugcuccaauauauagauuuuguugcucauuucuucuuuccagcucuaucccauggcucagaaagaaacaacaaugucuagaacauauaaaaauagagacuaacucucccuccuguuaucugaagggucuuuggcugagauucaggaaaucuuggagaccaggcaccaaaggauuuuguaaaggaaucuguagugggucuaaguaggcacuuuuuaaagcaucagccaucuucuugaaugucauagucacauuaaaagagccuaguuaaauguggcuuagauauuguuucacaaguggccuuaguggaaucccuguaaauaaauauguuagaauauuagguugggaaaauauuguuuuguuuaaucuaaaauggaauuuaaacaaaugacuaaagaauguaagcugagauuguuugaucucaugugauucuuuaaauaauugucacauuguuguguuuagaauuaucuagcuaucuggccuaguaaacagaugagcaauauucacugagaggggaaguauauacaauuugguuuggaacguggaagagaaccaugcuuaaguuggagagacacaagucagaaaagucagggggagauucaggcauggccauuuuaguucauauggcucaaauaccucuaauccaguggcauaaggccugacaagaaauguuccucucuaaggagaugcuggggccaagggagacuacaguucauugcacauucagagauuaaaauaucuccaaauuaguuccagugaaucauuuuaaauuauuuuaaaagccuuuuauauuuuaaucagagccuauucacgaccaguuaauuuggauggcacguucuaaaauuacuuucccccaaugauguguugugccacugccauugaaugcagaaaccucacggaagaggggauuaaggaaauuugaaaguaccaaggagcuguugaucuuagucaaguguuuacugguuuaugaguagauuaagauuucguucuugucaucugauuuggaugggaaaaugaguaaugauacucuuguagagagggugagugauuccauaggaugccaaaaguauggcgaugugcccauuuccccaaauauucagggaagacuugaugcuguggcauugcugcaguacuuucuucaauauuuggauguagucucuggguuuagggagguauuguuuuaaccaucuuugcuagucucaaaauuuuuauccaccauuuuguuaaucuguucuacaauuagcaaaggggugcaugccuguuaagaguuccaacuguaugguacacuuccuagucauuaacguaacugauagaguacaaugucucuauugucauugagaauaaaaaaaugagcuauacagaucauguguugguucaaguuugacuuuuaugcucuguuauucucacuucaaagaugaugagacugaaacucaaagaaagaagaccugccuuggguuacauaucaguuuagugauggaacucuaggccagcgcuuuuacugauagugaucuucacucucugcuccucuuugacuggggaggagccuugugcuuagcuguacuauucuacaucuugauacauagacuuuucauuuugugggagaguagcagcaaguccuuggaaguuguucauuuugcaguuagcuaagguagaggggcugguaauguucaguuuuucuguaccauucuccugauauguuggcucaagauaccagaaucuaucuuggaauguuguguauuacccauuaguuaccaaucuucugcuggggaagaauauaaauaggagaaaaaagagauggacaggaugaauuuuuaaauuauagcacugaguaacaacugcuagucaagaaguuuuuggcaguuuguuagaaucucauuuuaaagcaauaacacacucagaguuguauucaaacacugagauaaaugcaucaaccuaaauucaugguuuuguuuuuuuccauguagcugcuaauuauugaacauaacgaggcuuauucauaauuucuuuucuccugcuugauagccauaauccuguauuuaugcugcugucauucccaugguaacagacuaaugucugaagcauaagauuauuaaauacagcacaguacauuaaaauaaugcuaagguuuugacuuacagagagacuuucacacuggggcaaacuucaaaaaaaaaaaagagaacgcuuauacagaaagcaauuuacuuggccaguaauguuuaguauucccauagcuauuauggcagagauuuguuugaauuauagccucuuccuucccagcccaucaucuccuuuggcuuugcagccaagucuuaaucugguguuuaugaugucagccuguugccaugggaguuauucugucacagauguauugugacuucacugcaggacagaagcaguggaaaauuuaggaugaaauagaacaacucuaaaguuaaucuccagcauaucuguuuuggaaaagaaguauucccuucaccuuuaugugcuccuaaaaauaaauaaauaaauaaaguuaguuaaguggugacuuguugaagguuggccaacgaauauuguugaaaugaccaaaaugccaaaaagccagcacuaaggaaaaaauguuauguagcucaacccuggcucucugaagaguggucaagauuuauguuuuuaauccuaugcuacaguaaugaagcacaaccaugucuguagcacauaaauugauacaccauuuuuucugguuuucuuguaaaggacuuucuucuaucuuaaaucuaauguggucacauucacaaggacacgcgcccuuugcuuccaccaccaaugacaaccacaucuuuauuauucacagacauauguggaggcccugccaaacugagaggcaucuuugaagucaaauuuuguagugcucauagcacguuagcauuauggucccucaggggccccuucaucaucugguaucugggacagucucccauuuggauggcauaaaaauaaucuagguucuuuccuagggaugagagauuucuacagaguuaagcuaaguacacaggugauccugugugcaugaugaacucuuugaaugucaugaaccaaugguacaaauggaaugcauguaccuuaaaucauuucuuuaaaaaagaaauacgggacagaaggagaauaaaaugcuauguagcaacuaaaaucuuuuggacuauguuuaaauaauauguaaaauuaggaaauuagcuacagugagucuuuuuuaaaaaaaguuggaauuacaggguuuaggauuuuuuucuugcccucuucuuccauguuugaacuuaauagagaguuuuaauauccuuccccuuauuaaaauaaaccauuaaaguaggcaagguuaagcaaguucacauuucaaacaucuccgauugcuggcgauuugucacuagaaagcugugguagucaccuuggaaucugcauaccuuuuuuuguguuuaugagaauaaucugucuucugcucucucacccaaauccuucuuaaaggacuggggcucugcuguagaaacucaugucagcauaauaugccauguaccucuauaaugauuuuuuuucagcauuuuguugagccagcuucagaaacagcagugaguauguguguaaaugauuugcuuuaaaaagcagauguagauuaaugcauugguuuaguaauuuuuucccaacucuuuccuuuucccuuuaucuuuuucucccccuucaguucucugggauaaucccaaugagaaaucugaaagaagguagaagaauuuguuuguuuucuguacuuuacgucaaugauucccaaacuuggagagcaucaagaaauccugaaugccugcugucacccccaaagauugugaucuaauuguuugggggugugguuugggcuuuggcauuuaaaaaauaucuuuaagugauucuaauauacagacaaguuugcuuucugcuuucuauauaugaauagcugaaaauugaacuaucaaaggcaagucuaaauaucacacguguauuugauuuuuauaaaucuguugugccccuuccuacuuuaugccaagucucauuuccucuguauaagaacaugcuauaaaaguaaucaaucucugacccacgaauuuuucccuuucuuuuggaaugaauaauggaugaacauuaauuaucucuagcguuuuguuuuguuuuuuuauuuucuacuuuuuaaaaaaauuggcuucaaaauuuuaggaaauuuugcaucaagacuauaaaacaaagucauguggcucguagggaaaucaacagagcuccuguuucagaaacuugauuagcacuggaaauugaacuuuaguuuuugacauuggguuccacacuaugcaccaucucuguagugugcucagucugcaugcagauuguuuuccuuaagcucuuuauaaauaagaugacauuaaaagaauaguuuaaucauguuuucguuuuucaauauguaacgcuagagaagacgagaaguagauuucuucaucucauaaaacaaacuaccuuugcaauaaaguucugacuaaaacuuaacccggcauuuuuuuuuucauuuaucuugguuauugcuuuucacaugucucgugguucuuguaaacaugauuuucccucuggagcuagauagaaagcuaaagucauaaaggaaaguguugguauccaagcaucuugcuucugauguuuagccuuaagaaauauauuugagcuuaaaagaaaaguaauagguuugcuugaauuuucuuacuuuuccuucacauucucuuuuacugcaucuauggauagcucuaauacuugcuuuagauagagaucugauguaauuuuauaaagcagugcuguaagaugacugcaaaggauguuaauauuucuguugacacugccuuguagauuuccaaugagcaugugcagauguuaagucuguagaucuagaucuguaagcacaaccauugucuuuguucuaaauguuugaauuuguuuuagauagucaaaaugauuacucuaccuguacauacuaugaaaaagggcuucccuaagagcuuggguaguuuuuucuucugaccauccagaaagguuuuuuguuuucuuuuuuuuucuucaauaaauucagccuuuucauagcagaugauuuauuaccguggucggugacucuguauuuggcugauuuauugaaaaguccauuuauuaucaguaacuuuaguuuauauucaugguaaggacagugcuaaugccauaaugcuuuguauuuucucauuuuuuucagguuuguuccucuuucauagcuauguggauuaggaacuaaaacugaaaagaucccuugucaaauuucagauugaauuuuaagauacaaauuuuaaugagauaauuuuggaaugaauggacccuauaagguuauucagagcuguggauuuuuuuuuaauaggggaauaagaaugcauucuguuuuuaaaaaaugcuaccucuauguuuuuuuuuuuucagauacuguuaacauuugcucuuuuuucuaauacuuuauuuacuaagacuucauucuucuguuugauuaaugacaaccccgaaaaguauauuuuaucccaacuuuucuauuaagucuuucuuuccuucagucuucugugaaaucuguuucauuuaaaauuuuuuucuaauucuaaagguagaauaucuuuauguugauaaaaaagauaauccauaaaaguauaguuuagaggauaaaauucagcuauaauccuaccacucagagaaaaauauucuugauauuaauauuuuucaccuuccaugcauauuaccaugccuaguucagauuagacucuucuuguuuuuauuuauuuaauauuguauuauuugcagucuucugucuuuguaaauauucuucaagcauauguuuuaaagacuauauaauaauuaauuuuguggauguaucauaauugaaugggcuauuucuccuuuuuuuuuuuuuuuuuuuuuuuuggaagagauggggucucgcuauguugcccaggcugguuugcaguggcuauucacaggugcaagcauggcauacuacagcccugagcuccuggcccaagagauccucccugggcccaggagccucagccuucugagcacaugcgaacuacaggugcacaacuacugugccuggcuuguuucaccacuuuuaauccucuagauuuuuccagaauuuugcuauuguaaauacugcuuucaugaauaucuuuguauuugaucuuugccucuauuauauaguguuucuuugcagguuucacaauugaaauuccugggucagauaaugguugucuugauuuccuuccuccuggcuggaaaugaccaucucaccacauggucauuuguguuugggaaugcgaauguuaguuuuuaaaguaucugauaauuaugcagaggaaaaauauaauuuugcuuuaauuuguguuuauuugcugucagcgagguuguuuuccuccaaaaguuuauuaaccauuugguuuucuuuucaguaggguuuuagguucuuuaacccauuucugaaucaauguuuaauguguacguauaugugugucugugugguguuuaaucaauguaaauaggcuuuuuagaguagagguaauaagccuuuauauguccuauuauaacucuuuagaaauucucugccuaauuuuugccuuuucugcuugaauaggaaaagcuuuaagaaaucauugaacuuaaugaaugauucauuuauuuaacagacacuuauugaguaucuauuacgugccaggcacuggaguaaauagacaaauaucucccccugcauagaacauauauuugaguggggaguaagaaauaaacaauuaacacaauaaaugaacaaauuguauaguauuuuaagaaugacagcaacuauggaaaaaaauaagcaagguaagaaggacuaggaguacuagggaaaggauuacaauuuuaaaugggaugguuaggacuggcuguaaugagaauaugacaugugaacagaaacgacuuguuguuuuucuuguauagaaauauuuguucuuuguggugauauuguuagugugggccugauauuuuguuuuuuuaauaacacagauuuaauucugugcucugugggugaucuccuuuuuaggauagcuaaaaugaaucaccuugguccagagcccugcuguacacuguugaaggggucuguaaguugaucuuccugucugcaugcaugggcgggaacucugccuuuaaucaggcuccaccagcuguagcaccagagcacugaguuuguggccuuuguaugucagaaugugcauagcuguaagagaaguuuugucagugugaaucugaggguggagugagauuucuucaccaccuggugagaaauaaucugucuugcaguaagugcuaguguuguuuuguuuuggggaaaaaggaaaaaacauuuuucaugaugcagguguugaaauuucuggauuccucucucccucccgcauccuccuccucuucucuuuugccuuuuccuccuucuccuuuuauuucuacuucuuuuucuugcuuaauuuuagaauuugauucuguugcuggauguuauuuauucucuggcauaaccauugcaguucguuuuuggagcugugcuccacggccauucacauuuuagaauggaacuguguuguuuugucauucaucacucaagucugaaagaccauuguaaucguuuugcugauaaagaacaugaauguaaagaagaaauagugguaaaccagacagcccugagaguguguugucuugaaaaggaacaugagaucacagagaaguucuuuauuuuuguucauuuaaauugaugaauucuuuaaauuguaugucuaauuguacucauuuuuuuuauaguuuaaugcagacagguuauaagauucuagacgcuaauucacacugauuucuuucacaaguuaggagacaauuguugauucauaaaacaugagaggaacuuuggguaauugucgauugcaugacuauucugugcauuucuauugcuuugcuaucggcagucauuaaauggauucaauuugaaaucugaaugagaaauuaguguauucuuaugaaugugccucacauaaguuuuaaaugaaguguuugacuuuuucauacauaucaacuuggcaaaagaauuuuaauuauuuuauuggcugaguuuaugagauucauaguucaagauuacucaaaccaggguacauuuagaaauaaauacaauuaaaugcucacaaaugugaaggucuuaaacaggaacugagcuguaauaauuguuuaaucuagaaacuuccucuuuuguuuugcuauacacuauucucuuaauacucccacccucccccaaccuuuuuuuuuuuuuuuuuaagaguagccuaaccuuuugcuggugacuccgggaaccuauuagaaaaugaaugguggugcuguuucaguuuuccuuucagccuuucaguuaacuaaacacuuacaucugaucauugucacuuaguuuuucaaagcacagguguuuucucuuacccuucuuucucugccucagucucuccccugcuuuucuccuucucucccucuguccccuacuucucuucuuccuauauuccucuacacuuccucucuccuucucucucucgccucccuuccucccucuccucccugccccccaacccuuuccccuucucccucucucucagugaauaucaccauuucccaauauaauugggcuuguccaguucgacuuguagaauauuggagaauuucagcuugaacauauacucugagcaggagugguaagaaaugugacuguuuagcucaaaaauuaauagcuugaaaucagugaagccacugucacaugcuccaucuuuguaagcaccacugcuuuuccuuuuuucuccugugacauggggggaggugggaugggaggguacacaguaaucccacuauccucugauggcucagaauaaggagaaaagaggcauuaauggcucaugaauguguggaugcacaacucuaaauaaguaccacuuacgacugucuccuaguaugacuaugacuucucuguuuuaguucccaucuuugagacuacaaguagcucagauucgauuuugauagucgcacauccacaguauaauuuacuuacauaacagguguuccugaagauaaguaaauguaacuuauuccuacuaacuucuauaauuuaaagaauaaagcuucuuuuguauuauauaauuauuagauuauauaucuaauuaauuauuaguagaagagaaaaaaaaucauccaugaaccaucuccuaggaacagaugaccaauauugauaguuucuuggauuucuuuauaggcauuuuugucuaagguuuuuccuuuuaucugccuguuuuacuuaguugugaucaugcuauauguaucaucuuuaguccuguuguuugcacuuaauaucaugucauguguuuucaauuguuauaaacuuuuguaaacacauuuaaauacugcauaauguucuuuggaauuuacauagcauaauuuaaccauucuccucaguuuuugaaaacuacaugugguauuuucaaguugcuugcuuuuauaaacaaugcuuugacaaauaucuuugcacauaugacuuuuuccacauugaggugauauuuccagaaauaaaguuaugagauuaggaacaccguguauguuauuuuaaauucacaaggcugugugagugaagacauuguuuuguuugucuguuguuguuguuuacauuuuuuauuuggaaaucguuucaaacuuacugaaaaguugcaaaaauaguacaauguauacccguauucauuuuacacggauucgccucuuauugacauuuuguuccauuugcuuuaucauuugugucugugaacucucccucugucuuuuucacuccuuccuucuuuaucuuuuucccuuccaucuuucucugugcauuuuuucugaaccauucuaggguaaguugcauccaccaugucuuuuugccuccaaauacaucagaguauauuuccgaagaauaagauuuucuuauguaacuaugguauaauuauuagcuucaggaaauuuaacauugacauaauacuuuuaucuaaucuucugucagcauucuccauauuucaguuuggucaguugaucuaaugauauccuuuauagcaauuuuccucccuacagugcaagauccaguccaggauuacauauugcaucuagcuguuaugucucuucaaucuacuuuaauggggaacaguucuucaggcuuucuuugucuuuugugacauugacauuaaaaaauauacagaacucccccaccucuuuuauuuuuuagguaaaaaaguuuugaguuugauguuuugucaugaugagauuaaggcuguguauucccaaccagaauaauacugaaguaacauguccuucacuauuauucuggagauuacacuauuacauccagagguacccaauguccuucuacccuuuguuggugauaguaauuuugguuaucugaucagggcauugccugauuuuucuacuguauaguuacuauauuaacccuuacaacuaauaagcaauccgugggaaggcacuuuaagagcaugcaaauaucuuguuccucuucaaaacucaccccuuagauuuaacaucuauugaugauccuugcuugaaccagucuuuucuauggugauuuuccaacuauaacacuucaucaaccuuuaccagucaguaguuagcauucuccuauaaagaauuuuucuauccauucauccacccauccacccauccacccacccacucucauugucugucagucugucuauccaucuaucugucugucugccugucugucagucguauugacuuauagacuccccuuuuuagugguguauaguucacuacuuuucuuaauuauuuuggugcucaaauuguccuagauuuaauuggugggggccccuuuagauugucucuuguguucuucuaauaugcucccaucauuuucucagcacuaacuuuuucuggugugagaugugcuaggcuuaucuuguccuuucccugcccuagcccuguaaucaaccauuucucugaugacuucuguuuuuguuuuuuggguaguuuuguuuguuuguuuguuuuuuuuuuagaggagaaagguauuagaaaccaauauuggggugcuaggugugcugcuuacuaacaggguagauuugauucuaggccuuuuuuaggagacaggaaaaauaauauacacacacaugcaugugugcauacacaagcacauauuuuaggaauugugaguucacacuaauacuuccaaguucaaaccauuuucacagagaaugcuuaucuccauucuauaauguauuauucuuccacagugaaaacccugcugccuaacacauuuguucauuuacucaguccuuuaauacaucuaaaaauagauucaaauuaugucacccauacuacuacagaaaaagaccuacuaaaaaguucaggacauguuuucccuccacacuuucuuagaauaggguagauaguaaaauuuugaguucguaacuuauauuauucuuuuucucaccucucuucauagugguuauguuuuuaauuugaaguacaauuucccuuugcuucauuuucccuuugcuucauuuuccuuucaauuuuagguuuuuaucuuucccaucuuuguuuauuaauuuuauuuuuugaauauguggaacacuaauaagcuuuccaaauucaaaacucuguauaaagguauacugagacauguauuacugcuagaaguuggucauuuauuuauagcaaaugggguucaucucuucaaguuuaaaaugaucaacuuuauuuuuuaaucaagcauacuuauuagauauucaaagagaagaaaagcaacccuugauucuugugaccagccuuagcuuuuuguauaguagaaaauaagagauguuugguucacagauaaggcaagugacaggcacuucacgacagaggcuugcuuagccccuuugucuguguacaauggguuauguucccugcuuccauacacuguugcuacuugguuguuguuguuguuuuuauauuuuacuucuugaugcuagcuuacuggugauaaauuucauuaguucccacucuucuaguuuaacuuugaaaacaucuuugaauaguggguauaucaacuauaugcauuuuucaaggguuaagcucuugaucacauguugcuuugguugaauguuugucuccuccaaaacucauguugaaacuuaauucccaguauggcaggcaguauugagagguagagccuuuaaggggugacugggucaugaggcucugcccucaugaauugauuaaucuauucauggauuaguggauuaaugaguuauagacuaauagguuauaauagaaguguagaacugguggcuuuauaagaagcggaagagagaucugagcuagcggacucagccccuucaccaugugaugcccugagccguccugggacucugcagagaguuccuucaaacaagaaggcucucaccagauguggcuccuugacccuguacuuuucagccuccauaacuguaagaaauuaauuccuuuucuuuauaaauuacccaguuucugguauucuguuauaagcaacagaaaauagacuaagacaugugucuuuguuuuuuuaacaauaagacuuaaaaauacauuuaauauaaaggcugacauauauuccagcucugcauaggauauaaguguuccucccacuuaggguuguggucagauauauaagcuuucuuuuuuaauauuuggaauuuauggacuuugcccaugcaauagucucauguccuuuucuuuuucaaaauuacaacggguuuguggaaugauggacucacaacaguuaauccugaaugacuuaaugaacugccagacagguuaaggugaaaugguguucuaggacagaucuugauuuguagaauuaaggguggcaacaaacuucaaaauugcuucuuucauuccagcagguaauuuuguuagagguaacucaaguaaucuuaauaucugaauguguucaguuuuauccuguucuuauacaggaaaucccaaugcagggaagaaauaaaguagcuugaacaccaaagauacuagaaagguagagucuagggagcugucagcaagcuuugcuucuauuuuuuauacuggucaguugugacuuuuguuaagucaaagaacuuagaaauuuagaugaagggaggcugccuuugugcagccaguuagcuggucugggcagucaauuugaguggugaaauuaaggcuuuaucuacuuauauuugggaggaauuuucuggcagauugcaaaaucuugauuaaguuagccccaguuuaauauguaccuguggcgggcuuuuuuuuuuuuuuuucuuuaauccuuuacauuuucuuguuauaaauuaugaauugguccacuucuuauuagacagacuuuguauacauuccaaggcaaacauaaaguaaaaaucauauuuucaaauauguaauagaauaauugagaugauucucagaugcaugucccuuaguagagucauagugaaggcauuugcuggcuggcuggaggcauuguuuuauugucuguuucaacucuugagagaaaugaacagauggagaccuguauuagaaguacucacacauagaaaaagcuuuggaauauuuuuagcauuguacucaggagcagcaaauccuauuuccacaauuuuguguauuuguuaguguguuaucuuguuaagccuuuuuucccaucugcauuuaaugggucaguuguuucuaacuuguucuuuugaaauuuuuaauugaaaaucuguuuuuuuuuuuuuuggaaagcacauuuuacaaauaaaggcuguucagcuagguggcuaggugguaaaaacuaaaaugaguaugaauguauguuuucuguaaggguucugaaaacaauaauaggaucucuuuaagcucuacuguauagggaggcgagugauccaucaaaagcacagucuuagauuugggucuucuauuuagauuaggaauguuaagaaagauggaugguaaaugucuuuuagcuguauuguccccaaaacaugaaaugaaaucuaaagacucucaaagaagguuucaauuacacuagcaaaugacuugaacaaggauuggguaaagggaggucacgggccaguggaaugccaguuguggauuuauauuguuuaaaaugaaaacauuauuuccauuaaccccuuuccacuaacaccuccaccagaguuauuuucagacuguacguuuguagguguuagucauacuugauagaaaugccuuaucacaagugugaauugcacagccuuuccauggguauauauuuuuuccuuguccaauacacaauccaggguuucacuuggcuaauccucuagagagguacuggcaucccuguguucuucaaacuugauuuuaaaauguagcaguaagcuacccaguugcaaagaagcauuuguaaauguuuuaauuaaaaacagaaugaauggauucuguguugugguuuucugugauaacagccaaucgacugccaaaucacacuguguacuugaguuuagggagggaagagucuagguuuaagggugacucucaauggauuugcccuuaacugucaauguggguuugagugugguuuuugcccucucacugcaaauggagaaaagaguugguaagcagaagaugaagcauccuuuuaaugagucggcuauagugugcacucagggcagacacuuuaaaagagcaccauuaauuugaauaaaacaggagaagguagguacuuuguacauccauaaagcacugaaggggauaaauccaauuaucuguucaauauuuaauggccaugaaguuaaaaauuuuaaaggcaguaccucggagacugcuuagucaauucuguccauauuauuuuugacauucaaaagucaagguagaauagccauauugauggcagugcucaucacguuggucugccgauuuaguggcagugacccugggauuuguguuucucuacacagaugaagaucaguugcaauuuuuuuuuuuuuccaggagcucuuagggaaaccuuaggaucuacugagcuuccaaccuguuucuuucaguccuuugcuauuggcucuugcuaugaaagguaauuaaggaugauuaacuuaaaaauucagaugcaaaagaaccagaauaaagaucagccauuuggguuaacagaagacaggggauuuuaauaaaaucuguguuucagaaauuccuaagaaacucuguuagagacucucuaaaauuccaacccaauuuuuauaaacuuuuuugcacugugcauauuuucuaagcaagucauggggggaaaagauaauuuuuaaagucugccacgucugucuguucuacagcuguacuuagccacugaugcaggugggcauugcucugugguucaaaggcagcugaaucauaaagcuucuaagaaaaucgaugcuguagcgacacuuggaaugaaugucaguaugacagugauuuuugugauauggucuugaagcuuuauucuucuugccuauuagcuaauacaggauccuaauuagccauuaacaugcucuuaccuuguaugguccaaacuauagaagcauaucucacuguauuucagagaauguaacugcugguuaccuuuucacuuauucuguuuuauguauuuccuuucgcauugaauauucuccuuuuguacauuucugaaauagagcuguacgcuuccugggcauggauagcauucgaucccuuucaacauagcuucaguugccuguagcuaucuaccuguuuauuuaucuaaacuaauacuauguacagauaaauuuugacaugaugcagguuuacuguuaaaauguuauagaagaaucaugcaggaagacaacuuuaaaauagauuaaagaagcaaaaguuaauacauuguaugaguuaggagaugauaauaagacuuuuguuuuaagauaugucagaguuuuaagaagggcuagccuauugugagagcuuuuaaggagucugugauuuuccuugggaauacauguaaaguccuuuucuuuuucuucccuauuuugcuacccauuucccuuuaaagggagacuugguuuguuucacucuauuuucaaaugcaaauucagcuuauucuugucacguguaccaucucuaaggaugauacuugcugaagucuaaaacuauuuagcguuccuggaucuuacaguuuuaaguagauuguuccuuguuuugcuccaagugucuugagugauuuggcuguuaaaccagcagaaaccuuuguuuucuuaguuuccuauaaaggaaauaaaggugagaaaauaaugauuuccuggauaauucaaagagaagauuuaacauaaaaucucuaacaugccacuauacaaggacuugcaaaucagcuuauguuacaacucagcaugacaauuguuaaacucauuuauuuuuaaagagcuuuuauaugugauacauguuaaaagagccaagaagagagggacuuuuagcacuguucuucuugaauauaacauacauguuucugaacucuuacuugggguauuucauuuguuugcucauucuugaucugcacagcccuuaagcuguaagcuuuuugaggacaggaaaccucucgugugcauuuuauauuccuagaauguauuuuuuuuucuugugugacuuaccccggaucuuuauauuaacaguauuauuauuuacauaauauuucucuuuaaauugguuuaccuuuuuacccaaccucaugcaaaucaguauuagccaugaaauuacagguuuguugggcuguaucuucuuuuaauacauauuaauauuuacauuaaaauccuaauuauugccacacacgguggcucacgccuguaaucccagcacuuugggaggccgaggcggguggaucacuugaggucaggaguuugagaccagccuggccaccauggugaaacccugucucuacuaaaaauacaaaaacuagcccggugugguggcgggcaccugugguccuagcaacuugggaggcugaggcaggagauggcuugaacccgggaggcagagguugcagugagccgagaucgggccacugcacucaaacaugggugucagagcgagacuucugucucaaaaaaaaaauccuauuauuagaacuuauagauuuuuauuuguauaccacuuaaaagucaucucaugcaucacacuugaggaauggugcccuagcauagccuugcacauucucacauguagucacuauuuguuuaauuguggaggggagggaauaagauuaauguacuucgugugucagguauuguuuucaauaguuuacauaugguuucucuuuuaaucccuauaacaaccgaaugagaaagaugucuccauuuuauacauaaggaaagugaggcucacuaaggcuuagugacuuucccaaggucaaauaguucaguaaaaauuagagcugagcuaugaaccuagguuuaucugauuucaaagcuuguacuguuuuugcuacauguuguggacucucagugauuaguggguuaaccuugugcauuacugucugcuuuccuguuguuauuccucuguaguuagaauagaguugacccugaaugguauuuacaguuugucaucuuguucuggaauugcauuuugcacagucuugaaaguuguuguuaccaccuucuuuuuuuuuuuuuuugagauggagucucacucuguugcccaggcuacagugcaguggcgccaucucggcucacugcaaccuccacccccgagguucaagugauucuccugccucagccucccuagcugggauuacagguggcugccacuaugcccagcuaauuuuuuuguauuuuuaguagagaugggguuucaccaccuuggccaggcuggucucgaacuccugaccuugugauccaccugccucagaaucccgaagugggauucaggcaugagccaccuugccuggccuguuaccaccuuauuuuuaagguuuguaugaaagggaaccucuuagcacuacuaagaggaauauguuuguuuuggauuuuuaaaaaguauugcuaauuaagaguuuagacaaauauuaagcuucuuauuuaaguuagagguagcuucucucucuguaguuguuuuucauuuuauguagccuaaaucauguuauacuucagagaugaaaccuggagaugauuugauucucauccaaaaugagugccugaguuccauuuucagcauacacguaugaucaucuagcuauugcuugauuaccucuaauuaugguguucucacugucuccucuuuagcuauuacuaaaaaaugaaagagggccucgacagccauagucuuuuaaugcuaauauccuaguauuuaaaaguugcaagggagccuaauguuugcuuaauuaauuuauuuauuuuggugguagagaauagaaaaaguuguaaaaauauuguuugccuuuugauaaauucagaaaacauuuucuauuuccccuuaaaucacuugguuuccaucucagauaaucauuaggguuucauuuucauucagcuggauagcguacccagagaugguuuaaugggaucacguacacugauggaugguuuaauauuuugaagauggcacacaguagcacuuuuaagagaauaaucaggacuggcaugcgagggcugagaauugcuugaguucaaaaaucagagcuaguguaagugcaguuuuguguaacuucucuucggcugccaacugaccauuuuauaauucuuucuucccccgauuguauuuuucuugguuuccuguuugacuuauauuccaaauucacuuuacaucuuugaaauuauggaaauaaggaaauagaggaacuguauuucuuccuuucugaguguagcaucuggaugcucugguuuuaaacgcgaaggggcuguaaacccuaggaauacaaugucuuuuaaggaccggaacuaguacgucuucagaacugacuucaaauaguuuauuucaccccauugaucugaccuauauguguugauuuuuauuauauagucuauacuguagggggaggaagagccugcaguuuuacuauuaccucauaaaauuaauuggugccuaaaacaaauaguauuaaagauacuguauuuuauaacauaccaagaugacugauauaguuucuguagggaguuuuuguuuuucuguguuugugucaauaaacucauaaaaucugcagaaugaaaugagucauaaucucauuuuuacuaucaaaaagugaaguugagcagaagcaugaccacguaguuccucccaguggcucaaacaaguaaauaauuuaacaugucuucauaacacaggguuuugcuuauaucaagaaacacaaucaccaccccuucccuguucaauguaaggggcuuagcuuuauuggagucaaaaaaucuagugcaguacuuugucagucagugaauauugugagcuucuuuauuuucccuguugcuuuuuuacacaaaugugggaaauguugguaucacaagaaaaucagacuacauuuggucuucuaaaauguaacuccauuguccccaugcuggacugaauuucuuuuuaaugugcuguuuuccucaacccaaccuuucuauagggaagaguaguaaguuuauugucaguauuguggauauuuuaauugaagauaaacgaguuuucuuuuuaaaugucuucaguauuacauaucuuuaguuuuauuauccuaauuuuaguagauuggcaaagccagauaaucuuagcaacccuaaccugauucagcauucauuacugcugcuaaaucaaauaagaccuggcuaauagaaacauggcuugugcagccauucuuuaauuuaauuagaauauuauacauugcauugcacuuauauguguauaccagagacaaaacuugauaaucaguuuguaagcacucaugcuacaucaucuagcuagagacauuuaucauuuauugugaaaucuccucuuuugggaaccucuuuaaauuacuaaauaucaggauugcuugaaggggugaagauggggcuagcucacguaaugugccaucaaagguuaggaauuuaggucucauucuacuauagcaaagauuggcaaacuuuuucuguagagggcaagguaguaaauauguuaggcuuugugggccauacggucucuuucacaacuacucagcucugcuguuguagugugaaagcugcuguagacaauauguaaacgaaugagcauggcuauguuccaauaaaacuuuauuuauggacacugcaauuugaauuuuauguguuuuucggguguugugauauauucuuaagaauuuuuucaaccauugacaaauacuauuccuagcuuccaggcucuacaaaagcacauggugagcuggauuuggaucacaggccuuaguuugcugaccccuauucuguaguuuccuuucuuacuguauuuuaguuuucuuauuuauauauuuauguacuuauugacuuauacuucuuugaugguuugcucuguauccgugcaguuuuccauagugcaggaaauguggauggaaugaauuuuccugucauucucuuaucugacagucucugcuugauguggcaaaggagaaucagguguucaaccuccaaugagaguaauuucugauaucaguugguaguugcuguuuaauucucaaggugcagacaagguggcggaauugacuuaucucauuuucacauucugggagaugaucuguuaguccugaggaugcugucaguuuucugguauuacucucccugcguggucauuaacaauagcagaguccauaaauugaucccagguuugaauuguaaguuguuggcccugaaaacuuggugaacaaacuugcugucaguguuuguauugauggaaauagucugaggucagcuucauuacugcacccuaacugucucauacauuguccguugauuuuucgguuguguugcaagaggguucuuguuucagacacuugcuaccagacauauucaccucaaauauuuacaguacaaugaaucauucaaacuuaagguuggcagugucuuuuugaaaugguguucaugaaggacuggguuaauuuaucagauacagauuuugagaaguuuuuuucucuuaaagcaaaaguucaauuugcuaauaaaucaguggcaacucugucaucugacacauggauacuugucucuuucacacugaagcuugccacugguaucuuuugcaagaguggacauauucuuaucuauaaaguauuuucuagauucauucagaaaaaaauaaagugagaauacuaguuuccuucuugaauaauggaacuuaaagauaggccuagguauaugaauuauuacuguugcccauuuugaaugacuacugagcuuuggcgauuauuaucagcuuauuucuagaauuauuuauuaaguagggaauuuuauucauugucagauuuguaauuuuagcuaaguucugauuagaucaccuugugguuucuugcaaacauuuuuaguccuuguuuugugucaucaugaaagaaaauuuaacaaaaagaugcauacuugcuguaacuccugggcauuuuuauuuauucauuuauuuuuaguccugugguuucucucuauaggugauuggaacacaccagaccucucagaagcguucugcuguuuccuuccucccaguaagcagauuauuugcaagugacuugaaaauaauuucaaguauuggagagcuuucuucucagccacccuugccaauguuguaggugaugcacaaaguucuguaggucagcuugaaaucaucaugcuugcaaggaaaaaaaaauuaaaauugacuucaaaggacaacucugacacggucaauuaauaauuaaaacaguuuuuuaaugagcuaugcaauuaccuguaugucccuggagaugaugguuuaugguauuauugcagugcccuuucuuuagucauggcgcaugacauuuguaauuuaaagccggcuagacauuaaagugacagaacuuucauuaaccuugucuaaaguuugcugaugacaaaugacuuauaaaacaugcuguugucaaaauauaccacauauuuaaguaccuuaaaaguccugugggcucugagaagcuauggagacucagagagacaccaagaccaccaguguccuguggaauuacuugacagaauccccgguggcuggcacuauuucuuuguacucagguaagugguaccugcuucagacaagagcuucauguacuuuucauggcucucugguucagguagguuucccacggguuuuuauaccacgugacacgauucucucaaucagugguuuaugacuauugaauaauuucuucuaaaccugcuuugauauguaaacuuucaagucuuuagaagcaguuuuauuuuuucaucuugaaaccauuuagcaauuauguuuugauuuuagcuuuuuuuguaucuuggcuuucuaaauucuuagcccucuguuugcacuaugccauaccucucuuuugucuucucccuguauuugaaauuuucauuuuuuguagaaacuauguagaaacauccucuaaucuuaaaaaauuuucucaucauauuucuuuuagaagaauaucuugaaaugcuaccaagggagauauugcagguggauauccuuuuauguuauaacaguaauaaauauauaguaauuaacauuaaugugcagguauuguuugccaggcauuaugcuaagaguuguaucucauuuaauccucaugguagccagagcuuauagcacuauuuccccauuuacaaauuugaaaacugaagcacaaaaagauuaaguacuugcuuacugucuuauagcuuguagaugaaccaggauucaaaucuugacugacaccaaagauauuauuagugaccaccaagcaacauggcuucucacuuuuguuuuuucaaaauaaauuacaaguuugcuaucuggaaagauaaaguauagcaaacuucuaauuuauuuauuauuuaauaauuauaaccaccuuuaauuauuaaauagaaagaauuguuauuucauguuugugcuaugcaauauaccaauaaauauaugcuggacagcauaccagcaaauaugaauuuaauauuguaaguugaguauuuauagcuuauucgagagacuuguuaagagaaauuauaaccaccuuuuaacucaaguggcauaugauagauauuucauaaguauuuccuauuauuauuauuauuauuagcauacucccuacgugcaauauaucuugauucugucaugggucuauguuucaggauugguuccaauauaauuagagacuacaacuuuaacaacacauuguuuuauuccauuugguuaauguccauaccuuucuuaaacacuauguaaguauuauacaucacaaaguauuaaauauugucaucguaucaaauacaucucuguguucauauugcugaauaguagucuacucuuaacuauuuuuuaguugaaguauaacaccagggagguacacauaguguaaaugugcagcucaguaaauugucgcaaaaugaacacccgaguaaccauuaccgaggucaagaacuuugccagcagcaccccagaaggcuuccucauggccucucaaaauuacugcgcuuccuuccuccccagugauaaccaggauuugaacuauaaugccauaguucuacauuuuuuuguuugcuuuugcuuuugacauuuuaaaaacuucuuauuguugaaaaugucaaacacacaaaagcagagggcauaguguauugaauaucauguucuuaucacucaacuucaacaguuauuaacucaugaccaauauuauuucaccuguaaucucacccacucccccaaccauggaucauuuuaaagaaaauuauagacauuguacuaucuuuccaucaagauuucaguauguaucucuaaaagacagggauucuuuuuuaaaaagauaaccacaauaauauuuucuuaccuaaauacuuuuguaccaacaauauccaggcaguauuaaaauucuguaauugccuuauauuauuauuacuuugaaaaaaaccuuuuuauuuguugagucaagagucaaaugaaguccgugaguauaacuacuugauuagcacgccaaguuuuucuuagccuauagcuucuucaucccuuuuuucucccucgaaguuuaagaaacuggacugcuugucccauaauugcccacagucugauuuugcuuauuaugucuuccugauguuguuuaacauguuuuuuaaaaauuuuuuuauuucuuauuagucaaauaagucuaugagauucagucuuacuuuucuuuuuugggguaugggaggguauaaaggguaagaauacuucauagguagguauauaaugucuguaccuuuuuguaugcaugugaugucaguaaccauuugaagaucacugcguagauuuauucuuucagugagggcugcaaaauggugaggaucuuauucugccauuccuucauaaagagaaacuuccccuuaucauuuaacuuaagugcaauauacauagaauggccagacaaaugacugauucuuuaccuuuauuuacugauuuucaaaauaauuaguugguucucagcacccuucaaagguauuuaugaaaguuuuguuuugcuuuaguauuauuuugaauuuauaggguuaaacaugcuucaauccauucaauuauuauucuuacugaugcucaaauuauccugcuuuuggcuaguggaagacucuuuuauuaugaccccagaaucuuugcuaauauccuuuucugguugcgauaagauauuccaggcucaucuuagaagguuuuuuguuuuguuuuguucuugccucaaaccuggaaucagcuauuucuccuagaagcucauuucuuuuaguggaaaauuagaaacuauacucuggucccugggaugugcuuauuccuacuggauaggucacuguuuuuagaucuuuuuaguguacagaacuaggcaauguauuguuguugucuuaaagauaaaauguauaaggacuccauuuugacucuuccaauucaaauucaagacuacguagcuuucacuuaaaaucauguauuuguguuuucauucaugcaugugaaaaauccugacaccagcauuggagauucuuaaacugggauacaucauacgcacaguaguuucugggagguaaagcuuggcaucugcauuuuuaacaauuuccacaggugauucugauacucacccaaggaugagaaccacugaucuauuuuuuacgaacuauuuuauguuauagauacuuaaauggaaccucccauuuucuucuuagaaucccccuuuucuuuguugauuguccacauucuuucuucuucuucuucuucuuuuuuuuuuuuuuuuuuuuuuuuugagacagagucuugcucugucacccaggcuggacugcaguggcaugaucugggucacugcaaccuccaccucccagguucaugcaauucucacgccucagccaccggagcagcugagacuacaggcgugcaccaccacacccugcuacuuuuuuuauuuuuggaagagaugguguuuugccauguuggccaggcuggucuagagcuccugaccucaaguaauucaccugccucagccucccaaagugcugggauuacaggcaugagccagugcgccuggccaagguugaccauauucuugaugagccaccuguguacaaucugaauucuuuucuuguuuaacucauuggucugugcaucugacaguaaaguugaguuauuucacuucugugaaagccaggcugcaguuaucuuugaccgcuugaaaugcuaaaauacaggugaaccucacaacuaaggcucugcccaaggccagagagagaauccucccucauugcuuugagcagaaugccugguacuggaguagauuugcuuaaaggcaacucugcauuugauaaaauaucagagcaauuuauguccuuguacccuuguuccuuuucuuuccucuuaggcagaaauguuaauugacaaucaaaggaguaacaggugcauaccugaauucacaagccuuuggggcccaucuugaauacuucugcagauccaggccugguuuagguuaugccuucuuucauccaugcucaccugagaguuccaguguuuuccuuguucuuguuucugcauucagaguucuaaaauuugacucuggcuggucauuuuaucacuucucucucuuagaguagacuauagaucuauaucugaacauuuagcuucuaauugauuuguauugauaauaggugaaaaagaaguuaauuagccuggaaaugacuacaccauaagaucagacuuugguuaaaaauuuaaccacauuaauuuugauaaucuuuuacauucauuuaauauuagcuuuguuuuauguuaaauuugcaaacuuucacauuuuuaucaauguucuugagagggaggcaaagaaauucucaauuuaugaugcaaaauggaacuucaggucaauuauuugaccucugugauuuagaucacacaucuuauaagugggggagcaacugcucagucugauuccugguauuuuuuucuguuauaaagcacacucuuaaaaagaaagaauucaaaguugcuuccaaaaguacaauauaagaaaaauaauuuuaggaaaggucaaaaaugauuagaagaaggaagugagaauucuguuaauuuagucuggcuuugagcuuucuguuuguuagccaagacauaaagggaaaacuuuggcucauagaauacuuaucugauuaaagaaagcacaugaauuugcauggaguacagacuuuuuuuggcauugaauucugugaagaauauauuauaugaucuuacuaggggauaucuguaacaaugaauuauaccuucacugcuaauuuuguaaaagauauaaaaguaaacuucaaaugagcauuuuucuuacucuucuuaaccauuaucacaugaacucauugccaagguuuuagguaugaugauaucagaugaaaagguacaagauauaugcuuaagugaagcauuuacacuagguuuuaguguugaugcaauguaucuuuuuucauuauuuuacuuuuaaccuauuagucuuuauguuuaaagugauuuucuuauuauaaguauguaguugggucuacuuaaaaaaaaaauccauuagcugggcgugguggcaggugccuguagacccagcuacucaggaggcugaggcaggagaaugacgugaacucgggaggcagagcuugcagugagcccagaucgcaccauugcacuccagccugggcaacagagcaagacucugucucaaaaaaaaaaaaaaaaaauccagucugacaagcucugccuuuuaauugcguguuuagaucauuuacuuuuaauguucuuacucccaugauuaauuuuuaaauuaucuuacuauuucuuuuuauuugucucaucugcucuuuguucuccuuuucuucuuuuucugucuuauuuuguguugaguauuguuuauuauuccaguuuaucuccucuguugguuuauuagcuguaauucuuuguuuuagugguuguuguagagcuuauuguauauaucuguaacuuaucaaagucuugcaaaugauguuauaccacuuuauuuguagucuaagaaccucaugacuguauguuucuauuuuccucucucagccuuucuguuacuuuugucaaacauuuuacuuuuaugcauaugcuauaaaccccacaauacauuauuauuguuuauucaauuuaucuuuuaaaaauuaaaaauaauuuaaaauaucuuuuaaauaacaaaaaagucuuacauauuuacuauauauaaagugcauuuuuuggugcacuuuuuuccucccugucaaccuauauuucuauuauuuucccucugccugauaacuuccuuuagcuuugcuugaaauaugggucuguugcugaugaaguguugcugcuuuuauuuugcaccccaucuccuuuuuuauaauuguuauuguucaggcaggacaguaaaucuugucccuguuaacuucauuuuggugagaaauggaagucuucguuaguuuuaaauguagguuaaguugucgguaguuaaugcugaauucuuuaauagcugaguugcaguaacauuagguauucacugugggugccucugacuuccuucagaggucaauauauagggaucaggguggauaacuauaaaauccagguuguauuccucuguacagauaguguagcuguauuagucugcuugggcugccauauuaagauaccauaguguggguggcuuaaacaacggaaauguauuucucaaagucuggaggcuggaacuuccaagaucaaggcauuggaaagauugguuugauucugagacucuucucuuggcuuauagacagccagcaucucucuguguguuugcaugaccucuucuuuggacaugaacaugugaugggggaagacacagcaagcucucugauggcucuuuuuuuaagggcacuaaugccaucaugagggccucacccuuauaaccuugucuaaccccaauuuccugcaaagggacugacuccaaauacccccucgucagggcuuaggacuucaacaugaauuuugggcggauacaaacauuugguguauaucagcagccacaaguuauaguguucugugaaccugaagcuuucuccuuauaacuuguguaguuugugguuaaggaccagagccauacaucugcucugaucucuuucuuaccccucuaggcaucucugugguaauauaaggaacacuuuacccaucaauagauuagaaccuuaccuguacuugucuggagagagaauuuuuguucccguaauucuuuuugaagugucaagaacuuauuuaguuucacuggauuaaagagagcaaaauuaucagcuugaaucaggagcaacuugaaggagagaucagggcuaugaagccuguugggagaucugcauuuauaaggagauggcuucagcaaggauaagucauaucuuaacaucuuagucuuaaaggacagauuuguugcaaagaaaauggaaaugguaggaaaaagugcuaagucuuuuuuccguggcagcauuucagaauuguguauuguagcucaauuuuugcuguugccucucccuucuguuaauauuagagucagaagccugaucagacacagugcuguuuuuucugccuaaccaaagcuguggacccgugaaaccuguaaagauauuaaagaauugagaaauuucaugugagugaggugguugaauuuuauuucuguuguuaauauuaggugauugcaaaucuacuuauuuuguuacagagauuccaggaugccaauaugcccuuaaauuuguucagaauuuuaugugggauuauacuuuuauauuuuaauuuacuuuguaacuuguuagcuauucuuucucuaaacaucugagagauauuuuucuucccggcuuuaaaauuuaauugaaaaauaaaacugugacuauguuuuguuaaguuaaacaauacucucugccaggcuucuuaaggcaaauaggauuauaaaaucuuacaugcccaguucauauuacuugcucugaacaaccgauuaaccacucccauagaauccuaggagaguuuaaaaauuacagcuuucuuaauguuucucacauuugcccaaagguuucaaagaaggugccauaagaaauauaugaaggugcccuuggagauauaggcaaagaaggugcuguggaaauuagcuuucuuuuaguggcauguuugcagugagauugggcuauuaggggcauuuuaguuuuccuguaccuaggacaaucugcuacuuacaaugauucccugaugccuuuauaaagggaaagaggcuuccguuuuuaggauucaucuaacaaaguguuauugcuuaccuaauuuuuuuuuuuuuuuuuuuuuuuuuuuuagauuuuuuuucacucugcuaggcacuggggagcuauaaggacuaagaggaccucuuccccucuagaacugcacuacuaaauuggguagccauuagucaccuugacuauuucaauuuaaaguuaauuaaaaauucaguuccuuaguaguacaagacacauuacaagugcucaauagcuauuuguggcuaguggcuaucauguuggacagcauagauauaggacauuccugacacugcagaaacuucuguuggacaguacuguacuaggaguuauuauucagauuuauuuacccacaaaauaugguuguuguaguaguguuuuuagucucagagucauguuaacccaaagauggauaggaaaacaaaaauaugcuacaaggaaaauuauuaugggcuauucagguguucuuguuacuguaugugccccuaauauuaggauuuucuucacagaacauuaucauucaaaaaagaagucauuacauauauucagguucuuacaaaggcucucauguuacugacuaaucuuucaauuacaguacuuuauuuugaacaucaaaauggcuuucaugaauguuugcuuaugaugcuugaagaaguuacugguaaaaucagauuuauaaagaagaaagauuuaacacaaauuuaguaauuuggucaugaccucacaacgacaaguguugggcauuauuguaaacaacccuuuuuaagaacagauaaagcaacaccacaagugucauugcuauggagaucacaaccccugcaggaucuaugacaaacuguccugcuauuuagcaaauugguacuugugguaaccgugccacaccugaauuuuaaaaacggcuaucccccaaacaaucuggaagggaagaccauuuccuccggaaaguaaaaaaaaaaaaaaaaaaaaaaaaaaaaagacucuagugauaauaaagacauuuuugugccuggggaguuuuuaaugaaaugugagaggaaagaaaacaaggagcuuuucuaaauuaaauauguucuauaauaugccaugugauuuugaaugugccuacaacuaaaugaaggaaauacuauaccuagacauuuaaccauuucaaucucagucuuaaaaguuaauguaaacaaguuguuaaaaaaacuuauuuuuugaggaaaucaucucauauggaaaaugagagaucaucuuauauucaggauucacuuaaauuugaauuuggauauauaaaguaucuacuucuggagauaaccuuacuguuuuuuuuucuaagaaauucuaagcauuuccagagaauugauuaaaauuuauuaaacuacagaaagugaaaucagaagacuacugaauaauuucuuaaaaucauguuaaaauauauaaaauuuauaugcauauaaguaugcuaaaaguauacagaaaagaaaaacguggaagaaaugcaacaaaaugcuaacagugguugacugggcagugggauucguguucucguuacuccuuuauuauuuucuguuucauuuucuauaauaugcauuauuuuaauaauuagaauaaaaagaaaauguaaaugaacacuuaaaaagcacauguuaaagagaacacuugauuugauguauagguucauccuuuguagguuaagcaaauggaaagaaacuucuuuguacaaaaacuaauuccaugugggcauuggauaccuuucucagagaaaauagguugucuagccagcacaccuuguuuguuuuuuaaucucuaacaacguucaggauaucauacaaaagagaagucuuggaaauucuuacauauaugaugauuauuuuuagagauggggccuugcuaugaggcccagacugaagugcgguggcuauucacaggcgcaaucauagcucacugcagccucgaacuccggggcucaugcuauccuccugccucagccucuggaguagcggaaccacuggcacauggccauugugccuggcuuuacauaaguuauuaagacuuuuguuuuguucagcauaucuggguaacauugcauggccuaucccaaagucugaaauauuuuaaauuccaacugacaagauguuaggacacucaaaggaagcauugaccacacauaaaauuguuuaaauaugcucagcacuuuucagacuauuucacauuaauuccuagugaaauaauguagaaagaugacuuuaaggguaaagguaauuuaggccuuuuuuguuucuuuuuuuuugguguugacuuacucugacuuugaguaacucaagucauauauuuccaguuuccucuguguuacuccucauuugacaucuuaagaaaguuuuugguuuuguuuuuguaaauugccuuauuuggaggaaaugcauguucuaagaaauuugaacacaaguguauccuugggaugcuauuucucuuccuuucucuagugccauuuuuuacaucacacagauuuggaaacaaaaugacguauuucuuugcauguugugugaugaguggaagaaaggaaaaaauuagcaacucucugcauauacaaagagacauuucaggaucuccgaggggauaugaacucccagguacuaguagacuaagccucuuuacaaccuuacaaaauccuguacagaugaccuguguguaaaaugcacugccuguugcuuuggacaucacuugacacuaaaaagcuaugcauuuuguauuuuugcaugucagaaucuuagccagaggaauuaaaaauaaauauuuaaguagguuccugacuuuuccuaucaaggaggcacugagacaggcaauuugcuuagcaagucuuuuuguucaccuguuuuugugcugcggagaaaugugauguuugcuucugaugauuccaaaugugcgugcauuauauggucagagcagaguauagaaaaugccagugcuaucugugcaaggcuggaugauaacaugugacccgagugacagaaauaaauguguccuggcaaaaaggagucuuaaucugaaugaaaauauuaccacacagugggcagauuaaucuuggcaguuuauggcaauggcccucauacauaaaaccuauucuguguucccacaaaugcccaaucaaucaguagacagcugccccaguguuaauugugaccgugugggacacuuggguaaaaucuucccauguuaaugauccugaauuucuaaauggucuuauccuaaaaauugauucuuaguuuaagcaagauuagcaaugugggccuuucagcuuuuuuguuugauuuuuugaaaauguuuauauauuugggguuuaaacaaagaauuuuuuuuuuauuuuuugccgcgcucagaacaucuuagcuaauauaugagguaauuaaaaaguuacuguagaagucuuccugucugguuugauugaugcuaguaguugguuaaucaaaaaaagucauaacaaauuauaaauacauaccuucuacuuuucauguuaauauuaaaucuguauauauauauuuuuguuuuuuuauuugccaauauuugauauuaggucaaggccuaguugaaauucccugacaucuuucuuguauaaacaauacccacaaugcuaaucuuuaugauuuucaaucucugucucucuaaauuggcaugguaauuuaaagauauugggaaccaaucuaaaugcagaauccuccuagauuuuuacuaaauuuccccaaaacuucuuaguuaucuaaccuacaucagcuuuaguauuuuuuaaugacucauuuugaugaaggccauucaaacauucugcuuaauuuugauagaaacaaugaaucacuuucuguuuaccucguauuucauggauuuauauggaauaaucuguucacauacuauuuaauucauacaguuggaguaaagaggcuugggaccaaacccaguacacuugugaaugugugacucagcugguggggcuagccaugccuggguacauuagagaaguccaccaggaugacucugcagaaugcccuucacaucagggcauguucuacagagggaauggacaucaucaucgcuucauuaagccugucacguuuuuccauaaacaucuacaaauagcuacaggugaaaauggauaaagaauauaauauuuaauauuguuuucucuuuaucaaaugaaaagccagauauagcuaaguaaauacuaacaaaacuguuauuaaaugagguacacgccaacauuaauaaguucugaauuguucguuuuacuacuuuguacauauauuauguaugugguauauuaauugauugcuuugugaagcuguuuaaaauuuuucaacaguagagagugauaaugugccaaaugugaaauaaaauugcagaggugaaacugucaacgacuuaaguguuacuacugacugacagugacaggauucaagaaguaucauagauaccaauaugcuaugucacaaguauaauaugaccagaguggauguggucccugcuaaacaaguuaaacaaaaaggcuuuuuuuuuucuuccuagugcuuuauauuuucccccacuauagaaaaugcaugaagacuuuuuaaauggugacauuuauggccaugauagaugugugcuucuacaagaccaaguccagguguuuccauugggaauacauggaaggaauugauuuaagcaagugauuacuuaaaaaggaaaauuaaaagaguggaaaauggauaggagagaauguuaauugggaggguuucaaguauaaaggagacuuaaggaugggcauaaauguaaauguuaggaacacauuugaaauaacuuggccuuagaaaagagguuuauagaagcauauaauuuaagaacuguagguuuugaaacugagacacacucauugccagacagaauaagaaugaacauaucugaaauuucacugagaaagaucacagauauacagucauguguugcuucacgauggagguauguucugagaaaugcguuguuaggcaaugucaucauaaugcaaaaauguagauuuuuuuuuuuuguggaucauagaguggauuuaaucaaaccuaaaugguguagccuaugacacgccuaggcuauaugcuacagcuuauugcuccuaggcuacagaccuguacagcauguuacuguaaugaauauaguaagcaauuguaacacagugguauuugugaucuaaacauaucuaaacagaaaauguccagcaaaaauaugguauuauaaucuuacgggaucacuguuguauaagcuguacauuguugaccgaaaguuguuauguggugcaugacuguauuuaaaauuauaagaacacacaaucccaaggucauuugauucaggccccaauaaagcacuaaaauaguccaagaaucuuaccuuuucccauuagugaaugaaggcauucuucagacuuccuaguugaacugaugcaaugaucaguggaccuugaaucaaaggaaacaaauuucuguuuaucuuaagccuucucaauugugcuuuuguaugcauucaucuuauucuuucuauuauucuuaacuuagucauccagauugcugcuuaaaauggaaaauuagccuaaaauggagugggcaaacaaacaaaucgaucacuguccagaguuucugaauccuuaacccauuucuuacaagaagagagggaacuauuuucuuuaauauugaaaagacguuaccuggagcaccccuaaucaaccuugguccacaaguugaaugaugcaguagaauuuagaggauucugacauucagagaacagcagccaacugucagaaaaacgguaggagaugguaauaaugaccucgauuuaaggucacuggugcuugaaugcuugcgguauuuuggcacuagcuaugccacguccugcugaucauggaacaggugccagguucacucaguggggccaaaggaacuuugaguauagugacaagaggcuaaagagccucagccgcuuggcuuauaagauugauucuuaauggaagauugaucuggauugggugaaucugugauuuuuuuuguugguagggacuugaaauuggugaaugagauaaacaugaaguucagucuccuuagcagauaacaacagcuuugcucuauauuucugucaccuagcaccuaguaggagcuugacuauugaaugaagaaucaacugaacacauuuucuagguagacuuauaauagaauuaauaucuacauuggauuuguaaaaguaaugaugguaccaguauacauuuaauuagugaggaguacuuccuuugggguuauaaguauaaaaauacucaauaaccucauugcuuuauugauguuuguuugugaagaaggauuaaauaguaucuugccuuuuuuuuccuuugcuuuuaaucauccauuguuaaauagaggcuuaggccaucugucucugccaagaucugccucgauauggaagacuguauaauagagauacuaaaaaaaaccucucuaauaaucuguuuauacuauuauucuccaggcuuuucccuaaaacaguuuuaaguaaauuucuuaccaacuaaacugcaaacuuaucuguuaauuaaaacuauuuuuguugacuaggucgcagugcucuugaggccuguagaaauuguacuuagcugccuuuucucuugaagauaagacagaaaacaggaugccuuguuggguuuaaaaaguaaaauacaaacugucaguuuucugauaucaagguacauuuuuuugagaaucaacauuccaaauggccaaucugguuaacucucagugguauaagauagggcaaaggaaauugacuauguuuugguacuugguuuuauuuuauuuuauacuaagugcuucuuaggcaauucugccucaucaauauucuguagauguaggcaucauuaaccucagugaaaaguuuauuacaagccacuguuaggacuuguuucugaauaauauuucuccaguauuuaaaugaaacaaacuaccuuuacccaaacucagucaacagaguuuaagauuauucagaauauggaaaaauaagguuuagggccugggugcuguggcucucgccuguaaucccagcacuuugagaggccgaggugggggcaucacuugagcccagaaguuugagaucagcaugggcaacagagagagacuucaacucuaccaaaacaaaacaaaacaaaacaaaacaaaaacucgggugugguggugcacacccaugucccagcuacuugggcaggugaguuaggaggauuacuugugcccaggaggucgaggcugcaauaaggcaugauugugccacugcacuccagccuaggguacagaguaagacccugucucaaaaaaaaaaauaauaauaauaagguuugggugugugauuuggggcaguguuuuuggcaugcacggguguauugugggugugcauaugccuagacagacauaugcacaaucugaagacauaauaggcauuuuccucgaaauaaauuuggcucuuagaauugcuuucuucucagucacaugcaaaauauggugaagaaucauaagcagucauaaauacuggcuuguauacaccauucagggucaccuucaacaaaauacaagucacucaauuuuauccagcagucacagugcuggaucuacugugggacucuuaaaauguuucaagugagagcuggauagucauagguagaaucugaguuauacauucugauuuccuuuaugggcuauagauuaacugcaacucugauacuacuucauuauaauccuacugacuucuuucugguaagagaauugccagguacccagcucugaauguccugaauccugucaguagcucuaguuuauaaaggaugauuugcuaaugagauuucacagacaagcacuagauauugacggugauucaauguuguauguugucugagugguuguuuugcuucaggguacuuuuuuauuuuccauuucuuuagcaaccucuuuccccacccugcucuugcagaauuugagaucaagaaguagggcauuauuaauuacauauagacauuauagaauguuuuggggguucuuaaucaaaauguaaaugauaguuuaaaacauaguuugaauacucugaaugccuaguaccuauguagucaguaaauagugauugccgugaggacuacaacuguaucaagacaguuuuauccuaguguucaguuaaaaucuuaaaaaacauaaaauaaaauucuugcuguauuuuaugaguagguuuuaggaaccuaguaagauuuuuaaggcagaggaaccuuuagaaggggcucaaggucacaguuggcacuccugugaaaacgugugaauugccuuccagacacuuuuauuuugccuuaagacugcaacuauguucugucuagggguucugcugacagcacgaccacacaaguacaguuuccuuucugugcaucagcacaaucagagauugcaaugcugcuuguggccauuaggauuuagucauggaauguaaggaaauuucaacaggaaauguaucuggcuuugauauauuuucaucugccguagucgcuuaaccugcaugccuuuuuggugucagcauuuaauucuaggauuucaucuggaauauguguguauauaguuuucuccaucacugucucaaguaacccauuugaugcuguucauguacaggcccuguuaucauuaauaaucauguaagcaguguuagcagguuuuggcaaaugcaccguuucaucuaugccgaggaacauaaaacucuuaucagcaauauaauuuaauuucacuguacguuuuugguuaggaugcagccaacaaagucagcaaaagugcaaguuguuuuuagauggcucaguuguauuauaguuauacuuacuguaccucacugcucuuaagugucuucaauaacaaauacaguaucagugucagcuuuuggauuugugacuuauacaaaugucaaaguagcagguauauuauuuuauuuccaaagagaggcuucuuuauccucuccucuacaugauuaaugcucuuggccagaauuuaagcuggcagggccuggcacauaguaggugaacaaugaauggauauaaccauuguugugguuuuuauucaaggcucucaacaugugauugaaugaaggauaccuagaaauugaaauaucaaggcaauugugaggauaacugaggaacacugggugaagcuuguguaaugucaugauuuagcacaugccuuauuauuuucguaggucucaaacuuaacccuacuaggagagaaacuguauuuggaacaguacaaagcaaauaugucaguguuugcaugugccauucucuuacauuuaaacuaaauaaauuuaaaacauucaacaaagauugagucaggagcguuuuaucugauucauccuuaaaaaaaagcuuucuuuggugccaggcauauaguagacacucaguaaauauuuguuggcacacuagcuuggugcugaauauaagacauauucaauuuuguugaaugaccaauuaaaaauguaggagucacuguaaucacggugggacccauuucucuaaggaaguuucuaauaugacugugucaugucuuugccuugggcuggucuucuaucaagguuguuacugacauggcuaugcuuuauugggguaucuacuauauaccaacuauuauacuugguucucgagcaauaucaucucaucuuaauacauuguacuagugagaauuacaagaaauuucauauuaaaaugaaagagaaauuuuaauuuaauuuuuauauccccaaauuacuuaauaaucugcuaaagggaauaguuguccuuucccucuacguggauucuccaucagaagcucaugccuuugagugauauacuuggccacucagcuggaaaacugucagucuucauaacaacauuuuagauccuagaaccuguauggaacaguuucucaaaaauuucuaccaucuuaugaaaagccacacagaugugccuucauuuuguaguauauuaacaagaugguaaugcauguauguauacaaaucuauccugagagucuucuuugaggguugauugaaaacucacuccucaucuugguuuuguuugcuugauaugggaagcacaaaacauuuaucuuuauguucugacaauagaaauaguaguugguaugaaauacucggugggcgaagcagugaaugauaagggaaauaguauuuugcauguugcauuugcaaaggaaacucuuagaaaaguggcuaacuuuagauuuacuuauacuccuuagaguucacagggaugaauuuagguggagagaugauauuugaaggaaaagguacaggucuacguacaguagacuagauuaggugaucuuguugugcaauauguuuugaaauuacugaugugacauacauuaaucucaaaauaauuaugcugugugaaauaagccggauaaaaagaguguaauaauugauaugguucggcuguguccacacccaaaucucaucuugaaucguagcucccguaauucccacauguugugggagggaccugguuuggugggagguaauugaaucaugggggcaggucuauccugugcuguucucgugauagugaauaagucucacaagaucugaugguuuuaauaaagaggaguuucccugcacaaguucuguucuucucucuugucuguugccauguaaaacaugccuuucaccuuccgccaugauuguaaggccuccucagccacgugaggccuuuuucuuuauaauuacccagucuccaguaugucuuuaucagcagcgugaaaaugggcuaauacaauacuuuaugaaucuuuuucuauacaauuauuuuaaagauucaaaauaaaugacaaugagugagagaaggaggaucaaugacugcuugagaggugguggauggugcugcuauaggaaggaugacagauggguaccaggaauuuuuagaagugaugaguauguuucuucucuugauuguggugauguuuugcagcugcguacagcugugccagaacucauuaaacuguacacuucauauauguggacuuuauuaugcauuuauuagaccucaaucaagcuauuaggaauaaaaugcaauuuuauggcaauuaccacauuauaaucaaguaauuaucuagugucugucuguuguacuggacuguaagcucccaaaagacagacuuuuuucuguuuuaucuguguucucaaugucuaaccugugagagguuccuauuaaguacucauuaaauuaaaacauaguuugaauauaguuuaauacuauauuaaacauaguuuaauacuuuugaguaaguaaauagacguguuauuuagcuaaagcacagacagcuauuauugacugagcacuugccauaugcugggugcugugcucaaaauacauuauguuaugaaucgucacaaacaguauuuuugggaaaggcaauuuuguuauccccauuuuacagaaaagaaaacagagcuuagaacaguuaaguaacaugcccuagaccacuagcuaauaaguggacaacaccgaaaucaaggcugacugauugaaagucuguggugguaaccucugcgcuuggacccuuuggcaucuccuuauggccuguauagauuuuuaaagcugugacagggaaauuuucaaggauauaagacucacuuccuagccccacacuuucaacacaaugggaacuucaguaaacauuuaaaacugaaugaaugaacccagugcugaaagucugggaaaaucuuuuuccuucuguuuacuuucccgguauuaauagagcagcguuguuuuccuacacguggcucuguuuauacuggcagaaaccugaaugggaagcaggcugggguacagcaggagcgaaugccuuugggggagccugggcuucugccagcacaucuagcugggguuccugaaaggcccgagggacauugcuucuccauugucauauuggagauuuuguuccaggagggggaugaagagagcauauauuucaauuuucuucacaguuguauuauuuguuagauuccucuaaaagacaguugauuuuuguaagccaguauuaaaauuccaaaaagggauuacaaaaauguuugcauuguaauguuauaacacaguuggaauacacuuuagucuucccuuuugguuauaaugcuaucuuauaagaauuguagaauacaaagaaugguuacaugucugaaaauaauauauauauuucuucaggcaauugguguuuuuguguucuuaaaaaagccauuacagcaucaguuugucucguguguauauuuuauaguaguacauuaaacacaaacacugacaaaaguuuuuuaguuuagcuuaaaagcaguaguuauuucucauauacuauuagguagaggucacauugggauuuacauggacugcuguuuucccuguugaaagggcuacuuuaaacaaauacuugaaauguuguauagccacauuuaaaaaaaaucccuuauaaggauauggaauauaccacugauuucauuagaccugucauucacugacauuccccuauuuauuuauuuacucauucaaaaaauauuuaucaaggacacuuuaugugccauggucugugucaggugcuggagggccagugaaaaauguucguaagugacaucugcuuuacugcaggguacuugucguuuccuccuguaguuuugcuuuuggagacauuagauguaucaaaauuguuaauauuuuuauauuugcuuguaauuucuuccaaauucgcagguuauuuaggucaacuuauuugaccuuacuguccucauuauauuauauaauauguauuauauaauauauauaauauaaaaucauauaauuauaugggaaauacuuagaaaauauagaauauuaauuucauaaaaugggcuaguaacuucuuauccuaugugaguuauauuauaguguaccucagccgggcgcgguagcuuacgccuguaaucccagcacuuugggaggccaagguggguggaucacaaggucaggaguuugagaccagccuggccaauauggugaaacucugucucuacuaaaaauacaaaaauuagcugggcgugguggcacaugccuauaaucccagcuacucaggaagcugaggcaggagaaucacuugaacccaggaggcggagguugcagugagccaagaucacgccacuuguacuccagccugggcuacagggcgagacuccgucucaaaaaacaaaaaacaaaaauaaacaaaaccuaccucaggaaaagaguaauacgaugcauaaaguauaagagaacuguucaguaaaaucagccugcuuucugaauuugugccuguguguguguguguguguguguguguguguuaguaauuuaaacuugagcuaaaucuguuuaguuuuugauuuguagguaguuugccuauaacuugaucucucucucuuuuuuauaccuuuuuuuuagggucagagguacauaugcacguuuguaauaugguuaaacuuacgccacagugauuuguuguaaauauuauugcaucacccagguacuaagccucguacccaauaguuauuuuuuccgauccucagccuccucccagccucuacccucaaguaggccccagugucuguuguucuccuuuuugcguugcauccauguguucucaucacuuugcuccuacugaugagugagaacaauuaguauuugguuuuucuguuccuguguuaguuugcuaaggauaauggccuccagcuccauucauguuccugccaaggauaugauccauucuuuuuuauagcugcauaguauucuacaguguauauauaccacauuuucuuuauccaaucagccauuaauggguauuuagguugauuccaugucuuugcuauuauugugaauaacgcugcagugaacauaugcgugcaugagaacuugauuucucuugagaugacuuuugaaugauuuccuuaucuuuguguucuggauugaaaaugcugaaggcuuuuagagugauaauuucuauuaaucucauucuagcaaauuaagcuucuacaagauguagaggaguguuuuuguucaagaagaagggaaaugauuacaggcaggauuucuuuuaacuggcaugaguggacacauuagagauguuuagggaaauucuuucuauaauguauugggaugaaugaaaugaaugcauaaaaucuuauaauuaaguuaauuauuacuaauuuguugagaguccuuuuuuaaugauauggagaaacacucuggagacaguuaucuugaaucacucugaaggugguuaucuugaauuucaguguuauuugaaaaccucuaguuauuauaguccuauaguuuucagagauauaugugauauacauaaacuuggcucuuucccaugaccucccuauugcuguuuagggcuuaggucacuuuauauuguaauuauugggccaccuguaaaucccuucaaagaaaggacuguguccuauugaaguuugugucuccaaugcucccaucagggcuuuaagcaguuguuggcuguccuaguagaaggguccgucaucaaggcucaguaaccuccuaccauuucuugacccuccuuccuugcccugccuuguccaguuuauuuccaggucuuaagaauaucaggguuauguggguggaaagaaguugcuucguccucuguugcagacggaucuaggcuugcauauucacuugaucucuuaucaacugugugaccuucggaacauuacauauucuuugugccuuaguuacucaauuugaaaacaugaauaaucaugcuuaauuuauagagucgugagaacuaauuaaaauaaugacuagcaugauugucacauaguagguccuuaguaaaugauaguuuccccauaucuuuuaaucaguucaccuucuucaguaauuuuuugaaauucuuucacugcauuagauucuuguuaacuguuuucccuauuguuuagucucuucugcuuccagaucagcagagauauugcugccagauuaaauguuuauuaauuuuguacugugugcuggacacuagauuuuuucuuuccugugcaugauuuuaaacaaacaaaaacagcccaucacugcuucgguucacagucuggccguagccuaguuuuuuagccuuaucuugugccaugccuuucacauaccuaacaauccuuacaaauugaauacuccuaguuccugauuguuaggaauugggaugagacgauauccagggacucaggaaggcucaaaucccauccuaccaaucacgucuacccacuuaccacccuccuuucccaaugcaaggaggagcagaaugagaaucugaauaccacucccugaaccuccaggucagagcucugauaaaagcuggauuggauuauggauugaggcaugaacucaagucacccuucaacuucucugcguauucuaucucagucugggaaucuuacuaguuucuggccaacugcacuaaagauugaaguugacaugagagaaggagcuugcuaagaguugauuucaaagaguggcauauauaacagucuugcauuccauuaacugaaccaaaagaaagcuuuaacaaaauguuauggaauuaauuaaacuuaaguuuaaauagcaacaugccgcuauuuagauuuaauuaaguaaaauuaaaacuucacuuccacaguugcacuugcuacauugcaauucucaaucgcugcauguggcuagugaugucuguauuggacaaugcagauguaaaguauucccaacacaggaaguucuguuggacagugcuguuauaaacacaguaacaugggucauucaucaccaguacauuacagagaagauuucccuaaacaucucuaauguguccacucaugccaguuaaaagaaauccugucuguacccauuuccguuuuucuugaacaaaaacacuucucuacaucuuguagaagcuuaauuugcuagaauuacauaaauagaaauuaucaaacucaaaaagccuuuagcauuuucaguccagaacacaaagauaaggaaauaauucaaaaguuaucucaagagaaaucaaguucgcaugcacgcauauguucacugcagcacuauucacaauagcaaagacauggaaucagccuaaaugcccaucaguggcagauuggaugaagaaaaugugguacauauacaccguggaauacuauggagcuguacugccuggccuggaaaucuggcugugacaggcacuagcugagugaaacuuaccucugucuuaccucgacugcaagauggggauaauaauaauaauaucuauuucauauggcaguggugaggauuaagccaauuaguguaaaauacacaaaaauacuaaaaacagugcccaucacuguacaaugcuguguuuuuucuaccuucuccugcuccuccucuucuucuuccuaagucuucucuguuguuuuacuaagaaacacauauucuuugaauauggaagagaaaggaauuuacuuugcucauccuguaauauuuuuccuggagaugagcucuuagcuggcuucugggaaaagaaaauauuuccucuauuuuauccagcacucugcauagccugugacaguuauauaaaaauaucaguuuagauguguuagagauuguuuuagaagacuauuccauguaagccaugcauugguucauucauucauucuugcacaagugcgugaggauugcuucuuaaaugcagggcacuauaucugcaucagauggggacuuagaaucaucauuccgugcugacaagcccucugccaaagggaucaguacuccacuuuuguauagaacugggacagacuuuccgucacaauuuuguuaugaaacugucaggugagauguugcacugaauucccuuuaguagauuuauacaguuucagagauuuuguuaugguaacuugggggcuuuuaauuugauuuuauuggauucuuuuuuuagacucuuaaggcagugguguuuucaucacuacaucugcacaauuuguuauuggcauuauugggaauugcggauguaaagcagucuaugacuuuugggaauauuaauaaacuccuaaaguacuuguucaauuagcuucucugaccugcuguccagagguugagcugucauuaacugaggaagcuuccuaugguuuaagugguggugaggaaaaccauugucuuucuuccuccucaucuuugucuugccuacuucauucacuacuuucuugggagcagugcaggaagaggccguccaauuccagagcugcagaggggcuccuaugcccuagagaaugagaaagagcaugcugguuagguuuuauauuacuacugugccuauuuuugauuaagagaauguuuucuguguguccagagguuuaaaagauuaauaauuuauuuuacauaucuggagaauugcuucucucugccucaagcauuagggccagaguucuguauuuuguuugcauacaauuugaaguguuuucucuaggucuuauaggggagaaucugaagacuucauugcucgcugauuucagucuuacugauguugggcucuuagaucagcuugcuagaauacaaaaauuauucuuuuaucgugacaccaaauucuguacccugggacuccaaguggccauugaaagacuuggguuuaauguuagugccucaugcuaucaacugccuaucuguugugaaauucuuuuguugucagauuugucguuuccuuuucagauaguagaucaucugauuuagagcaugaagguacgucuuccuaaguuucuaugacagaaagauauugaagaagaaggagaaaagccaaauaccagagaccagacaagguggcaggaaauugcaaacaugguggaauuuccagucuuuuucauuuuuugaagucacagauaauuuaaaaacuacucgcuuuuacuuuuuuuuguuuguuuccuugcuuuugcaaccaugucuaucugccaaccuuucuaaaaugucaugauguaauuauuuuaacaggcacuguaugcuccuuuauuugggggauauuaaccuuucuaaacaaaaggaauguuaauauacacuggaaacacaacuaaugggauuucauuuuucuuguuaggcaagaagcuugacuuuuuuuuuuuuuuuuuaacuucucguaaaagaaugcggcaagugaaauaauugccuuaagcuaauccaugauagcgauuuuaaacgugacuuuccagaucacuuuuauauggcuuagaaagaauaaugugauuuucuuguuuuuguuugcuuuagcuaaacaguguugaaggaugauauaaauucaaugaauucaaaacaaagaaaaugcuaauugcuaaugcgcuaaguucuuuuaaggcaugaaauacaguguuuaauucauaagcauuguuucguuuuauauagauuuaauuuuuuuuuuuaguuaguaugggacaaacucagaauaaauuagccagcuagccauuuucuuaauuauuguguauuccuauuugauguuuaaauauauaugaccuaaauauguugugguuuuuauuaaaaaaaaaaaaaagaaaaaaagaauggucauaggcucucagauagugaggcaaagcacuuuuaggauuucuacagggcaccuccucucucccuggcuuuccaccucuccccuucccugccuucuucccuccuucccuuuaauauccacugaaccauuuucacauacuuccugaaucacccuuuugaccaauagcaugcauuugccauggcauggcuaggcuauacaucuuuaauguuaaagaugguaaggcuggucaggcgcgguggcucacgccuguaaucccagaacuuugggaggcugaggcgggugcaucaccugaaguugggaguucgagaccagccugaccaacguggagaaaccccaucucuacuaaaaauacaaaguuagccagucaugguggcacaugccucuaaucccagcuacucgggaggcugaagcaggagaaucgcuuaaacccaagaggcggagguugcagugagccaagaucaugccacugcacuccagccugggccacaagagcgaaacuccaucucaaaaaaacaaaaaacaaaacaaacaaagaaaaagaugguaaggcuaugaaacaaaugaagacuaauuggcccaugugguguaaagccaugacuuuggccuuuuuauugugaacuaccuccccgacaguuccauagacauguauacucugaacaaaauaugagucauuaaucccucuaauggagggaccuagaacagugaaauagggaggacaggaaggagaaugaugcugaauugaacugggaucuucuugucugucaagcccuugaacagcuuucccuuuaagcaacaaagaugacaaguuuuugcuauuuuggauuagugagaguguacgaaaugguuucccuuuccuuccaggcaaaaauaccaacagaaucuggcuucggaaugaaagugcuaauuucauuuggugacuuucagauuugaaauacgggcuugaacaggcauugugcauuagucagcugaggcaguggagguuauuuuuacgaugcuaauuauuauuuccugacagugauuuacuuuauguugucuacuguuuacgcccccaaacuagccauuguuuuaggaacagaauugguuggguugucaugcucuuuucaaagacaaaucuuacuauuuuaugcauagaaauacuuuccuguaauaaagaagaaagcuuuauugaagagaaucuugcauaugaaauguaaucuggauaaauauucaaaacuaauagguuuauauuuuagucuugauuuuuaaaguauauuuuucugacauccuaaccaccuugcuuuaugugcauuaaaguuaaaucuguuuuacugggaugcggcugaauuuuuguuacucacauugaacuuagaaaggagcgacacauauaguuaacaaauaaauacaaaaugaaaucgaauauaaccccuugaugcguaaaggaagauaaguggaagacagaguugauugcaugucuggaaguauaucugccugauuuaugcucuaauuuuaguacugaguuuccuuuguaauaguaaaaugucacauuagcaugucccuuuuaauaaucuaauaugcuaccagugacaauaaauacaugcacugagucuagcucacgguuucucaaacuucagaggcccaugacccuucccgauguaguuaaauugcccagaugacccuccugucauauauuuuuaauuguaaagcacuugaaauuaaucauguuuuauuucuuuuuaaauaagcaccucaagagcaguggugagcaguuuugcucacggcacuuauccacucuuaaagaaaauuaaagauuggaaagggccuugcgucucaguggcagcaaagccaucuacaugggggaaaacauagcagacaagagcugcguuugauacuccucuacacagucucuugccugugcacuuagugaaaauuggcaccggugaauauaacaaaguaaaagcauuuugaauuauuaccgcaagccuucaaguggucauaacccaagauuucaaguaccucagugaaggguaagguuuucuacaauuugugugguaacugagugccuuuaauuuaaacuacacggagcuaaucuuuaggagaauuggaaucugccucugaacuaauuaugauuuacagaaauugauaauuugucuucugcaugugucugcaggaagaaauuacuauuaaauuugauuaacaaaugacagauuucagccuaguaauuuaccaucuuuauuagcaaacuuagaaaacuucuuauaguaaucuuuucaaucaugucaacucuauucugguaguuaagguuuauguagaaguaacccauguguguggcuuuaguaagaaccuaccuuaccuuuaacaaagaaaucuuggugugguuucucuuuucaauaggcaagcacuacucaaacgcucacacugauuucccaugguacuuagaacuuaauaauagguaauuaacuuccaaaaaugaauaaucuguucuuuugaauacauuccugcacucccucaaaauauaugaaauuguguaaaaggaaguagagcauuauaucauauguucgccuuauuuuucgugcaccacuuugucaaauguuuuucuuucucuucaaacagauuguaauuguguaauggaggauacuauuggcuaaagcagugccauauauaugauugacauugugaaugauucugaauccuacuuuggauguacauaacugagauguaaaacuauuguagcauggcaguauagugagggcauuaaacuuuuccuuacaugagugacaugguguaguuuucaaaaguauguuaauguacauguuuuuauauaguugaaaaaauauuccauugcacuaagcagccuagcagaauuguuacagugguuaaaaaugcccuuuuauauuuucaugucaggaaaaucuuaucuucuugcaugucaaaaagggaauuugaacuauuagccuuuaaagacccagagguaaaguuuaauuuuauaaugacauaaaauaaauguucuauuaucuaaguaauaguucaccagaaaagucugaaauggccuccuuucucaaggaugcagcuuguaugugaugcuaauauuaaaauggaccugccaaauugagugaugggaggugcuaauaacuccaaguggggagaugaaaacaacauauugcacacaccugcucucagcuuuaugucagucucauuaaguuauugaaugggugaguauaauggggaaggaggggagucagacguaugccaagaagcaguugggggggcuaguaccccacaacaugaugaguaaacggauugucuuuggcgcaggaagccugcuugucacugugguucauccaugaccuuugaccugaggaugcaaaagaaguuuagauucuuuauagcagucuauccuggagcguuguguuggcaaugaagauuguuuuauucacuuguacccgcaucuuaguuuacugguguugcauugagaguauauguuuauaugcuuauuuaguuuagguacucuaaauuucguucugucucuuucaccuuuaggaugaaucaauaggguuuuuuuuuguuuuuuccuucugacaauguuugguauuauuauucuuuguuaaauacggcuauacauagucugaucugggucaaagaaagucauucaggcaguuugcuaacaguuguugcuaguaauggucacucuucuaaacuggaacaauugaacaccaacaaaacaaaaacuuaggaacugaauuguggggcaagcccauauaaggugugauggauucugggggacuccagagguuagccggugacccuuuggcuugauccgggccucucucugacagcuuucauucauuuuaaagaaaccugggaaaaguugauauucagaaagugcugguuagcugucuguuacucaccccaacaaaaaagaaguuucaugaaaugucuuucaacaauggaaaaaaauaagaaaaaacaaaacaauaagcaggccaggugugugugguggcucaagccuguauucccagcacuuugagaggcugagguggggaggauagcuuaaggccaggaauucaagaucagcccggggaacauagcaagaccccaucucuauagaaacaacaaacaaaaaccaaaaacccacaauggcuuccugaaguuauuuagaguugauuuuguaauguuuuaugaaauuuuaccccaguagguuaauccaauucuguuuugcuuauucugacuuugacauucacuugcaguccuuaagcacguaucuuuugaauacaagccaagccaugcaguggguggcaagguaagucaauuugggauuaaaaggcugucagggauaaugcugaaccacauguggauauuugagagguggcugcaccccacuuugcucucuguccagcuugcaaaccgaagucucuggaaaaaggaacuucuuaagguaauaugauucacgugagcagaagagcccaucagaggcugucugguuucaguagagaugaucaacagauaauguacugaauugguaggcauaaugaggauacaaagaaaagacauccuggaaaccuaaugaagacuucacuuuauuaucuuuucagauaauugcuuagaugcauguacauuuuccuuuuaaauuuagaguuaaaaaaaaucaaguugaaacacaaacauaauuuugagugaagaaaugcuugagcaucugggagguagagcaagaggguccuuggaaggguauggagcagcacagugaggcugugacaaaugucccccuagccacuggccucuaucaacccaaagugcuucucagaaaacaaauaauaaaacaaacaggauguaaacaucagcaacuuaaguacuugccagcucaguuguugggaguggguaaagcuaaagauuaaagacagcuugacaaaauccuacacacuauccagcugaguuuuacacauuaugagaugugguaggacagaaugaggguguuuaaaaaaauuauugcuauuaugcagcuggagggcaaugggcugaguugggaauaugccaggagaacuugugcugcuuguguagauaaacuuacaggacuucagcuuucaaccccauccaauucuuucugucagauucucuuaaccuuguccugucccuugcugagcacugacauuuucagagcagaggaaaaucauguuaaauuuauguaugaggagggguacaucuguguguauugcuguacucugguuuuaaauguuugggcucuuuugauuaguucugcccuugguuuauuuuguagucucagaagugcuuauaaaccagugcugguuaagagucuaauuuagcuucuccucauguucuuuggucagcgugguggcagucuuuuguggucgugcagaagagccucagccccugcugugggacaaaggggaccaaauuguuugcugucccuagacagccuaggccuguugcagcccagauggugcuuuuugucaguuuaguuuauugggauucugccgaauacuuuguuugaugagagaguuuuaacacugaagaaugcaugaaaaccugggaugcuggagaauugugagagaugggcuuggaaaggaagauucaagccaaauuguagaguaccuugaaaccugacaaaggggaauauauuuuuauuuuaucuguagacacguaauggggaaacauugaggaugacugagcaggagagagaccaugugaaggauggacugaauggagacuuguaucaaagagucugaguaucaaagacuuguauuagagaggguuguuguaguaaucuagucaggguaugagaaaugguuuguauuagagugucaggaguagucguggcaaaaauauauagaucaggaugagggaugggccucaucucacacccugacuccagucaauggcaguggcucccuggaguacacuacuauaggaaggauuuuguaaaguuuugucuggccucaguggagggugagguaggggaggaguucuaugaacaguuaguggugucugccaugguugaaacaauggagaagggggacaccuuuucugugcagauguugcuucugguagauauaauccacaauguaaugggagaaguacuaagaaucaguaaauuauggaggguguaaaagacuacugauauuuaagccuggcggaccggacuuagagaaaugauaguuaaaggagaaauauccagcaaacaaagauaugacauugaaguuugggacugcgauuaguaccagagauuggauuggaggugauuuguauagaauggauaggugauuuuacucuugcaauuuggauugagggugggaaaccagagagggcggggguaaauuaguagaggucaacuugaauucuguguccauaucaaugcugaacugauugugaacauuuuuacaucuugagucacauuguaaggagaccagaagugaauugagcauaguaagcauuuggaaguaggugaguguuugggguucucugucuacaacuuuuaaauuuuaacaaagcuccacgauacucuauuuaaacucuuaaauauuaccuuguuuauuaauuaccaaauuuuaguacugacuugagcaagaggucucuugucugcuauuuugagauuauauagaauauugacacuaagaagaaacucaaucguaacuccuauuagagaagaaaaauaacucagaagcguuaaaguuuugcccaauaucacagagauaauagguagcaugguugggccugagacucaggucuugugauuuucauucuaagugcuuuuucuguauucgaugcuauuuuuuuuuuuuuuuuuacaaucuguaugauacagauuugaacauuauuuauagaaauaaaggauaaaugauguguauaaucugauagaauaauuuugagaaaugcagauauugauaguccccagcuuuuucccuuuuuauugugcugauucauuuauauauucauaaauguauuuaaaccagucucugaauauuuaggucagugcuagucauuugcucuuauaaaugggaagagacuguauaaguuaaccagacugucuagguuuaaaucugagcucuuccauuucuuaccuaugagaucuuugauaaacuucuuaccuuuguguuccaguucucuuauuuguaaaaugaggaugauaauggugcuuaccccauuggguuacugugaagguuaaaugaggguggauauguaaaguacuuagaacagucuuuggcacauggcaagcucuauauauguaagaucauagccuugagaguugaccuuuuggauucaaauucuaacuccaucuuuuacuaguuguuugaccuuggacaauuaacuuaauuuuucuaagcuuagauaacagucuguaccuuauagggcugcuacgagaacucagugagauaaugcagauaaaguacauucucaaugcuugacuucaaauaaggacacaauacaagauaaucauuuucauuauuaccaucauaaucuucauaaugaagaauaauaugauaaugaacauccaugcacauaaccccuuguaucucuucaugaauguuuccuuaggguaaguucuuagaagugaaauugcuaucuuccucuugacuuucuacaaggucuuuaaucuuuacaaaguuuuguauauugaaaaagacaagcucuuauugaacacauaguaggugcaauuuaccagcauaggcagaggagguuauauaagguugaacauuucuuugucuauauugacuuuguaaucuagugugagaguuaagaaaugaaacuaacugugguaaaauaugcaaugugagauauaucuuugaaaagggacaaaguacuauggaaacacaucauuugaagagagaaauuucagcagagggaaaucaggaaagacuucaugcaagagaugaaaaaauuagauaucuaugaugcauaguguuuugauagaugaagauagugaagcauauccuuggcauagcaagguuugucauauggccauuucugucacuggggccuuaggguuuaagugcauauacuagcccuugacuuuggagacuuagagaccgguaaggagcuuaucuucucuccacucacucuguuccuccauguagaaucucuuuaucuuccuuccaucuccuucaggacacaggcaauguuuggauuuccuaguuucucucagaaacaugauacuacaucguguauuacuuaagacagauucaggccagaguacacauacaacucuugaguuggucaaauuggaauucaguuucuagguucuccaugauuacuuuaaucugauuuaucugaagaaaaguuaaucuguugguaugaucugauggcaaggcuuuacaaguauauguguuuuaauguagucgcaauuuuuaagguaaguuaaagccuuuccaguuguuacuuauuuuucagugacaggacaaauggcuggcauaauuuauuuuuguuuguagauggauauaacuggagaucuuauauauuggguaugcauuuuuuaugaauuuauagaauuuuagccuaagacguuggauuagauguuaaagcauuuauguugauaagcaagaaguaaauuguauucugauccaguuuguauaauaaugugcaaccaacccaauucacuaaguuuguauugguaauuuugcauugcuaugggacuuaaguuacauauauaagaguugacaguuauuucagcauguguuagacuugaacuccagaagguuaaggggaaguucugcuauuuauuuucuguucaaaaacagaugaaaaaaggaucuuuauauuauucucugucacacaccgguaaauacauggucuucccaaauccaccacgaaccaaugcugugagcugcuuaguuugcuuguuucccuaaagcuuucaugugacaaauuuauaauuuuguauguuauuucuaggucaacaguuagauuaauguuuuaucuccugagcaaaaacacagugcuucuuuguaaacuuuguuaucuuacugaaacugaaaauugcaaaacaaagaauuuucuaguucucacauuccuugauggagaacaguguuuauauagagguuaucuugugguuuauuuuauauucuacuuaacuuuaacauuucugcagguagaauaaauauccuauuuaaagcuuucaaaucuuauuaauuaaagguaguugucauuacuaauuguuuacugaguuuuauuuauuuuugcuucauuguagcucaugaggaggccaccuaaauugaucagaauauaagcuuauccuagucacugaaauaauacuuagugccggcaacagaaauauacucaagaaauauuuguuaagugaauaaacugauaaugaccuaggaggaugcaagucuuaaaaaguaguucagaauaugcagauuuuaccaucagucugagaguugguaacuuagaacauuuucuauuugagcuaguaugaauuuaauuuuuuagaaugcgacgaugucaucaguucuuaaguaggccugggaacucauucuuuuugaaauauauuacauuuuagagacuuuauaacaacauuuucuuccauuugcauguauugacaguuuuuuauguucuggcuggucacagugggcucaugccuguaaucccagcacuuugggaggcugggaucaccugaggucaggaguuugagaccagccuggccaacauugagaaacccccgucucuacuaaaaauacaaaaauuagcugggggugauggcacaugcuuguaaucccaguuacuggggagguugaggcaccagaaugucuugaacccgggaggcagagguugcagugagccaaaguugcgccacuacacugcagccugggcgacagagugagacucugucucaaaaaaaaaaaaaaaaaaaauauauauauauauauauauauauauauauauaauauuuauuauguugugugacuccacucugagaccaggggaaauuugauuuuaaauaaaucccccuuauauggcguauauuaugaccuggcuuuuuuuuuuuuuuuucuuuccacaaccccaccccaaaacacuuaauacauuucagcaacugaguaagcuucaucauuaaaaacucuuagcauugccaauucuaguuauuuuucagaguguuccuagaaagacacauccuaaaagagauugucaugaaagauuuuguauuuccuuaaaggaacaauagagcuugcauuugugaucaaagauggaacagagauaaucauagaagugacccaaaugccauaaaagcaaaaauacagccauaaaccuacacauuauuuuaucuuuauuucuauuuaauaaacauuuuggguauguacagauaugaaucuuagguagucauuaugcucagguuuuucagucauugagggaacacaugauugcaguggacuccagaugucgucagccagaguucaggauucacacgggaacgcgagcuuuauggcagcuggguaauuuggaaucucaucuuuauaacuuggaugccuggucuggcaugguagaguggaccugaugaguaggcugauuugaaaucugaucugagguacuuuagugaucuuauuggaaacaaaagaauaacuuagaauacguggagggaugaauacuuuuuuuuuucuaccucuuuuauacuaaaauacuaugaaucucaguugggcaugagagguagugaauugaagaggguuuguguccgagcucucuggucaaagcuuggauuuacuuauucugugcuauaaauuaaaaggaaauacacucucuuaauugguggugaagagacuugcugaaaguugcccaauuuguaauuaaacuuuggaucuaauauucuuuuuuucauuuucuauacuuugauauuagauagcugcuuguaugacuauacaugaugaaauaauuggauacauguuaaaaaugaaaacuaaacucugcauaaguaaaauuagugaagaggcagaagguagggguggccucuaugaagcagguaugagaaaagcuccaugaaguuaugauuacauuuguuugauuuuuuuaauuacaccauguuuagaugguuauuuaaaagaagguggacaugaacucaucauuuuuuauggcugcauaguauuccaugguguauaugugccacauuuucuuaauccagucuaucauuguuggacauuuggguugguuucaagucuuugcuauugugaauagugcugcaauaaacauacgugugcaugugucuuuauagcagcaugauuuauaguccuuuggguauauacccaguaaugggauggcugggucaaaugguauuucuaguucuagaucccugaggaaucgccacacugacuugggacauggaugaaauuggaaaccaucauucucaguaaacuaucgcaagaacaaaaaaccaaacaccgcauauucucacucauaggugggaauugaacaaugagaucacuuggacacaggaaggggaauaucacacucuggggacugugguggggucgggggaggggggagggauagcauugggagauauaccuaaugcuagaugacacguuagugggugcagcgcaccggcauggcacauguauacauauguaacuaaccugcacaaugugcacauguacccuaaaacuuagaguauaauaaaaaaaaaaaaaaauuaaaaaaaaaaaaauaaaaaaaauaaaagaagguggaacagaccucuuuaaaauagaaaguacaggaucuuacaaagcauauagcacuugcagucuccuccccucuucuuaucacuuuuaugccaggaaggauuaagaaauuugaauauuuggagacaaagcagugugagauguaauugcccaauacugaaggagaguugagccauagcacacaccacaguagggaugcuauaaccaguuaugcaggcggagacacagugugcuuccuacgugugagcaucugccguuggucagugggggccuuccaaaggcugaagugauuaugauacuugaaaacauguuggguucaaggauuuauaaucuauuuuuaaaagacaguaaauucaagguaaaauagaguacacugguguguaccuuagauauuaguucuuuaagucuuucuccaaaugguaguuucucuaaaauuugagacaugaacacuagguaauuuaguauuaggcaaauauuuaaacaguuuaaaugaguuuauugcauccuggcucuauuacuuacuagcuguguaaguaaccuuaggcaaauuauuugaauuuuuugcgacuuaauuuucuugucuauaaaagauauuuaacaaugguuucuaccucuuaggguuuuugugaauauuaaaugaguuaacauaugcgaaguacuuagaaucguuucuagcauauaguaacaccguacauguguuagcuguuaugauggugguaaugauguucuccuccuccuccucuuucuccuuuuccuccugcuaacauuuguagaagugugaacuuucucucaauucaucuacucgcuucaucugagaagagccagucuuccugaccaguauuuuacaacccgagauacccacuuagggccaaccaguaugcuaccagcuuugagcuuagguuauuuccaaccaaucucuuaaaagccggagucaaaauucaaccucaguucaguaaugguaauuguuuuucucuggucaucccuaaggugauuuauuacuagacguaucaguaugacccucucauaacauuuuuaucuauuaaaaguuuccugagaaauggauuuuuaauaaaccauuaucacaacagcauuauuaucacuacuccaugguguauuaauuuaaccacaucuguggcccucuaguuuauuuauaguauugugauagaagucauggggaauacaaagagggcaaaaaagaaaaaaauauauguauaacuuaguugggaagacauaacaaaugcauaucaaacguuaaacagcauuaagaaaaaacauuaguaaagagccaagggagguuagaguaaggaaacagaaugccugcccuaagucuuggggcagaaauagaaauauagaaggcaggaucucaauacacagaaaggaggggugcaggucgaaugguggaggaagaaugucuguggugcauuaagagaaaccaugagcaaguugguuucucuggaaaagagaggugcuguugagaacuaauaggauagcaaguugguaaguuuggaagacagacaauuauguggaaagaaagaaauucuguuaccugcaacaccuaaugucuacaaccuaucaaauuagcacauguauuaagcacugauaaugccagcuaaaucucagucagaagcuaaggaacuggagaacaucaaggaccuaguugcagaagcauaucagagcugcuggcccugaaaaacccugaaagagccgggaauuaagaauuucaucuuuggacucagccaagcuuagacagacuugguuuuaaacucaguuuagcuacuuacuaguuguauuaguggaaacauuaauuaauuaauucucuguaccucaauuuccucaucuguaaaauggugauaagguuaauuugaagauggcaucuuugaaauguguaaggauugaaugaaauggguaauuuauguaaaguucuuacaaauucaaauauauagucaguacuuacuuaacgguuacuaauaauaacagcaacagaguauguuucaaccagacagaauaaguucaauuuaauuuuuuuucaucuugagaugccauguaaaauguuaacuaauguuccacuucuuuaagaaaaaguuggaaaaacacucauacuuauuuuuaaccuuacuacugugaaaugacagugcuucuaauucuggcugugaaaucuaguaauccuuuuaaaaggauuaaauugugaacaaacacaucaggaaagaacuuaaaucuaguguuuccugacuuauuuugguucugauuaauuaaauuuuuuucagaaaggguagaaaccaagaguagguauaauugaagaguuaaucagaaaauuaaauaaggguacucauuaaccaaguguuuuaguaauagagguuuuacuguauuaggaguucccacuuguucuuuuucugcaaauguggcagucgguuuuauuuuuaaaugcugacauaaauugaaagucuuuuauaaccucugaagcauguuucgcaaagugcaguccauggauccuuggaggcucccaaauuccuuuugagggaucgaugagaugaaaacuguucucauaauacuaagacguaauugccuuuuuuggguguguugacauuugcucugauggugcaaaagcaaugguggggaaaguugugggagccuuagccugaaucgaguuaguggcacuaaacuguccuagaagucauuguauucuucaccuccacauacaguaaaaaagaauaucccugaugaagcaguaaaaauuauuaauuuuaugaaagcuugaccuugaguuacauguuuuuaaaaauaguuugugugaaggagaauuacaaauaaagcauuuuugcuacauacuugucucaaggaagaagacuggggagauugaguuaaacuauaguuauucagacgcguauuuggcagacauuuucuggaaagcagugagccugucauuuuaagagaaacaauggacauuguugucagugauaaaauuaaagauuucaaguggaaaugugaauuuuuuaaaacuugcaucuuccucugugaacuugacagcuuccuaaugaaccauugacuuuucuuaugauauugguggugauacuaaugaaugugacuuuuuugauacugaauaaugaaaugugucaccauuuggaagagugcugcauaacucagugaacuaauauuuuccaaaugaccagugcaugauuuuaaaacaucaugaguggcuaaaagauccauucaaagugcaggauugacuaaugaauuuuaaugugacagaguaugagaaguucuuugaugugguuucagauuccacaauccaauuuaaccaugaagaagccaccacuuguugaguuuugguauaguaucaaaggagaauaaaaccauaauuaucugaaaagacuauuaaaauacuuuuccuuuuacaacuauauauauacaugaggcuauuuuauuucccauauacuucaacauaaacaauggaucacaacagauugaaugaagaagcaaaugugaaaagccaauuguucucuauuaagccaaacuuuagauuugcaaaauucuuuucuaauuuuuuugcuguggaaaauguaguuauuuucacaaaaacauguccuuuguguuaacacgcgauggguuuauuaaguggauucauaagauucuuuaaaaaauauuaucaguuuuauuuuuaagaguuuaaagugauccugacauuaugaacuuugagaaccacaccccugacgugguaaaauuaaauuuuccuaugaauuuuuaugguuuaccagugcaugagauugccaucuugugacaaaauagggaaaugcaaguauuuuugaaaagcucaucuuuaaggacuuggagugauuucuaaugacuacuuguuggaaauuuaucaagagaaagauauaaguucagauuuccaagggcuaugucuuaaaauauaugugccaaaaauauuaauuuucagaagguaagcaaaaaacaguuaauuaaaugcauauuucuaaagggcugacauugguuuggggccagucuucuguuaagaacacauuuaguuuuuauguucaguguguauauuuccuauuacacugagccccuuuguaugugauguuauagacuacucgaauguguauuuacuguucaaaacacugauaaauguuuguggugauauucugguggcauauaguugucccccuuuauucucaggggauguauuccaagauccccaguggaugucugauucugaggauaguauugaacccuauacagacuauuuucccuauacauacauaccuaugauaaagcuuaacuuauaaauuaggcacaauaagagauuaacaacaacaauaaaacaauuauaucaauaugcuguaauaaaaguuaugugaauguggucucuccaucaccugaugggguacucaucaauugaugaguacuguacucaucaauuuuuagacccccauuggcccaggguaacugaaaccauagaaaguaaaacuacagauaagggggggacuacuguaucaucacuugugauugacuuaagguuuagucauugguugauaccagaaacuuggcugauaauauucuucuuucuaaagggaaaugugaucaauucuuuaugauguggaguuuagguccacacucuggugaagaguuugaauuugcugcccuuaaauacuacaucacuguaguucugugugauguguccuguacaaacaugcagaguaaacauuguuccuugccuucugcuuucuugagcacuaaaauacacaguguaaauaugcacaaacauguagaaggacauauagacaaauacagccuuagccaagucaugagagaugcagcugcaagaaacaggcucaugcauaaugaacauuuaugcuauggcauagcuuguguuuuugcauccaugagcuguaugaaaaggaaggaaccucacuucguuuucauucaguuagaaugaaggcccacuggucaguuuuuugacucaauucagcugauuguuuucaaaauaaccuguucuuuucuaacaguuguguguagggacagcugcacucugaugaaaugacugugagccuauacgcuaacuacuguacuaauuuucugccuauauuuacuaugugcccagugacucugcugaugaauauuuuagacaucuucaugaauaauguuacugcccacaguagagcugcuugcuuguuuguaaggcuggaaaugcuaucaagaugauaccgacucccauucuauauaccaacgugaaaauaauaaaauaccuaaguaagguuguuggucaagauugucuuugaggaaucauggaugcucugaaauuggaugccaaauuuuacauguagguggauguguguuuuugagaaaacuccagagcuuuuaucagacucuccaaagggauugugaucucauaaagacuaagaaccacuagauaagcuuuauaguuuugaaagugcuucuccauacauuuuuauuugauccucccaaugauuuucagggaggcauguugggcauucucucucuuucucucucgaucucucaacagaagagcaugacucagagcuuaagugguuuugugcuucauccuguaggcacugggagccuuugaggguuuuaagugaggaagugaucugaucagaucguccuuuagagagauugcccuggugguaguguagaggauguuuuaggggaguaggaggcuaauuaggacaccauugggaaaaucagguaagaaaagaugguuggccuugaguuuguugcagucagauuggaaaagaggggaggaauuugcuaaacagcuuugauuuugaagaacugaugggacaucagggagaaaagaccaguaagcaauuggacguucuagucugggacuggugaggugaggaggaccucgcacaggguguauagagugagaagugaagaguuccuggggagaaaaugucagcuaguguuuggcuggagugauggucuuagggaagcgcagggagauccaggaacaucgcuuuuuuccccccauucucuguauuccuggguugacaaguagggauuaaauauauuuuuuaacccucuucauuuacuaucagauuauuuauauuuuuauuucucaaggacuuuaaauuuaugaaguuuacaaaaaucagucauaccacucuaaucuaccuucugcucaguggaggcgucaagcaaaggauggguuaaggguacuccccuauaaucaauaugaucuucuccauucuuagauguggaaauugacacguuaucgagcauauguaagugccauaccauuccaacuuuacauacuucucaccaccccugcugcaccucaccucccuaauaacacuucugggaccgugguugcuuuaagaucagcugacuuuucccucagugauucaaugcagaauccucaguaaguagagcauuccuuuugauggcuuuacuaauacccagaucucguaguucuuuaaaucccucaacuaaaaugaccuucaucuucauuucacuuuggcugugcacacacaugccacaccuaauagaucugcuccacuuugaauauuucaaacucuauuagucuccucuuugaaauagccuucuaacuucuaccugccccauccauguuucuccucaaccugucuucucuuccauuccuuguuccauuccuuguucuguccuuguuuuccaguaugggaagauaggggagggaagaggcuggcaacucucuucgaaucccugcuuccguacucagcccacaacuauucagaugguucaauaaugauugugcuuacccugcagacuuccucacauaguauucuuugagaauuuccaacucagguucuuuuccuguuuuuuuccccgacuguuacgcucaggcaccugggcauuguuaguaaauuucauaaaaacugggacaauuggaucaauaaauguauguagaauaaagaaaucuaucagauccuuccccacgcaggggaggggaagcuuagggcuguguugaacucaaaaaaacaaaaaaaaaggucuauauuucauuuuaguuacaucucaacuagcucugccuaugugaauauuuguaugugugucaccugauaguggucagaaauuuggguccuucauaccuuuauuucuauuagaaaaucagccuuuguacccauuuuuuuuccuuacagguauagacuugguaaaaucuugauaaaaauuuucugcacauauuuacucuauuugaguuaggaacuggacugugugaaugcuuuuucuucuaagccaugagugauauuuauuuauuuuauuuuugucaguuguuuccaugguucaugaauucuuuauuauauauaguaggagucaucaacuggauggagaaucauugaaauuguaaguuuaggacauuaguuggaauaaccugaacaaugugcuuaccuuuugggcccuuaauuuaauuuaaaauuaaaugagucuuaugauggcaagcuucacagaucugccugcagggcuuucagaauggaaaugugugucucugugugugggaggcucuuuuguuuaguuggaaaggcuaggaaaucuuugccuaaaaacacucauuguuuagagagcauaaauaacugaacauaauguuagugagaaguuuaauuugagauugaaccacugacuuccaagaauauagcagagugaguggaagugcuaugaacaaugucuuccuuauuuccuuuaaaaugcccaugaaauugucucaaaaaaaccaaauccccagaaguaacuacaaugaguggcaggcacugagcccauucuaguuucuggaaggaauuuuuacauucuuuccuguaguugaaaucagauggaguugccguuucuucaccaggccccccaaccugcaaccugauuccuccucuucacuucccuguuucagccacuagucauggaauccugcucaacauguacccuguacccuuuuguucauguccagugcugcugaguguuaguugauucuguaacagcugcuaacaugcuccuucuuggguggaggugguucucauugaacugacuccuggcucccacccagguucugggcuggucugugaauuuaggugcuugaaagucaagaaccaggauuugcaccugcuuccaaucauccuuuggcuccacuuugaacacaagggcaucugcaaagacgucuacaugcggucacuaguguaggauuuucuugucuccuccauuagacugagcuccaugaggguggggaaggaagagaugagggugggaguauauuccuucucacugaauccccaacacucagaauaguacuuagcacauguuggguacugaagacacgcaucaaacucauuaauguaacucaaucguugggaaggacuuaaaagcaguccugaagcaugguaagcacuaaaggccaaggucaaaccaagcccaaggauguaaaaaagaaaugaaaucacacauuauagaugaauaauuaaaacaaaauucugcagcuccaaagcaaagaaauuguagagaucugcagcaauaucuuucugaaacaauuuuccuuuaugagacaguuauaaaagcugugcuuuguaaacucaguaagauaccugaagaguuuacaucuaguaaaugagaacuuuaaaaagaauaaaacgaagugaaaauuauaguagauaaaauaaaucuccauuguaaauaaaaagcugacuguacuuagaaaauucauccaguugauauggacaggaggcagggaaauacuggguaaaagagggugguucccuggcaaaggccccacucucaagcccagaaacccauggcucuaaaugagaacaggacuuccuguuuucacacccaaauguucucuuuuggccugcugcaccccucuauccuguacccauauaaaccccagacccuaggcuccacaagcagaagagcagaggagcagaagagcagcagugacgugguagagaaggagagaagagaaggaacaucugaacaccgagaggaguucagcuggggauagcuggagaggagaugguccauggaauggucaaacuccagaggaagaucaucuucccgcuccaucuccuuuccggcucccuauccauccugcugagagccaucuccauccagcaauaaaauccuccgcauuuaccauccuucaguuugucugugugaccugauucuucuuggacacuggacaaaaucccagguaccaagagggcacugagcugguuaacacuuaagcugucuguggacagcagagcuaaaagagcacuguagcacacccacuggggcuuugggagucacgggcacccagcccuagacgcuacuaugggaucagcucccaaaagugcucuccccggcuccugcaccugcccuucugugugcucccccucccauaagguguuagagcaugcagcagcccaacagacgagccacaccccuguugcaugucuugugaggggggucagggaacucucccguuucauagugauagaggauagacuucaaaaaaaugcccagacugcaacaaaaaagccuagaaagacacagauccaaccuaaaacugauggagauuauuguggaagacacagcaaaacaauccacugugauaacuauuggagggacauuuuucaguucuaaaagaccugaucuuggguacugauauaccacacuacauuccagguacacuuucuaauuauuaaucaacauugaaaaauauucagauuuuuuuuucuaacuagaaaacuugcagguagaguaaggaaguauaaaagugcuaaauuauuuguccuucauuuaagagagacuaaaaugaucuuuugggauuauguugagaguaguuaaguggugguugaaaguuuaauaaaauuuauuuaaauuuaauaguucauuaaaauuuauugaagguuuauuaaaguuauaaaaauaacuaauagaaguaaaaaacaggaugcccauaaaaguuaauauagaaaacagaaucaaauaaaaugccauaaucucauccggcuacagagaaacagaacuguucuucuuucuuuccuugucucucauguacaucuucuuaccacaucccauaagauauacugacaacuuucuuagggacuuuuuuagcccacuaaaaguucuuuuguccccccaaaagagauuggauucuauauauauauauauguauauacauauauauacacauauauauauacauauauauacacauauauauacacauauauauauagugugcguguguauauauauauuuauauuuagauaguauauaauuaauuugacucauaaaaauuacaacauuccuuucaaacaacucugugauguaggcagacaagggaauuuagcacauaagguauugccuugucuuuuugcaaaaaguaugugauucaccugucauggugcaugguaggcacuaaagaaauacuuguugaaggaaugaagacauguauaacuuaacuagcuauacacuuggaaaauguaauuucaucuacaaacaauaacuuuauaaauaauugcacuguuucucgcccauuaaauuuacugugaaaucuggacaaaacaucugucauuauguaagccauggaagaaauguugagauuagcaugcaguaaugaacaugguaguaaaugcuggggaaggcagaaaucagaagagacguaaauaaguccuaaguuuuaggcccucaaaagguuaauuuggauuuucguucugggugucuucauaucagagagacuuggccaaucugauauaaaaaaaaaaucggaggucaacagaagugauuaagcagcuaggaaaauuaacucagaaagaagaucuuaguauauaauuuggaaaaaggauuugaaucucucaaaacccagagaaacagaaggauaauuuagaaugcuuuguagagcgguagagcugauggcauaaaaugaagcagaaaaaaauacugaguguaagacaguucuuaauagacagacaaagaaccauauagcauuccaaagaagguaguaaaguuguuuugauagaaucugacaccccaaagacagacaagcgcuaacauuuauugaguacuuacaauguaucugguacucuguaugcauaauuucauuuaaucuugcaguaaucugugaaguagguacuaauacaaucuucacuuuacaaaugaggacacugaggcuuggucacaugaggcugguaggagauagugccguauuuugaacucuuguucuagaguucaguccacaucacuauacucuccugccuucuagucaugaaguugggucucaguagguguguuguguagagguuugacagaauaacccagcugguuuuccaaaugcugaauaggugauucuaacaagccauuuuaauuaaguuaaaaaaaaaacucuuauguauuccaaucaaaaguguacuuuuuguucagucuucuggaugaaugaauccuugcagaaacaagauuuguauaugaaaaagcauucuuaaugcagauuuaaaauaaacagguauuaggcuccuggacccgauagagugagcagcaucccgcaagugccagccuugcaggagguuuuaucugcuggaaaauuggcugcaugguaguguauaggggauuggagagagaggcuugggucgaaauuccugaucugccuuucauuugcuuauuaccucaaguaagucaccuaaccccucuggaaguaacaacacugcuuaugucauggaguagagaaucugacaugauagcguauauguaaagguagccugcacauaugcaaauuagauaguaugcauguaaagauggcaaguagauaagauaacauguauauaaaaauaguauguauguuuuuauauguaaaauguuuagcucagugccugacacauaaugaauauuugauuaauaguagcuggcauuauuauuauuuauuauccagauacaaucuucaaguaaguacuuuagaaaguauagcccggugguaaguuuuaaaaaagauucuaauuuuauacaguccucucagauaacauauuugauaguaaaauuucacccucuguguacccuuuucacaauuugggaguuuaccgaaugcuuugguguuuuaaaggcagucguuuguucacugaaaaugcagcuuaugacaaauucaaugguugccaagcucuaauauguuagcaggcagaagcaugcuuuuaauauucaucaucuuuaagugcuaccaacugacauuuaguacuaaaugugcagauaugggugcugagcaaaacagagcuaggaagaggacuugcuaauuuguauucuagauggaaaucuuaaauuaguuucugagauuuuuaaauggauuuuuaaaugcugggcacauaggaaauugaguucauauuaauauuuauaagguuugagaagauauuuagugaaauauuuguauaauuuaauuuuggucauaaucaaguaguaaaccauaacaagaaggacauuguacuuuagucugguggcuguuuugugacuuaggaauauccuucuggaaaagcccugaaugacacacauacacauacauacaugcuucaaaaguucuucuuuauuagaacccagaaaccagagguuauuuauauauaaauaccuuggguuggauuguuuuguguuaauuuuaaguuaauuaauuuagaaaucaguguugauaaugauuucuuuaaaagcauuuauugacaguucugcagaacucuauaaucuagcugcuuuuauauucuuuauuauacagaacagcuccguugguucauagaauaccugcuuccuguaguuuugcuuagggcuaauugaguuuaauguaguuuugugugcagaagguauugacuugugcauaguauuuaauuuguguaaauauguguguauguaauguuuugccccucugaguuuuauuuuaaauguaacccuugaaacugggauaauagaaauucuuagccuaggccugcuagcaauugcaggugccaacgguuuaaacugcuguagaaauacaauuaugagcagccaagagcaaaucuuguuuuaagguccauguguaaugaaugccuguuaguaucauagaauacaauuaaaaagagguuuaccucuccuaagcugugauugguucuuucugauggaaguguagagucccaugaguggacuguguauucagcucuuggugauuuagacuccagugagccuggcauucugcaggcuuggauaaauucagggcaguuauagucaggcagagaugagaaaagacugaaagauuaaugagggagcuuaaaacaaagcuucaaaaaugagagcaacacacugcuuggucuuauguaauugugccgaguagaagucagucuuggcugcuguuguuuaaaaauuuuaagagguuggcagaaaauauuuguuauaaaaauuguaucuugagaauaauagugaaaaccuaggacauaagaucuaauucuugguugcuuguguaugcccuccaagacacacccuucucuucauccugcuuuuauugcaguuugaccaagcacccugcuuuccugcugccccccaccacuucuuuuuggcaaggacccuuauugaugacugauguccaagcccuggcugccuccaggagaugcacgucugggacgugcuccuagaguucacguugaugcucucucacuacaaggccugaaagaucgggagcauauagaggugugagagcccucuggggagauaaucuaagggauuguuggugaccuauggccauuucugguugaugguuuuaaauagcaguugguuaacauuucuucuauagaacuuaagggaugcuaauggcuuuaaaaugcuauuuugccuuugaaaauccucuuaauagaugcucuaacgaaccuuccauuuacgugauaggcacgguugagcucugcagugaagcuguucauacuguuaaugugaagcugggcacuuaaaggggaaaaagcagcucauaaauaacguggcgcaggugaaucacuucugaaaucuagagcuugccaauaccagugaagaagagcugccuuggaggagaaauugccaacucucaagcaaauucuucagcgcuucaaucuagacacacaccagccuuuuaacuuugcuuucuguuuccucuucaaggaguuugucgccaccuacaggaaacaggaagcacaauaacccacucagucucugagugacaccugguuucuuccauuggucauuccucaucgcaguuuuuauacauuuuaucacuuguucaucauauaguauuuaucaagcuuuuuucuuggcuauggaaugaggcuaaggucuauggaagaaaagguucuaucugcacuagcuguuuggcaggagauuccucacccuuaauugcuuuuuaaggucucugucuguuucugcugucauguucuuuuccacgaacacaccaacaagagagaacagacuuaccgauuggggcucuguaguauauagcauguaaaaguacuagugcugacuuacucacaauuuugccuucuuuuguuuguuggagagagcauggcaccaaaaucaucauuuuuauuguugauguuguugauuuuguuuucuuuugccuuauuuagagaaaaauguuagguaguuaaaaaccuacauagcaaagaaaguucaagaugcaugaugcaguucagagaagucuaaaggaagacaugugauuacuuuuacggguacauuaaggguguugaagagauaauuagaaucaauuauuuucauucauuagcaucucauaacuauaucacugaguuaaguuguuccccauuguuugaaacaagagugaguuggcuugaaaggaguuaagaagaaugcaggguuuuucuccuucauauaugaaugccuguggcucuuucuuuuucccacagcaucuuuaacccagauccucuccugaacuccuucuggguucuuuguauggcuaucugcuucuccuggaacagcaacuuaacauauccuagaccaaguccauuguggcccaaauuagauugaucccacuuuuuuuuuuuuccuuuuucguaucucuccucuuaaaagagcagcagaaaccacugccacauaaugaauccuccuucagaauauuuacguuuuguuuuguucuccuuuuccuccucccucuuccuuugggcaagcgauacuauaaucauccacuguccuaggaaauaauucuuaguuaucuuucucaguucaacaccucucuacuacuaaguccaaauaaguugcuuuaccuuuguaacguuucgugaacuuccuucaucugaaacugaaucugugcuuuauucuucuuaccaucauuucaucaucuugaauuuucuguaacucaaccucuuccgcaucauuuagcuccagaaauucuuacuaguugacuuuuaguagauuugggaaaugggcuguuggcuagaaagagcuaucuaaucaagugaaauuucacccaucuacuuucccugcaccccacuuccauguuuaugcuguggaauuucaagacugguuuuagauauuaucuuagaguuuuuauuuaaacaucaaaaguaacuuaggguaagaaaauacaucaguggcuuguugggaaaugucacacagugcuggaagauuauagauacaauauuuuauauauuucuaccgaauaguugacuaaaaguugcucaaaauuauaauacauuuaucuaaagaagauaaacacaucaucaauaagcaugaaaagauguucaaugccauuagucacuagagaaaugcaaaucaaaaccacagugaaguaccacuucagacccaguaggauagcuagaauuuaacaagaagacaauaacagguguugacaaggauauggagaaacuggagcucuuauauguugcuagugguaauguaaaauggugcagccaauuuggaaacagcuugacaguuccucaaagugucaagcauagaguuaccaauaugacacaacaguuacacuccuaguuauauacccaggagaauuaaaacgugucugugcaaaacauguacaugaauauuauauuauuauuuauaauguaaugcauuauauuauuaagcagggaugauucauaaucaaaaaaauggaaacaauauccaauauccauuuauugaugaacaaacaauaugugguauagccaaauaacagaauauuacgcaaccauuaaacagaaugaaguacugauacauucuaugacauggaugagccuugaaaacauuaugcuaaguggaagaagcccaaaggccacauauuuuaugauuucauuuaugugaaaucuccagaaaagucaaaagcuauagagacaaaaaguagauuagugguugccacggguugggauaagaggcgaaccagaagugacuaucaguggauauaaaguuucuuuuugggaugaagagaauguucugaaauuagauaguagugauaguugcacaacucuaugaauauauucaaagucauugaacuguacacuauaaacaggugaguucugugauauaugaauuauaucuccauaaaaguguuauauauacuugacauaagacuauaucuaaugaagucauuggcagcuguauaugcuuaacagccugcgucagauucauuuuugugucuuccaaaaugcuaaacacaaugccuugcauauguaagccuuugauaaaugguugaagaaugaaugaguggaugauugaacaaacaaauucacgaguggucuuguuacaguguguggaaggauuguuuuuggcaagugcuacaggagagagguaaagaacaauggccacgaauugaagcuucuguccuccuguucacuuaggcugacaguucagcuguccugucauugaucugaugucagucugauagaaucauucugugcuuugacgccagcuagaugguauauuucuuuuuucuuuugagugauagguuggcaaaauguacuuuagcgacuguauguuauguggaugaugcaugaugccagugcucuguugugaccuuuauuuuuaugagcugugagaauuaagaaccuaccaguuuuaguuuaauuaagcaguaagacacagcagauggugcauuugugggugaugauugcauuccacugguuuccucaagcagcacucuaacccuauggaaugcuuugccuggaguaucacgccacuguugcaaaauuaccaggaagacaaacacauuguaauaauguagucagaaaaucuuggaggacaguuuagaaaaggaccugaacuccacaggaguuuuaguaguuagcagcuacuggaacuaggauauuaaggagaggaauccaugacauaacggcuguagccauuuacuacccaucuuuacuuuccaauauuugcaaauaaaguauaugaagauuuuuauuacccuaguauucuuucguguaaucugggucaaacauuaaaaaugcauuggaauaugauuugcauguauuaaagugcucagagaaguuucaguaaauggagaaauacugaauugaugucagguuguuuuauuauguuugcuuuuagucacuacagagggccuagaguguccuacaaaaugcauuuuuccccaaguacugugcacuuaccacuagcauauuuacuccauaggauguugaaaacauaccuaagcagagauaauauagaguuaauccaguacuucuuaccaaucuugcaacucuuuaggaagaaaaccaaauugguaaguagaauuacuuucauuguuaagggauagacugccuaggucagauucuuuucccuuuacuaucuuugaaaaacugaauuacuugaaggcuggcauaaaacuuacaauugcacaauauuuuagaaccuaagauaauaugccucaauuuuucucauuaaugcaauauaugaaaucaucaaaaugaaauacauucacuuacuggcuguaauguuguuaaaaguaugaacuauguggauuuuacaaaauauagcaaugguugcuuuagauagaauaauuauuuaucucaugucuuugcuacaaaggaagacuagauuuggaauucuaguaaaauaaugaaauucaaaaauaauauuuuaacaggagaauauaaauucucuuuggaaaaacccacauuuuauauugauuuuuccccuauauuacauaaggaaucucuuuccuucuauuuuuagggguauuuucaucacaaaaacaugugacuacaucauccuucugcuuggagaccugacuuauauuuaauuaaaugaaacuuuuuuuuuuucuggauucccaccaacuucaggauacucaagcauugaagauaaaacuguaggucuaaacacuaauucugcaauucuucuuguaggaauaaaacauuauuaaccuuuuaguuaauacugguuuauaauacaguauagggaaauacuauaaacaccuaucugcauaggaaauucaaaauaauaacugauuuuauccuauaaauuauucaagauucugacacaagaaauugcaaauuuuauuuauauggaaacaugcuuuacugcaaaaucauugguauuucauuucuuuauagaacuagauuuucaucuaauuaaaauuuagaaaagugcucaucaugguagcucacaucuguaaucccagcacuuugggaugccaagacgggaggauugcuugagcccaggaguuccagaccagccuggacaacauagagagaccucgucucuauaaaaaauaauuuuaaggaaauuagucagccaugguggcauguacucccagcugcucgggagccugaggugagaggaucgccugaggccaggauuuuaggcugcagugagcuaugaucgcacuacugcacuccggccugggugacagagcgagauacugucucuaaaaaauacaugaaugaaugaauaaauaaauaaaguuuagaaaagauggaacuagauuguuucccguuuacucagcauauagguaacuugccgauuuuuuuguagcucuguuuaauaaaaauacacuacagaaucuccaaauaaggccccaacaggaagauaaaauuauguuugauaauuuuaggguuguuaggauuauuuauuuuaguucucuaaaauugguaagauguuaauucuucaucaucuacaugguuuaucuaauggcaauaccuuuuuugaaugaugcauuuuugcauuauuuuuguauuagaggaaguaacaacaucugucaggauguacauaaaccaauaauugacaaucuguaccuauagccucaauugcucccuugagcagucuggcccuuuuuguuaagaucauagaauuuagaaucaaagaacugccuucaguuucugacuacgugacuuauuagccgugugacuguuuauuuuaggaguacuuuuuggcucccaaagaauuggcaggguaccuauauaaugaguaaaugggaauauaauucuaccugcaaaaucaccaaaauagugauuuaaauaauguuuuuuaaaacauuauuuaaaguagaaagaaguggagagaugggcaauccagggcacguauggugcuuccacaaaaaucuugaauucagccuucuuuuuucugcuucaccauccucaguuggugacuuuuuuacugauggucaucucaugguccaagauggaguuuuugccagugcugcugccuguuaggcagcaggaaagacaaagaagagcugcuuuuggcacaaccaguuucuuuuccaacccacgcaacacuuccucuuaaagcucaugaccuagaugugagggagguaggaaauguuaucuuuaccaggcacagcuuaaaaagagggguucuguuaccaaggacagaaagaagaauggauguuugugaggcaacuagcauucucugccauagugaccuuggauccuuucaucucauugagccucagcauucuugucuauaaaaaaugguuguaaaaacaggaucuaauucaagauccuauuguuuugaguaucaagugaguuaaugcauauaaugcauuaagcacagugucuggcauauaaguaagcaauaaauguuaauuauuauucuugcuacuuccuuaauaucucuagguuaauguccuauagauacuuaaaaugcuuauguguauuacagauccuuacugcauuaccuagcucaccaccuaccuauuccaacaggcuggaaaccucagagcaaucuuugaguaugucuuuauugcugucuguaccuaaaagucaucaaguauaauucugccugcaaaauucuucauggauuucucaaacuugucccuccauuuccauucccguaucugaauucaagccgucaucuuuccuugccuucuacccgucuucacuaucuacaagaucacauccaaacuccuuagaauaguauucaugucuucauguagucugauugaaguauuaaaagcuuaaucuugauuccgccacaucucccuagucuccagaucacacacuucuuguacucuaacuucacugaaaauucacuauuccccaaauaggacauuaugacucuaguuucaucuucaggguaaauuuuuacgaauuuucaaguugaaacuugaggaaacuaagcauagauguguuucagccuauaauuuugaacauuaggaugugauuucuggaaacuccuuugugauuuuauuuaugaggccaacagauggacagguauuccaguauuucuuaucauagcugaguaucuaaauguaugaauaugaaagaacgaagggcuuuuaaguaaaaggaauggauggaagggaauugaugcauuucuaauggauggguuaguuuguucagcaguucugaaaguauagguuuagauauagagacucauuauuuuuacuuugcuagacaguagcauuaguuuagguacuuaaugugaauguuauguacgcauuuugcuuucaaauuaaaaaaaauaaguagggaagguuagcuuuacuuuuauuguguguguguguguguguguguguguguguguaguguguaauaggauguauaauguaauuucaaagcccucugaugcaauauuuugaaacuaaguugguaguacaauuaaaacauaucuuuggucauagauuacuuggccuuaugccauuuucauaggcaauguccuacuuauauagccuggauuggcugagaaaaauaauugcugcuaugaaauaauuuugcaauuaccacuguaauuaagggcaguuuguuaaugaaagugcuuggugaauaaugacugcagggcacuccaucuugcagcuucagccagaugauugguucaugugguggagguaguuagggaauuagugacacagcugucaugguuacaggauggauguaaauauccuuugcaguugaugaugaagaacagucauuagccuccugccccuugggaacuggucagaggaacaaaaauaaacuuaacacgugaugguaaaagccauuccuuaugucuccuuuucuucaguaugaacaauuaacguucuaauagaagcugcagagagcauguggaugaacccucuccacuuuacaggcguguuagugugauaaauguuccuucguguagggcauugguuguucacaguuuauaaccacucuuauuagcuuauaggccaguuaaaaacugcucuuuagagacccacaggcccuauuuaaauuuuucguguucaucuccagguguuguguauucaguuugacccuuuaaagacuguccacgguuggauuuuugcaugcugucugcaaggcugcaggggcaauugaagaucaauuuucuguaucugggcuuacuugcuuguguaaaauauauauuguuaugaagaagaccuagaugcuuaucugauccuccuuuauaguuuuuaaaagucauugaagguugaggagccguuuuuuccgccuucuuaaaauaaauguccuagguguuuaagugugcuucguauuuauauucauuccacuuccuugguguuuugauguuguuuuucauuguaaauuugcuuaagcaaucuuuuguggaguaauuucauaacaugcacacacugugguuuuacauugaguugcucgugaucugcaauucauuaacuuuugcugacuaggaagucaguauagcacguugcauuuucucucacuuuaucuugcuauauagucaguuuuauuccuuguaaaagauguuaguagaacacuuccuuaagauggcuucucuugcugucucauaugcuaaaucuuuuccucugguccaagucuucucagggccuuaaggagagauuuuuggcauuuguaucauugcauuagaggugaccagauagcgucacuaaaggaacauaacaguuuucuggguuuuagcucaaaaugacuauucacgguaacacuauacauuuuaaggaugaauuuauugcugcuugugucuggauaagauucuuugcauuugcugcuacuuuugugcccaugucuccucuuggcuuuagcaagaggaggugccaaauggaaggaucggaauuccgccucggaacuaucacacacuguagcccaaaccucugccucuuccuuuucuauucuuuggccauuguggaaagaaugaaaacuaucaacaagcugaacaaggugaacagagccuuguucagauguuuaaaugccuccuuugcaacugaguuacucacucucccaagaugaacuuuucucauuagacauagcuaacucacuguggagauguuucuagcugacuugauugugaucagacauuauaggaugcaagguaauugcugacccuaaauaguaggggugagucccccaaagccaaauaacuugaaaaaccuuacauacugagcauuuuaaaaaauguguguaucuuaguccaguaaaugacaaaauccuuuggaaaaugggcauuauucucaggcauguucauggcuggccaaauuauuuggguuuuggugggauaugacucucuggagacucuucgcaggaugccugucuacaggaggagcuggaaugcuccauauuaaaccaacaccgggaagcaagaggagagaagcaugcagaaaacacccucccaguugaaugaaaauugcacuguauuaugacuuauucccuuuuuagcaaaaguaugggcuuugugguaggucaagauaacuaaaaugggaaagaaagaaacaauuguguuuuuaauucguguugcuccagguagugggacugagaaacuuuuccucuuuuucaggagaguugugacacgcuauaguauuuagauacucaguuuguguucccauuuuuguuuuguuuggugguguuuugauuauuccauuuuuuuuuuuuuuggcuaaacauaugugauguguguuuaauugaauuuccaaggcaacgauacaggcaccugucaaaaaguauauuuaaagauacacugcagguuuucuggagagguggccaugugaauuuaacaaucugcaaugagaggggaaaaaaaaguuucugaguuuguauaaguaguugagauucccaaguaaaacagaaucuguucucaugcaguuuucugggcuaguuuggacaggagcuggaaucucauuuuuauacauuaacaacucuuguuggauuucucucauuucuucaggacaagucaaaaacuuuguaguucuccacaaugaaaaugugucgugucccauccuguccuuuugccaucuuuucuaucaaagaaacacuaauuauaaaaauugaacauaaauuuguacuguuuaauagguuuggguuuaauuuugccucagugggaagacguuuccauuaaaagaguccuuuuuuuucucuuccucccuccuuuuucuuuugguagaacaguuaguaaaggcguaggaaauugauuuuagugucacaaaggacauuucugacagggauguacuuugaaaugauucaaagcaucuguuucucuugcauaugccuagcacugcugagagcuguaccuagauuaaacuguuuaacgugucaacuccaaauccgaucacaauuuacaucccaguugcuugguuggaauuuuuaacauuucaugaacuuucuccccuaauuuaugaaacaagcuucugcugaaagugaccauuuguucuagaugccaauaugucacagucaaaauugacuuagcuugagaaguuauuuguuuuuguauggucauuuugccuaugaaacaaaaucaucuuugcaguuuuuauuccugcuggcaggguuugugaaugaacgcuugguggguguuuuuguuaccauuugccuuccacuggugcuaugucugucauacaagcuggcucagagaauuccaguuuuaagagugucugagcacagaaauuaugggcacucuguuuacuaccauauccaugacauccagcauaguaccuuggaaagccaccuaaaauaaaucuuucauauacaaacgaggaaugagcacuuucuacauagucauacugcauagucuuagucauagacucuugauucugagggcucacuuaucuacucugcuuauguuucucagaaauuaguaaggcucacuuguauuacuuauagugaagcauguccuuugaaguugaagggcaggggcaauuauuuuaugcgugugaacuuuuuauauucauagaagaaauaauuuacuggggaugagaagaaaaggcaaccauguugaugcauaauagggacccgagcucauuaacuuaauuguuuaguggcuccugacuguucuucucucccccaguguccccccaugugcccuuucacaguauuuccccaugagcuuugagugaagaauccugagaagggcuucuacucuugccuuucccucugcuaauacgagcauagugguggcguuuguacagguuuuccugggguacuaguuccccaguggacucacuuguugaccuugaagaugcauggucacucaugacuagucaguugagaacauuauccauaauauuguuaucaauaucuugcaucucuaucagcaguucucugggauuguguuagugaggauagagagcuucacauuuacaauagcuugaauguuuggaaauuuucuuaccuucacucacuagucuagggugggugguccagaucuauggauggguuggcuucaucuaguuguucagugaccuaaguuaauggcagcucugccaccuuuugcaugucacucuggaggcacucugguguuacuguuucagcuucccagaaggaggaaggagaaaguacaggaggagcaaccucaggcacuaggcuggaaauggcacacaucaauucugcccacauggaaaagaacuuagucgccuggcugaccccgcuucagggaagaccaggaaaugcagaggagcaggccagccuugugccaggcugcauggaagaagaggaaaauggauuuaguggacaguuagcagucucuuggaccuuagguuuuucccagucaguuagcuguccagcagcuuuauauuguaaagcuaguugaucuuagacuuuaaauaauaucuaguacuaucuaugauaauuuccccccuuuagguuucuuuggguccaagcuauuuauaaauuguacuaacuggcagagcauucagcuuaccuucuucugguuaaugucaaggacucaguaguuugcacagacauauuuuuacccuuugaagugauaaauuaacauuugaaugguugcuucauuuccuuccacuuuuuuaugucugggacacaugguagaauagggacauuuuuguagauuugugauuucuucuucauuugggaagauauuguauguacuacugguaugcuagucauucacuguauaggaaaacccagaaggcauaaucacuguugucugcaaauauuauuauauaguauaugcugauggucacugccuaauguaaaauuagguuucccuucaggaucuuuguuuagaagcaauucuugaggugacaugagaaauuguugccaauauuauugcuugcugcuuuucuaguuuuuuuuuucuccaaggaucuaaaaaaucauuuacagcauacuuuccucugcuuugauuagauuuuagaaacauugucugauuuucugcucacauuguuuagagaaauuauacucccagccaucucuuggcugcuuuagggugaaauauaucaaaaucuuuggacauuuuaaccugugguuagacuggcuuuagucucuucugcuacguucccacaaacaaaggguugucagaguucuugcuaugcaauauauucuauuuuuaagguaggauuuagauuauuagucaucugauguuuuagguguuagcacaacuagacacuuaauuuugguuuugugccaauacaaaucaccuggaguuuuauuuuugguaagguggggacaagaaaucaaucaaguguguucuaagcucuuuguuuuauguagaauguaauuuuauuuuaaauauacucuuccuugauauaucuuguugcucuaauauugauacggcaugaaguagaaguagguguuuuuccugaguaugauuuacuauaaguccugugauuucagcuauauugaggcuacuacuaauggauuaguacauuccagcaguguauuuauuuagcauccuacccuccgguaaucaaaacaugagaugcuucaguguagaauugcuugcuagaggugauggagagaaaacacaccucucuaguggugauauuagucuguuuuaacugucuugugaaugugcuuaaugucuagggcauguuaaauugaguuauccaaaaauagagucccugaaauuuaaauaaagcggcauuggagcaagaaacuaaucauucuuuuucugguaguuaaccaauugccaccuuucccggcucacuuauuauagcagcuccuauggcugucacuacacugucacauuguucuguaauacucuguuuacauuucucucuucuguaccagacugugagcuucuuguaggacgggaauguguuguauucauguucauggaacuccuagucacuaaauaguugaugaacaaauuaaaagaugaagaaacauauuaaauacauugaguaggaaaaucuuauccuugugccgauaggugaaaacuaaucugaugacauuccuuuaaaguuuggacaaauaaguugguauuggugauuucuggauauagggaaucuuuuuguugcccaucacugcucaucugauuaaucuuaguuuucuuaaaaaucaagaaaacauacagauaccauguauauuggucuaaaaugauaaaaaugauaacaugaaaaagagaguuuuccucacugaggugucucugacuuucugcaagcuccaugcccacucucagccuguuuucccaucugucaaacugggggcauaaugggacuuagcuuuuugggacuguugggaggccugaaugagauauauuugacccuugaacaacauguguuugaacugcguggguccauuuauaccuggauuuuuuucaaucaaacaugaauggcaaauauaguauuuacgggauaugaaacccacggucuacacuaggggcagauuuuccuauccucacauucugcaggaccaauggcaggacuugaauaugcauggauuuugguauaugcagagguccuggaacugaaccccugaugauccccgagggaugauuauauuuuguggagugcuuagcccagugccucacaccauaguaagcucccaacaaauguuagucaugacaaucaugaggaucguuguagauuuuuucauuuccugagacgucuuccaugauuauuaaaucuuuuaaaaauuuuuauuaccuauuuguuguuguuuuacuugauuuuacuguuaaauaguucauuucgacagaaaucgucaaauagugucuuucauuaccaugacuagaacucagggaaaguuaggauagcuaucuacagucauggaaaacaggagauaauaagauaaucuuucucucucuuuguagggauaucauaucacgaaguaguugaacuauguaaaguaguacuuguuuguuuauccagcauguaaugccuguaacaacaaauagaaucuccugguaucagaugguucugaaagcuugcacaaaacacugaaaugauaagaugccacagacuuuuauguuacccacaaauauuacucuucuuuuuucuucauuuuaaaguguguauuucugggucagacacugaaauguauuuaagcauuucucugcuaaccuuuuauugaagcagguauuuguuuucuauucuuucuaagaucuagugaugaggugcagugccaccucacuuaucuggaggccauguaucagauaaccucagcuaccuggaacacagcugcggcuuaggaguaaaccagaaaggccuccagcugccauaggugucacacagucuuugcauuaaggccuaugcacacuacucaaagaaaagccccgggguuucaccgacagcaaaucugucuuaauuuuacaauccuguagaacuuguucaaaaucuuaucugucuuuguuaucuuuucuccacccccccauacauacaugggaacuagaaaauuugagguuugagagguacagaguuggggggugcugcuagauacaaguaggcucaaguagcaugaagaauuccuugauaacacuuagcaggaugcaaguguugacuugagucagcaauaaugguaaaauuauuauuuuuuucacucuguuuaagaaggcagguacucuauuaacuucuggaauauuuucaucaauauaauuuaauuaaaaacugucaugaugauuccagauaaauuggacauuuccauuuucucuguuauuucuggcuauuuaugaaguuuuauaggcauaaccuugaccuuuuacuuaugaauauguuuccuuuacuugccuuuccccaucgugcauauaugauucuuucuuaccuuuauuuuuuucccaucgaaggaauaaaaauaaacauuuagguaauagagaaacuuaacaagucuugaauaguacauuugccaaaguugguauuuuuaguuuguaccaugccauucugcauuaacuaccccaucucaaauacuaaagaacaacaguaaacccagcugugucagcaucugcuuucccuccaugacuggauuucuaagcaugaggcuagggauuauucucgaguaucaguagaauuuagcaccaugcuaugcacauagaaagugcucaguaauucucacagcaacaguuauuugagauagauauuguuguuauccccauuuauaggugaggauguggagguucacagagauugagugacuugccuuaagucacacggccgggggauagaaccggaacuaacaucucacggcuggcccuuuaguccaugugucugacuguccuagaugcaaaccucacugcuuagcuucaagaaaagcucggcauuucuggauuucccauuucaguucuacauaacauaaaaacagauacguguuuccuaacugacaaaaaguaaaagaaaaacaaaggacugauugaaauccguuauuaaacuucuuugaaugauugaauuggcauaaauaccuagcucaaagaaaaugaaccguuuuaaaagcaguaauauuucacgauacuuuuuuccccaauucaccuauucuuuucauuuuuacuuugacagcauucuuggcuuguauauuaaaaagcccauggguuaaagcuaaucuuauauguuuaaaauuaugcauugacaaucuuucuuuugguuuuccuuuucuaaacuuuuuuggagcguugacaacuuuaaaagaaauggcauguuucuuuaaccuuaagaacauuuuauuuaaauuuagucacugguuuggagaaagaauaaacagaacuuuucauuuaaauguucucauaucuuggaagaaugaauggguagugauaugauuuauagcuuguauaagaauaaagaauauaaaagaaaauugaaaccccaaauuauugguuucagcagagcauuucugacuuaauucuaaauugugaauaccauuuacaucuugcuuaaauguuucuugccaguuuguagaagcaaaucucuaccuuuuguguaacacauaguuuaacugaauacucauugucuauauagauaauuuaaaauuaagagagguaaaucaucauucauaucuagcauagugcuucaauaaauauuuguugauugaauaaaugaauaaaauaaggaaggaaagggagggauggaaggaagggagggagggagggaggaaggaugaagggagggagggaaggagggaaagagggaaaggaaaggaaaggaaaaagggagggagggaaggaaggaaaaaaguaaaagauugcuguguuacuauuauacuguguguaacaggaauagcacucacacucuacagaaaaguuguugguaccauagauaucuauaccuuucuacgagaaaacuaaaaugugaaaaauagguuacuuugugaaaaaaaucacucuaacacuacuguuuugcagacgugccauaucacagaucagcuuugcaugaaauggaaauuaucuugcauugucuucauuuaaaguuuuucuaguauauuuauugaguaaaaagacagauaaagaauuaacagugguuacaauuucuguauauaugaagcaucuaccacugccuuugacuuaacccuuuuuaugucugagcuucaaucaugagguuuucaaaaauuauuucuagaaagcaaguuggguuucuucaauagacaguggaguguuuugcuccagaguacugaaauauucuguugugauguuggaaacuuucaccaauuaaggacaaaaaccuucucauagguguguauauauauauauauauacacaccuaugagugauauacacacacacacacacacacacacacacacacacagagagagaguuugugucuuuuacaggaaucauuuuaggaguucauguagacuuauuuuauugaggcuguugagcaaaaauuuuuuuucuacuucuccuugugaauuuuauuuggguauuauuugaauagucucagaaguagcagaucuuuauuuuuuaggauaauuuauuuggaaucagcccaaaguuauuuggaaucaugcuguuaagguggacacugaaguuguggauuuuaaaaaagaaagcccaguuguagcuaucaaacacuaggguauaggugugacacauugauugucauagaaggaaaggauauaaggaguaguugaaaauaugcaggaccaaugacaguaauguuggaauaaacauaugacccuucaaggcaacuauugugaaagguaauccucucuuaaaauuuuaaaucuauaaauuccagugauuuuucuucaaaguuuuaaagucucaccuuacauagacucaaagacugaugugcaacagcaggacaagaagaaccugaauacuuaggaucuaguuaauccuaaagaccugaagcaacauaaagaucacugucaaccuuggcauuagccuauuuuaguaauugggucucagcauauauauauauauauauuuuuuuuuuccuggcuuaaauaguugaaaauucauuuaaaaauguucuucugauuuuuaaauuuuguauuuauauuuuuugucuucuugucucauaggaaacaggguaacugcauuuuugguguucuugcugagagaggauaggucccuuugaggaacauguuuucugauuugcaagaucuggauaccugggacauuuaaacuuuucaaguuacuuuuugcaaaggaaaauugcuaaaaauuauuugggcucuuguaauuguaaaugcugauuaccaaguauagccaacacuuacuuuuaaauggguuaggggcauaucuauaacaacuaucucugcaauguggaaacuuaaguuugcccucaaauauggaaauccagauaaguagaaaugaaagcauuuaaauauauguuauaaauaucaugugcauuugauuggccugaaauacuguaacuauuugaaugcuauugcaugaugccagcucucucuuugacauucugacuacaucacucacucacuccaugcuacccugcauggaauauugauggacaacuuaaauccuucucaauuugaaagugaagcauggguaauuaagcaaugcauccauaaguuggauaucgaguuuuuacugaggcccaguaaugaauagaaagugcauuaaccaaauuaaaacuguugcaugucuauauguuuggacauugacaugucugugaauuucauuacuggauagugaagucaugcuuaucaaagagcuuuccagaaauuucccuuguauuaaagcuuugguuaacuucuaaguuuagucaggggagauaauucugugacacuucaucuugcuuacuaauuuuaagaguaguccuacacaauccuacuuguuaaugacccggaagucuaagacauagaaaacaaggccuuucucuuauaccacguucaguacuagauaaauguuaucccagauucuguucuguaccaaugacuaugaaaaauuuuagaagaauucuguuauaucuaugucuuuaauauagaacugcuagaagugaguagaugaccauuaaucuuaguaggugauguagucaugcauugcuuaacaacagggauacauucuaagaaauguguuguuaggcaauuuugucauugugugaacaucacugagucuauuuacauaaacauagaugguguagucuacuacacuccuaggcuuuauaguauggccuauugcuccuacgcuacaaaccuguacgcauguuacugcacugaauacuguaaucaauuguaacacaaugguguuuguguaucuaaacauaucuaaacauagaaaagguacacuaaaaauacaguauuauaaucuuaugggaccacuauccuguaugcaguccaucauugaccaaaacauuguuauauggcacaugacgguaugugugugugugugugugugugugugugugugguauauauccucugcaaauaucccuuaauuaaaauuuugaaguuuaguaaugcuuauugcugaaagugguuugauauauaggaaaauguguaggaauucuauauaaucaaaauuauauauuauagugccugaaaguuuacauggcauauucuuuuuuuuuuuuuuuuuuuuugagauggagucucgcucuguagcccaggcuggcauauucuuuuuacacuguagcagaauuugaucagaacuaaauauccugaaacgaaugacuggcuggucuguuucuagcucuaacaugagucacuaauaaaguauuuuggugcuucaccuuuuugaaugccuuagaauucuaaggcuguugcccauccuaaaaaaaucucaagucaagauacuaguucccuauuagcugcagaaaacacagaggggaggagggagcuagugcugguagaagaaacuggauuuuaacagaacuuuaaagaaugccucuuucauuguggccagccaaugcucuauuuaucccuuaucucauugugcuguggcucuccaagcuagagaggagagaaaagauugagaaucaaggugcagagaauaagcaguagagaccaaaaggacaaaaaagcaaaaacugacuagaggaagcagaggacugaaaacacagaaaaggagaggaauuucaaagacagaauuggauagauacauauuaaaaccagugagagaggaaagugcuuucugauaaugcgaacuggguugaggucuguguauauaaucagauacuugucugagcuggaaggcgcccguaggcaggaguccagauaaucuuguggccuucuggguguugcauggcaggugaggcuagaaucuaauuuuuuucuaucucaacaucaucucauauuaagcacuugucaagcuuugauuugagggcuccgggugauuuggauuucgguguuaucucucagaaguugguuuccccacuuaguugagugaguucucauuucaccaucugugagcuucuaugucuccugucuaggugucuauuucgugcaugguugagacagucugugcagucuugaauuguacuugugacuaagaggaguagucauaauuuaccauucauuucugucagagauggacaguugauagguuuuugccauuguuuacauaaugauuccauacagccauaagcaaaaaggcagugaccucauauuaccugguaauuuaacuacuccaaaaucaaggacaaaaacugucugacaauaggcacuuaauaaaagugaagcuugucauuuguuuccuuuuuuuaauuugaguugugaauuuaacauuuguuauguuauuaauauuuauaagcguauguaacaggguuuuaucuuacacaauuuuaauucuuuguauaccuguuugugguaugauauccaaucagauuauugcuuugauaauucuaagaugaaaugcauagggaguaaaugugucauuuuuagcacaauaucucuauuuaaguuuucuuugaagccaggaaguuuggacauaagcuguuuauuaugccauaguuauaucucuuccuaaagaaaaccaccauugaauuaacuuuugcaugguguuuuucuaucaaagcauuugauccuuguuucugcaagauaauccuaagaacuuuuuauuuugagaauagaagaccaugauggauuuaauucauaacggggagcugcugcaaggaauguaaauguaagcgcuugauaagguaggauuuccuaguugcuauggcaaccuuugggucaugagccugagaaaauauaaaguaaguccugaagcugugaagaugauuauaaaauuuaacugucauucuucauuuagaguugauggcaaacauuauuuacuuaaguuuaucucaaggcaggcaaagauccauuuuuuaaaaucugagacucagaucacaaaugaauccauguugcacaugucuaacauuauaaagcacaugcagcauuuauuauucuaaccagacuauuuguacauaauaucccuguagauuuggucacuuuccuauagaagccaacaguuuucaucucuugaauucuuaaugaaaacuguagaaugcagcuguauacacugaauaauuuugcaaaaauguaugugcuuuccaugccaaaaagaaggccuaggggauuguauaggaaggaggccuuugugccuucuuuucagguucaaauauaaaugguaaacuauuuaggguggacaagcgccaggauaugaauacaguuguauauucucaaaauauaucacaaccuggagauuaaagagguagguuagaaucucuuucacuaaugcuucccaucucccgguagggcacaggguuguggggagggggaguaaaaucugcuucuucuccgaggaaagaguagauuuggggugucaaguuccuaaauugagaugugacguuuaccuguacacuaugacaaagugccaguuuuucuugcuuuaucuuuuacagaaugcuguuaguuugcacuaaugaccuaugagacccaugcaaauuacacaaucuugcaaauuagugaguaugugaacaaacacuauaaaacuaucagauacagaaucaaauaaauguaguuuauugcaggaagaaaaauagacuugcauauggagaaggaaugcauuuucacaaccagauaagugcuuuccuguugucugcuugcccaccggggagcgucaacacauuauaugaucuguggcagccaaugacuuacuggcucuugggcaaaaacaucauuuuuucaaaugcaggcauagaaaaucucagugauuacaugcauacuggaaucugguauugaauuguuucccuuauacuuugccuccuuaaaaguauuccccuuuccagcuucauaugcugaacguuuacacuagaaaggaggacaggauuuaagguuauuaagaagagaauguauacuuggcuggcuuuuuuguaccacacccaucugaaccugggagauuauuuguugccccccuuuugggggaugagguagaauccagcccacacacccagcagcauacacucugcucaucaaagcacuuuucucaguugguuuguuuucaugucuagcagcagaaauagcugcucuuuuucuuuccuuuuuucuucuggcaucuuguaauugcaacugguaaugugucuucuuccuaaccuggaagcagcacagagauggcaacauugcuccacucauacacagccuuacuccuggcuauaauccaaugcugccaccguugggucaccaauggugacccagugcaucacccuuugucuaucacuccaucucccuucauugagaaccuuuccugggccaaccaguugccuccuuuauuuuugucacccugguuaccuauauucuaucagguuugcuaaugacaauaaccccaguagcaaaaacuauaucaauaaugaacauuuucuuuuuuucuuuuuuuagguaagaaaaugagcauuuauuuagaaugagaaaauaaauaacaacaaaguacaaacuuuacaaagcuaacacauacuauaaacuucacaaaaucuagaaaauauaaugguuugaauugccugauaugacuccauaauaccuuucccacuguauuuucguaggaaaaaucuggaaaacucccaucaaguuucuuugauauaucaguuuaaaaaaugcacuugcuauuuguagguuuauuauagguuugggguuacaaacaugggaaucugagaaauucuauuucacauaaugacuauaagaaacauuucuguuuuucugaacuuuaaauucaggaauacaugugcagguuuguuacauaggaagacuuguguaaaggggguuuguuguacaaauuauuucaucaccccaguauuaagccuaauacucauuagucauuuuuccugauacgcucccuccuuccacccuucccccuccaauaggccccggugugugugguuccccucuauguguccguguguaguaaugaacauuuucaaauuagguacuaggcaccgugguaauguguuuguaugugugugugugucugcguuuacugaaugcuuuaccugauaucauuuuuacauguacauauauauuuucauuucauuuucaaaauuauacaguaacauuuuauuuuguguauguauaguucugaaguuuuaagaaauauauauguucucaagacacagaacaauucugucacaacaaaaaacuuccucaugaucugugauaagcauuuugagugcauugcuauuuaauucuuauaauguuaugggguguguacuguuaucucuuuuuuacuguuuuauuuuuaauuucuguugaggaaggugagacuuagagaaauugaauaagccaaagucacacaccaaaugaacagcgaagucuggauuggaacuuggagcuaaguucugucuaagccuagaauuccagcuuuuaugcacuguaucauauuacugcucacagaacauggcuugggggcuauaugaucaguaaaguacaaaggucuacaugucaguuuuauaugauauaaaugugauguugcaccuuguagaugaucacaagauauuuuuaugugaugcacucucaaaagacucugaaagacuaggguuauuuuuuauuuguuuguuuuguuuuguuuugacuucaaguaagacuaguaagaggacugaauugaacaucucaacuggaaaccauuagugcucugcucuucaaacuaaacuucccaacacccaagucucauuacugucaugccuauuucccucccgggcugugucauacacauagaaagugaagcugggcuuuuucauuugccauggccaacucacacuauccuaucccucuuuugaaaaaaaauagaacccuuuucaguagcugugggcucuucugugagggugagucagcuuuaggaauaauaaccacaaucuuucauccaugccuucagucuaaugugcugaugcugaaaucauccuaaauaucaauacagaauuuugcuuuagacuagggauucuccugcccucacucaguguaaauccccugaaguacaagagaaacugugagcaauaaaggaggugcuaaaguucuauuugaguggugggggggcgguggaggcaaaaugcuuugcucagggaaaggcuagugcuucauagaugguuagagaaacucccuucuccucggaacuuuugcaauuuggagcccaaccuuaaauugagcuuuacuaggacaaauguaguuuuaugaccagagccuacaugcauaucucacaguuuuaaauaauguauucaccucuuccggaugaucauaaucagugaugaucauggugaaacuaugaggaagcagcccuccaugugcucguuuucuuguugucuuuccauuucauaguuuugcuucuuaauuauaaugaugcuagacauaggcuguuaagguacauuguaaauagggauacgagcauucccuuuguauagguugagaaauauuacuccagcaaauuuuguuucaagaguucuucaggacagaauuucgauaguaugugcuuucugugauauauaugcuuaagaaguaagauucacuguauauugguauaaaauaaaggaagccagauauuaacauaaaauuguauuuuggauucuuugaugccuuaauuuuaucuuucucaaggcagcaucuuagaccuucacuccugugaguaaacacacuccugucuaaagacagaugaugggaucuguuuuuaaagugaggauguauuuaaagccuaaaagccaagaaaagaguuucuaucuucuauuuguaguuaccauucaugauuaagaggguaggaauuauuaccauaauuuagacgcaggagccccuugaaaauucucaucuucaggaggucucuaggaauguuauucacaucaucaccgaguagcuaacaguacugagaguuguauguaucuauguuuguguuuguuuuaauguuuuacuucccuuuuuguagccuaauuuaggcuggaucaaccaaaaaaagucuguugcauuugcuuuuuauaauacauuuagaguagcuaaucugaaaucacaguuuucaaucagaaaggaauuuuggaugcuuuuauggaaagauuacuacaaacuaaguuuucuuuccuuuuuuucugauuuagauuccuugaaugcacuuuguuaaugucugaacauugaaucaaauaguguauuucucccauuuuuaaacauugcaaauucaaggcaggguccucugcuucugucuucaaaugaaugagaauaccauuuuaagagaaaauggcggcuaaagugucagugcucuguaucaccucuaucaaagagacugauuacaauguugauggugauuuucaaggccaucuccgucuugcuucugcuucuuaagaauguauaauggaguccaaccuuaagacaaauaggucagacugcaaaacucugcaggaauauaagaauggauuucaaaauaauaaagcagugcaacuuugagauucuauauacuauauaaauaucuccuaauuuacaggacauaccuuuuaaacaucuuuccaccaugaugcguauuggugucuggucuugccauucucaugcauuuucagcuguuauuucuagaauuuauugaguuacugauguuuaaucuuuaaugaugguugaaggggagaaaaaguacauacaccauguucaccaauucucacugcugguaaacaaaaaaauuuguucucccuguggggcagggagaaaauauuuuugagaauaucccaucugcagauaaagucaguggccauuugugguucugucaaagauaaaaauaaaugccauguucagcuguauuaaauacuguacuugagcauaagggagagugugcauuugucuuauuucauuugucuucccagucuaugcccauuuagcacugcaauagcagugaacuucacgggcagucaggcccagucuuucauguuuccuuccaguucuaaauugaaaauauuuuuuugaaaagaacuaugacaaaagcaauuugaguuagugauaucuugaaagagaacccaauuuaagauuaccuuuaugguuggucauuguuaccuacaguaggcagaugucauggugaucuucuugauauuaguauuccgagagagucugaccuggcaguguucagguaacaucagagagugggcuauaauauugagauuucaagugguggugcaaagggcugcucacggaaagcuagugcagagagaaccacuguaaccgagaaggagggcagccagccauucuccucauccuucuauauuuaguaaauaccacgugacagugaguggcuaauuaaaguguguugggagugagcuuuguaacuguaaacuguagagaaggaaauaggaaaacaauggugucuucgcugauuuuccaaccuguaacuuaaaauguugcaucuuuccaacucuuucucaaaaacucaccacgcugguaaaaugucaucauaucuuucagauuugugucauuacaauuguaacaggaucaaugauucaugaacauacggagcuaaagucucuuacaagaugaaguggugacuaggaggagaaguuauuguuaaagaggaccaucugucuuugaaagugugauuuacugaggcauucaccucugccccaagccaugaaaauaggaucuagugacugggucucaucgucuuucucuuccugccuccuucccuuucuucuucuccucauucuauccuuagagccagaaucagucaagagauucaguaagaaaugaugcuacugugaaucacauagcuucuuagagcaucuuauuuacguuccuaaaaucccuaccagacaaauaacaaguguuaaaauuguuucuguguuucagaugaggaagccaagacaaggagauaaauuggcaugcccaauacagaagggugucaguagcauugcugagacuugugucuaagucucuacuuuguggauuauucacggcaacaauuauucccaugagaaucccuaauuaccaccuacaucccugucaguugguggugaaucuguaacaauucacaaacugcauauucugccucugugugaugagagaauccacucuuauuuuaaacuaugcagaaaugagaggccaauguuacuucuaagggaccaugcagugcaguccagagguaaauaugaaugacauuuagcucugccguuuuggcuguuccacauuagugcagcucuccauucuucuacauaaccaagaguuaguuauucuuaaaccccaguguucugucuacucaugcacaauuuaccugcauuucucaaauucaccauccuuuaguguguuuggcuuuuaaauccauuuuggugcuuacaguuugugucauguucuuggcccuuagggaugcauuggaucacauaggauaaucuauugaacauauauuaguuucuugaucucaguagaguaauggaugcugaaauauuucagaaagauguauucuguaacgauucaggaauugcauacucugccugugucagaagcacaacauguaugauuuuaucuguggcuuaaucaacaggaaaaaaugccaagcggcuuugacuagcuggcaguggaucuguuuguguuugccuuauuuucucuauaagacaccugcuggagaugagagccggcacaaacaccgaguagguauccagggcuucauuacagcaguaucucuaaugaucaaagaagccuuuuuuauacaaucuuguuccugaucaugcagcugaacaucugucuaccugucuguccaccuuuuaauugcaucauccaggucucucugauccuagacggucugucagugcagcucugcuuuccaccauuucugaucauaguuaacacaaaauuucccacaaagcaaaacaguaaaacugagagcuuucuaauaaacuugaacugaaccauuuuaugagaagcuaauuuucuauugcauauccagugaaacccuugugcuaauuuauucuucaaagccaaauacuguauagcaaggaggggaauguacuauaggaauacuugaagcauuauauuuacuggauacaaaagaagcuuguucuacauagaugcugcaaucugcuaaacacugauuuguuuuaaaaaauuggcaguagaaagucaggaauuuaauucacugauuuauuuauguauucccuugucaaauacuuauuaagacaaacccauuauguauaggacugugugugauucaagagugagauacuguccacacucuaaagaugagauucauguagauuaauuauaagagaaacauuauacauugauuucuauaagaaaauacucaaaaagcggcaugguacuugucucauucuguuuugucuugcuaaaacagaguacccaaagugagauaauuuauaaagaaaagggauuuauguaguucaugguucugcaggcuaggaaguuuaagggcaugucccugacuucuggugagggcuuucaugcugugucauaacaugguagagaagaucaaaggagaugcagacacgugcaaagaggaggaaaccugaagaguguccuggcuuuauaacaacccacucucuagggaacuaauccauuuccacaagagcuaauccagucucaccagagugagaacucacuacugcaaaagcagcaagaaccagcaccaagauguucaugagggaucugcccucauagcccagacaccucccacuaggccuuaucucccaaacccaccacacuggggaccagauuucaacaugaguuuuggugcgggcaaacuuaaggcauagcacuacuccaguggagggagaacucacuuccaguggggcuaauagaaaaugucuuuaugggccaggcacagucguucaugccuauaaucccagcauuuugggagucugagaugggaggauugcuugagcccaggaguuuaagaccagccugggcaacguaguaagacccugucuuacuaaggccaaaaaauauuagcugggcaugggugcacucaccuguagucccagcuacucgggaggcugaggcaggaggaucacuuguaccuaggaguuccagguuauagugaacuaugguugcaccacugcacuccagcuugggugacagagugagacccuguuucuuaaaaaauauauaagaaaagaaagaaaaugccuuuaugaaaggcggagcccuuaaguuaagcauugacaaaugaggaagauuuguagcauuuaagaauauaguauuaauaguugaagguauucuaaauagaaggaccagcauuagauaaagcauagaaacaggaaaccccaagucauggugagagaacaguauguuguaggcuaguuugaucaaaaaccuggagagaguaauucuaugagaaaucaugcugaaaaagcagauuguaguagauccuuuagagauuugaauauuauguuaggaacuucggauuuucuucaguagaaagcaggaaguagaaguaauugaagccuuuuaagaagggaaauugcagaauuuauauauguguguauauuauauaugugcauauacauauauauuauauauauauauauauauauauauauauauauauauauauauaaaauaucuugaucaaagcauauaguauggauugcagacggcagagaguggagccugggagauccuaauaguccaacaaggaguacugaguacuuuaaccagggcagaagcagugggagagagacaugaagacugaccucaaggauguggaauguacaaaggcagggcaagugaucacaaaugagggagugaaaguaacuuagagagaggccagaaggaagagcagguggacguacugaugugauggauuuugccgugaacuuguugaaugcucacugaugcaagugaaagugcccaggacucuauugucaacauggaguugggaguggaugaaaugcgucagaguguagaaacaauucaugguugaauugauagcaucugauaaaacaucucuaagcaaacuagauuaacuaauaagcauugcugugucauugagcugauauaauucuuuuuguuguuguuguuguugagacugaguuucacucuuguugcccaggcuggagugcaguggcgugaucucggcucacugcaaccuccaccucccagguucaagcaauucuccugccucagccuccuggaguagcugggauuacaggugcaugccaccaugcccggcuaauuuuuguauuuuuuuuaguagagacggaguuucaccauguuggccaggcuggucuugaacuccuaacaucagaugauccacccaccuccuccucccaaggugcugggauuacaggcgugagcacugcgcccagcugagcugacauaauucuguguaugagugaggaggcuuaucacaaguaaaauuuuuauuuaggcuuuuugagaucuuuuugaaaauuuuauaaucaccugaggcuucccucucuauuuuauuaccuuauaagaacccucagaagaauagccacauuuaaugggcaggaagcaaaggaggaauuggaggugggugugguacaaaaaaaugaaaaaagccagaggaagaggaaggcccuucccaaaguuaaagggagagugcugaggugggagugggucagcacaguauuaaauacuagaagagauggcgguagaugagaacgggcuauugaguguaauguuuaagaagaaauuguuucaagagaguaguuucaguaguucaguugcauuaaaaugguaagagcugaaggaaggaggguuuggugaggaaguggaggcuguagguguacacacaccaccacuggagaacaggcuguguuucucaguggugcuagcagaggccuccucuggcaaaugcaugacuugagaaggcagcccagguuccuugugaagagucuagaggggugugguaggggucaccagaggcuacgucuggagaggcaggcucauccugaucauguuuccuggccaguagccaucugagcauuguccugguuauuaccugcacugcugagauacuucaccccaccuaauacuccaaacugaacagugguggguaucaggaagccaucaugaaucucaauaucugauucuugcuugugaaauaacuuaagauauguuguuuuaauuuccuuauuuaccucucuaaaucacagaaucugaacccugugaguucagaccguagaguaccuucagauucuaaaucauagagucugaagaucauuuauauagaauaacuggccuuaugccugagaaauaaaaaguuugcuucuuauucuguuucugugcuugaauuugggacuuaaacuacaguuguugauuacuaacugaagucugcuaaauccuuggcuuaggcagcauaauaacacaacuaaucauagccaauaauaauaaauauuauuaagcaauaaugagacaaaaacuacugugguugucucauucaauaauacuggcuccagggcauuuacaguauaacauuuuguauguuugcuucaaauuuaugauuuuggguuagaugagacuguaggauagaaacuuuaauuacaaguuggguuuuuuguucaugugcuguggaauaagggauggaaaccucagagaucuucagaagaguuucuggggucucuggagggcagaauaguuauacuggaucuuuuuuuuuucuuuuugagacggagucucgcucugucgcccaggcuggggugcaguggcgccaucuccgcucacugcaagcuccgccugccggguucacgccauucuccugccucagccucccgaguagcugggacuacaggcgcccgccaccacgcccagcuaauuguuuguguuuuuuaguagagacgggguuucaccauguuagccaggauggucuugaucuccugaccccgggauccacccaccuuggccucccaaaaugcugggauuacaggcgugagucaccgucacccggcccuggaucuuuuagcuauaaaaaaagucauuggaaacuuugauuuucugccucuucuccucuuuuaaugucguuucuucacaguaguuuaaaugauggcuaauugugcugcagcauuugguaaaugucauauaucuacuuuucuaaaagcagugaaguaguguaaacauguggcaucuuuuuucaaaagaucuauccaguaauuauccugaaggcuauuacaguaugcaaauagcaaggggcguccuugucuccuaaauuagaauaucaauauugauucaacauguucaaaaagaaaacaauauuucuaacaaauguuaauccugcuucaggauaguggaaaagacacugguugccaagcuuugauaggauuugaguucugggucccccauugacugaucugccugucauuugaacuaccgccccugguuucauuuuucucaucuacaaaaugggcaugcugaugucuguucugccugauacacauaucccuuggaggauugaaugugauaaugacuugguauaucauaacaugccauacaaguguagauuauuauuauuucaggagaaacuuugucaucucugaauuuuuaauuauuacuaauuugaaauguucugagcacccgauuuguucuggcuuccacauagaauuuaaauuggccucagauaaggaugugccgugcuuccccucuuucauauuagggaaguugaggcauguagaugugaaauugacugcuuuuuguuuuccauugaaaucauuucuccuugcauacuauuaaugagcuuacuauacuugguaucaauuaaauucacauugccugaaauuacugcaugaagcuacaaaaaauaauuucuucugacaaugaaaugauacagucuuacagguacuuuuaguuuuaauguaaacaugacugccucugauccauuuaauacucccaucuuggugugcuuguauguauuuggaaucccuugacuuuagacuugaacaagguugucagcgacugugcggaaguaaguguuuuugccaucacaccagguggaugaccccuccagcuguuguuucagugggugguaagaaacagaagacaagccccuagucuucauuauucuuaggugugaaaaauucucccaauuguguuuuccauagguucccaauauaccaauuacuuccuaaugucaugcagacaccuauauucucagaaaugccaaagaaaggcugcucugcaaucucucagaauuauuuucccagcugaauuugucaguccaaauuuaaaagagcaacaggcaauuaaauauucauuuuuaauuuuuuugucacucacugcugcaggucacagguuuuauaagauuucucugacuguguaguacuguauacuaaacccuguuuugauaguauuaauuaauauucucuugcaggcccaagugagggugagagagagauuuggcugggcauuuugguacagcaaugcuaauuuauaggccugggcaguggaauauuauggaaguguguaaugauaauaucaaaacugcauuuaauucuugaagaggaaggaaggcuagcacaugagagacagaaucugcuguucucuuuguaagugaaaggucaugcuacugagcgcugcgggguggauuggugagaaaugagcucccguuugcuaggaauuagaaugagucuaucugauuuuccuucacuugugaccuuuaaagaugcagcuuuuagauugauaagcagguggaugcuuuuaguaacccaaugcagaauuuguuucauauaaaaagacuaucuuucagacacugaagauauugcuuccacaaaggguuuuuuucuacaaagccucuggagaaagaaauucagugauuauaucuuaucugucacacaaagagaaaauucagaauuacuguauguucaauuagaacauuuuuuuuucccucaaagcauuaaucauuuccuggaacacacauccuccaguuaagaaucucuaggaaggcuugacagugggcacuccucguugcucucgccucuggauuuccugcgccacuccacagagccuccuccaugcccauaaaagagcuuccuauguugcuauaguaauccuuucauguugggcacuacgcuaucuugaaggcaaucagaugggaacaaggaguggggagcaguauagaguuaaugucaggcagcugaaggugaucugcgcuauucuauuuggagauguuuugguaugcugaagacgggaugccagucaaugcaagcccuuagcccacugugggcccaauuugauguuuagauauuuaaauauagaguuuuuuaugacacuugugaacucuaaacaagccuuuggauuuaaacaaguugaaauagcuuacuuuccauagccaacaagcucaaauuucucuuccucuccacuuguuuucuguucguaauuacaucauccaucuuauuuguucuaauuuccuccuuuuauuuuccuuaucuccccagccaucaacagcucaagcccaucaguguguguuuuauuuugucaaaugcugguguuuuauuggggcuucugugcuguuucuguuucucauuugauauuccuaccugauaauaaauucuucauaaagcaccccugaucaaauacaucagggcuucauucuuuuccuguguacagguuuuaauuuccuacucaaaaucacaaaugagguuuaaaaaaaugcauuucucccgcacaguaugccugacuuuuuaaauguuuagggaaagcagaggagugagcugagugacuuccauccagcagacuuccugccacugucuauggcaagagucaucagcucuguuuuccucucuaauuuaaaaauacccugcuuuuaaaaaaaacuaacccaguagcguguuguauagaccacguagaugaacauuccccucagaagugucucaacacugcagagccacuguguauagaaaaugccagcuuaucugcaggcagaaccaccaggccucugcagacacugcucucaccuuucugcccuucccuccaucuguuuacaugugcaugcauaauuccacauucacugaaguccucccaggcacuguucuaggaucugagcacgacgcuguggcgcucguggaaucuacauucaaaucaauuuugaccuaucugaaagagaggauaccuuuguaggaggcucuagacccacacugugugucacagaaagcacuuagcccuuauggcuauugaauuuaacuuaagcaaaauucaauacaauuaaaaauucagggccgggcgcggugguucacgccuguaaucccagcacuuugggaggccgaggcgggcggaucacgaggucaggagaucaagaccauccuggcuaaugcagugaaaaccccucucuacuaaaaauacaaaaaauuagcugggcgugauggugggugccuauagucccagcuacucgggaagcugaggcaggagaauggcgugaacccuggagacagagcuugcagugagcggagaucgcgccacugcacuccagccugggcgacagagcgagacucugucucaaaaaaaaaaaaaaaaaaaagaaaaaaaaagaaaauucaguuccuuagucgcuguagccacacuucaagugcucccauauguugagugacuaccauauuggacagugcagauacagaacauuuucauuguaccagaaagguauacuaaacagugucaguguagaucguccaccauucuuaaagguagacaauuauuacagaggaaaaucuguaaauaaauaacuugauuuauuuauuuuuuuauuuuuugagauggaaucucacucugucgcccaggcuggagugcaguggugcaaucucugcucacugcaaccuccacccugcggguucaaacaauucuccugccucagccucccuaguagcugggauuacaggcgcccaccaccacacccggcuaauuuuuguauuuuuaguagagacagguuuucaccauguuggccaggcugguuucaaacuccugaccuuaagugaucugcccgccucggccucucagagugcugggauuauaggcgugagccaccgagccuggcaauaacucuuauuuuucaucuccagaaacguuuaagcuuuucuggcuucuucaguucuuccugagaacagucagcuaagcaaaaucaacauguuccuuauccuaaccuggggguagugugagguuuacaggaacaggagggaggagggcagcugaaauugaggcucccucugagcuaccugagucaucugccuccaguggagaaggucaagaugggaagguuaaagaggaaggucaaggugggaaagcugaguaccaauccacuuuuucauucauuguuuccagaaacuuuuuuuaggcauugagaggcaauugcagugaaguaaauacaauauuuuuaucuguaguggaaggaaacaagggucaaacagugacagggcagcaugauaagugccaugauauaggaaugccugagagacugugggaacuuggaagacauuguaccugacugcccugugaaguggggacaagggagagaaauaggaagagguacaucagagaaggaccacaaguugugugggcaguguaguuuuaguuugcuugucuuugauguaacccucuuuagcauaaacugauuugaaagccaaguuauauagaaacagggguuggugauuuuuuuuuuucuuaaucauaaaugugaugcuguauuuuuuuaaaucccgaaggugauuguugauuucauaaaauaagcacucauaaaauucugcaaguaacaaaacccugucguuccuuugaaauguuugcuguaaaauguaauuuuuucuccuggacuucuggaagaaaaguauuucauuuggagcuaugugugagguccugcuagaauucuagaugacccauucucuccccaacaucaucucuuacuccugaucaugcuggcuuccuugcuguuucuggaacacaccaaggccauucucccuguagggcccuuguuuuauugcuccauuugccuagaaugaaacacacuuccucacagauauucacuuggcugucuccuucacaugcuccagauucugauggaauuucuucacacagaaugucauuucaucacaaggccuugcugaccacccuauaugaaauaucagccuccccacacacugccccaacucuccuaaaguuuucaaagcacugaucaucaccugacauaaugauguuauugucuauuuauggccugacucccaucuuuaggauauaugcucccugaagacaaggacuuggauguauauaccgucauaugcccaacaccuagaagagucccuggcauguaguacgucucaguaaauagauacugagcgaaucauuucuaucuugauuuauguuauggaucccaaaaaaaugguuagguuaaccuuucugaugauccauuucacuauuccuuuuguaaagauaauugagacuugguguuuuguggcaauucguaacucaguaauucucaguaaccuaaucucagaggccacucucaucuucaccacaccaaagaacuguuaagcaaaacugaugcucuguugcuguuugucagcugccugguugucuccagugugguaguguucaaauacaauucacuguguuugaacgcuucuucuggcagaugacuagagugcgcuggagaagcagcagagugugccugugaggccaggagcguggagcucucaaaggaccaucuuguuuuucugguuuuaaaccagguaaucugggcuugccuuuuuuccugccuccguccccucacccucugucccuuucuucguuucuuucuuccguccaucauaccuuucaauagaauaacagcaacuaauaaugaaaucauccccauggaggcagguguuagaguuccauccccaucaaccugguuuucagugcuguagaauaucaguguauaaacuucagaagaaaaacuucagugcaagauauacaagcuccuuuucuugcauagcaugucauucuuaauugagagaaugcaauguguuccugcuuuucuuuggaugcuuggcccuaaaucuaaacagaaaagaaaggaaaggcaguguuucaaacaggcaauaguugggagaaggggucgggagaaacuacuucucuuuuauugauuuugugaaauuguuugaagaaugauucagcauuuugggauauaaaaauaacagcuucgaguagcuuuucaauuaggcgaauguacuuuugcugaaagguucuguuguucuugaaaugcacuuuccuucuguucuuuuggagccucuuuaaucaguagugaugugacaggaggugcggcaaccuccccaacaccccugcuucuuccuuucccucucucuuuugugaggcugaguugccaggaaaacugauuggcaaaauuguuccuuaacuggggggagagguaguucuguaaagacaggcccuaugcagaacauaacaaauugaacuaccagaauguauguuuuaccccaguuggguucuguuucaacuagaaauccuaagcagccauggacugcguuugaagcaggcacuuauuguaaauuaaaauauuacugagguuuccauuuuuaaaaauaguauuacuuugagcagggucaugagaauuuuuguuucauuauuguguccacugucaggucacugcauuuaaacuccuuugaaaaugcauauaguaaucaguuuuguauauaagcugaaugcccugagccuuaacagaauggcuaauagguguuuccuggccuaaacaaaaugaaauuuccuuugguucucuuuguguauuuguucuggagugugagugugggugugagugugugaguguugaugugggggagaaaagauuauacuguaguauuauauuagcccuuguugaauaaauuuaugauaaugggugcuacagauuugcugcgguugcaaaguaaacuucagugugcauauaacgaguagcaauuucguuugcuaauuuaaaaagauuauauaaaaacauuuuuaaaauuuaauuuuauuuacacauaucuaaacuaccaccucuuuuagaagaacugaagaacuaagagcugauuaugucucuuguuacuuaugcuuuuacgauugacaggugucuguggccuuugaguauaucauggugcuuucugcuaaauuauuucauuuuccccucaaaacaaccaugucuaugauaauuuuauggaugaaaaauauugaggcucagaaaaguaaaguaacaucacucuguaaaagcugauauugagugccaagguuucaggcucuuggcggggcaccggggauucaugcuaagauucaagcucugccccacaggacccacaugaugagagagcuacaguggcucagagggagggguucaccgagagcucagaagcuccagguguaaccccagcugccugugugcucuuagacacauuaauuucucuucuaccucaucuaucaaacuuaggcuacugaauacccucuuuguauuuguuuucagauuaaaugaaauauaugaaaacacauagcagucacucagugaguguuaaauuuuucuuuauauuucuagcccaugucuuuucuucuuuccuuauaccaacuugcaucauagacaccacacuuguaaaacucuuucaacgauuccagacuucacuccuuacuagccaggugaccuugaacaaguuauucaacucucugugccucagcuuccucacuuaaaauggggauaagacuacuacuucauugggauuuuauugaggguaaaugaacuaauguaucuaaaguacuuagaacaauuuguagcacagaguagguacacaacgaaguuuacauauuaugagcuauauuaguuuuucuccuuuagauuauaaauuguguucacaauuguuuucagugugaaugugucuauuaaaacguuuuaguaaguucuaaguguucgaucugauuuuaagccugaaagguaaagucauacucuccugaguccuucgacuguauaaaucaggggguuggcaauuugguuucugauuccuuggcauugacugaucaacauuugguucauuggugagcauuuaagaaccaccagugagagcauaagaaauuagcaauccuucauacugucaggcagcauugagauugagcugucagaggcugagggugaaugcuucguuggauugacucacugaaccagcuguauuucuuugucuuccauggcauucuuggauagaguccauuuaacuaggaaguaaagacuuuggucaguucauuuaauaagaacgaacuuagaaaauccugcauuaaccacuuagacguauugaaaauaggagaacauuaguuauuuaacuaaacuccuuuaaaaaucaaaaauauuagggcaugaaauaauacauaauaccuuugacuuuaaugcacacccuacauuguaacuuuaaagcauuagaaaauguuuguauucuuucuuuuuuaaaaaaaauuaaucagagugacuggggugguuguaguggugaagaaaaaauagaaaaggaggaacuagacauuuggaauugugcuugguuacaguauguaaacuuucaugaaugugcuuuauuccuuuuugaaaacuaucuuccucuuacguuuuuccuuucuguuuuuuuuuuuuagacaaaccuugucugacugacuauaaccuuuaaauaauugguaaaguagagcagugaaacugacaugaaaaucuauugaaaagaaauggaagccgggagcauuauucuaguaaaggacuggcuagccuauuguucccuucucuugugcugugugugggaauuauuucugcuggcaacagacaacaucgacaguaguaguauuaaaauaauucacaucuauuuuuguuaguaauaauguaauacuggaucaucucuaggccacaaaauaauugacccauuucuaggagcagaaagucuucaaacuacaagugcuucucuugucugcccacgucugcuuucucugccuccucaccauacacacacacacacacacacacacacacacacacacacacagagagagagagagagagagagagagagugucugggcuuguagaucuucacccugguucucacaggccccccugccuggaacgccacuuucagccucaauaauuuuaccauuuuucaggagcaagucuaggacccgaucccuuaaagcuuuucuucacuuguccauugcauucaguccuauucaagagacauuugagcacuggagauaccacgcugaacaaggugggcaagccucuguacugagaccucacaguguaguggggacuuguaagcaaggccaggccuuuacagcagcaugguagacacuacgacagguggcacagggcccugugggagccuugcccagaccuugccuagucuucugcaccgaucccacuuugcccugaaugucuggcguggcuuuaguagcuuccagggaaguuggcauuuaauuuuuugcugccuugcauuguuuucuuucugucuguuaucucccuggcuggaugguaacuacuuugaggauaauggacuucauuuuauuuuuaugcugccuuuuuaaacccuauagggucuuaaacagcacucaguggaugguaaauacucaguaaacacucacugauuugcuuagacccucuucccuucccuccaccucuguggcuuuacacagggaugacuuccccucacugcguuccuuccaauaccuucuauaauuugaaaauggcuggccucugaaccuuguuugcuuaggggcagugaacuccagcugauuauagucauugucuucuggcccuggguucuugggcagcaacaugacuuccuucuaccaaccuauccuuucuuccucagcucccaucgauuuaauuauacuucaggcucuccaggcacagaucuaccaucaccucuuuuugcguagccucuaaaaugcuuuccucuuucagggacuguuuuccuaaugagggcagaauauaauuuagaggcuuaauuuuagaaaacuauaugaagcagcagacccauaaaauguuaugauucacaaccacuuguuuuguucucauaaugcaaccuaaacuaaaaagccauucaucaaagcuauaaaagcuguucauggcugucuuuaguauaucguguggagcauaauucagcccacagagaggcuaaagauggauucauggggccauuugccuugguguacguuaaaggccaguaauuucuaugcucuguagaauacuguauuuuacuauaaacccuggauuuuuucuuaaccccacuuagcuuucguuuccauuuuaauauaagcauguccccauuuauaaccucuuccauccccuguaaauaauugccaagauccugacuguucccuaauucauaguccuucuugucucagcuacuuugaccauuuaaggcgauugguguaugaagauguguugaccagaaacccaaaaugcagccuccauggagagcugccuuggucaucugucuccucuaacaacacccuaggagaaccauugguccucccaucacagcuccccagagagcaaauugccaacacuuuccuagaaaugaaugagggaacaaagcugugggcauucugggcuauguuuuuauaguguugugauaagaaugcacuggugauugugaacccaaguugcuaacuauagugucgucagaacuuaagaugccucuuauauuguguucauauuuaaauaaugaggucugaccuuuacauuuacucauaaucauguaucuaggucaucacgucacauuuucaaaaguacaagauaauauccuggaagcuaaagguuccagccauaggguagaugcagcuggguuugaauccuggcuuggguaccaguuuggcugugcuuccuuaagcauguuacauaaccacucauuuucuucaucugcaaaauaagauuacucacugaaccuaucccauaggauuacugugacgauagcaaaaagauaauccauauaagacaucaccauaguacuugguucaugguaaucagcauuacuuauucaguaauucuucuuuuuauuaagagucuaccaaaaaaaauaauaaagcaaggaacuggaaggaucuuauuaaaucuagacaaacauuuucaauaaaacucuaagauggauggcuugugugucuuugauacauguuuuacuuuguagagcuaguuuaaauuguguuguaaacagaaggacaccuaacaaaaaaugaaccaguuauuuauuuaaccucaugauuaaaugucagugacaugguguucuuuuuuuuuucaguuagccauuaaauauaguauuaugauuuuaaacuuaccuuuugcacaucaguuguuuagcugaaaaguacauucuuuuuauuuauuaggaacuaagcuuuuuuucauugaaaacugcuguaguuauagacagcucauguauuuccacuuaagguguaccuuguacugcauauuugcccuggaucugaagauccaucuuuuuuuuagcagacucauuuuaaacucucauagaacuaaaugauuuccuugaagaacaaguuucauuauuuggcagaugaaacuggagguggccauucagaaucuuaagcuggaucacacgauuuuuaaaagcucaacaacuuugaaauaaauucaugcaaaauuuauaauagaaaaaugguuaaaaaaauugagaauuguuuugaaaguggcuuugcccccguuuuaaaaaucuauuuuucugcaagauguaaaaauagcauuuaucuuaguguucucuuuaagcucaagucuugagggggacaguucccuaaaauuaaacucuuuuggcugaauuaauacucccaugauuuauuauuuuuauugggaguuccugggcauucccugugcuacaaaagagccugccuccuacgcucuggauaaguuuguuaggucuguucagaauagcuugacacaacuauggucaggcaucuuccaggacccauagcuuuaggaaugcucaggcaaaaagauacagugugguucuuucuguagcccuuuuccauaaugaaagaaacagauucugucuuguaguuggguggauuuucccaaucuaccgggaguucaauccauuuauagcuaacauuaggucaaggccagaggggccauagcccucgcaguugucauuagugagcucuuauuucuauuccauugagaagcugaaauugacaaacugucuagggagaugugcaguuucuagcugccuguuuuugagcagaacgcauuaaggauaggucacuucucaugguagaauuccucgucauuaaucacugaaagaccaaauuccuagguaaauaaguaaacucguugauaaagccacaucuugauagaaaauguaucuucuugacauccuccugucugccagccuggucagcaauguugcugcccacucggaacagacugccuuguuuaauucuguugauggagauacaccacggaucugugaagaucugagucguagcuguugcaggaggccugcuuugauuuguauacaaugugaauaacucucuguguauucagagugcuguaauuuuuucuucuucuaugccuacagggacuggauugccuuaucaggguaaaguucauucgguaggacuaacaauuaauccccuguucuuucuguuuccugcuuucuuaucugguggcuacauuauauacaaauuccagcauuuuucaucacuaugccacauaaagcaguuuggagaugcaagccauaaaaagcuuauuuuuauaaccccucuagaaagaaagcugcucagauuccauuugagugaaaaaggcauuccauuuuguggccauguuuacaucuacuaccuaaaccaaguucugggagaaugagaugaccggcugugacugaugagucucuauuguccaauagagucaaagaaaagaugguauauuuguuaaagcuauucccacuauccaugagcuuccuguacacaccacacugucuguuuuguuucucuugcuuuauaacuuuugaaacacagaaauaagauagucuguagagguuaucaacucaagauucacauccuuaacuggauagcaaaugucuuacuaauugaggcauguauuuaacuggauuaaauccaguggcuugauguuagcaugcauugcggccaagucugcuguccuuugaugagaaggggcuuagcuuucuacagcugugcaguaugcgagucacgcacucauccuaggguacuggcuugccguaauuucauuuggggacaggggaacauugcagcgugaugagcuggguaggagcuaaauauuucacauguaagaaggaauauuguucuaauuaaacugaaugcggugcccauggcaagaucugcgcuuaauauauuuggguaugugugaaaaauuacauauauuuuuuauaaauuuguccccaccccauccuugacaaaaagcuuuuguuuuggauaucauuuaccauagaggaauuaugucauuaaagguauuucauagcacaauaaaaucugaagaguuguaacaguuuccccagcccuuaaauguuuuucuuuagaaaagggaagaguucaguuuucaccuauaacuuguaaaaugaaagaacaaaaucucuuugcauuaucuaauacagaaucuauuguacaaaucccugggguuuuaacuguuuuucauuuagaaaagaaaagcaauuauagcauaaaguagaucuuggauauucaggagaaaauugggacuguguacaggauaauuccccuuucuuagccugaaacuuugcucuuacauggucuuugugaaauauuugguuggggaggagguggguaaaaauguuaaguaucugauuucacuugacaacccauugguaggcauugacuauacccccaaauccauuuuugcaaccuugaaacgucuacuuaauauauuacaauuagaaauaagugcuaaugagucuaguuuucugacuuauggguuguuaaagggucuguccacaaagggcuaguggaaugugggauuggagaggaugacauucuuagggacaggaucgucuuaccaguggucucugaaggucugacucaacugucaucuugauuugggugauucccaaaucugcagcuucacccuugagcucacuuggaaaauguaguccuacacaccauccagcuaguggaacacauuaucuacuuuucccugcccacguccuccaggcuucccaucuucggcaguaaguccuaguccuccagacucaaucuuggcauuuuccuuuauucccuccauccucucucaccaccauuuugugaucaaccacauuguauaaacuccuuccuuguaauucuaggaucugaucuuuccuguggagacugcugcuccucccucccugguucaggccagcauugacuugccuggcaaugcuccaguaaccucuucgcuagucuuuuuacuuucaugguccgcauuucccacccuuaucacacaacauucaguccuucuuacaaacuucuguagaauuguucuucguggaauacacuguggaaugugguaccucuuuacccuguucccucuauacucaucgacuucuaacuaccuucagucauuuuucaacaucuauaggauaaagucucuauuucuggcucuggcauucagaacccuccauaguaaugacaaaauaaggcccuucuuccucucucuuaacuccuaccaguccuuucugaaauauucauaugaucuuuauuaugcccugcuccuuauccuaguuauaugaagaccuuucuuaucuauccuacuaaauccugaguugcuagagguuaaguucuauuucuuuuacuugcuuauauccaccacauacaauucuaacaaacugugacuaguaauaaugauagcuuacauuuacugaacauuuucuaugugcuaguuacuguucgaaguguuuacauauuuuuuucucaucuuaguucacagggcggguauuauuauucuuucccuuuauuacagugcacauggaauuuaaagaggcagaaaugaucacuucuaugcaacauaaucaggcaagguuucauggcaauccacaggauauaguggugagggaauuuauuguagagauaagcuucucugcaggggaugaaaaugugauuggggaggggugggaauuacaggauagguagagaggggcauggucaucggaaguuugauaccagggauggaagaaacugaggaugaggaugaaucuuguauuaaguacauuggcaagcaguagagaaaggaguucugcagagauuugugccuagaccacuugcucaguauuuagcacaaauggcuucauauucuucuuuuugucuauucugucuguacagcuagauccuaagguccuugaugaaagggaaugcaguuuauucuuuuugguaguuucagcauuuagucuauacuaaaugccuagucagugucauuugaugacgaguaugagaggaaaaaauaaaaauauuacaaaaggcagucucuccuccauuaacagaagccuucuucaugugaaccaagcaugaggauggcguauaaaaccuauuuggagcaggaacuuuaugaagaauagaagagcuucuuuccucucaucuuucacaauuacucgacccuaguaauuguauuguuuuaaucucugaauucgaugaagggauuuauaacuagcauuucuacuaguuaagaucugcuuuaauuuugacauuuaguggaauaguccccauaauuucacuggacuguagauuauuguuguuauuauuauuaaugauaguguucugcacauucuguuguuguuaaagaagaaagcauacccuacucuuuagcaugcauuucagggagcugugagcccuguguauuuugucaagccauggcuuucaucgagucuccguaacaacauuagagcuuggugguugaugugagcuuucaggguaucaaugcugcauaauaauacuaauaggcaaaacaaaacagaaacuuguaggagcaaaagauguugcuauggcuuacuuugugguggggcauuguguugcuggucagcaauauguucccgucuacucaagcuggcuuuuggcuaccaacugugagauguuucguugcugacaagccuuccccauucuguauuuugcccucgggcucgcaauuuacuggaugcaaucuuguugagaaaauguggucuuuauuaguguucggcacagaucgacuuuucuuuuuccgcuucugcagagcuagugggaugcuuggugcagggaagaaacaggggacagaugacaguaugagggcaggaaaauaaggguuuucgggugcugagaaccagaaugcuggcuuaguguagagaugauuggagcagcaucuaggguagaaacagcuuauuuguacccacggggcuuuuggcagcauucuaaucaacaacuaauugucagagaaagauauuugucaauaaaaauacuuguaaguuaguuuuuagguacaugacaaauaaggaaacuuaauuguauaagacaguucuugcccuccagaguuuuaugauguaaugagaacacaaaaauaacauugaugcuccccaaaucaccaugaauauguauggcuuuacauacaauauuuuauuuuucacugugaggaucugugcguguauucuuguguauauuuuucuaucugucuccacgccgcuuugucuguugacuuggcucuguuucauucaucuaauguauucuacaaagagauuugugaguggcaugcugcagcuaccucuuuuccuucucccauaugcugucucuuuaacaaaugcccacacaugugacuuucccccuccuaauccugauggugccuauuguuuuaagcaguuccucgauuuauagguguuacuggguagcuuuuuaagcacaaauacaaaugcauugcaaguggaaauuaaaugccagagcaucugugaaaaauguaaaucauagucauuuaaaauagucauucuaugaagaauuguagagaugcgaaauuaauaaauacuaguauaagcauuaaauauucacugccugcuacuucugaaaugguacaacagcaucauuuuuuaaugauggguaaugauaaaacacaucaauuuuaaauaaccuguuuucuccuuuucuccuucugaagcuaugaguuggcaagcuugaaauuaaauacaaguaaugguaauaacuaagcuucuguuaaccuuagucauggaauagacacauuuuuguguuuccuggauguucuguggcuauuugaaaagacuaguaaauugaaaauugcagcuaaugggaccagcuugaauuuaaagaaaaaaauaugucuccguuaguggaaaacaggaaacguggaaccuuaaguagcaagcgcaccauuauccucuaacgcauucuuauuuuucuccuuauuaaggcuuacuggguccucuuagagaaguuaaaaugaaccuuuaacuaagauacauuucuauucccuccccuccaaccccucuaaaaucucuuaaaaacaccuuuauuuuuaguuaugcuucacuaguucuuuaauaaguuacuugcaaaauacaagaguagaauuaaagagccaacaauuauaucuugaauucaugugucccuaugcuaccaaagaacuguguacaccuuuuaucuucaaucuuauaugccauacaaauggaauugacagaaauuuuucucucuauuucauagaugggaaacaguaaagcaucuaucuccuaaggucacguuguaaagcauguuacgaguuuauguguccuaagauggggaagggcaggauguugugagucgcgagccugucuagggagguuggagugagguaaggccuccugaaggaaaucgcaccugcacugagaucugaaaaaugaguuggaauugauugggcagccaaggggugagaaagacgugggcgagaggaggacaugggugagaggacgugagcgagaggagguaggcauagagaaaugacuguauguggcucccacggggaggggccaugccaugcuguuagugggccugauucugggcaguggcgcaauguggggaaggauuuuugugaaauugaaaggaguggguuuucccaaguuuuuccaugcucauuuuuucucuugagcugguuaagaaaauggcaugaccauuuagaguggcugaaauguaauccugauugcagaccucaguuaccucaacugaaaauaccauggcagcaaacggccuugagacaaauucgugggaagggacuuuguagaggacccagggcaggagucaagauggggccaaaaggagagcgcuuauggugaaagcaggacagaucugggggaagacacaagaucugaacuucugaugucauugcgggguccugggcugccaccccacccaagaaauaccgguauuuauagauaucuaaagcauccagccuguaaagaaagauauaaugaaguuauuaauccuaugaggacuauauaaaaucaaaaucucguccugugguucuaccuucuuuacuacacguucaagagcuagugauuauuucucccaguuuucguuguugcuguugucuugucucccccaguuuuuaagcaccgugcugcaaaggccaggaguggcucugacagaaacauugccaauggcauuauuacccuggaccauugucaagauuuuguauuaacaaguuguaugaaacugaaaugcggacaagggaagaaguagacuuuuuuaagcccagccauuuuguuuuucaagggacaaaucucccugggcgauaacuaccagauugauggggauagugaaauggcacucagaaaggagaacuguuaacacagugugcgggcagagccuggugcucgugcuuaagcaccugugccauuccgugauucagagcaagaaauaggaaacaaaccccuguugucuaaagggaaccuagcaggaauagucucuguguuuccauuugaacagaacuccauuaagagauuacuaacuaagaagcacuaagauuugugguugaauaagcaauugaaaucaaacccuaaagcuuaucuagaugaauucacaugcuccuuuaccugcagaaguuggcuggaauuaugcacaccuuaugucaauguugaaaagcaucggguaggaagugugauuuucagggaggaaaauagaucuugaaacccaccaaaauguacugugguugggggacuuuucuggagagaacacaacuucuauuuaauggguaugaagaccaacacucuaguauguaaugucaguguguguuuacugugacacuccuuugucauguaucuucaaagauggcauugaauuuaucaugagcuauagccaucucauucuuucuccaggcgauguuuugauaaauguugaugaguuuauaacuguaaaaccaaaugacauuuauagugugauacacacuuuacccauugcauaauuauaucuaauggcuucgcauguagaaaggcauuuaccauuugcuuuuguauaaaaugacaaucuaaaccccagggcuaaauuuuuuuuuuuaaacacgaugauaaagacuuaauuaagaaccaaauacaauuuauuuuuguaacuggcauuuaagguaccuaguucuuugguuaaauaugugauaaaaaucaugauacuucuaguaacaaagaucaguggguuucauuuauuucccucugucugaaauauuggugaacucacuuaauuaucgaacugauaucugguaugacuucuuguuucucauuucuagcuaaaagagcuauuuugaaagguagcacagaaucgaauaauguguucaguuaaugaggaacauuuaagagauguuucugaauuuaauaugauggaaaaaaaauaaaccaccacuguaguauagacauucuuuaucuagacagugaugaugucuuaggccucuugguuguggucaagcaagguuuuauuuuuagccauuuagacauuuuggaauguuuaucaucauacaguaggucacuuaauagaucaaaacaguuuuauucuuagucuucaugucagaaauagcucuuaguaucuuguuaggauaucuacuguguucaugugugacgacuaaguagcuuucuuggaaacaagucugcuguuguaguagguuuaucuuucugacccgguauugacccuaccugcccugacauugacggccucugaucagccuaccaaugagcagaaguuaaaguuguucucucugucugccuuuccaugguaaaaacuucacgucguugcuuuuuuuuuaaauuuuuuuauuauacuuuaaguuuuaggguacaugugcacauugugcagguuaguuacauacguauacaugugccaugcuggugugcugcacccacuaacucgucaucuagcauuagguguaucucccaaugcuaucccuccccccuccccccaccccacaacaguccccagagugugauguuccccuuucuuuacaggaaauaaaacuagaucgaaauaggucucuucucaaguguuucaucguagaaauaaucuuauuuugagucucaauauuucugaaaaauacggaauuauuugugaauaacaugaaguuuguccucuucaaauugcuaauguuagauccuauuaaaaaucuaagccucauggaaugcuggagaguuaaaaguuuguuuuuguuuguuuguuugagguuaaacucauaauaaucuagcuguauacuaguuaggucuaacugauuaaacuaauguuuuuuuucuuuuaaaauaugaaaacaguuuuuauauacaccugaauaaauguggaacucauuacuauuagauaauaagcaaaaaaaaaaucuguucaucuuagcucaaaaaucaagaguagaguguucacugauuucugaacuugaaugcacaauuuggagaaauguugcaacugaguauaauccuuuggcuaagaggcuuaauagaaaugagaaaugcauugaccacaauuaaaacacagaacugagauucuugcuugugucugaggucgggauuuuaauaaugcaucugugaacugcuuucuuuugccuuuaacaaaauuauagagcaauggucuuugcaaguuccuaaaaaaaaaaaaaucuauaaugaaccagaaaaagugauauuaaacuaacauuuaagaccuuccagagagauugcagaauuuauuggaagaaggaacagaguaauuuucuguguaagagugauuaggaagaaccauuuucaugcuuuuagucugggacaggugguauagauuaauguugaauacauacaaaaucuauugagacuaauuaaagaugcauauccacauggaauaccacaucucaguggaucuuuggcugccuauccaacaagcacauguaguguuuauaccaagcauuuuucaaauuuagccaagaauaguaccagugaaacuucugaaaacugcccugaaaauccuuagucucuuuguauuauaaagucucucuugagaauuucuaccuccaauaaaugcuucuuggaauagaaaagauuguaaccuguguucaucuauaaugggcacaaauauuauauagcaauauagaguauuaguugacuguacugaucaaaauccuaggcugggcgcgguggcucacgccuguaaucccagcacuuugggaggccgaggcggguggaucacaaggucgggagaucgagaccauccuggcuaacacggugaaaccgugucucuacuaaaaauacaaaaaauuagcugggcgugguuguaggcgccuguagucccagcuacucgggaggcugaggcaggagaguggcaugaacccgggaggcagagcuugcagugagccgagauggcaccacugcccucuagccugggcgacagagugacacucugucucaaaaacaacaacaacaacaacaaaacaacaacaacaacauaaacuauauacagagcuucaauuuaaguauuuggcaguggcuauaagaaugaacuugacccuuuacuuccugagagggcauccauuucuaaccugaugcuuagccugauaaagaugaagcuguacuaaggaccuaucucggauguuuaauccaggagagugaauuaacacaucagucccuaagccucugucccucauccagguuggcuuaauacccuuuggugacuugauugcuucuuacaaaugcuaaugaacaguucacuuugacacuguacacaaacacaaucuggugguuguguugagauguuuuucauacugcuaaugaauaaacucccagugguucacaguuagcugaaauaagcagugacuugagguagaucccaaaagugauuuauuaaccauguuguaaaccaaguggacuggauuuuagagaaagugggaauguucucuugaauucaagggccaaaguaagaaggauauuuuaaauaaacgagcuuaauaaccuuagauauuauuccauaccaacguuuuuauugggagugggggugagaguugggaauauguacagggagauaagaaugcccauuuaucauuuaacagaagagguaucaacauuugucuguaaagcuuucuuuuuaauaaacauugaauuggagcuuugcugggccaucagcuauccagucagugaugggcuucaaagaggccacucuuuccuuccuuuuaagguuuucaccaauaaagcaaauccuguaguugcaacaagaauaagaaggaaauguucuggaagaaaaggggagggggugcccagaaguuauggggaauagauugauauuuauagacaucagcaauggucuguuaccaacauuuauaacuccaacaguagcagauugagggcugaaucaacauuuuucccccucuguaaaauaauaaauaugguaaaguagcucucagaacugccuuuaucauagggauaaaucaggacaguuuguguugcaggagagacuuaaaacuuauaaauauguugcccuuuaggcuacuauucaucaaagugucugauaugaaaucuagacuaaaggcuuuuguuauugugugucugcguauucucuuuuagaagucuaaauuggaaagagcgcugucauuuuggucauacuggccugcugugcuacuuaaaugcaugucccuuuugggauguauuugaagagaaggaaauagugggaguugacgccugcacacuuuuacacaaauccucuucgucgccuaaaccuuccuugcagagggcauaauuuccagcaggaaaaauucaguaaauaaccgcuugacaaaugaccuauuuuggugcagucaacuuucuuccuaagacaccggaguagagagguuguucuuaaaagccucaucaaauccagagggacguagcuuuccuucuuggugcuccaauucaaauguauacaaauaggcauggcuaaagauucuuucaguuugcagagggaaagcauaucaggcuagugacagaugcuuuaagucacaugacuugauggguauuaugguauaugaaaucucauauaacuuugcaauucugaucugaauuuccuggcuucugugguuuggagucagaguugaagcuccaacccuguccucuacuccccuuggugccuuuaaauguugaaucacguaugguguauggaaucaccugcuguuuggaggcccccacagaguauguacugagcaguuuuccuuuuuuaauguguaguacagcuccuaguuuucaagaauaacuaauugggagcauaaaccucauuuuguccuugaaugguuugcaauucaggaguccugaauaacggaaauggagggccuacaaagagggcaucgaagcgugcugcaguuugauaauuugcccacuuggcuuggguaagcugcugguguggaauugcucugggaagaaacagcagacucucucaggucgguagcuugucucugauguugauuugggggaauuuagagaguuggggaacucugaugaccccuuggggccucuauccugccauguguguuuucacaagagcaagugugggccacuggguuagucuggauuugcuugaaugacagcauguggauuguacacuuagauuggagcgcugaaguugcaccaggccacacucauuuauagaaaccauuguuccugggaguccagucuagaagcuauggccgaggagagaaauacuucgaacuaugggauccaaaaagcccacuggucccuaugugacacccaagcauguuuaccuccugcugggccacguagccaaccagaagagcgcaauauggugaugucaaguuccaccugugugucgaacugaaaagacggcagcucugcagccccacucauucuguugaggugguggcaguuugacuugccaagucaaauuccuuguacucuguacaagucagaaugcccaaccuuaucacugguaacugacucuaaagaggggcucaggaacgggagagcacagguuuucucuuuaucagaugccuuuaaagccgcuucgcagcacaucccugugauugcuaacaccauuaugaagauugacaguuucaucaagaaagcaaagaagaaaaucugcaggcaauaaauggaggcagugcugggcccugcucugguuacccucaauagugcuuccagagcacugagcugggguaggguccuuucccugcuucaaggaccuguggcuuuuuuuauugagcacagagccugagaacuucuguggcccuuuuccuaguacaaauagguagcuuuaagacuuaaugaggagaaaucugaagagugcagauagagauuugguugugguggugaggauugguuuuuuccuugccugaaaaggaugaccugaaaacaagccucuagcauuguccagcaaccuuuccaccucacaggcugaaaugcauaucccaaagucugcaaauacuuuaguacaguggccaaacugaagaagcucaaguguaaaaaaucaagaauguucuucuaaggacacagaauaucucugaauuguuaguaguuaucuauagcuaauaauucugggcacucucuuaccccaagccagcugcgucacaaauaugugggcuguuggcuacaaggccaguggugugaaugauucaaugcaaacccaucaacacuacuggaaaaacaauucuucguaaagacuuacuggagaugauucagugccaucaucagcagaagcgagcagcugugugaaaccacugcuucucugagccugggauguguuaacgauauauucucagaaguaaauaauccuuuugcuaacaagacgaacccuauuuacucacuuucauucccuugagguuugaauucagcccggugaccgugucauaaauaucauucugaccuccaagggggcuguuccugaaucugaguucuuuugcacguguccuucucggagguuaaacuguccacccagccauguugccuuauauucgucauauuuuuuaaaggaaccaaagggguuaauugguuucuucaguaaagagacuuuugccgaagaaagcaauuuuagaaaaaaaaaaaaaaaaaaaagaaagcaauuuuagguuaguuuguguaguagccagggaaauguacugaaagggguggaccauguuucuguugugcagauaaccuacauacugcuuuagaaaugugugauuuccagcgugugcuaaaauaagaagugguuguuugauuuaucucccacaaugguauggcauucucuuccuaaguggcauuucauucgcaagccaggcacuguaaauuugaacugaauauguaaguaaauaucccucaaggagauagcacacuggcuggccucgucugagaauacggcugcuaaaaaugaagcucuuggcuuguggaaaaggcucagcaccugaaauacauuagcauccaaaagagugcauggugugcuagccagccaaacaaaucgaaaguuugucugagcuauaauuguggagcguugccuacaaagaaaguaauauuuggguuguaccuccuacauuugcccucaagcacucaaacugacauuuaacccgcuggaauuuugcuuugaacuuucuuguuuggguacaucaccucagugcauggcagcuugguacaucauagcuuuuacuauagcaucuuugcauggcagggacaaagacaguaacaguguuuuaucaagcccuaacaagauugcugcagugcauaauuguuaaagggcugucgaucuacucaugugcaacaggcaagaagcuuaaagaauggagaaaacccauaaucgcagaguaacuuguauucugauuuauuauuuaucacaucacgguuaaaacaauuuccuaguuuuguguauuuuuaauauugacauugaauuuucaccuaaugcaaaggcagguuucagaaacuuuuuaaacauuuauauaugcagguaguuaagggggaaaaucccuuuuuuauuaagauacagaaugcauguuuaucaaaauucaucucagauuccauuuagaaauauagauaucuuggguuugaaagagcuuacugagcugcacggaaugacagauauuacugacagaacaaaguuaugaaugauaaaagaacccaggaaaugcuuauacucauguggcuauaaauuaaguaguagaagaaagauugcuauuuguuggcuggcauagaacaagcauuaaguugguaaauguggaagacaacacucaguguacaucuugcuucauggagagguacugaaccuccucuguggcccaguccugcguggcugauggccugugaacccagcacucccacggggcucucacugucauaaugcagacauggcacuccagcaggccccaggcaguagcacaggagugcugcacagagauccuagcugaaaaaguuauaguauucuagaacaauugagcauuguaaaugcugguuuaugcuucaaaauguuacauuucacugcuaugaguaacaucugucaaagccaccuaauguuaagacauggcugaguaauauuaccuuuguuuugagcacaauaagcagcucccuggaauaacuggugcaguccagccccucuggaaauccuacuggcugaugcccacagcacacugaaugcuggcggguaaggcugccuuugcacaccuucguaacucaucucuuaccacggugguucucaaacuucaggaggccucagaaucaucuggaaggcuuauuaagacauuguugggccccacuucuacgguuucugacgcauucaacccgaaaggacacccaagaguuugcauuucuaacaagcuuccucaugaugugaggcugugguccaggaaugaccacuggggacuacuguccuccuaauugagcuacaugguuaccaauuauccauuucauugauuaacaaaccaccucaaagaaaagaccugagaggggagggguggugagaaaagaccuggacuuuacaccaaaagauuaaaugaauguacagccauauauuuuaagucaaaauguuuauggcauguguguaucucuuuuuaugauuucccaccauaagucauucuuuuggauuaacccagugaacuacuggucccaaauacagauuagacaaccuguauuguagaaguaguguuuguguuuacaacacagguagguguauucaaugguggagacagggaaacuuuuccaugauuuuaugagggaugaacacuggagcacguaaaaauaugagaaauacauaccaaaagcguuuucuguguggauagaggcagggcuaaauagcugaguaaugaaaagcuagaauauaaaggaaauacaacagcaagaaugcacugcccaagguucccagauuuggcauagccuguaucuuauagaccagaagccagaggcccaggaagacuaagggccagauacuggucuaggcacuggagaaaccaccaugaacacaacacccagguuccuucucucuuagagguuaaagucacuucuuuccuuuccucaugagaaaaggggaaauuucaguauugguauugaauuccuaaaaauagggagauguuaugauuccuugguuuuaaaaacaggcaggcagaaaacuguuuuccugauguaaguguguauauucaagaaggggaggggcaugugguaggugggaggcaguccaguaaacaauauuucgagagcaaacauagccuagugaaugccuuauauuuuucuuaaugcuaacagacuuuucauuccuaauauaaugguuugagugugugcgugugucccaccaaagagauggagaaauacugugguguuguucacuuaccuucauggcacccuuguuuaguaaauggggucaggcaguagacucuccuuccccauucccacccgauuccagcuuguucucuuguguagguguggaaagaaggauaguaagagaaaucaucaugauugucauaugauagcugcuguuuauugaauccuuauaaugucaaacagcacguucauugucucguuucauccucgcaucaguuacaaugguucuuaauauuuccauuuuuauagaugacaaaauggaggcuuagguuaaauaacuuacucaaggucacaaagcuuauacaaguugaaacaggauuugagucuagcuccaucugguuccaccaccagagcucucaucaucagcacaaauauccuuguacaggagcuuuuguuguguucauggaaaaacuaggucucugaaaccuucauuuuugcagagaauguuuuucuguggucuugagauaggguacaccuguccuugguugcuacaauagaugacagagauggaagugacuauuuuagaacugaaugugccauccauuagcccacagaaaggaaacauuuuugaauguuuguuuuuucuaauuguguguguuaaguaaagugauuggacaaacaguucucuccugcuugguaaucuguuauaaaucaaccuucagauguuaauaaaacaagucaagacugacaaaggaaguuccguuuguauuuuaaacucccaauucaucagggucuccuccuuuagaucuucugugagaguguccuuggucuuaauguagcuggaagauaaaaugcagauaaaagagccauugucucagaagagcauuaauaaaaaaugaauguugauccuaauugaguaguauuuaaacauacgggguggaggcagcagucugcagggagcaucugagucuguuagaauuugacucucgaucucaucuuccuccucuuauuacagggaccucaccacccagcugccuucugugaauguaaacugucacacuggaaucagaaaagauauauauagacauaguacuauagcagauucucagcucuuuugcuaucguuguucuuauuuugaaacaacguacuacuauuccucuaucuuuuccuaaaaaucuugucauaaaauguucaauuaacucauuuucuguucuucccuuuucauuguuugccuguuucuguuuacagugguucuugauaacuuaguuuuaaguucuccuuaauucuuaauucuguuaugcuggauauaacagaaagaacucgcaauggucaaaggugaaagaauuugaacaaaaauauuaguaauaauaguauuggauuauaaaccaaagaacaaaauaaauauccaugaguccauacugauauaauuaaauuacugaauaaauaaaugggaggaaagacaaaugucuuccuuacagaagaauuucaauuuaaggagugaaagaaauaaaaauguuaccacuugaacacugaaguaauuucugcagacaagauccacuaguggaugcuaaaauuaacaagugaaaguuuaaggagaaacaugauaguuucacagccuccaaguauuuucccccaaauauuuauuaauuccucuggugguuuuaacauacacauauaucuacaaauucuuuaauacugcucccucuuaggagaugaggauaaauuccccucauugugaggaugagcuggaugucagugacuccaauuccaaugaacagacucuggaaagguaaaagucauaauuuuucaguggagaaaccuggcauacaucaccuugaccgauggaucaagguuaaugucaccaauaguaagacuuugacgucauguaccucaugauaugaugcaaugaaggggcgcgucgccuccguggcauucuuccccaaauucauaaccucgguguuaucaugagaaagcaugaaacaaacccagauugagggacagucuacaaaauagcugaccgguacucuucaaacugucacaaucaugcaguguuguaccaacauucaucucuuaguuuuuguaacuguaccacagcuaaauaagauguuaacauuaggagaagguggaugaagaaggcuuuaugauaacuuuuugcauuauuuuugcaacuuuucuguaagucuuuagguauuucaaaauaaaauguuuaaagaaaaaaaaaaagacccaucaagggcauagaaaagcuuaggugaagaaacccuaaaaugaauccucauuuaucaacucauucauuuauugauucauuuguucauucauuuguucacucaagaaguauuuguugccagacacaguaccaacaaagaaaauaagcauccacuacggcuuugcagagcuugguacgcaaugccugguucagaggagauauuuguucaucgcuugcuuuuaacuguaucacagccuaggguggcaugcagagguuugaauaagugcugaaacaggacaagugaggugcuuauggaaacacacaggagaggcacuuaaccuagucgugggagaccacaaaaggcucccugaucagccuuuguaauauaaguaagccuauuguuuaaucuuucauuuaaaguguguucaguguuuucuaugggacgaacauacuuaugacuuacauuuugaaguugauuucauccuuuuagauucuaaaugccuugaaagugagugcuuuaaaaguaagaauagcauaaguuguuuauauguauccauaaaauccuaguugguaacacagaguuuuuauaaggaguaaaggggucucaaaucccuuuggguuggaaucauuuguuacuuugaguuuuccuuagcaggaaaaaaaaaaaaaagacaaaaaaagugugacacaaaauauauacaugcugcugugauuuaaaaaaacugaaucguaaaaauaucuucgguggcucacgccuguaaucccagcacuuugggaggccgaggugggcagaugacgaggucaggagaucgagaccauccuggcuaacauggugaaaccccgucucuacuaaaaauacaaaaaauuagucaggugugguggcacgugccuguaaucccagcuacucaggaggcugaggcaggagaauugcuugaacccaggagguggagguugcagugagccgagauugaaccacugcacuccagccugggcaacagagugagacucugucaaaaaaaaaaaaaaaucuuauuggagugcaugaaauuuuugauguuaaaaagauguuuucuaaauaggcugaaacaagaacaaauauuuuuacaaaagucuuuucaauguaacauuuucagaaaaagaaacuuagaaacaauguaaauauaaaacaaaaaggagacagugaaaugacuucucguauuccuauaugacggacacauaagauaguaauuaaaauuacagaauuuauguagaugugcacauugcacacauacaccccuucaacauaugaaaaugaaaaaggaauacacuaaaauauuaauccuuaucucagaguuaugggauugugggauuuguuuauacuacuuuguuuuacuuuuucuaccaugacuauauaauuuuuauaauuagaaugaaauugcccuguguuaauuuuugagagaggcauuaauucuaagaaguagugguacagagguccugggacucuuaauguauggguucaguaacagaugcucuaauugaaaugagaaucagagcucaggaaagcuagucuaggucucccuguguagcuaaauaauaauuucauguuagcauuauuuuuguauaccauuucucaauauguuuuuaaauaacaucuuugaugguuuuauauaggaagaaacauugugcccauaauagguguacccucaugacauuuagccuaccucaugguaggcucucuuacagcuuguaagucucaggcauugagaagcacuuggccuauguaacaaguggguagacucuacauugcaaauucccaaaaagguaccuaccaaaggucugauuaagagcaccuggagguaggaugggcaugguggcucauaccuguaaucccagcacuuugggaggcugaggcgggcggaucaugaggucagaagaucaagaccauccuggcuaacacggugaaaccccgucuccacuaaaaaaauacaaaaaauuagccgggggugguggcaggcgccuguagucccagcuacucgggaggcugaggcaggagaauggagugaaccugggaggcggagcuugcagugagccaagaucgugccacugcacuccagccugggcaacagagcgagaccccgucugaaaaaaauaaauaaaauaaauaaauaaaaauuuaaaaaaagcacuuaggaaucuuuuucuuaaaauugauuaugacucaguaaacaagcacagccccucaucaaucagugucggucauucucauguagccauuugaccuaaugucuuguuagcaauuauaccuccucauuauucugaaaacuggccaggccucggccauucaggccaccaggcacaaagauagagaggcccacuggccacauauuaccugauacaguaugauacaaccauugagaguucuguuacauccagcguacaaccaauauguaugaugugacauauuaccugauacaaaccacggaagggaaccauuucuuagaguguugagcucuaccugucuuacucucugcacauuggaucauuagagacuguccugggacuaauccagagaggucaaucuaagcacauuaaaacaaaaggguggccgggcaugguggcucaugccuguaaucccaacacuuugggaagccaagcuaggaggauuucuugaguccaggaguuugagaccagccugggcaacauagacagaccccgucucuaaacaaaauuaaaaguaaaaaaauuaggcaugguggcaugugccuauagucccagcuacucaggaggcugaggcaggaggauugcuugagcccagagaguucaaggcuccagugagcuaugauagcaccucugcacuucagcuggggugacccagugagacgcugucaaaaaaacaaaaaacaaaaacagagaggguuaagagccauuaucucagagauggagacaggacugagcaaaggagaaggcuagagcuaaagugaaaugaggugggaagggcauggagccaggaguuacagagggagaaaacgaugcugaagaguucaggaugagaucuuuagauggcaggauuucugcuuggacaguguuuggaggaaagcuccuucuuuagcuccucuugggcuauaccgaacguuaaggaaguagacuccuaacagagagguagagaccguagcucugcuuucaucuguagauuaagcaccucuuuccuuuaaaaaaaacaaaaaguuggcuggacaugguggcucccaccuguaauccuggcauuucaggaggccgaggcggguggaucaccugagcucaggaguuugagaccagccuggccaacauggcgaaaacccaucucuacuaaaucuauaaaaauuagcugggggugguggcgugugccuguaaucccagccacuuggggggcugaggcaagaggaucacuuaaaccugggaggcagagguugcggugagccgagauggcaccacugugcuccagccugggcaaccaagcaagacucugucucaaaaaaaaaaaaaaaaaaaaaaaaaaaaaaaaaguuaagacugggugcgguggcgcacgccuguaauuccagcacuuugggagccugaggugggcagaucacuugaggccaggaguucgagaccagccuggccaacauugugaaacucugucuccacuaaaacuacaaaaauuagcugggcgugguggcacgcuucuauagucccagcuacuugggaggcugagguaggagaaucgcuugaaccuggggagcagagguuguaguaagccaagaucauaccacuguacuccagccauggugacagagcaagacuccaucuaaaaaaaaaaaguuggaaaguuaacauuuuucucuuuuucauguucuuuaaaaaaauuaaaagcuuucuagggcaccuaugacuaccauuuguuuuucuuuaugcuuugagcuacaaucaucuaaaaauaaaaaugauugugcuucuuaucuucauuuuccccuaaaguaggacucuuccuauuugaaagaugguuggaggaaaggaaaaguauaugugaacugcuacaucuccuuagauuugagagacggagggagaaaaggaaaccuuagauuucuuuaguacuugcuccaaagaacucagauaucuuauugaucuugguaacacguuauaauaaaaguagaguuuuagcuucuugguuuuggcugccaguguccaugacaagguucaccaaagaugguuuuggacucugggccuggcucuaagcuauagggcccaaaucuuagacaguugagauccaacaaagcuggguucuggaguaggucgggaaacagagcugguggcagagugcaucucggaguucccucuuugaccuguucacaggccuuucauugagccuuguuugccaugcuuuucuugugguuugugacagauaagaacuguauugauuccuagcaucugcuggcaguaaccuuugaaagggcaggcgaugcaucaccacagaauuuuaucuaucaauaucggaguaauagaaagacagggaugacaucuaaucacaacacagcuggcagaucauaaaucugagcugauacgguacuaguaaugggcagcagaaaaaaagggacauggauuaacauucggauaaagucagggggucguuuacauggaaaggacacgaucuggccaugagaaaaguccucauggaaaugaucacccucagaggccugagaaguuaaguaaccuucccaaguuuauccgguuagucuguggaagagcccugcuguaagccucaguuuccucaucuauaaaauaggcaaauacuuugaugguugguaaaggauucaauuagauuacguaugccaauucucagagcauagacccuggaucagcagugucagcaucaccugugagcuuacuaggcaugcaaacgccugggccccaccucgcaccugcugaaucugaaacccugggaagggcccagcagacaggcccuccaggugaugcugaugcaugugacaacguuugagaaugcagauguaugcaaaacaaccaacaaacacccuuaaaaggguggccuggcauagagcuaagguucaaagcagcagcauuuaacugcugcuuuuauuacuauuaauauuacuugguccugucauuuauacuaauaauuuacucuguguacaagcccuacauucuucauacuuuuuucauucacuggugaauuagugauaaaaauaaacauuuucugacagauaaacauuuuugacauuuaaaagaugucauagaacuggauacacuaacuccuaugcuccucugguuacagugcuagagaauaccagcauucuaaagguuaagguucuaaugugugcuuuggacauauuuagugcuuuugacaugucaggaagcuuccagucuggacagugaauagugcuacaauuuaauaacauaaauggagucugucugauucugcaaagaaauggccuuccuuggggcccagaauauauaguuccuucugcaguuacacucacaguauuuuuaaucauuucaugauuuuauuauaucccaaguauaaggugcuacaaagagucccuggugcuggcagucacucaaaaauuggcaaaucuaaaaagugaauagaacagcaaguagcccauuagauuauuuuuuucuuuauuaaaaaaaaacuuuuuuaaaaagaaaaacuaccguauaaaguuggaaguguugauuuuggcaucuuauacaugaaaaguagucguaauaaagugccucaauuguuggugcuuguucugcagaaauuauggcugugcacaauugugagggcuuaacuggguuuccaggaaguacguaauucacacucuaaaugugacaagcaugacugcccauaaaccuaacgacuuuuuuaagagaccaaaauucagaauguuauucucucugaaacugcacuuaguaacccagcagaaaacuguucagagaucugcucccauugcaaugaaggcaucuggacauaccagugguaagaacagcuaacagcuuucauauaagaacaaacuuuuuagaggaaggaguaagugugaaccuauugcaauugccauauguuaaggaacacaaacaauaggaacuagaacauggcaauggccauuuuguugcuggcucucucucccugcccaccuccaaccagaaaaaaaguuuacuggaaaacugaaacaaauugaaguccuagguauauaaauuuucagagugauaggaaagaaccucccccacacugagccuuucacucugaggugaauucucugguuucaagguaaguguuacuucccccugugagcagcugcuaacgaugcuguuagccuauauccggauggcacaaggcacgcugacuccagugacugagaacagggccagcaguccaggcugauccauggauauucauuaagaggcugugugaaaugaaacugguguuuacuuuuucuucuccuggacauucuaugaggcucauuccaagccugauucuuucugccucaagcuuaagacucuuguuauuucucuuaaacuuugguuuaugcuguuaccuauauuuuuacagcaauuuuuaucugcuagccagagugaaaaggccuguuguaauggguaagauagcuuuuauuuuuuuccugccuucaaaucauauagcugaauuucaucacuucuauaacaaaccucugcagccucuuuucaguuuucauuuuggaacacuugcuuuauuucucuauuugcuguuuuugucuucacuggccuaaugcucacaaacacaaaacacacaguaacaauaaaaccaaguaagcaaaaauucagcuagggugcuaccgcuugugaacugacagaccccacuaagggugagagcgcuggcuagaaguagucauuuuugcaauuaagugcagaauaaucuauuugcauugguuacagucagcuagcugcuuugggagaggauuuuucauuugugcauugguuguuguuauuuuucaucugugcauugcucguuguuugcaacuuaaggaagaaugauacauucaguuuccuauugauuuuauccaugagccacaucaauuuaucuuccugcaaccuugaauuuuuaaaaauuuguuuuuaaacauguuuauuccuggaaacuggccuaauuugguggcuaggauucaugaucuucuuuaucccauuacaccaagauucaccaguuuccucaaaacaaguuaucuaggaauauuucucuuucuaggaucuccuuugguuuagcuguuagucuuguguuuaugacugugauauaaaagaaugauuggaauuaauauacuccaggccagcgcuccucaaauuaauaugcguaggaauuaucugagucucuuguuaaaaugcacuuucugacuuaguaggucucgugugaguuugagauucugcauuuuuaguaaucucccagggauugucaagacugcuggucaacaacacugcauagcaaagcucugaggggacugguggacagguguccuaauuauauuuuugguacaauugggugcuacggaaaacccucuugagucauauugcagaauguauguguccuuugcccuuuaacuucugaaauuagcucuuugcuggucuuuccuuagaaggcagcuagaccuuaacugacguuuauagaggcaaguaacgcucauuucuuccuuuaaaaggggaacacugaugccaaagcccgugcgccugaccucugaaguauucucgacuccugcucacucucuuuuccuucuccugaguucugcuuccucuucucuauacucuuuucccugacucuuaucagcuccugagcacucuguggcagucucuuaacugauccuccugacuccagcccuuuuccuccucagccucccaucccucucuacauagaagguaucuuucaaaauacagguguaaucauucccuggauuaaaaucacuuaauggcccccuauugauuacaagauacagugcaaauucccuagccuggcaugcaaugucauucaauaucuggaccuaaugaccuuuccagaaaacguuccuucuugucucuauucagagcacacuguauuuuucauauuguuccaaauaugccacgauccuccuuucagauuuccucuccuucuucccccucucuagaagcugcacccuuaucccaacugagcuggucauccuuuucuaugguacccauagcauauuaguaacuugugacuuacaaguaugcguuuguugucucuguguguguguguguguguguguguguguguguguguguguguguuugucucccuugcgcauuaggaacuucuuaaaguagggcuguuuucucuauuagcacucuagguccaauacuaaggccuguuuccuuccaagagucuugugaaaauccccgagauaucgaaaaguauuggcuucaaaauaaaauauacaauuggaaauaauuuugaaagcaaaaacccuuugaaaauuuuaauucaaaauuauauuuagugugagauauggaugauacuuaauaagucuugauguuauauggaccaguuacuucaaaaagugagagcgccuagcacccaugaagucuuaaaacagcuuaucauuuaguaauuuuauucaauaaacauuuauuaacauucgcccucuuagccaauacuguauuaugcuuucgagauacaaagaugauuaagauagugugacugcucucaaggagcucaagauaauuaaaauaacaauauauauuuuuggcacacagguuuugugucaagacucaagcuguacaaauauguggauuaucucauuugcaccucaagauaaccuagcaagggagguauuucauacccauuauuaugugugagaauccugaggcuuaagagaguuuaacuuucccaaggucugccuaauaacuggcagagcuaggauugaacccagaucaaaaucaaaugaaggaaauaacccuauaaacaaauaaucacagagcuauccauguaaugaguacugagacugagacacauaacgauuugugugaguuagacaucaagaaaccugggcagucaucagagcucucuucauggagaaagcugauggcuuugagcucaauccuacaggacaaguaggaauuccuccauggucaguuuuccgcugugaugaguagauuaguaauagguggguuugauuaagcaauaaauuaagaaauuaugucaguaacuacugucagucaucaauuacauauugauuugcuuccuacauucaaggguauauuuuuaccuaagaauaucuauuagugucauuguauaguuaucaaacuaaacaaaauauuauuauucaauuaaauuuugucugugcaacuuuucuuuguuugaugucaaaugaaaggggaaaauuaugucccgugaugccauaggagcacaccacuuagugaagguuagguuuccagacaccccaaacaucuuagacauacccaggaacucauuagaaagcaggaaaggucucaauaccugauagcuuucucaaagcucaugcacuuaguccuaaaggcaggaauuaucugugagaugugacagccagcauucgagggaaacagcagaggacacgugcaagccgaacaggcuaagacuguuuagggccagcuuguccaaccugcagcccacagaccauauacagcccaggacagcuuugaauguagccuaacacaaauuuguaaacuuucuuaaaacguuaugagauguguguguguguuguuuguuuguuuguuuaaccuuaucaggggucaucaguguuaguguauuuuaugugugacccaagacaauucuuuuuccagugaggcccagggaagccaaaagauuggacacccccggcuuagaggaaggccaaguauucgugcauauuucaguaacucauggauguccucccuguauagaagcauagaacagagaaaauuggaagacagcaagcuuuugugcaauuugucauuuauuucauuuugucuuagucucaguguuuaaagagagguuuaguuauauggaaagcugacuuuugugaaacaccguauucccucaagauguuuggcaucugaaauauugauuuuuuuuuuuagguuuuacagggagaagggugcauugcauuaucagccuaacacuaggcacccuucacacccuuugaauauggugauugcucucugaacuacuuaugggcuuauacagaaagggaggaaacccagacgauaagucauguuuuuaaugcuguagauugcaauuccaaaugucugguccucugcccucaucugcuauuuaccuuauauguuucauacuugugguuuuuaauuugcaauucaauauaaauguuugauaaagauauuuuaauuugcucucugcuuuuuaguuagccuuagaauuaaaacaauuauagcuaaaccucugaaauaaaaaaaaauucagcagauuauggaagaucauaagaagguccuaauaaaauagacagagagugcauagaugguggugaugcugaugaagaauauggaagagaaggucauaguucucuauuuagcauuuuuggagcuuaaauacuuucauaggcauuacuucacucaauucucauaauaauccuuuuggagagauaacauuuauccauuuuaaaauauagaaacauucagaauuucagagguuuuccuguuuucaccaccaguaagcucagaacuacaacaaaaauuccuguuuuccaagugcgauggucucauuucuucuuagcugcccccuauuagugaaaaauaagucauagguaauguucuucucacuuaucucuaauuucagugaugauuaaucagcagcccacacuuagaugauacuaaucaaguuauuguuauaauggcaccaguuuguguaguuacugugcauaauugucugacauaggcuuugcacuggggagucagcaggcauaagaguagaaucuggaaucucuuugguccacugacuucucuccacaugcaauuccuucaucaaacuguggcuuaaaagagcuuucuaccucuauuauacgucuucccagguugagcugggaccagcaacugaggaaaccaguuuuaaaaacuaauaaacaaacaaaaaaccacuagcacuugcuuuaugauugacagaugauagagugaauaacucagcaauaagggccuuagucauggaccccaguuuuccagcuaagaaauugucauuucauauaauaguucaaagcugcuuggcuuccugguaggagauguggauaagcugaauguugcagcauuauucagcaugaugauuaucauggauuuacagcuguuucuugaacaaaccauauuacacacacucacagaauacacucuagaauaagaauauaaaacaccucuccccucccacuucccaauuuucuguuucuguaguaaugucaguugaaacugacauucacucugaguccauaucugauguguuccaacugauauccuuacuugcuuguccugucggcucuaagcuuuaaauuuggaagguuuucaaugacucuuguuggcaggaaaaaugaaugaggagguguagagagagacugcuauuacagccacauuucagccacguagacugucaauacuaaugaaugcccuugaggcagguacuguaaaugccguuaaguuggaguugagcugccuuucgaguuuggguccuuuggcagaacagacaucuccucucuaaauacuaaagacccuguuguagagcuaauuuuaucaguaucacauauuggaacaugcugguugcugauagauuggcuguuuggcuucagauuccuugauaugcugagaauguuacuuuaguuuuguuccugaguuauaaaaaugagauacuauaaauucauucauuaguucuccuucauucuuuuagcaucguaaagcuuauuguccuuucagcuaccuuauuaauauaguauaauuguuaauagcacccaaucuagaguuaaacagaccuggauucagauauugguuccaaccacuuauucaguauauguaaaucuuagcuuccuugucuguguaauggagaugauaaugggauauugaaccacauaagauuguugugagguuuaaauuagauaaugugaagaaagggaaaaaaaagaagcauagcgccuugcauagaaaacauuuuaaaaauacauuagcuauuguuaucaugcagaugauuaaaagaauauccuccuccagauagcagugagaguuuucuuaauauuagaaaaauuaauaauaagugcuuuggaaaauaaauaauuuguuuuucuugccucuauacauguggagaauagcagccacuuuccuuuucuucucuuuauguaguaauuauuguuacccguuacagucuuaugauuuuaaauaucuuacacuaguuguuaaucuuuuaacacccuggagacaaauguaaagggggaaaaacccagcuuuuagugagcugaagugaaaagugacccaaguuuaaucacaguaccucuuaacaaagagaaaaucauauuaaauuggguacuuaaaauuaggauauauaaaauaagggaaauacauauguuaucuccauugagacuugaggaugagguuguaaagaaauucaauuuaaauaauuuuauaaagaauaacugguaagggugggcacaguggcucaugcuuguaaucccagcacuuugcgaggcugaggcaggcagaucacgaggucaggagaucgagaccauccuggcuaacacagugaaaccucaucucuacuaaaaauacaaaaaauuagccagggugguggcgggcgccuguagucccagcuacuugggaggcugaggcaggagaauggugugaacccgggaggcggagcuugcagugagccgagaucgcacuacugcacugcagccugggcaacagagggagacucugucucaaagaauaacuaguaauggcaaguauugugaacagccuacaucucugauauacuuacgacucagggggauugagaaguauccauuaaaguagaagagaccacaguagggucacccauccccauagcuuugaaauccuaaauuuuuccuuaauuugguuagggaaagccaauguuauauuuuuuacagaguaagagcucaccagaggcugcugcaguauauauaauaaguaguuuggcuacuaagaucucuucugggguaaaagagaaaucuaaguucccuuagauuuuguaggaacaguagaaccuaauauuuguaucuuccuuugugguuuucaaauauguguuuugaguuuuaauccaguaaaccuuuuguuuuaguugugaauagcuuguguuuugggaaauguagauaguucuauauugaauuaaaucagucgcuuccuauuaucccagacuucaacuaacuuuggggccugugaccaacaacaccggaugaagugaggguuugugcuuuaucagcuaucagcugcuauuuacacaguucaucccuuuuaaaagaaugugaguuuccuucucaauaguccaugcuugucaacaguggaauuuuguguaaccgguuuucacucuagaaagcagucacuuaauguuuccuagaguauaauaucauauuauaaguucauuagcaaagugguugauacagaagaucaacaauuggccuucagcacaacuccauuuugucuaaaagaaacuucauauguuuugaaaugcuggaauaccacccagcuuugaauugcuacuaaagcagcucaaucuaaaacuauucuuuuauucuuuuuuugccauaaacgagcaucacagaaucaaauccauugagaagaaacugcuugcuuugccaacacaauuaguuucauaagaagccucugccuucagauuguucuucuccaaaguccacguuuguuggauggcugcaguuauuguuuaauuaauauuuuuuaagagccccccuucucccaagggccucuaagcagauuuagcaggcuuaaaaugacucuuccacaaggugauuucaaugccaucucacaaacaaaugaaauaguggcuuuucuacuuugggggcucgauuuuuuucucucucuuuuaguucucauaaaaccuguccacuagagagaguuuuucuucaggguuauccuaucuucucucuaaaaaagaugcuaucuugcuuaugaacgaaaagcccaugcaaccuauccagcuaugaaaagaagugagagaaaaaagucucagguuuucaccuaccagugugcaaagcaaaaggauucaaugauuauuauuaucuuuuaugguuuauuuuuauauuccuguuucuuuuuuugccauuagcuucuuugauaagugaauuuuaauggaaaagcuaauucagaucuucaaguuuaguggaugggugucacuccgcauaaacauucuauagagagaauugcaccucuuccuuuuaugggaucagauagcucagaccuucagcgucguaauuguuuggcacuuuuagugaugugggcccugauuaaaaagucauauugagcucagucuuuuaaagggaaggcagcuaaugugaugguugaaauuguaauaguacaggcagggaugcuauaacuauuuucuuuugucacagucuuccuugaaaagaguuuucacccaucuaaucaguguuuucuuucacaagagauacccauccuguauguaaauagaaguuggacugugcuugaccuccguucuucagccuuaaugucaaaaaccaauacacacaaagguagaaaugguuugaugcauauuagucuuugaagucaagacucuggucaccuuugguuuggcaugguguaggagaucauucucuugggagagaaaagcagaaauaacucuucuugcagcugauguuaaagaauuucauggggacaaaagaaacuuuacauaauucuuuccaauaacuuuuuuccuaauuuacauaauucuuuccaguaaguguuuuaaaaccugacuacuuuccaguguguaaguugagggcggaauugucaaaaaucuauucacuagguaaguuuuguuggccuuauagcuguggaaaacccagucuggggacucugaaggagaaaccuugcugugcuauuucagagcugccucuccccaaaggaauuucagaauauaagggacacuagaagacaugagguuugagaaaaugggucuucauguuauuugcugugguugcuguugaguuagacccugaguggaaugcauuguggugagccaccacccuaagcaucaguauucuuggcuauucucccuucaugugcauuuuggacuuaaaggugaaauuccaucuuuaacccccuugugguugucugaacaaugauuaaugaacuagaugugauucccugcagaccuuucaaaggguggaugaaggauggaauuucagccuuuuuuuuaaaccaggccuuuugcuuaauacugcuuuuaaaauuaauguccuccuuugaaugccaagaaaacaaaaggaauuucucaaaaguguaugcagcuugacacaauagaccuuaauuggugucaaggagauguuaggaugaaugggaaaaugcccaauaagacugaaaaguggaaccuuguuaugagcugucauuucaacguguauuuaaacuauagcaaaacugaaacauauuugccauauagaucauaaugacuccaaaggagccauuauacucuauuauguaauuacauaaucaaaccaugcauaguaaucagcuuuuggaauucaaugcuaaucaaacauaccuauaguauguguuuaagcgaaaauagagaacguuaauuugccauuagucagcuaaacaagaacguguauacagaauauucaugaauagcuuaauguugugucagaugauauuuuuuguuguguauucaggggaaaucaacaauuuuaauugaagaaaaauccagcacagaggaggauuacucuuaaacuugccauucaaaaauuugccucaccuguuacugauuauaaaauguuaaauuaaauaaaauauuuuuccuuuuauaagcucaagugacacaacaguaauuauauagcagaagauucuuuugagauccugaccaucuccaugccauaggauacaguguuauaaaugcuacauaaaauaaaacugucaaaacaacaacaacaaaagccuuugagcacauauugcuuuuguaauuagcaaugaaucaaagguguuaucuagaaagagccaagaauagaaauaucuugaugacuuggucagggggucuggcaucuacucguggcugggccucaugcuugucauaugauuucaggccuaucugcucccugggccuaaagugagagaguugaucuccaaauuucuuucuacucaguucuauugauucuggauuccauaggguucuauaaaaaacaaggugauacagaugaaguguuugggucaaugucacauauucuuguucacuccauuauuuguugaguugguuuaguuuauuuuaucucuaagccugugaacuguaugguuggcauucauaauuauuuucaccauuaaguagacagucuuuggagcagacaaucaacauauuugacuuaacuguuugguguaacaagacauggagaggaucaaaaagguuaagaggggcuuuguaaacagcagacagauugauugcuuuugauuuuagauaaauacuaaaguauucaugcagguugauauuugccugucucagaaauaaagaauugcauuugucuugaagaggucacacccuuaaccuuaaaucuacaguugaugggccccucucuuuggacccugguucucacugucucuugucugcacauuggaugccuaaaaauguuacuguaauauuuaaauagaacuaaauucuuucaucaaacgcuuucguggcuugaacuucgaauaauuuauuuucaaauuacuuuuacuguaauucuuauuaauucaaauagguuucugauuugauauaaaacucuguaaaugcagggaacaguuuaaugaauugaaagauaggauugagucuuuuaaaggaaauguacaaaauaugcugacaauaauugcuuagauagaaaucaaaucuuaauggcuuuguuaaugauuuguagugaacacuguguuuacguugacuugggggaacauacguaguuagaaagauuuuucccucuggguuucagcagaaucuuaauuuuuuucauucuuuuccugaacguacucaacucuguacuagcucucagaaacguuagcaggaauugcagugccucuacuagugaugguuuuauuucggguagggauuagagguucuucuuccaaguugggcccacccugaacaggguuguaaaaauaguauccaacagaaaugagcauaauugacaagucauuugaagcuucaagucagcgaaggcucacacaucuaaagaaaauaaguuuuccaaaacaugcuucuuugaaaauuuccaaccuaggaggguaggaaugaauaacccugagccuuucauuuguguaaaauuucaagaacuauaguagaguuuuuaaaguaguaacuuacuauauugauuagcagaauguuuuuuuuuuaacaaucaauaguuuugguuugacuccuauuuagacaauaugugcugauuuaauguuagguucagucuuccauagagcagaagguuuuccuaauaugauuaguuuuccuaauaugauuuugcuacaagggacuguauuugcccuuucucugggcaaacugucuucccugugaagagucgcuggugcuccuucucuaugucaguaacaguuuacguaguugccauaguauaaacucaauucuguuuuaacuaugacuugcccuuuuauuauagucuugacuagagagacucccccgguguaaaugaagugcuuuauugaugaacagccaggcagcgggggcgagagcuuguggugcuggcaaaaggccgccaugcacugguaauaaaggcuuucucuaggggcagagugccgagcacugaaagaaggaagcaguaguaaacaaggucuuuuacauucaggacaguuucucucucaucuuaaaguguguaauuguguucuggauaaaauauggaaauaaaaaaaaucagaaguugcucauaggcaaacaacccucuuuaaaaacaaguacauuuuccaaggcagagccaguaugaaccuuggcaucaaagccugaugcuggcugguaaagagugcaagcugugugggccggagaaucugauagaaccggguucaagcaucagcuuggccacuuagcugaaugacaucaggcaguuuauuuaaaucgcucugucucagguuuuucaucucuaaagcggggauacugaaaacuccaggaguuugagagagaaaaguauguaaagcauccugcacagugcccagcccuggauaaacauuuguucccuuccucaugucucauuuaagauuugccuugucaccucccuacgguggccauauuguugacugaauagauuccaauccaggcaaguguuuuauguaaugucacugaaauggaguuuauaacaaaaugagguuuuaggaaagcauuuguaaacuauguuaauugaagauugaauuaguaggggauuuaugugcccgcugcacccccaccccaacaacucugcuaucauggucauuacuaaucauaaaaauauauuuuaucuuucuuuagacaauaagcuuucucuucauugugaugagugcccuaacaacuucuaguuuacuacaggaagcuugauuguaagcgaaugggacucuccagugccauaguuuuauuuuuaggaaucgucuggcaaaucggggaguuauagggaauauaguugcugauacaaauaaaaauccaguuggauucugucuucuaaaccucacccauauacaccgauuagucuauaaaugccagauauuguuccacccuuaaaauaaaucaccuuccuguuaacagccuuauuuaauggcuacaguauguuguaccuauuugauuucuuuugcccagaacauguccuguuucugccuugacauuauaucugcuaauugaguuuuagaaaaucagaaagguuuuaaaaauggauucuugaagaaaggcaccaaaguugccuguuuguacccuucugcuacacaucaaauuguguuuuguagcuaccuaauugucaugauaucuauuucaaggggaaauuuaucaagucacagugcacucuucuguuuggaagaaauauuugaggaugugagcagaaauuauuuuuacauaaaggcuucaggcaguuaagaguacugacauacauaccguauuuucaucacugucauucacuuccuuugccucaaauaaauaggucauuauuauuccuuugcagccaucuuauggugccuuaaaguguggagcucuguguaacauaacugccguccagcugacccauauaauuuauuggugauauuuacagaaugacauccuugggccaccaccaucagacaaggcccuuugauaucuuucagcaaaauauuucaugaucacuuauaauuuuuuagcauuaguauuauaaccauguuaacauagcuaggaauuggcauuuucugagacacuggauuuuagguuagccuuagcaauuuuagaaaauaauacagucaugaugaugauaccaccauggguuugcagagcgcauuaugugccagagcacagcaagggcaaacauuugcagauggaaaaauuuuaccugaaugauucacucaguagugacacauuaaaauagucuggccuuauaguacucaauuauaagugauuaagaauguuucuagaaaacaaacaaaaccucacucuguuuuauuguugucauugcuuaaaagacaaaaucauggacaacaugccucuuuucccauccccuauauacauguucuguagccuuaauaugaguggaguauucuacucucagaauaugcuagccuuaggauuucaauaaagagcuaaaauuaaagcauacaguuauuuccacaggaacuauucuguuaaagcauaauugaauugcaacuggcuuuaagucccaguggcugcaagauaguagucaggauuuguaaggccuugguuuauguugaaaggauuaaugcccgucaccaggccuuuccacauguaccuuuuguaaacugaagauuauuuauguugcuaauauacuuccuuugauagaagaaaucccucccauaacccaguaagaccguguuugguauucuugucuacucaaagcaaguccuaugccuuaagacaguuauagcccuugaaucacacaauuaaauuuuuucuuaauuuucuuaguagaucgcgcauuaccugaggcugugagagugguagcuuuucuguacacacuuuugccagggccagcaaaaccaccuugaaaaccucacuugauugguagaaauuuucuucuccuuuuucuuuucuccaaucugggaauaaacuuucuccagcuggguucugaauucuguguuugucacaguaaugcacuaaggaaaaaauaagcaucuguucauuuuuuuuuuuuuuuuuuucugaucaccuuuucucuuuguuguuauucuguaacacuguucggcauacuaagccuccacugcuggaucaagcuuucgggaauuuacccucucacugcaagcccggugggccugcauucucacaccuggguuaauucccuggauccuagagcucgagguuggguuucauuuuggucugcuccucaagcaucagaaauuuuugucuaucuguggcucuaauaauuuuuuuuccuuauccuuuuaguuuccucuuuucuaauccucugccaggggcuggucuauuucuagguggauuuggcuuagagccaucuuagccaccccucucacacuuucccaguguguccuagcaaaggaaaaaaaaaaaaaaaggauccuucaacagaaauaugauagcagguagaaaccuuccauuuauucuaauugcaucucuauuuauacugucucaaauuuucuuuagaugaguauuuaucuuugaccuuuguuucuuuaugugggaacauuuuuuuaaggagcaaauaaucugccccgaguugguguaaaacagcugcauagggagguccuugagagcaggagccuuauucuuggauccacacuacucccaaugcauaauggcuuaauaaaucuuuguauuugaugucuagagaaaugaugacgaugaugaugauagcagcagcugccauuuauucacuuuuaugagaaacuagacacagugcuaaaugcuuuauauuuauuauccuuuuucauccccccaucagcccugugagauagcuuuuaauuacuauccccauucuucagaugggaaacuggcucagggacuuuaauuaauuuuccagagaucacacagcuaaaaagcagucucucucucuccccuucccaauugaccauuacaucuacugccuauaccacacuuuuuguucuguaaguagggauaagguaucgguuuucacccacguggcagcuucuuaaaggcuaggacaacauauacuucuguauccccuacuaugccaggugugacauugaacacuggagaauuacuucauccuuugguucugaguugaacucacuucuccuccuaccuguacgguggaucauuuaggacauuuaugagguggcccaggcugccgucacuaaucuuagaagcaacaaacuagggcagaucugaagauaauccuuauauaucagugaaucugaaagccucgacuuuuugacauguucugagggagauuuucuaaauggcuggcaggggguggggggugauuugcagauaggggugucaguucagagaugccuggggcuuugggugaaucaugaaggugugaguuucggagagcagaguaacaaacuccgaacccuaagccuucccaggauuucaucgagaucccaaagagucacucacucacacacgaugaacugccuauacauugggacugucaacaucaacuaacaagacgagauuauuuauugaacccuccuaccuacuucuauuaaguggcuccuugaguuucugugaggcugaccaaauagcuuagcucaagggcagguaagcuaaaguuggcugugucuaucuucccuacuccauuugugagagauucagcauucacaaaagcugguacucugaccuuuccaauaccuccucaauauacuacucaacuaguacaaaguacuagaggcugaaaccuuuuguaccacagcuuuugagaguaugaugauuccaggcuuaguuguauuuugucccuugaucugucuucgauuaacagacucguuuuguagacuacaaagaaagguauuagagccaugcuaaauguugcuacuuguguucauuuucuaauaugccuaguucccacuuuaauagaucccacugaucacauuuuaauugauggaaauuuuccucugaccuuuucuucccuuuuuuuaaggugaugggcagaaucuguuuacgaaagacgugacagugaucgagggagagguugcgaccaucaguugccaagucaauaagagugacgacucugugauucagcuacugaaucccaacaggcagaccauuuauuucagggacuucaggcguaaguuuccaucucuauaguuguagauggcaacuuuuuuaccuacauguugucuugauaaagagauugcuaaggccaccuuuuuuaaauuuaauguuagaugcuuaaaguuuagucaguucuuuagagggaagaagagacaggcaaucauaaucuuucuacuuaauagaaaccuugaauggccccuuuuaaaaguaaggcagucuuacuuugcaauagaaauugauuguaguaauucaaggugaauugcaaucgagucccaaauacuuagcugacacaaacaacucaacaggguaaggcaaggaaaauacagcauucugaaagguaaucccuuugguuugaagauugaaguuuccaaggcaauaaaugccuauaagcauaaaaccaagucuucucucaucauagccuuuggcauauagaaguguccacaugcugaaaucuuuccaaauguaauaucacaaaaaacaaaauugcaauggacuuguauagaauagaaaugguucauaucagugucagggcuuaguaagagcaagaaucaaaucuuuugaaaaaaaaaaaaaccaaaaacuguuauuggagagcaucggugccuaaccaaagcgaagcaugucucuucccagcugcuuguccccuuccuccccaauaccucagggucauucaugaccuguggaaaacguugauaaaccuaaggaacauuuaaaagguugaggaaagauaaaaggaaauaagccagcuucuuuucuuaaaguuaauuuuugucauauacuaaguuagucuuugccaaaauuaagaaaggauuuugaaagagaacauuugaacuaaauaagaggcccacauguaucaguuuugcagugauuuugauuuccugcuuaaugcuuaaucaguuucauacugugaagccaaauguacuuaggaaaccacaggaccaguuuaaggccuccguaggcucgaggucauccacuuuuggcagcuccaccucaaaucacgucaaauauguuaaggugcauccaaguugauuagguuuauuuugcuauuagauuauaaguuuuuaaaauaauuuuucauguugcuuuuguaauuaauaugaaggcuuuuuuaguucuguuucauaauuugaaacccuuguuuuuugaaggccuuacuuacaauuuuugaggcauuuuaaaaggcuguaggcccuagucccugaacuuccagugcccaaaggcuagggggcccuggcacucccugcuucaggggacucaugaccugcuuuuucccuuuguuuucuuuuugucuaucucuaguauaaaaccugaaaacauguaugaguaagugcugaaaacugacagcauuuggaauugugccaaguuagaagggugcguagcugggugugugugcauauauauauaugugugcauauauauauauaugcacacgcacacauacacacacacucacacauacacugauauguguaaguuuccuuuggacaagguuauuugucuacaugaaguuacugcaaacacccaaaauaguaagucaagaaguaucagauacagcaagauguaauaaauaauuaaggaaaauagacuguccguccaccuucucacaaucacuaacucucuguuuuguuucacagcuuugaaggacagcagguuucaguugcugaauuuuucuagcagugaacucaaaguaucauugacaaacgucucaauuucugaugaaggaagauacuuuugccagcucuauaccgaucccccacaggaaaguuacaccaccaucacaguccuggguaagaaacgcauguggggcuuacccggggaaauggaauagagauggcccuuuuacagcagcaaggaaaagguuaauggugaauucuccuguucaaacuuguuucaggaagaaucaccgcccaucuugcugaauuuuaaaaauagccuauuuuaccaaaugcuguaaggaauggcaaucagcagucuuuauagauuccaccugcucuuggguuucaacccucaagcuucagaagcaaagaucaagagaauuuagagcccucaaaugaaucacucaccacaugaaauguuauuacuucuaacuaccgggauuuuuuucuuccuugugugcaggagaaggggagaugggcuaccaaaucuauaccccauggcagagcucaguuaugaaauccacguaaugauuuuuccuucugaguuacauccucguuuuaauauuguugaucuccuuuucauuggcuugacuuacggccuuguuuauugcuuauacucuagauuaugcuguaaaaaaaucauacuccaugaacauauacuuugccacaaauugcagucauuggacauaaaagaguuaagagcacuuuaacugguaauaagcaaagaacuguugacgggcugcuagguacaccuccagugagcugagugucuucauuuaugaucaccagauugugaguuucagcaaaauccuaguagccagguuuccauguucaauuuuaauauagucagcagauauuucuauguugaagguggucugaauuagucaccuuuagacaagcuuacucuacugcauaacaccagcugauuuggauucuugaaacugaauuuucaaggacauacacuauagcaugaggcaagaucucugauuuacaccuucgggaagaugaugaaucaaagucuauuugaggcggcagacugcagcuuuucaguguaaugauaggaagauuaaagaggaaagauaaauaugaaggacauuuuugcuugguaugugugcacauauauguauuuauggauguacauauugagcugcugccucauuacuuuacuucaacacagcuguagaagggaaauuuuuuuuauucauuaagcuaaaacauaacccuaaugcucacauauauguuuuugacaagaggaguaucaauuuuagaaagauguguuuaaaaccaguccauacaauuucuaaucuggucuguguuuaaugauagauggcuuucacguauucauauuugucacuauugugguuuuacuccagauuagaccuguagaaauaguaagcaugggagguuuuagugggaugacuauuuugguauuuugcagauguaccaaauucgcaagcauaaauuugaaguuuucugucugucugcuuguaucagaguauuugaaaaugcucuuugcuuauuggaguaagucauuagcagcauagacuucaaauugacuauccacucauccacccuuugacucaucaucguuuauggcauuuccacaaaagugacagucauaaaauaaaaucuauuuauggcauuuugaauuuucagaguauuuuacuacauauaccuuuacguauuuauauguuguuuucacagaaguaaaaugauaauaacagauguuagacaucuugcccagguuacaaagcacucaguaagaaccaaaaaucuuagaauucagaauaaaucuuacaauucugucuuaaaauuacaaccuuugugucuuccagucuagguuguuuucaguuaaauaccgaaugcuuuuguuuuaaauuuuuuuuuuuccuaaaggcacacaucuuuuguuuucaggaguaugucuagccauuggcaagcaguuacuacugccugucauuuucuggugccugauacauuuauucucaaaacaacugcuuuggaucaguuuggcuccgaauacaccaugugcuugggagccagugugccagcacuagaauuuugagaggcauuaugccuguaauccuuuuggaggucugauuauucuagaaguaauagguuccuacuuguauuuuauagaaguauuaacuuaaauauacuugaaaguagcacuuucaaguauaaaaaguaguagauauucuuucuguagauauuauucauucacuuaauauucuuuccauuuaauuuacucuaggauuccuugacagaguaaaauuguugucaucaguguuugaguccuucauuuuccaaaaucugacaauuuccacugauacucguauauuccaacguuucucguaagguuuagaguuuucagauauuacaaugaaugaagaaugacaguagcaucuucguugcuaucuucaguucucugaaaaggacuccaugcguacuuacacagcugucaaacuucuugauagguugaagaugcucauuuuagugcaugugucuauuaguuauuugauacauucaguaaaaacuucagcauaauuauaagauauggaggcggguacuuguuaauguugucuaugcuauucuauaguuacuauuaugcucaugaucuuauccauguaaaaucugaagacucuccuaugauauuuuguaugcauuuguugccuuuaaggauauucauucauuccuuccacuugugacgauuuuguuucuuucuccagaacauaccguaggacucucuuuauacuacuauucauaagaggagaugaaugagacagagaauacacuucuuuaagauuaauauaguuacugguaauaguagcuaauauuaucacaguccuguccuucuaagauuaguguucguucuuaagauuccaggaacaggagaaccuaauuauuuuaaagggucuuagagugagauuucacauacuggaucagcuuuaagacuccucuuuuguuguaauuaaugugacucaucuugauauugcugauuuuuguuaaauguuguaggcguaauguuuauaauuagcacucuuauagauuugagguuagcugagaagaaccuugacauuucauuacuguuuucuaguauuucccucuaugugauuuucauucagguuuucaucuauaugcaccuccuuagaaauaucuuugguuauuuucauuaauggcugcaggcaguuuuuacuaaaugugccuguuuaguggaccaugcauaaguauauucucugguuagcagcaguuuuaauucauuuuucuuauaaauggauuuuuauacuuuacuaaccuuuuguauuagaguagacauugugaagcuaaaggaaaaacaggauagaauuaauagaccaaauaaguuuuaagauuuucuuguccaacccuuuuuuuuucagaaaagcagauuuaaaucaccucauuuauauuuuugaaagcuuucuugcucuuaaaaaaaaaaaacugagcaaagucagcuuuguaacauaucaauaaacuauuaugauucacaauaucagauuuuauuuuauaaaccaaacaacucccaguauacaugccuguuucuucuucuaaccuuagcuaagaucagaaauacuggucacaaucuugagaaaacuauuuaugggcuuggaaaaaaaaaucauucagugauuucacaggauggugaucucaacaaugaauaagcccuucauuuuucuacacugggcaaauuuuuuuuuuuuuuuuuuuuuuuuuuuuggagacggagucucccugugucgcccaggcuggagugcaauggcgugaucuugacucacuucaaccuccgccuccugaguucaagugauuuuccucccucagccugcugaguagcuggaacuacaagugcccgccaccucaccuggcuaauuuuuguauuuuugguagagacaggguuucaccauguuggccaggcuggucucaaacuccugaccccaggugauccacccaccucagccucccaaagugcuggcauuacaggcgugagccacuucaaaccugggcacauuuucuaaugcuucugaaguuuuccacauuuuuaccuuagccuuaaauuugaagaugaugucagcucuuugggcauauaauccuaggaacuagcacugguucaggacucacucugaagaguuacagaguagaauuuaucuguugcaguuguuuggauaaugccaaacaacaaauaauccagauggggaccuagcugccugucaggaucucagcccccaaacgaaaucuggaggagacauuggugaauuuuccucgauccuuaucuguaccugucccuuuucauuuccuuacuuuggaccagcagacguuauugauaauguggaaggaacacacccucaucuuuaugaaccaaauggaggcaauaaagacuuuccacugagaaauaucauugaagaugaacgagguagugaagguuaggagaagcuugggguaaacagagacaagggguuuccaggcucagccugaaaacucagagaauaaaggaaagguauccaggaacacaggaaacaaccaucugaguauguuugaggguaaauuccacuaagacucaacagagauacauagaggagucuuuuaacaacugcuggacugucgcaucaagaagauucccguguuuccacagagggagcaucaaaguguuucucccaaaguuauacagauaaagugggaucugaucugguccauucccuagggauuucccggguugccaguggcuuuagccauuugcccucuuugucacauacuaagagagccaccuuccuaaguuccuaucccaucaguuacauugcuccauuacaguucucauuaggaaccacugcauauuucaacaugaaaaauuauuuucaucacuccuauuuuuuccuggaccuugaaagguauuuuuuuuuuuuacuuucauuccuuccuuaguugagaagacacuccuauauuuguuacaccuuaguuguuuucauuuuuucuuauaccacucuuuaaggucuuauuuucuuuaggcuuuuccucugacauuugaucuaacaauagcauguaaaaaauauuccuauaauacugcacucagaaugcaguaguauuuauuaguccuaaacaucuagucucucuguguauccccuaucaaccaucuagguauguaugaugaaaaucuauaaccuacgugacugucaucuagcauggaugaacuaugugaaagauacagcuaguugaagucauuccauuucuuuuguuaaagccuuucugugucucauaaaaugcuagcagaugugaaacucuaaauuagauguuaaauuaucuuuuuguuuauuuuuucuuaaaauguagacuaggguaguucuuugccauguuuaacuacucauuugggccauaucauauuagcaacacauccauuugagcaauguuguuuuccuuguacacgggaaacaaagaagagggauccuuuggcucugcucauuacaccccccgccaccaccaccaccaaacacuaucuugcuaaggaaguaugugcaacaaaucauuuuacuuuuacuuuucuaucauucucuauaggaauuuucaacugcuccaauucaguguaaaagucuuccuuugggcagaauuuucacauuguggacuagaacaguuggaaaucccaaauacuugguuuaauaccauaauuuauugaagcaguaucagagauuuauuauucaacuugaucaucaggauggcauguuuauacauauuuaauuucuuguuucucuucugaguugagaaacuuauuaaucauaagucucggaacugucuuugcuuauucaugguggucaggacauauauucuuagauucacuguacuaaauucaguauucuuacugauuuuuauuucaacaggcucaguccugagguaagguugcauaugaaauuuuacugucaacucaguuucauaaaagauaacauauuuuaucaucaucaucauugucaccaucacuaucacuaucacacuacauacucuugauuugauagucaguacuuuaacuucccaauccguuauuuugaccauuuuaucacauauauguuuaauaugcuuacagaagggugguuguaauucugauauguaaaucuacuuauaagcacuuaagagucucuuucgucuuugguuuccaaaauuggagcacuggaauucagaauauggaaaauugcugcaaacuaauuggcauuucuuauauuacugcaucuucauauccaaaggacuuuauuacuacauuauccaucagagguuaugauuacauucuggaucucugugaauuauuugauuacauggaacugguuugagacaauuuuucugugcauuuuauggugagugauucuuuuaagggacucaaagauuuuuaucuuugcuccguugacuuuggaaucuuucauuugaagauugaaauucaagaguugaguucaaggagaaauacugcuuucugggguuuccugguaaggaugaucauuucaauagcauguacuccccuuuuauaucuacuuucugguuaauuuuugaaugacuggugacuaauaucuauauugauauaaugugcucagugauaagagugagacauugguuguuguuguuguuguuguuauuauuauuauuauuauuauuauuauugagacggaguuucgcucuuguugcccaggcuggcaugcaauggcacgaucucggcucacuguaaccuccgccucccagguucaagcgauucuccugccucagccucccaaguagcugggauuacaggcaugugccgccgugcccggauaauuuuguauuuuuaauagagaugggguuucuccauguuggucaggcugauaucaaacuccugaccucagguaaucugcccgccucggccucccaaaguucugggauuacaaaugugagccaucaugcccagccacacugguuauuuuauaacauaaauuuaggauagaaauucuaaauuaacugauuuugcauaacucacuuuauuugaugauuacuuuguauuucuuuuucgccucuugugaugauuuaaauucccaucaggaaugucuacuguuuuucuccuuuuugauagcaacaaugcaaaaaugcauucuguguuuauaaagcacauauguuuaauuuguagucccaccacguaaucugaugaucgauauccagaaagacacugcgguggaaggugaggagauugaagucaacugcacugcuauggccagcaagccagccacgacuaucaggugguucaaagggaacacagagcuaaaagguaagcugcagauugccacacacugaaguaguuagcugauucuagcagauaugccuuugugaaaaucauggagaaauacaaaacaugcccaugaaacaaaaguauucauuuagauaugguuuauaaucaguuacuaaauaugucugaggccaaagcauaaaagcauuuuauucuucuaauccauguccucauucugcuguuugaggguucauggugauagcugucgcucuacucagaugcccagaaagaacuaaaacuguaaacuagaacucuuuaggcuaggaaaaauuuucaugagggcugucuccugagcucaggcugucucugucuguaccuucaauucuaauugcuuuuacccugucuuuugcagagaccuagaggggaccagaagcccacauuuucaggguauacauuuaaaaaaauguuuaacagucuuucauaugguaaauuccaagucauucugacgucuauugcacuaucaccuguguugacuauaugcuuuccugcaagagugguugcacuaaguggacuaacaguuucaucuaaauugugaauuuacagggaccaccuuucuugugaaauuugugauucaguugcccaauucaccagucuguucuuaugcaggcugugauuuugugaugacaguacaaggcagcuccuucagccccauucugaucaucuuuaccucuguacugggccaucccggguucggguccuggauccucaaauaccuggcaccucagguguugcaucagauaaaggagacagccuauacccuauuugaccauuuuuugccaguuaucuuaaauuccgcauguauuucugcauugagauuccuuccuuuucaaaguuacccugcagguaguacccugcacaaaggucuuaggggcugaacuccucuaauuguuugacagaaaugcuaguggcaugcuucaguuuccucuaaaauaggguuaaucguauuacauacuuuauggaauuuuuaugaagaugaaaagagggaauaguuguaaaguauuuagcuaauacuugggccaaaguaagugcuguauaugugcuuguuaaauaaauaaagagcgugagaaaugaaagaaucagcccuuuuagaaagaggauauagaaaucuauaucuggaagcagauaaaucuauauauaacagcuuaaguuucaagaagcuuguucuguuuuaaucuccuacuuccuagguaugguuuuggaaggaaggaguuucucauuuccucucugcuuuucugucuaagugaauucagccauuaaauguguaccgauaaguacaaaacauuaaaagaaaguuaauggugugccauguuccugggagugcugaguucaggaagggacugccuuggccuauucauuccauccggaagccuccucccuccuuuucuggguguucuuggaugugucucccaucuggccccaagcccuguaucuuacuuugcucuagcccacugccacugcauuuuugaggucuuccaaaagucucagaguuuaaacauuucaauuacaauuucaauuauguaaauccauuuaguuacuuucucucuuaauuguugaugaugggaguaggcaaaggggguuguuuguaacucuacugcuuguugaauuacuuaggggauuuggauaauauccuagaauuucuaaauggcaugacagccuagucaauauuucaaguucagaugguuguaggggugaaaaacauuuuucuuuuucuccuccugaauaccuugagcagccagaugucagaauguuucaacuuucagcugucuuuuucugggagguuuuaagauagaaaaaccauacauaauauauuucaguaaaaauaguguaugguauuuggacuugaaauauaucuuaaauacuaugcugccugguugaaaagucauaaauuaaggaaauaaaaacuuuaucagguaacuauccacagguuacucucaucccaaguaacugccaucauauuuguuaaaauagcaauguugggguuagaggacagaggggaggacauaaaaacaaacugauggaaauucacccaacucuggugucuugguacauuuucuguuccccaggcaaaucggagguggaagaguggucagacauguacacugugaccagucagcugaugcugaaggugcacaaggaggacgauggggucccagugaucugccagguggagcacccugcggucacuggaaaccugcagacccagcgguaucuagaaguacagugugaguacccugguaucuuauucugagggcguagaguugcaguuacauagaaacucuucagaagccauuuauucaaugcauucauuuuauauaguauacauagaauucuuauuuuugcuagaaaaauaaaggauuauuuuauugaaauauuguacugccauauuacagagugccaaugaggauuugaaaaugcuacauugaacccaaagguaaaacugaaauaauaucaaucugcucuaacacgugacuuaauuaauuucuuugcauauagacugucaucauuucuaugccaacugcaaaaucuaggguaauuuucccccuuuuuuuaucccaucauaaguacugaaguuuuuauagaagggauuuuuuucccauuuacgucggcauuuuguuuuaaaugacauuccuccucuauuuuagcuuaaauuagagcaaugaguugaaaagucgacucuuugggaucauugccacaaucuugauggcuucaucaauaaaagcuagauuguagugagugagguuuucuccuuaccaugcccuguagacugaauauguuuuccucaucuucuccucuggacccuucugcuuaaaaggaaaaagucuuuuucugcacaaagccauucuuaugccaagguuguggcuaaguagccagcuucucacuuuguauuuggcuucugaaaaaucaaggugaucuuugaguaugcauacugaaauguuaccagaguuugguugggaugguagugauuggaugucugauaaaggaaaagcuuuacccuuugugaaucauuggauuaauuuccuagggcugccauaacaaauugucacaaacuugguagcuuaaaauagcagaaacuucuuuccuuacaacgcuuuaggccagaaguccaaaaucaagguuuuggcaggaccacacccccucccaccacaaagacuguagggauggaucguucauugauuuuuccagcucuaggagucccaggagcgccuuaacuuguggcuucaccacuccacucucugccuucaucgucacaugaccuuccccucuccucugugggucucucgucuguguguuuuucugaggacacuugucauuggauguagggcucacccagauaauccagaauggccucaucuugagauccuuaagcugauuucaucuguaaagacuuuuuuuccaaauucagcuacagucacagauuccaaggguuagaacauggacuuaucuuugggagccaccauucaacuccauacaagcccuauuauuugucuaaaugaucugagcaaaaugggaaggcaggaaaaguuauaaaaaguugcuucuaagaaaccaucccauuccaaccuuuucuuaacuccgugagcuuggcucaauuuaacauuacauaaugcaggguuuccucguuaauucauuuaaucugcuucaauaugggcaucaugcuuauaauuuucauaucacuaaaacuauugugguauaaugucccuauaaugggaaaacggaaaugaucagauauuaucuaaauuagcagauaguagauuucuugugacuuuguuaauauguaauucauuuaagcaaacuuaauauccauuaacuuuccuuguaggggcccauuagcuuuaauaauacauuagcuccuuuguacguccugaguagauauucacccaguuuccaccccuaaacucuuucaguauuuucccagaauaucuuuuaaauagaauauagucccacccaccuaccaaauuacccucacucccaaaugcaaaauauuucaagcgcuacaccuccuacuccuuggaaaacuugauaaugauccuuauaagccuugguuuccauaaucuguagauucuaagacaaggaauaaggcuccacaucugaauccauuugacuucaaucuaacaaaguacugcgagccuuuaauugcaggaaagugacucuaaugcccuccaaaaacaaggaugcaccaauugauacuuuaaacucuaauauggcaccuuuuugugggagacucuguuuuuuauccaagaaaaucauacaaauauuuuagccuuuauuccacuuuucagaauauacauaaggaaaaauauuuuuguauaaaggaaagcuaagauaauuacaaugcauuauauuaaccugaauggaacuucgcaucugguuugauaucuuaaguaaggcucucugugcucaagaaaguucacuacccuccacuccuagagcacuauugagaacuuugcagagucagccaggaauuccuuuuguagcuucuucaaacacaguuggaauucucuacaucauuuccuaccagcuuuacucuccuugaacacuagcagcuaugcaguaacaaaaaguuucauuccucaaaugccugaagcacucagucacugggcccugaagucugaucagucauugcccagugcuguugauggcucaacuccagugccccccacagccguccucucucugcagacaaguagcaccauauuuugaugaccaugaggaaagaagagacacucgaauacaugagauuccuagaauaauuuauucaguagccacucugcauggagguugaauuauuuuggaugccugugaggaguaacauugcaccuguauuuuaauguugacucaugccguugaagucagcaguucuuaaccuuuuggggaucauuggccccuuuaaaaacccuuugauagcuauagaccuggaaaagaugaauacaaucacauauucaccauauucuacuuacaaucuaaggaguccauuuaccccucaggguuuuccuaaauucaguuauuugaggaccacuuucacaaauuugccauguucaugcaucaucuguauuuuuaccugauuuagaauuuuucuuuaagucacuuuauugcuuuauccuaaccagggccuauguaaaaauaucuauuaaauuacacauuucauuuguuauauauagugucuaauaagcuuuaaaauaaauguacaacuaauauuuuucaauguccuuuccuuugucaccuaaaaagauuucuuauguucucggugagaaacaauagguuaucacuaggaaauacugaucccauucauggaccucagagucuacuccgaguaaauaaggcuaccuugggggcaaaucuaaucugauacuauugguauuaaauaugcucacuuguuuaagccuggcugauuuuacaccaugaagguuuauggaaaccucucuuuauccccaucuaagaugaauggauguuaaccaggacaugaauaggguuaaaugacagaucauggauuugaauucuacaucaaguaauuuuuaaaaaauacuauuaaaaaggaaaugaaauaaugaaaaccugcguuauaugucauuaaauaucuuacuuuaaguaagacagggaaaaaagagaggaaggauaaaaagaaaggaaguguugcaccucuguccuuaaaauggagugcuaccauauggcauagaagacaaggcuugagcugcaacuuggaauugcuuuugucuuguggauuuaaguccuaauuaauugaaccaggauuuugcaguguuuguuuguuaggacccuuauuugugauaccaggagaaauuguugugcccaauuaugugaaaaaucagccagauguguaugcugucauacuuuuaauaauccuuaaguuuuuggugaguacagauauuaauuguguaguaugcauugaagugauuaacaucaauguaauuuaucaucuggagauuucugaacauaaauaaaugaguuguuuuguucagcaagguguugaccccuucagaaucagugaauuaaagucccccccccuuuuuuauuauaaauaugaaaggcaccacaaucagccaaguguucaguuauuugauuuucuggggcauuagccgcucuuguuugugacauuucccuguugggugcucguuugcaagcucauuaauaagguuuucucauaggaacguugccgggaaugaagaacauacaguaggucucuuaguuuucuagcuuucauucugagacucagcaaggguacagcagcagcacacaguuaaauguuuaaaacagaaaauaauuaugcucccaagcuggaagagcucaaagcucucuuuccuuagauguuaugcagagaacaguuuugcuuuuuaauguuccgagcuguaugacccuaaaaucuuucagugcauuuuuuucuugcgaaugucuguacaggugguggugcccaaauuuacaacaugguugauuauagcagagugugauacaauuguagcacgguuaguagagcuucagaucugagggaauguacucuugucaaauaaaagccuguuuaaaugggaacaguucacugucugagcguuaagagaaaacugucuaaauagcaucaagguggcaacacauagcgacauaagcugggaauucaaagaaaagcugugacccucaguauggaauucagauugcuuugcacaagggaggaaagccuuccucuggacuggggugaauaugaagcucuugaauuacugcuguguggcuucugcuuucacccaucauagccuugcucuuuaaaauguuuggcaaaaauccucauuuuuugaggguuuuguguuugugcauauuuuaaaaaaagaaagaaaacucagagaugaguuuugaaaagaagaaugaaaacaaagacucuagaaaugggugcuugaaugccaugccugcucugauuaucaucugacaguuaauuguauacgugggcaucauuuucaaaaugaguuuuauugacugaauguagcuagguauuuuauaaauccauagcccuguucauccaagguccagagaaggguagauuuuuuuuuuucuuucauucccucaacuggaggaaaauugggcauugaggagaugaucaaaaccuguucuuuaucugugccaaaauaaauguuucucugguaucgauagugcccugcauugaaggagagaggaaaaccuggaaaucagaaaaucuuuccuauuuggaguggaggauaacacuuaguucccaagagcagcuucuaugucaaauccucucccucaucaauucuguuuccagguuguauucuucagagcauaauagcuggcguuuucagauuuggccuguuucucucugaucuccagucucucucucucucucucucucuuuuuuuuuuuuuuuuaaacggaauacgcucuuccucccacucucccuuuuauuuuuuuuuuaaagcagugaauugaguuucagggagguuauuuuaguauuuaugauuccuuaugagaaauaaucaaggaaugaagaaccccgauugaagcuaauuuuuuaaccuauuauuucuuuguguuaacacagaguaguguugguuccaaguuccugauauuauaaggacuauagauuguuagugauacaaucugcaguaccaaaagugucaagaggcugaguaaccaguauucaaaauacaaagagugaguguugggcaaauacaucgugagcaagacuggaauaacccuuaagggaaaagccuuugccuuuauaccugccuucugaaugcauacccugcagaaagaggccuguuuuacuaagaaccaccuccucucaucucacugaccuuaauguauuuguaaaagaugugucuguguggcuguggacauugaauacuuacauagugaaaccagucuucuaaugcacauacuucacuuaaugguuuuuaacucaagguuaaauuuugauuguguggaagguuaaauaguugugaagcuggcaucuaaaaaucuaaaaggaauggucaaacaacauccuuucugauuuccuguaagacaccacuuagagacacaucggaagugcuaaauaaauguauggugaaguggaaauauguaaagcagaacaccugggcugaaccucugauuugggcggcuggauugaccuuccaaaagaaaaacaaaauuauauucugugaugaggacuaacgggaacucgugaucugauuuuauuuauuuuuuaaucaguaguaaagguggaaggagaaguccaugccccaauguuucuucacuuucucauucacuuauuccuucauucauucauccagcaacuaugucuugaaugcuuacugugugccagucccuggcaccguucuaguuaccaagacuucaagaaacagaacaaaacaaaacaaaaaaaccccucucuuguuacagagggaagauucuuguacagaaaaucuugcuauagggauuuucuugcccaguguuugcuuacaaaugaugagaauugcuuccaagacauggaagaauauucugugaguauguacccccauuuaaaaagcagugggaacaaagcuuucugccaccacaccaugggaucaaauuugauucuuuuuuguaaacaguaauucuaauacccacaaaccuaccugaaaguugcagcaagagaagacugcauucuacugugguauuggucuuacgucagucccaccagauuugacucaucccacucacaaucguucagcccucuucaggaagcccaguuucaguacuaugagucauaacaacagauguaacagcaggagguucuucaccuugcaaacaaacaaaauaaacggcagugaaaauuauucaugaauguauuaugacaauagaaagcaaauauuuugcaagauguucucuuuaacuccucugagagcucugugugacuccguucauucaccaaucccagucaccuggcauugcuagacauugcccuccuuuaguugcaaagcuguccucccccaacaauuuagacagccauauuguagggguugauucuugcuuugagcucaaacagcuucuaacacucaccaaaucucagguuaaucuuugcauugucguucuacuccaaacuccaauaauccuccaugauugacaaagacucuucagucaaugcuuccucacuugaaugcacaggggcugacccagacccgcuacccagacauucugauaucaucugugcucaugcugcccuugaguucucccugguaggacuugaaacaauuagcacuugauccacaagcaucaaauccccauacuccuugguguuucagaauauugggugaaaucuaaguaagaaacaugaagaagagccugugucccaaaugcaguugcagaaacagauuugcacucaagccccuggaccuaguugcauugagcacaucaaagaaaauaugacaccugcauuuccugauuuagaaauucuuaggaagagagggaagguuguggggacuccagggauaauaggucucccgcuggcaugucuccugccaggguaugaggaugccuuuuccacugacucagcucugcuccucucugcuacccuggaagggugacaucccagucaugaagaaacugcaaaguaccuuuuucuaaauaaaggaaugcaaagaccugauacguuaguguuuggaccuacagaggagacugugucuuuucauuuacauaggaaacugaaauacagguucagaaucuugaguuucaucuucugaaaagaucacagaauguggugcaaggucagacuggcaugaaaucaauuguaaucugccagcaacccauuccaaccucuuuaagaguuuccuuuuauauauuuuuucccuuuauagagagagcaaaguacauuuaaagaaagucucaucaaaucagaaugucuuucuaauauuauuuuuuuaauugguugcuacuguagugugaccuaaagccuccugguguuuaacccucugugcaacuuugacuaaugaacaaauuugucugcuauagcagucuugcuaaaugucuuuuacaggguuuaaaaaaauucacaguguauuaugaaaaccucagaucccucgaccuaauugauuggcuguugaugaugccaugucuauaacuguaauguucuuuaaguguacagaccuaacuauuuuucuuauuuuuauauagcaguuccauuuuauaaugacauuaagccauucugagugauacauuucugggcaguuauugcacuuggguagaaaguaucgucuggcuuuuggccucaugccuuacaacaccaaccgaggcguaaaaugaucccccagaaaauguacuaggcuuuaccucauuacuuaaaaauaaaucuuggaggcugguucuguuucagaaaagguuugguggguuauaacauuugauuuaugaacauaauuaaaauauaaaugaugagcucugggcuauucaaucagccaucuggauuguuugguauuuugacauauucauaucguaguuaggcucuucaauggaaaauuuaaugucccuuaguucuagaggugccaguggaaucccaggguuucuauuccaccuguugaaaacgcuuaaguuucucuuucaggacaaaggaaggggaacagaauuuauuuuuaaguuuccaucacccagggauagaucucggcacauagaccuucuauaauauuugauuccuaggcugggcgagaggauagcucaucugcccguggucagauaauaugccuauaaauacugcaugugucaacagaggggaacauuuuucuguauaaugcaggcaagacuaacgcuuaccuuuucagccagcuauuacgguaacuguggcagcuguagccauaaguagauaguagauguuucuccagaacuuaaagaguaaauugggaaaaucaguuaucaaaacugaagguguauuuuuugugauuuaguaaaugguuuuuaaaauaaauuuuggguauaacaaauccuuagcuuguucuucccaauuuaugugaauaauuggcaacugauaaacagcucauuaggaacauaaaaaagcauuuaacuaaaacucagugguacugaagaagcaggguggauuaaguuuuucaacacugucuuuauuauugauggaaguugagcauguaaaauccuuagugcacuaugcugaaaaauaugcccucucuguuugcuuguaaauuacauuaaggaaaaaagaagaaaaacaaaauccuuccacauaggccagcaagcauucugcuucuucuuaauuaauggccaaagucagcagugcaugaaaaacguagccuuucuguagaucagagauuaaccuauaagcagauguuacauuucagcccaaauuuugggcuuuaaauuuagccucacccagaagguucauggguaagaaugauagagguccccuaacuaggaacucuaguaagugcugcuguuucuggguaugaacugugagguagcaggucuucuguuuucuguguguccagugucauaaccuucuucuuucauuuuuuuuguaucuuuuuuaaaaacuaaacuucacuaacuaguguguguguguuacacgacuacaaacaauaaacccacaccugaugcccagcaguuguaguuagccuaauauguggccucugucucugaaagggggugcccaggagcucuugagccacccagugcugguucaaggucauccuguuuauccuuuacaagcauuucugcuuuucuuuaaugacuaccuucccgacccaguuaucaguaucuggaaaccucaacaccauuuugcucuuaaacaguuucuuugccaacguguccaagaauagaacuguguaacuugcaagggucagcuggagcuucugggcuuguuaacuuuacguucucuggcaagagacuuagcuucucagaaagcacuaccaauucucaguaugcagugcacacuggugggugaacaagggggcucucuuaaaagguuuugaaugccauguaauuuuuagagacaugagagaaagauuugugauaggaaagagacuauaagaaugcaucuagaaagcagcuaucucuagugaggacuuccuugugcagcuuauauagcuguguacaagaugagauugguugagccuugccguaauauuucuaucuucucccuuauuccauaggaugaauguuaaugagcuaaccacagcuuguaaaaggccaaggggcuguuguuuaggugguaugauugucugagaaaguaaaacuaugguaauuauuuugaccuuucagccaaccgaugucuugcccucucacauuuauuacucuuggguacauuuccaaaaauaugcauuuacagagccacagaauuaaaugagaaaaccgauuuagggauuaauagcuuguuaguucagcacugaaaaaaacgaucuccuaauuacauucagauuuuauuuguuaauguauuuguauguguaucuauguuaauuccaacuucuguagcuucccucccuauucccugaaccucccauuauucagcucucauagccauauccccacacugacaaauacaguuuuaaguagcugguggaaaugagaauacuuauaucuccuuccuaaguaccucacugcauuaggaagcuauaccuggcuuuaauuauggauugccauuggaaaugcacuuauggaucagaaaucuaucccaacauacacuuauggggcugucucucucucugugaucuuggaugagcuacuucaaucuguggguaccagaguucccaucccuaaaacuaggcuuauucuacccccaaugaugguuccuaggggaguagaugcugaguaaaugucaguauuuuuucuuuuuaauguuuacacugagaugucagaguuuucacugggagggcuuccaaaauaucccaguuguuuuuucuuaaagucauucagucugccuuucucauuugaaaacaagaacauagaagaggcaaauuuauuaacaugcagugucacaacauauugucacauaguaauauaugauauaugauaaaauguaucaauucugagcaccacagauaucuauggcuucaccucagcaugaaggcaaaugaguuuccuuuagcuugagugaguuuggagauaaacuucaguguaacaaaauguauuucacaggaaauguuugauguggcgcaguuggcuuaugaaucucuuaucuauuugcgguucacuccuuagaguuauuagucaauuuaauuugagcaaaugccaggauuaccaacuaauuagaaggguguuacugaaggcaucggaugggagagaguaagugcugguacugugguuuugaggcagugugugagucugauuuugccugaugauaucauuugcuaaacauuauacuuuguguuuuugucacacagauaagccucaagugcacauucagaugacuuauccucuacaaggcuuaacccgggaaggggacgcgcuugaguuaacaugugaagccaucgggaagccccaguaaguucugaaggccaaaguuggcagagggucaugcgcaguaaaugucacaacacagacaugugcauucaccaguccuuggccugucaccugucuccugcugcaaaggauggaugguuuuucaggaacuaaagaauauucagugagaguggaaauaaauauccauaguucuuaauggucaggacugggagaaaaauuaaaugcccgcuaagauugaaaucucagcuaauucuauuuuauuauuaucaacaugauugucaggacuauuuucucucacacacaaaaaaauaauccuaauaaauuauuggugucccuacaaucuaaugauauaucugccaccuuuuguguuaaugucuaagcugcuagaaagaugguuuuaagacuuacauuaagcugcuauguuuagggccagcuguaggcaaaugaauuugcccuaccuuuaauuuugcaucuucuucccucaaagaaaagugucauucauacuugacucccagaaauauuuuuguuaguaaggaaaagcucaggaacuuuucuuaaggaggauauauaugccacuucauaagagaaaaagaagaaacaacuaagacucuuauuuuauugaaaguauaaaggagccacuugaguugcccugugaaaugauccaaagugaauuugaggaacuacauauaucaucacuaauacaagaaaaaaagccacacagugguaccauuuuaacuauuauucaguuuacuuacugggcaggggacacuucuuuaguguuucuaguaaagauuguuuuuaacuguuccuuagugggggaaagaaaaaaacaaguugaggauucaugaaauggaauaauaggucaauguugggauuaaggacgcucaaacuuuagugguacccaacaaaaaacagcauugagcucccuuugcuguccccguaguaugauuuuguuuuuucccucaaagaguuuugcuagccagcgucaucacaguuuucauauaaagaauucagagcaucuuaacaaagcuuccccagaaaucucuggaaagaagccucccuacuuuaacuaaggaaugaucuaugacaagagaccagaaagccaaagggggcucugccugcuguugguucucucuucucauuucaacccucccuaucuuugcacuuaccucuccaugugcuggaauuuccuucccucugugcuaaccauguggaguuuuaaaugaccuuuaggagcuggaaaguggucuugguucuguuucacuuucccucugguguuuccaaguuauuugguuuugaaugcuucgagcuucagcagagugaucuuuuucucguuugagcacugccaaagauucagaucuuucuuuuuguaaacaguuugaauuauucccuaauuagcagcuuucuuccagaauaauccaauggaguaagaaaaaaaaauucucagaggccucuugccgcuugcaauacccgugcucggccacauuaaccacaguuacagucuauggcuugcuaaccuauacuuuguuuuuguauuuuuccccugaagaagguacuucguucaauugaaugugccacggggacaguaaauuacauguuuccuucaggacauuuaugccagagaagggauuuguuuguuccuuucaaauaggaaccaguauaugguugugugagcaagcucacauuacucuacugcuaccccuucuagcauguuacuuauuuauuuucucaagaaauugcauacaauaaaaaugguaauuuaacuugccauuaaauguugugaagauucucagcaguuaccccuacugauuguuucagcugucaagcagcaggacauuacgucugauugccaggcaggcccauuugccauugccuacaaggaggacauaugcaguacuaauuuuuaaauaauuuacuggguugugaugacaaacccauguguaauuaaagaaaaauuguaacuucacaucccauuugaaaauuggaaugcuacuugacagggcuaacuugaggauccguucaucauuaagcaugggucucuugucgugucgcugcuccuagaggcagcuguaggaacuggaaggaagucacuugugugcuggaucucuguuguccuuccuucaaaaugaaaguuuucaggcacaauucuaaauguggccucaacuucauaggagguugagggaagugccuugaagaauggaaguuuucaaaagauacuugguguguaugcauuuuuagcuuuggcgaaucuuaugaaauuugcuuuuuccugauggauacaaauguggcacuuuaaaucacuaaaacaaacuugucucugaugagcaaaugcccugggcccuaagggauccauguggaaugcaugccauggugauuagccugagagcccuacccacgagcuuggggagcugcaggugcacacacagggaaaguucucacaauaugcaggccuuggagagccaguaaagaaggcaauuugccaaggaacagauagacaugguggacuagggcaucagagacagggguggcauucuggguagggggaugcagguuauggggagggguuaaagggaagaggaaaugauuacaucuuuccagaaucaaaggugguuuuucaaacagaggcccaagaaaagcacuauucagauauaaaaguccauuccuuuuggugaaacucaaaauccaucuaaauaucacaagaggcuucuaaacaagucuugguguguuaguaaccaucagaugaaugcauguaucacuagccaagaacuugauuucuuuccuaauuaaugagauguuaacaaugggugaggucuguccugccugaguuggugugaaaccacacagcggggcauaaaaauaggcacacuguuuuauuuguugauuugucgaacaugaauuggaaauaaugagacuccugcuuguggucuguucaaaguuuuucaacaccugaucguguuuaaaagaaaaaaauuguauaccaaacagauuuuuggagacuucacaguuguaauucugugaacuuaaaauaucuccaguagguccucauuaauugugucacccugcaugugggugagcaguuugaugcaauggggaaugauaaugugacuugucuuccuccccuucccccugcaggccugugaugguaacuugggugagagucgaugaugaaaugccucaacacgccguacugucugggcccaaccuguucaucaauaaccuaaacaaaacagauaaugguacauaccgcugugaagcuucaaacauaguggggaaagcucacucggauuauaugcuguauguauacgguacgugagaagauaaaaugcucuucuacuagagucagucacauggagcugcuacuugugauuuacucucaaagcuuuuggucaaguugaaaaucaaaaaccaguugguuuccuucuagaacuuaaagaagccuggccugagguggacccuagugucuccaccugggauagugacuuuucuucucucccucuaaugguggguguuucuacuagaucacagucuuuggucaugcugagaaggaaagcuguguccucaggcacaagccauggagauuacguuagaaguaaugacugaaacauucagccuuaccaauuagcagcuuuucagcucagaaaguuuauucccagugguauuuuacuaugauaccugggcuagcuuucuccugcuuugaugagcagaacuauucuauuuucagcaugaagcuauuaauuccaaaagauguuguaagccaguaaauacucagaacaaauacaaggucccuuguagcuacaugaaccaccuguagcuacugcuucagaacaaaagcuuuuuuaaaaaaugugucuguuuuuuuaauaucauuuuacaggauuauuaaaacaucaugaauuuuauucucuagucaacagauauuuauugagcaucuacuacauuucaggcaucuuaaacuuacuuccuguuuauaacuuacuguugauuuugcacauggugaauauuuucuauuuaguugagaugugcaccuccucucuaguuuuauaauaucaaauuaagucucuucuguucaauugaagccucauaugccaaaaaauagccaugaacugacaugacaaagaaugaguaaccagaggcaucggcauuucaauguguuauaaauauuugaaugugugugugugaaggggguauuuuuuucuugauguuaccaguguaaauaauccaaauauaaguauauaugaauaaauguuuagauacacauaaauuauaccuuugaaauauccacaccacagugucuuagaaccaggguacuuugcuuaugaagaaaauaggaguggcagucuuuuuaaucaaauagaagcaugcuuuacaccauaucugcauggauauuaaaauauaauccuuagccuauaccugagguuuuuuuccuagcauaaugcaaaauuaaaagaucacaucuaaucaccuuauuuguagacuucugaaguauguuuuaucuuuacgcacuaccaauguuguccgugguuguauuaugucuguucacacauaauaacauuaauucucccaguaguuaaggaaauccaugugaagcaaacagcuuuucuacauaggugagaggggacacagcauggcccguuuucagcuggcgauaugcagagccaccucuuuccacagacugcucggcgggggugaaaaguacauuccucccuuuuucugcaugugcucucuucacacaagggccugcgccucaugggaguccccgacauugcuguugcccggguuuacuggcuuucaguccagcucuuuacaaacugcagguuauaaaaagcagugacaaauuuccauuagucuguuaugugcauccuugauucagaacacuaaguuaucuggauaaacaguuuugauuuauuguacuuacugccccuacauuucaagagaagaaacauuuuguggguuugauggacagauauauuugaauaauuuuggauaguaguuuauagcuagcauuuauuuagugcucacuuuauuccaugcccuaugguaacgauuuuccaagcauggucuccuuuaaucuccacaauaacaccaggaggcaggcauuaucacgaucccauuuuacagaugauaaacugaaguucagaaagguuguacaguuuuccccaacuucaccagguuucuaaauguguuuuagaaccaaaauacuuuggcucuaaaguccacaacaaaguaugucuuucuuuguauauucucuuauucucacugcuuuccaguagaacaauccccuucaauaugagaugauccuuuuagaauuaacugucugggccagagugcauuaucugaaaaccaagaaauauagggauccaccuguuaaaggcagacacagcuacauacacaugucucccuaauccaagaugguacaccuauccuugucuagggauuugcuagaucuguaauauacuaccuaucuccccuaaucaguccuaguaacaauacuugggaugacagauuagaauauuagccuaagguauuacuagucuacuaacaaaauacucuagcaguuugggaagguguugaguagauuuucuuuccaaagcugauuuguuguauuacuaccauaauuuuggaaguauuuuaugaacuaaaaguuagcaagcccccauaaaguuuaacucucuagaagcaacuucuacacaugaagaaucuagcugguuagugccugagccccaacugauuuuauucuuuuagccucuacaugucaagcacagcucauuaacuccaacucuguacuuucuuaagugguggccucacauugcucuuauugcuagaaaugaucuaagcacugaaguuauuuuaccuguuaaaggaaucuaauucuuucaggucacuuuagccagaugugaaggacaacaguugccccagucgugauaaagauaauugaaagugugugauuugcacaaaaugggagggacugaugaccuuucucugaagucugugucuucauuagucugguccaccccuugguucauaaucauauuuucaaaucaccuucagaucuacucuuauuguauuguggacaucacacacuuuaugucaacacuuuuagaauaggugcagaaauaggauuauaggcugggcgugguggcucacgccuguaaucucagcacuuugggaggccgagguggguggaucacaaggucaggaguuugagaccagccuggccaauauggugaaaccccgucucuacuaaaaaaaaaaaaaaaauacaaaaauuagcugggugugguggcgcaugccuguagucccagcuacucgggaggcugaggcagaagaauugcuugaacccgggaagcggagauugcagugagcugagaucaugccacugcacuccagccugggcgacaaagcaagacuccgucuaaaaaaaaaaaaaaaaaaaaaaagaaauaggauuauaguauaucaggggaaaucucccaggaacaaauguuccuuuucaguaguagauauaguaauugaagcaaaacagaaaaaucacauuaacugacccugugcugggcagcaggcaccucucuggauauaguuuaguuguguaguggagggagcgggacgucuuuagugcugggcucaggggucagugcacuugguucauuuauaucuaugcugacaccugcagcagguguguaggugcauccaaaugaguuuccaggucacaaaaugcuucccuaccuguggccuccauaaaaagugugaaggagcaagacugaacacauggccugaaucaccguauuucucauucugccuuucuuuuaaaaagguaguuuaaaaucacuaacuuaaccauuuuuaccucuuggaggagaaugagauuuuuuuuaaacgacauccuuuuuuggacucacgugaggcugcuuuaaaugaaaguguaaacugcuuguauccccaucuuaaaggaacggagccucccauugaacagaacaguugauucuucucuguuaauuucauccaaguguguuugugugagagaagcaauuugugaggaaaauuaaaagcucagauuguugaucgaugguagauaucauuuuaaguagacuuugcaaccaagcaccaaaauaauauuucuauaaacuuuugggaaguugcaccaaacccaauaaaggugcaguauauaauuaaaguuuugauguauuaauuagacaaucugagagcucacuugaagauaaaaggacaccagaugugucagggagaaaaaguugacaugcuuuagauaaaauuuaaaaucaaaagcuuucaaaucgucuuaugcucuauuauagcagaaugauugcuuaguucaaagucuugcugacaauuuaacacauucaguuugaucauuugggcuuagaauuuuuuuuucucuuucauauuugccccucccuugucuccaaauaauuuuugagaugauagaagaauauacaguauaucaaauaucugacagaggguucccuaucagguuccuggcuuugaaggucgagucucauuuauauuuaguucucuuguuuacaagauggaaaacguucuuucaguuuuaucacuguagucuacuuaggucaagcuuuuaauaugagcaaaggcaacuuauuaauauuuauaaguuguaaaauuuauugacuuuuaaagaauaaaaucucaguaaaaucucacaugccuggaacuugauauuuaguggugacauucucucuucuuuguauuuauuaugaguagagaaguaguuuuacuuccugcuggguuguauugauggagaauaaugaaguuaacagucacagagagcaagugugcaggggcacgcucauccuuggcugauaugagcccccuaauagagcagcaccaccuccuccuccuccuuccugccaucuguaaaagcugaaacgaaaugacaaccauuguacccucuugguacugaguugauuuaaccucaccuuugaaaucugguagggaagaggggugucguauguuuugauuuuuccuccccucucuucacaucuccucaucccuaauucacuucauuaaugaaaauucucuuuucuucuuuucucagcucuuccaacuaaggcuuugggauauaauuacaagacauaaaucuugcagggaaagaacuuuugguuuuaaagggggaagccaucaaacaaacaucucaauguccucaugccuuuguuuugucauuacuggucauuguuguguucagcauuguggguuugauuuuccuuuuuuuuucuauccagauccccccacaacuaucccuccucccacaacaaccaccaccaccaccaccaccaccaccaccaccauccuuaccaucaucacagguaugguaucuucauuaccauugaaaauguccugaauguauauugucuuucugguauguauaaaaagaagccgaaaaguucccuuuaaauccuuggaauuuaaucguuccuuuauuuuggaacuccaacgacauuagauacuauguucuuaaguugaaucuuaaggaccucagaaacaucccagcauuuaacaguacgucagauauuuugcagcuuaugcauaaaagaauucuuuuuuaagcaucacuauugaaagcaaaaugcuagggaaaauggcagcuggcuacuagagaacacgccuauagcuucugcuuagacauguuugaugaaaugguaaguacuguggcuuucaaucuugucucugucuuaguuucaucucaguccauguaagggaaaauauacacaccuaacuucaaugugccuauuugggccaugcuacuaaaugcauagucauccuuccugcuccagagaguacccgcugacaagugauacuaccuguuuguguugccuagguagucacaagagaucagagggagucacugucuuuuccaugcugagcacucaugugccccucccugcccucggucacauauuggaagaguggaagaggcagccacugugguucuaacucugcggcuuuaucuuuuuggacugucugaaacucuuauucagcaugaguuuuacugucucuuguuucugucacugagggagguggcaugccauccagcccuuccuggcauccaguggcucucucauacugcuugauguggcuugucugggagccaugggguuucuucugccuaccuaaguaggaaagcuucuggccacacuauguccacuugacaugaaggauuucccuagauaaggccuucccaaccuguguuuacagggacuuaacacaaaaacaugugaaaguaauuauucugugagaaaaaaauaucucuugaaagaguaacuuuuccgcugcauuuuguuagcuggugagacugcaagguaucugaaccgugugcccugguacccaccccugucucuggacuucuuuaugaacacugaguauuugacuccccacccuucauggucagcuccuuuuaacacccuagauaucauugcuguccuuuucauugacaugcuagagacauuuccaauuuucaugggagucaguaagauagagaugaugaaaauucagaguguucaaagaaagaggaggccucaucaguugauagaauauacaacagauugucuaaucucaguuuucuucacuuuucuacccauuacaguggaaaaaagaacccuuaaggaagccagugcuucucaacauugguuacaaaaccaucagugccagcacuuaauuuaaaaucuucugaaaauccaucaguugguuuucaugucucacucuaaacucagcuccaaccaggcugcuuccuagauucuugucuguguguguuucuguuuuggcucuuuguuacuuccuucuguaaacuuaaguaaacucaguuuguugaccuagugaauugauucuuuccauuuucuauacuauucaccagcauaucaaagaugcuucuuccuaacucugauuuccagaguaacugugcuaucagcuuuucauacuaagaacuagguuuuuaccuuuucacauuucuugccugcuacccaguucguaagccaaauuagacucguacucuugugaagugcccuuuagauacuaguguaaaauauacugcguaauucuccauugcccuacauauauuaacccuuuaagaaaauauaucaccagucuauuuuaucuucgcagaacuugcccagguaugagccagcauuuauuaccacucauucuagaaggugccaguuagguagcuauccagguuuacauuuuaaggcagucgagaccuuauucacgugguauauaaacaaccacauuucucuuuuauauggaacaacacuuuucauuugcggcuggccuucucacuagcuuaugcuuuuuuuuuuuaagaccuuucuuagcacucgcugaacuccucccccucacaaucaaucucagcaacucagcagagucgcuucaguucacagcucuuaauccuucacuccagacuaaagcuaaucuuauguccucaaacagcuacaacucacuguuaucacaguuccgacugcagagacuccauuuaagaggaaauuuaaaaaauaaacaaugcucuauuucuguccacaucaaagguaccucuaacagaaacuugucuuugcuucugucucucugcuacuggacucucagcucaagguaauguaagaugaucucauagaugcacuuuagccucuugauguuagcaguugaguccucccugcgcacaaaauacauuugugguaaugaaugcccagaaucucacuggcacacccaagaguaguuaaacuaaaauugcuacuaacacaacauuguagaauucguugccuuaauggaugugaucuucuaggcuuacugugucuuaacaagcagucuuauauauauuuaucuugcccagaaaguacacuuguagaauuuaacauuugcuccuuucuccaaacagauuaaagguuaugcagcugaaugauucugugucccauuuuaaagguccaggcuauccccuagauuuagauuaguuccuaaaaaaucuuccagucugaauccugacaaauggauagcuaaauuaauuuccacuccucuucucucuugcacuguuugguacauuacagccaccauuagccuuaaaagcugcagcagccaaauucggugacaguaacauaaagccugagcuuaaaaaaaaaaaaaaaaaaaaaaaaaaaaaaagaaguccacagucaucuauuucuuuucugccagucaaaugcaauaacugaaacccauucccuaggucaggguuucauuacaagaaaaauguacacaugcaauagaaaaauauuuuuaaacucgagaagucauaguugauuucugauuucucugaaaggaaguguuccaguguuaucuuuuaucuuccguaaccaggauaaucaaauuguuccccuuguuaggaaggcagacugacauucuguucugagucgccugacuuccuugaaacauguuaaagcuucaucguggagacccuucagagagaaaaauuauaagccaaaucggacucugcuuugcccacccagaaucauaccccucaugggugggagcacagggcguuuucugccuccugcuuacccuacacggagcaggucuggagaguuacacgugaaggcacacaucuaaauguggccuuaucuagggagaaauuuuuguagucucuaaaguacugaaaggaauacaaacagucccugauuuaugaugguucaucuuacaauuuuuugacuuuaggaugguccaaaagcaauacguauucaacagaaaccguacccauacagccuuucacuuucaguacaguauucaauaaauuccauaagaucuucaacaccuuauaaaauaggcuuuguguuagaugguuuuacccaacuauaggcuaauguaaguguccugugcauguuuaagggaggcuaugcuaagcugugauguuugguagguuaggugucucagauggauuuccagcuuacaauguuuucaacuuagggugcguugauugggacauagccccaucgaaagucaaggagcaucuguauuugaugucaacuugccguaucaacuuguuguggcuuuaaaaccauuaagccauuauaguaccauuaaauuuuuuuuccaacuauaaaacaguuuuagauugggagccauucagagccucacuaugauuugccacgagguuccuuggagucuguuuucuuuccuguguauugauagucugaccauauauuucuguuucaacuauugcuauuggcaagccccuguuccuuuuuuuuauugugucaaauuguccgugugguuucauucaugaagacauaugcugucauguggaagcauaaauugcauaauuuaaauugucccuggaauccuuugugaaaaaguggagacagccagccauuaccccggguaagaguccuucacacagauuccugucaaaaacuagaauagaagaaaacccugaugccaugcugggguggcgggaggaggugggggagugugagugaguagggaguguuuguucugucuuguuuuuaacuuucuuuguaauuaguugacuuuguguguuagguguacauaaacuuacccauuucugugauaguauuagccccugucuuccaguuggaucaaacuuuuuccuguaaucaucucaggaaagcauguuguguuucccuuccuaguuagcguggcuguuguuuuguuuguaccugguugcaucuugaguuagaugcuugaugaggaauaucauagaaaggacuccacacucaguuuuaaauacccuuagcaacuuacagagaaaauucaggcugggaggaguucaaccuggaggucacacuagacaugugacugucauaaauuaaaaaauuaaaaccaccuuagaauaagaaaugaauagcuauagggccaaauugugaaacacauuaaaaaauccuuucauaagaaugaaguaggucauuucuaaaugaguuuuccaccuuuuaaaaguacguacccaauuaaauauuuuguguuccuaggaaaagaaaauagccaggcuuuucuuauugguaucuaaguacucaaaaaccaauauagcuuguagcaaaugauuccuacccccaggcccacauuauuauuuuuggcuuucauagucugaaaucauaagcuuuuguuuuguguaauguggauuggaucacauaaagaagguggguauagccuuuauccuucagugauauguauagaauaugcccaaguggggaaacuugacaccagaacacauguuuuuaguuccuuagguacaaagcaaagaagcacaccuguccuuaagacugaaucuaugucaugaccaucuaaaugaugauagagagcuuuccuccaaauacagcuggcuauuccccagggucuuagccuaaugauuccuacucuuugcuauugauauuugcaugguucaagagcuggucugcuuuuaguuaugcacucaacaaauauugagugcccauaauauguacagcacgaugcuagugcuuauggagacaaaauacucccuaaaccccuuaucaugugguugcgagaacagguuacacacauuggaacccaauaagagauacuguacaauuggggugauucgguggcacaggcagaaggugccgcagaugcugaggagagugucacaguggacuuuggucugugccaucaaagaagggacaaaauguggauaagaaaggauggcauuuuggaaguuacacaugaagguccaauguuacuucaagcaucuaucuucaauguguguuuauuuugcauguauuuauguuucaggcauagauuaggccacucuugcuaggagauacacaucuucauccuagaauguuuacuaaauugccuuuuucucuagaguugacaucuacuucauuaagauuauuuuucauucagcauuuauggaauauucaucaaguguuauugauaugccaguauaccuagugacaagaauauuuugggggcacuaguaaauacucaugagccaccuuuuacauaauaagccaccuuuucaaguuuuuacuccaaaaaguauguguccauuuuucuucauacugucuuaagugucuacauuuuuuuuuccugauaauuguaaaccuguuacaaauaacaacauagcuaaccagcuuuugaccuauauugauuuaggagggaaugagaaaagacuugaauacuacagugauggaggccaccugaccccauauuuuuuaaaaaaugaaugagaaaugugaugcuaguggaaaaguuuuuaaugccucuaucauaauuucaauaacuuuaugcucuuuauuuuaaaaauaaucuuggagauaaagauaugacauguuuucauacuaaagaccuaaucaacaaugcaaacaaauaauacugugaauacagguuucccagaauuaaaaagugauguuuacagcuaucuugguagugaaaaauaaaagacuugacuggaaggacccagcccucccauaucuaacacaaaauuugccaagacuuaaaaaugugcuacaacuuacagagagccucuuuccugucuccaucacuacccucguggcaacauccucuucuuuuccuucccuccccucugccuuccucuuuucuguacccccuuccacugagcauucacacacaacaugauauaggaauuguuuuucuuguuaaaugaaaccacuauacagauuccuauuauuuugcagaacaucugguuugcaaaugaaaagaucucaggggcacaacagcacuagugaacaauucugaagaagcuuuuaacaaaacuugaaauugcuuauccaaaaaaaaaaaucaucccccguugcugcuguucuguagcacacaaucucuucacucacaggggaggugacuuuaacaaggaagagagcuuuauccugucucuccuauuuuggccuuuuaguuuucauucuguuccuauccacuucucccaucccuaagacaggggaguuugauuaaaacauaacauagauggaaagaaaauuagccaggaaaccaggagaaaauaaauuccagaguuuaauuuuccagcaguuauuuuuguuuucgaucgaguucaaauaacaugaaagagaagaaaaaaaaaaaacccaccauauauuuaauauauauuggccagcacagcacaacuaugaaaauaaaauugucaggggaauuccuugccugcccuagugucuagauuuaaagcaccuccauaacacaaacugaaggggaauucaauuaagaaaacccauuggcuucuuauugacuuuaguuaagaaaauaaacugggagaaaguguauuaaaauaugucuaacugcuuaguaugcuuucauuuaggcuuaugacaaucaaaaaugagagaauuuaaauuuuuuacaauuaagcucugguuuugaguagauuguggguuaucacaccgugcauuuuuuuaauguacaccuuacucaaacacacccuaaaaugcaggcuugcagucugcgcauuguaaagcaggagcaccgcagaucaauugggggaaaaaauauuuaagguuguaaauuuaauuuuguucuaggauuuucauuuucauuuauggcacccguuguguuugagaacauggaccaauuuauggauuaguuuuaaacccccagucugucacacucaaugaacaauucuaaguuggagagaauccauaugaaaggauuagaaugugccacaguggagcuuacacaugacuguuucaacuaaauauugcccagcugccucuccugcaguauuauuuuuuuuuuuugcuacuuaguuaaauugcuagugucucuaauuucacacauugucagagcuuuuuuuauuuuguaaauauacugccacaauaaauguaugugauguuucauuuauucaagauggggucugauaaacuguaggacuaggagacuaagaagagaagucaauuuugaguagaaugugcaucuuucaaauaauauugcugggcccuucuuuggauaccuuguuugacuguacucauaaaauagccagagagugacuguuaagaccguacacacuuaauggguuuucaagaagaugggauuguuuuuucuuggccauauaauauaaauguauaauaaauuugcucucuuuguaauuaaaauuaagagacaguagcucagcuaggccuuuuaaaugucuauauaacccaacaccaccauaaguccagcucaauuuuuugugaccuguuuuucucaugggcuagcucaaagauuuuuuuuuuuuaaggcagcagcaagaugagguuuuaaaaaggcuuuguuagggcaauuagacauuuucauuuuucaagcugauuauagcauuuaucacuuacauugaaauuuaguauuugcauuuugccucuacgcuuagaauguuacccaacaauauggucaccacacaaguugauucacaggguguguuugcacauuucuccaguuuucugauuaagauacccuaauaaauccugccucacagaguugcacucacuucagagccagggugucugugguuucugcaugaagucauaacgcaauuaugaaggagaauuagauucugucaucguggucuccugcagggagcacaaaguuacuucuaaagaauguuuucuuaauucuuuacuugaaaauaaccucuguucaaguagcauaccagaugcucuuagagaaauggagucagugacuccccagacacaccaucaaucuugcucugaacuuuguagccagccuguguuucuccugcagucuccuaccccguugcugcuccggguuuugccauuuccagcugcaguaaucgugugugugacuugaacauguguuugcuguuaaccauuuuagaauguguuuuuucuucucaacaucccccuuuccuccccuuuugggugcaguugauggauuucccauccccagaacggggaagcaagaugcacuguggauuuuccuucauuuauuuucuaguacucaccuaggagcagacgccuagcuucacuugguuuaauuucaucuuaaagcugacaugauguugugauguaggaagacaguaaauuggggucacugguuaaugcugauauuauuuuugaugacucuaacccuuaggucuuacuccaccccccgcccuucuaucauuuguacuuaaguauuuaccuggugaaaauaaagcuuaugccgggcacggugccucacgccuguaaucccagcacuuugggaggccaaggcaguggaucaccugaggucuggaguuugagaccagccugaccaacauggggaagccccgucuccacuaaaaauacaaaauuagccaggcgugguggcacaugccaguaaucccagcuacucgggaggcugaggcaggagaaucgcuugaaugcaggaaccagagguugcggugagccaagaucacgccguugcucuccagccugggcaacaagagcgaaacuccaucucaaaaaaaaaagaaaagaaaagaaagcacauuagaagagcuacuacaaaaauaaugagccagaguguugauugcuuuuuuguaauuuuggaaaggagccgaugccuaucuauaaaauguauuaacaugcauauaaauguuucuguacaaaugggcauuugauccugccccucaaauuuaaaguaccuaaugcugcacuuggauguuucaacuaaggaaaugugucaucugugucaggagaaucugugacagaguguguuucaacuguacaguuuauuguuuuuuacugcuauuuuaugcacacagacuugacuuguaaguauuuuguucuuaugcgguauauuguauguuucucuuuccuucaucuauucaucagaaacuaagcuaucaguaauauuaagcugcauuggccuuucagacuucugguuaauucuggcuccuuagaagggaucuaauuuuugaugguauaggauccucuggaaagcaugccaacugaaggggaaugccggugugaauucaugugucacauuuauacaucagaagcaccaggcucauuugccccccaaaaaagcuucauaugaaguuccagugcauuuaaacauugccuguguugaaucagaaagucuuuuggcgucuccacagcucaugaaagcaauugccagcuaaauagcugcauucuacaaaaggacagugaacugcuugcuugcaguuuaacccagaaucuuacuucaaccaccaccauuugacuagagauaacuaacuccugucucaguuucaccauuucuuuuugccagcaaugagucguagaaggaaugugccugggaaguuuagaacucaaaaugaaaguauggccagauggguugacauuggaaugagguugacuagaagaguggugauaaaaugacucuggaaaaagaaugucacccugcauuuuguuagauauuuauuccacuuccccuguagccaaaaauaaagagaaaauuccuugagcuccuuggaggaauuucuugugaacaggagcaaguacagcaagcuuggcuuagaagccugguagaagaaggagaaaacuugaacagcaucagaaauagaagaagaaaaagacaaaauacauuuccuuccacagcaaguucaucuagcaauggaaaaagaaaaaaacaaaaacaaaaaacugcacucucuccuacuccagccaugaaagcaggacucccagccccucagaauggugaacgugguucugaauugugagcgaaaggauggcuggauacuuaaauuuuuggaaugucauaugauuagaagcagcguuuggcagauugugugaacuuggguguuuucauuaaaggcuucugcucuuggauuuuaacaugaagagcuuuagagugaagaauggauguguguguuuguguguguguguguauagaaacuaaucugugaaaaccuugaacauguucauugccauggccucccaguuaauugaacuuucuggcuaaacuaugcugaaauaauacacuggauggaaaacuuaaaccugucuauucaucuacaggcaucugagcauaagcaguaaaaggauccuaaaagugugauugagucagugaugccuaauuggcagucaagaagcccaagugcccggguggguuggguuaaaacaaaggcaauguuugaauguuaugaauccauuguuuaaccagccuuucgacugagcuuuucugucgcaguccugagccuugaugcuuuaagagccaucuaccagccacugaguuugcacugguguuucucaucacuuugcauguccaccugacuauugacuagcaaauauauguguccuggcaagacccccagaaccaaagaauuuacuguuuuccucacuggcucgcagcuuugagcucaaggcaugucuuaaaacagugcaacucacuucaaaugcuuuuugcuuuucauuuauuauugcuugucacgcgauguucuuugaaagcuugcucauauauuaucuguuccauuuuuuuuccauuuucccuuuuuuugcaugccguuccuccuguuucuucccuuccuccaauccucuguucccgucuguagacacaacggcgacgacagaaccagcaguucacgguugguaucacauuacuguuuaucuacuuucucagcacugcugagaggcaaggcaagccugggaaaaagagaaauguagucuucaagggaaaucauguuucaaguagacugaccucauaaauauacuauaauuuuuuaagguuugaaaagaugucgagucuugucauuucuguugugaguucaguacccaauggaugcaagcugagaugagaccuucuccccacuggguggcuggaauuguaggaguuucaguggcacagaguccuccuuacaaaacuccaccaaaccuugaaauacauggggcuucaaacaaacgaguauucgcaggaaaauuguaacaucugaauuaaaggcccaguugcuuuguuuauauauaggccauagucccagguaaaucuugaagaggagucauuugugucacuuaguaaaguugagauggaaggguagaccagggaagaagauuccuguuuaaaaucgugagcuucugaugaggaaggucauuguucuucuuuagaaaggucaugacuuuaauuauguugcuaaucauauguaccccaccaccccucacugguucacuccuaaucucuauguguucauauaacuuuaugcucacauuuggcagaaaacuccuccaaaccaagaaugauaccaugugucaauuuuaucagcauuaacugggacuuuaaauaaguuacugguguguguguggcuugcagguaaaauaguaauacguuuuuaaccacaaagugauaaaaacugggugagucaaagcucaggaggggcaucaggaaauaugaucucuuuuuccccaucucaccaaugacuuacuggauuggaauaagucuauuaacuuuucuaugucucuccaaucagaaaaugagaaucauguuucaucuguauauuacuuuauuacuuagcucaaaucuagcccugacaagacugcuuagaaaagauauguuuaaaacugggcugaauuuuaauaauugaauccaagggaauuauuugguaaagggccuacuuuaaucgcuuugccuguuguuguacaggguggaaaucuaucauuuaaaugacaagaggugaucagccaacccugccauguuaauucaacuuuuagagaaacauuuccuggcacagacugacucacuuagagaccuacauuugauaacucaccaguuggaaaaucucugagcucuguaggagcuguccuugaaggucaggccuugaugcuuggcaggucaccccaucuuuugacuuuccuaugacgaauucugagaaagcaaaacgaacuuggguacugagcaauauauccuuccccaccccauuccuauuucuuucugcccuuucuggucauuggugcaaagggaaaaguucauaaaauaacuuaaaggggcuaggugugcugacagucaugagaaaucaauuagguauaaaacuuccacuuucuaagguaaugccccauagugcuugcuacaucucaggcauugcaguccauuaagcucaguuauuuguagauuucaucauuaauugagcaccuccugacuuuuaucuauuauucucaaaggguuauuuuaauguaguuagagagauuuuauucuauucuuuuuaagauacuuaaguuucuuuuuaagauacuuuaaguuuugagcuuacuguaauuaacuacaagguaaaaugcaagcucauccaacccauagccuaugggcuaccugcggcccaggacggcuuugaaugcggcccaacacaaauucauaaacuuucuuaaaacagugugagauuguuuugugauuuuuuuuuuuuuuuuuuuuuuuuuaguucaucagcuaucauuguuaguguauuuaauguguggcccaagacaauucuucuuccaaugugguccagggaagcuaaaagauuggacaccccugauauaauguaaccauacaauuccuaaauucugugagauccuugaagaaauauugaccauuugucuccuaaagcuccagaauucuauuuucuaggucccuucaauaaaauucauguucuuagugugacucuaguggauguaggucucagaguuggauaggcuauucgaaguaggaaauuuguccccuaaucugaaaaauaagaaguuaacuuacaggcugauccugauuuuagaguacuaguuuuaaucgggucuuucccuggagagagagaaagagaaggugaucucuuuuugugguauaaggaagagacacuuggaaugggacuuuauagcauuucuguggcagguaauagagguguuuguguacugugagaagcaacugccuuccuauuaguuuggagacgauguucaaguuggugaaaccucaguaggauguuauugacuagcagugcaugaagaauacaccuagagccaagggauuuauuguauuuuguauauauauacuuggaauuugacuucuuaauggcagagggauagaaaagugauagauaaucuaggcugaucccuguauaauacacuuauaaauacauucuuuaccuuguccaaaauccucguagcaucuucacaaagggcuccagccacuguuuuaaagagcauacucuuuaacccacagcaaagaagcuguaaugaaagccagauaauaucuaaaauuuugcuugaugucggggaaaaacuuccaggucaguugucaggauagaaaagguaauagaacgugguggaaauuacaaagcaacaucugagauuuccaaagagaugaugauacagaacugauuuuauucuaaugaauuguagcugaaaacccaacuucuucauuacagcaaccauuugacuuagauucauuugagaauaaucucgagauguuuguuguggugaucugggccuagaaauguugaaagguuugauaacuuagcaacuuaaaugacaagacauuaagucaaucagcuaugggcaucuuauuuggucuuaaaaguuuucauacuggauuuccuucuauauuucuguguuuuuauaaaaaggaaaagaaaaaauaaaaauuuuuaaagcuuucccuuugaagacucauuaaaauauuuuauucaagcuuguuuugcuagaguauguaugaaguuuauaccaguuguuuauguauguugaccauuuguucuuaccaauaucugauuggaauaagcauguauuggaagguuagaagugcaugggcaugauucaaaaucaaguggauuuucuccaaaaagaaagccaaacaacaaucagccacaaugugcuuuuaaggauuuaacugauaguaaagauaaaugugaguguuaagaaugggauuuuuagacuaggcugacacaagggaucuucuuugaauaaggaucuugagcauuuguguuuuuggagcucauccuuaaggccuggacaggaagaauccuguguuaugugugcauguugagcaaugcaaaaaacacucugccaaauccugauaccacauggucugagaaaugcaugagugauuuaacgcacggaugguguagucauuauguucuugaugugugggugcgugugaugguuuucguuuguucauaugugggcgcuucugugucuugugccuuguuccuucugcccuguguguccccucuccccuuccccacccuccuccccaaugugaggggucgggugacagcaugcccauggucuggaauagugcuugugcuuuugcugcacugcagucagcuggcuuccucuggguuugaggucucucugucuccgucucucucucuuucucucugugccccuucucuccccucuccauuuuauuauuuucaagucuaccuguccucuugcuuuuucaccucuuaauacaguagaggcugaugaucucaugaauuuucauauccccaaugaguuuuuaaauuguucuuaauucaguaugcaauugugguaagacgcaaacuggaaaccccucugaagaauaauuucucauuuucaguuuugguuucagaauguuuggccugugcuagcuacaugcucguacccuacgagcacagcccuuagaaaacugccccuguagcucuuccuuuuccugacucguuuauaaauaaugcaaaccauggucaaauucuaaaagcacguacaauuuucuuauuauacuuuauauucaguuguggggaaauucuuaagcccauuuuaaagaaacauagccagcagugcgcauuacuacaaccgcuauguccaccaucuguguaugugccucuauguacaucucucuguaugagcacauaacaauggcauucaaaggcugucauucagucacgggacucugcagacauuguacguucuacacaagagcaaagcucaagagguuuacgaauggcugcaggaccugaagauuguguuucagccuugauaugcaguuuggaaacaaugugcuacugucuaacggcgugaaccaaauuucugcuaaugggaagaagggaaaacucuccacaaaagcugacaaagcaggaagaacaggaugacugaguuuuuagauuaaaacucccgggggcgucugaacucauggcuggugguggaaguaagaguuuccauaauauggccaagugaucagauguaugcugcuuagguaagagagagaccaucgccuacuuuguuuuucauaaugggaaugguacuagggccggugggcuaaguuuuuguuuucuggagguuuuauucgaucauucuauuucaaaauuuucuggaaaaaaaaaaugauacccugaaaaacugagcccauaagcauuuaaaucguauuugaccuugaauugauuuaauaucucuagaauuucuuacuguuucuaauuuuuugagguuuuucuuacccugguuuuaaauggccacauuguaucacuuuuagaagccagcaauuacuguugaaaaggaagaaucacaacggcaaaagcauuaccugagcgggcuuaggguauguuauagcacauuguagcaccaugaaaaaguuaaauacucaucucugcagaagagauggcuaucaugcauauauuaaauuaccauguuugcaucuuuaggacuuuauuaauugcucaaaaauaaucccauauggacaaaaaguaaacuuucauuuguuuaacaaaguuuaaagacauauguugaauacauuuuaauuagcagugacuagaaagaggccuuaauggaugauaugaaaguuucaagagaauacacaagaaguaauuucccacuuauuguuagagugaagucuccuuuugaagaauguucucugcuucauaaaauacgucuuugucuuuuucuuugagaaaaugaaaaguguauaauuuuuaacaugaaagaaaaauaccuaagccaaaucaguuuuaggagauaaauuuugcucguccccacuugcacacccagugcuucaguaaauucuuuugaauuauauuuauucagaaauuguccaacuauggcagaguauuguagguucacacaauauaauagugcuacaaaaacaaauuuaaugccaguagccuaaauggcuuccugcuuuagaacguaauccgagcaguagauuccagauaacuugauauauuuuaaaguuuaugccauuaaaaaugacaguuuccacuuuaaugagguguauaucaacugucuguugcuuuuaauggaaaccuuugcauaucaaugauauuucauaaacauauuugucuuuuuggguuuuuuaauuagcuuucuaaugcccuccccgaggaaauaagccuucagcaguaaagcuaccuacuugaaacauccuuguuuaaugugguucagugggcaccaagcacauauguaggacgcuuugauauuuguugggccagguagaagugagagauuagccuucugagaacugcaaauuuauaauuaacuacaaaggaguacuuuauguugccuauuuauaacaguuauuuaaauaauuguauucaucagucuuuauacaauguauaagccaauuagaaauaggaauauugucaaccaaucagauuucagaacaaauggauaucaucucuacucaguugccucuauaauugauugcauugcucacugcuuucccuuuaguugccuaaaucuauaguuugggaauaccugugggcucaaaaucuucccauuuuuaaucagcaccugcuguuaacuauuagcacccaagggucaugauggaaguucuucuuccucaaggguugauggugugacagccgucuuucacagaauugaccuggcuaucaauguucguuugguuucucuauaaagcaacuuacaaaaugcaggcuucagugaucauuugcacaugacuguugugguucauuugggccuuuaaaaauagugaucaguuugacauuacuuguuucaaaagcauuuguuuugguugcuuuuaugcucugauugggcauuauucccaaauuauuaauucaacaaauacucacugagaauacacuuuguggguuggcuguagcagaagggaaagaugcaaaaauaaacacaacuugcuucuccaaagaccuugcaguuuauuaggucuacagacaucuucaaaagggacaaaucugacuagagaaguaugagcaaacugcugugcaacuuaaaagaccuaagcaguuagucacacuggacuuugagcagaacagcaaagaacaaguaaagccacauugaaugucuaacauuuuguguuauuaaauaaacuucauuaaaggaucagcucacaaauaaagcaaaaggaaauggaaaccaucuccuaucugagccucccauuguuuaucuacuucccucuucaccccuuuuaauucaaaucagagcuagcugagaagcaucucagcuggccagcauuggaauugacucggauauaggcauuucaagccccgauuugauuaccuccugaccuaacugcuuuuucagcuuugaggguuuuauuuuucaggaauaccauugauuuaugaaauucucuuuuuuaaaaaaaucauuuugcgaaucagauuuucugaugaaggcauaaccugcaaucugcaguuagcagaugcuguaccauuuugaaauaugugauccaagaucaucauaaauugauaaugaacuguguuugucaguauuggcagcggauuucaauuuacaguaaaaugcgaaauaaaauguacauacaucaguauguaacaucuaaauacauuuuuauuuaagagauaucagagcaucgacagcuaacaaucaggcuuuauugauuuucuuuuugcaugcuguuacgaaugagugauuuuaagcauucaccuucauguuucauguccuuugaacaguggagacugaggaaucuuucugccucgauugcguauuaagaacaaaauuacauaauugaagaaauguacuuauggauuaauacauucaugcuaucaaaaacauagauagcaagagauuuggcucauguuuuuaaagaaauucauccucaguucuuaaguguuuuguuuaugucccucgaggaaugaaaagaaaaacgauuuguuuuuacuuguaaggccuuacucaguugcccaauuccgcagaagaacuggacagugaggaccucucagguaagggcuagucauuagguaaggcacugcaguguccaaccugugggugcucuauccacuucuacaaaauggccauuugguuugcugagcaaucaguguggauuuugagacuaacaaaaaacaaauuuguaucaauacugucuuccuccccggucacccacucaccuguuuucucugugguagcgauauuuauauuucggaauggggacaauuuaauuaacgcaggagaggacaaguuaccuuugggauuguacuaaagccccucuguucaguggcuucaaauaauguuuauguccuagauauauaaugugucgggagaaauuuuguuguauuacaaagcaauuuaaggauguuggauuaugugacaagaucuuuuuuaaaaaaaaaaacaagcaacucauugacugccuacuucuguggaggggacuagaauagccauguuguaguuaucuuagaagucagggguggggaagggcagggaggagggggaagcaauuguuuugucacacaccaugauguaaacuaauuauccaccucagaccucuuucacagcacacugagcucuugcaaaaguagguuucaugcuugauuccaggauuuagguguuacuaauccagaauaagaagcauauccuacaaaggagggagggaggagauuuaaaguggucagagcuaaacaauuauaugagcuuccaugauguugugggacuuaacugccaaccagcuauggcuuaaaccuuuccauccaucacuuaauaagucaguaagcaaggcccuucuuguuauugcaguggagaaauuaagucauaggacuguagacacuuacucaagccuauuggaaagaaagauuccagaggcgcuuuuacugaagcuccuuuuaauaguuggcuauugaggugcaguccuuaacuauaagucugacccggugagagaauaagauaguacuacucgauuuuucaaagugcaauugauuuauugccaacuacgugcuucugacgaaccucagggauaucuucacuuugcuguuauguagccuguaguuugaguuuagcugucggauuuauuuuucuacagacuggaagcuccaggaggccaugcugguuuuguucacuguuguacaccugucauguacuaaguacccaguugacacuuauuggaugaaugaaugaauuuccaaaucccaaugcauagauaaauaaauagauuagaaagauagacagccaaucaagagaguguuucauuuuuugccacuucuuugugguguaguuggagaaguugcaaaaacauuuaccuaguuuuauuuuaaaauaaggguggauaaguccucccuacguaaaaugugaugcuggaaguaagcaauuucugcuugcauuucugguaauagacagucucaguucugguugaccguaaagaaaacaacucucuuugauacaguagcccuggcaauuggaucuucucaaagauccuaagaaagcugguggguguguuggcccugaucccucuuggcacaauagccagacaaggaucacucagauaugcaaaagucauuuuucuccucuuuaggaaaaugugacugaaucagccauccaccccuuccaccagcaucaucaauuaggaauacucugggccucagcacugcgccaugucagaugggucccugcugcaguucuaucaaucacccaagucagaagcaauaaaccaacaacuguuuguguucauaauaauucaguuaaauuaauaauuauguugucccccucccccacucccugcaggaacacugcagucauauauugcucaggagccguaagucauguagaacacugaugaacuaucaggcugggccgggcugccuuugcaucugguuugaugaacuaaucaaaaacugauuagcaccuuuguucgaaggggaugcugauuaaucaauuacuauugauugugagcuuggcuucacucagcagcaaagagacaucugaagggaaaaaaaaaacaaccaauaaaaauugagcagcugucauaguguuuaaauuuauuaaaacaaaauacauuauuuuuaugaagcugucuugaaaugggucacugaaggggagcauauugauugagaaaggaugaacuucucaaauuucuguagccuagagacugaauucaauuauaauacaagacaaaccgguuaacacccgucuuaaacaguccaucaauaaauuagaguagguguugcacauuuaaugcuaaacugugguaaugaauaauaucauccauucccugcugcaucaggguagaaauuuccuccuuuccauauuauggauaaauguuacguacucaauuuccuuccaaauaaugauggucuauuuuccuuuuguccccuuugccccgaccucccccacgcaccagugcuaccuucauuaaugacaguuucauaagcaacauauggugcuccauucucacccagcaaagcaaguugcccagcugauccuccucuuuaaucugcauaaagaaauuaugcucguauguaguucagugauuuaauuauuggcaggccuggggagcuuacccaguucuacuuugaacccuuucauuuacuuuuuggguguuaacuuuauugaugauggauccauaagaguuuugaauuguuuugucaauuacaucugcucuuuccuggugacagcuggugguuauugccacucauguggaauagaauagcuuuaagcauauuuauccuucuauuuuauuuuaaaacuuuuucaaaaugucuccaacugccucucucccuucagcaguggaggggccuuggggaacuguuuaguggagugaggugguaaauauacagugugccagaaaauggcccuccagcacaguucaagaaauccaucagucuucugauuuggaagcaaaggcaccaaaaagaaauuccagagcugucaugauuccucaaaacauguuaucagcucuuguccuacagacaagaaagugaucuggaaaacuccuacaacaugucccucacgauccaaaaaagaaagcaugggccucggagggcaauucuaaauggcuuugcuaacccucaucuagguguuaggaagaaucuaggugaaccaacugcaguccccuaaauggauuauacaagaaacacggcuucaaaauauagccuauauuuagcugggcgcgauggcucacaccuguaaucccagcacuuugggacgcugagacggguggaucacuugaggucaggaauucgagaccagccuggccaacauggcaaaaccccaucucuacuaaaaacacaaaaauuagccaggcgugguggcaugcaccuauagucccagcuacuugggggcgggggagcagggguugacugaggagaauugcuugaacgaggagguggagguugcaguaagccgagaugacgccgcuguacuccagccugggcaacagaaagagacuccaucucaaaaaauaaauaaaauaacaaaccuacauuuagcuaauaggagcacuuaaagcucuuuugaucuagauuaucagucccggagguggggauauauggccuuccgguuacugggagugucuuaaguccuggcuaaacuuacuugaaaugugugugagaaacugucaguagcuguaccauuuagggggaacucuuuccuaacccccacauaaagaguggcccagauuuggcaaacaggcuauuuuauucccuugguagaguaauaacaacaauaaugauaauaaaacauuaaaaaccagaugagcuguauagauauauuuaaguuauagcccauaaaucuaaaguguggcaugauauggcuuguaucuguaucauacuuuguaacuuagaaagcucuuucacacauauuacuucguuugaucuuuauucauucaacaaaauuauuugagauccuugugcugggcucugggcugggcaccagggaugcugcagugaacaagaccaacaggagcuggagcugccauggcguccaggagccagggccccugcucuccuaccgcgacacccuacugagggagacagacccaaaacacgaguuaaucuuggacagugacaaaugcugugaaacaauaaaaccggauaaaguggaagugagggcuggggcuggaagaagguggaggucaguuuagaaaaguuuaccagggaaggccauugggacaggaagacccagauagaugagaaugagccagauaauagaagauuuucaugaaaaucuccugagauuguuaaggaagggcucuuggucuccauuuauaaaugaggaaacugggacccaaacggcuaaacgguuugcuuaggagacagugagaagcgaagcaugggucuuccuggcucuagaggaaauagaggacuuugguuugcaggggccaccuuucccccuaugaaauccacagcuuccugugugcuggagccuuugguaauccucuugacccuuuucaauucacugugcgcacccggggaaugagggaaaagucaggcucucugcagcccaucaggcauagagcaaugugcugacuaaccugggaagauuuuuuuucccagcaucaaaucaagcucuuucuccucaaagaagaccuaaacucugcuucaguaguuuaguacuguugucccacugauuccccuaaauuaugggaucaguuuccccugggaggugacccuaagugccaugggaaagugauggcuggaaaagguuaaaccacaucaauucccuuuuaaaacugaguuucauacaaggcaguagacugaagaaaucacauuggguccaugccagcucacccacgacuuccccacgauguguuugaacugcauccugcugcuggucuuucucauaauccaacaugcuccuguuuccaccgugggaagggaggagaccaucaaacgggaacuuuucuuccaaaguuaaaaaguuggcaggccacggugagugugaauucuaguucuacagguuggacacugcuuuggggugacuucaccauauucauuaauccauccuccucacacccccaaaugccugagguccacugaagcaucuuucuccagagagagauucuagugggaaauguauguuuggaaauacucgacaacuguccuguuuaucaggcguauauuccuuuaagggaaacucuggugucauccucagugccuuccuguugcuuaaaauggaaaagaugaucacauuucuaaaucugugcuaucaugagaugaacagaguggacucaagcacgacuucuggugucucuggcgguguuaaaugccuugggagaaaucuugcauccuguuggaucaagucauuuccacucaugguuaaauuaacuaaaucaaggaauuugagaggggaaaaaaucaacaagaaaaaacccaaaacacuuguuuucauauuuagcuacaauaguauuuaauauccugauacucaaaugguacacccgaaucgaaaccugaaucagacggccuucaccugccaggcccacagccuugaccuucauaaaggacagcuaagccauuaguuacacaguuugucaauucuguauaaaugaaaagaacuuggugacuucaacucaguaaguguuuauugggcaucuuaccaugugugggcaaugcugaguaugcaguaccacgcuuaccccuaacgaacugguaauuauuugccuugggucggugauaagaacuggaaaagcccuccuuaggcucuaauacaggagauuugaauuuggcaaacaccaggucccuaugauacuccaagcccugagccaaauaggcacuuucauuuggcucaggaaaugaaaacaguggccucucaaagugacccugugaaguacguaauuguacucaguggcucagagugccucauugaccugccugaagucacagagaaaaguaaugaagcucaaguucugucccagaaaugacagcaaguccagugcucuuuccaauggaccaugcaggagaugagcuccuagcucguccccuguucaggccuguuucuggaaagcaauguagccagugauagucuaagagagcccugaguccugaucauuugaguagugacaagguacagccaaaaucugugugcaguacuucuaauuuaaaugaacacauacugagcucuggguggcaccaugaggaugaucacugcaguuuuccuuuaaguagcuuaacauagcuccuuugaaacguuaguauagaugcaguuacauugcuagaauugaaugcagcugacguguaguaguagaugccugggaugcuauaugggagucuucaugauuuucuugcuuuacguuuauuccuucucguccacuuucuaagaagacagaaaagaaagguuaugcugcauaaaggcuagugugcuccaauauauauuaacaucuuaaugggaaagcugugcauguacuguauacauuuacuacucucugacaagagggaauuaaaugucagaaggauuuguagcaucuauaauugaauuggugcugagaaaagcaaaucuuaaagaagaauaacauauuaggauuagcaaauaauguggcauuuugucagcgcaugccauucaguuuguuccccuucaguaauaaaguugugcuuuuuaaaaugcacacuuauuuuuguugccauggacgggagcuacaauagaugaugagaauggguagcuacauuuuucagauggugccagguuuucuuaagugucauuuuuuuuuuaggucagauuaugguuuugcuucagauuugggaaauccacuaccaggcuuuuucuuucuuccuagcaagaaguaacaaaugacaucauagucacuaagcuuucucugaaauagacuaaucccuacaacccuaggaagcuggaggcagcauuuccauuacaaacaccgauucugagaguuuguaauuaaacugacuuguccagcaagaucuccacccaggaaaggaacuaaaacugagccacgugacagaacuguugcaaaaaaguccgcaacaauucuuuuccuccagucauccacggaugggggaagcacagaacgcugagcaucugaacugucccuaaacagaaguaggaagacuaauaccguuagaaccuccccauggcuuaaacguaaaaaugagagcugagguaguuuaugaccuaugaaaagaguuaaagugugcguuuaagcgccauguugcuaaaugugccuuacagccugagccagggauguuugagaugugagggugacccagugcaauguggcugucaugccucaugcugcauacuuuauuguguaucauugugucacccuucacuccuucucagagguagaaaucuugguguccuuuuggcaaaaagacugaccuuggacucuguguagccgagggcuucagggugggcaggcagcaguugcagugaagguucugcucagugaguccuucugccaaagucccuauuugccaggagcuugucuaggauguacuagccacucuccaguuauccauggauccccacuuuggcagcagagccuucuaggcuuaucacagauccaugauuauggcauuugcauggcgguuuaugcuacacaucucaugccaggugguaaaguagccauagaaaccaggaucucuugcagagcccuguuuaauacaggcagcauggcugccagagugcugcguuuaagacgacucuggcaaggaguuugaggaaugaaaacaaguagagaaagaaaagucuccuagaaggaggggaaaggagacugaaguuccacuagcagucaccuuucuugucacgcccuggggaacuacugccuuuagaacuuccccuucuuauugcccaugaggaauggaucgggccaggucaacuggcccaagguaaagaaaucugagcaguuuggggcaucacucuugggaguuucuuugagauuucucugucccgcaauuucuaagaugcuaaagcgagcccaggguuguugaagcugugacccaagcaguaguggccaacuuaacauucugcaagcagcugguaaacucucaccuggagccaaguuguuucagcuuuuugccaaaagaaaagcuaacucacgaauacuaaacaccucaugauuuaucugucacacuuagagccauggaaguggcugcgggaugggacacgacaggcagggaggguuguaccacaacugugagcugucaggaacaccucccugcaacugcugccugcccgcccugaagcccucgacuacagaguccaaggucagucuuuuugccaaaaggacaccaagcuuucuaccucugaggaggagugaagggugacacagcgauacacaauaaccuuuacaggguucaucugcaagucagaaucauucaaggacuaggccuaauucaccugaggucacaugugaaauaauuuggaugagauucuuaacuccaguugaacuguguuaugcaaucaugcuugguucacugaggcuggaauaaccuuuaugcuggaaccauucaccaagcaaaaacauggcuuuacuuuucaggaugauggggcagggcuuagucccagaaaagaaacacucuuacacuuguuacuaguaagaggaacacuuguagccucuuagggaacaagaaaacauggcuuucuaaaccgaagugauguccauaugccugagcaucaggcauguuuaaaagugcuuuccacucccacauuuauuuuucaauugacaagcuaggggcagcuguagaaucugccucugguuucguugccugcccgauucagaaaaugagccgggaaucugaagagaauguccccaggaaagccagcacuucaugggaccugaagaaggggucugcacccugcaggaccaggaucuguggcucauggggaaacccauagcuuucccacuuagaagucauuucucauggaauugguuagaguccuugccuugggaauggaaggaaaggucaagcagcugacagacuuugucgcagccaugcuucucuuagugcucgguauuuccuuccauuucugguuuucgugcgacuccaguagcccaguuccccccugggcagcaucuugcacggcugcuucaugucaugagugaggcacagcccgcaggugcaggcagcucaccccggcccugcugccuugagccaauccauggcauuauaaacacucccccacccuccccacacguggaaauaaaagaacggacugagaugacuccagaaacagcucugcuuuucauagggaaggccaagacagaggcacucagugaacaggcacaacucuauuaacaccucccacguaaacccaggaggugggagugggggugggaagaggcggugaggcgcucguaaccggcaguguucccuguaaauuaaacaucaguuaccuucuguguccaucugcaguaauugaaggcaggagaaaugucuuggugauuaacuggugguaguaaacuuucugaucaaaguggguaucagaagauagcuggagagauuacccuuauaaauaaguaucuguaaaauauguauguccuugaggguggggaagauaacuagaacaucuaagguucuaguuuaauuugggcaaagugcagggaaaaauagcaacacugagcauauuuagcucaaaguucauggagggcaaaggucaaguaaggaguuucggcucaagaaauuaaucucacagauacauauaccucgugagaucuuuuuguuugagggagguuuuuguuuuucuuugucacagagccucucucugucucuccccuccccccuccccccucaggcuuccagaauauuccugugucuaggcauggagaggaggcggucuuuuauuaagaguggacaagauagugucuuccccuagauggguuagaacuguccuggacagcuucucgaagcuucucucuguucucagucuuccuggaaccucucuucaccucuugccucuugugccuaacuuuccccuguccucaaugucuagucucacuuguuuuccucccccaauuuuaaaacauacagaguucaucgaaagacacauaaauuuuaauaggucugaagcucauggccauuggagaugaguuaauucucauucccccaagauucccuauuuugacagcucccuaaggaaaacacaacuugcuggcuuuucuguuacuuuugucccccaugagcaauuuugcaucugugcaguuggacugaacaucuccagugugucaagcgcucuccuccagcagacaccccguguccagcagcaccccacggggaaugcuccccuucaacgagcuuugucgucucuaaaaaggaaaaaaaaaaaaaucccuugaccgaguucugccuuguugaaaugacuuucaagacaauggggguuguagcaucugcaguuggcaacacuuuuggcugaggagggagauuccucuccaccacuuuucaaguugagcuuauuagacacguugcuggaggggcucgcucagcucagagcgggcuaauuggcugcagugcacucugccuccaacccagcucccuucuccaauuaaacucccaucauccuguuguccugggcgaccugcugcugccucugauuuggcauuucuguuuggguuuugguuuugguuuuucuguaguccuuucaaagauaacuuaaugaaacacuuuaaauacuccauuuuaaaauuuaaacucuuuuaauuaaagcacuuuucauggaacccucagucacgaguuauuuccccacauccuucaguacuuaaucucggagcagaauuggaaauaucgauagaaaguguaaaucaugcccuccugcugaaagcguuguaucagguuucggcucaaaagagcaccauuaccuuuagcugucacggaucuguacacuugaucgauaaacuucaaauauuauuagagguagaggcuucagagauuugcucuguucuuuggagagagacagagauaaaucuuucuuaaaaauugacuugaauuugcacucucagucuuccuggugaaaugcauuucucuuaggcauccagcaacugcaagggggacagauuuauaggccaugugcuucuuguacugaaagauucaaaugguaaauccuucacauaugacuucacaaaucauguaaaguuaaaagauuuuuaccguuucuguugcugcugugcuuaaauuguaagguacagcuaguaaaucauuuuaauggaggugucguacuugacucaauaaaaaaaaaagacaaugguuuagcuuccacuccaaaauguuaauguauuaaucaacgggagaauaauuguuuuuuacuacauuauaaaucucaaaugccauuaggauuucagcaaggggugauguagccacauuccuaaauuaaaauuguuuacacugccauacauccauucugcaucaccauagcucauucuggguucauuuuggaguuguuccccagccaaacaugucguuccucagucagaagaagacauccugagggggugaugcuuauaaaggaaaauuaauugcauugcaagguguuaaauaaauaaaauaaaaaccguugguggcaauggacaauuauuccuugcugucucuuuugaaauagguuuuuagguuuuaaauugaggcuuacuccuucauacauccuaaauguagcaagccugucauuugucuuuagucuuauaauccuuguuuuaucucuaggcaacuguggcuuuugagcaccuuacuucuccuaugcauaucccuaaucuaccagauaauaaaagucauugggcgucuauagaaagaugcuguacccuucuguugccuaaaggugucauucagagcacccucaaauagucaggucagcccccuuaauuaggcucugcaacuggauacagacagagugaacgcuaagacuaggucagggccggauagacuauuucuuccuucccugccucccuaagcuuguuccacaugcauuaacccuccuaugcugcuuaucaugaaauugccucguggggagaacagaucgauucagcacuggacaggucagccuguuaccucaguguaacuugauccaucucgauuguucucugugacuccuccauuaaaaaagaaggugacccucugacccuggagacagugucgccggggcuucuggugccuuguaauaagcucuacaucccuauuccucuucugauuuuaacagauucccgagcaggugaagaaggcucgaucagggcaguggaucaugccgugaucgguggcgucguggcgguggugguguucgccaugcugugcuugcucaucauucuggggcgcuauuuugccagacauaaagguaagcaaagcuucagcagacagaagcagcguguccccacagcuucugccuuuggagacuuuacaagguuguccuugauaggcaauuugauguauguggccacacggccuaucugauuccugaaacuggaagagagagaagagaaaaaaaaaaaaaaaaacaaaaccagaaaucuuagcagccgcugauuaggacucugggaguugaugaguagcacuccuugauuuggauuuucucuaaauauaaagcuuuguagaguuguuauucugccauccauaauuggggauagaggaaaaaugauaaaguagaggcuggugugcaagguguggcaugaagccgcaaaggauaaacauggaaaaagcacauccacaaccuacuguuuucugggaggcagaggauuucccccuauccccuguccccagacucuguguaagcuggucacaauggcgagaagacugccuugguuugaugugcccagguuaaagaaaauuuuuugccuuaaaagccgcauaaauauguauuuuuaaaauuaucagugcaauugauuuaaauugccauuaaucaucacacuuaucaacugugcagucuggaugggcaaucaucuuuuccaaugccccuccugucugccccaugcugcucugauccucuucuucccucuugguaauuuauucuuccuuuucuuuguccgccccugucucucucaguuauuuuucucaagcacugugcaaugagcuugcgggguuuucuaggugcuugcauacugcuugacuguugaacuuggguuugggggaaggucccuugagcacagcaguggaggucuaagguacuuaggcaccuuuaggauacagagugccugucucaagcauaaaacaguuuaggacgaucagagcuguccauacuucgcccucugcccacacucaggaggcagucuguuuggccaagagcucccagccucucggugguaagcuugacagagacaggagguaaggccagagagcagggcagcauccgagcagcagcugugaaggaccaggggaggggaacaugugugucacucugcagcaagaaaaaaggauacugagaagcguuugaccucuugcuuucucagauuuguuacuuugaaaaccugaaaauauagcaaaugucucaaccuuuuuaaauagaagacucuucaggaauacaguauguaaugggaggaagauuauuugauuaugguaggcaguuuaacuucuaccuauauagcauacugaggugcagucuuuguuguucuccauguaaacuguugggauuuggugauaagaguguccccagcuguguaaugucugucuauugucauuauaaaguggcugugccaauuagcaaauccaugaauccggguccgggcuagaguuauacgaugagagagaccuacuugcucauuaagacagaucccaaaccuugaucccugcuauuauaaugucaaauucuuucucaaucuggaaccucacucugaaguggaagacaggaaaaucaaacauacuugugcaaguucaagcaccuucucaccuauggguaggcaacaaugauucauauagacacgggacggugguucaaauaaaugagcugaggugacaacagaagcaucaucagggcccuaauucauuuauuggcuaauugcucuuccuugcuuuggucuuuaacaauguacgugcacauaucuggucauuggucauugguguuuacuguuuauacguuagucagccccucuccagcuuucugcauuuuuagcucccacucacgucuucuucugcugacauccucuggucauaaucacugcucuaaugucucauuugcugaauuauaucgcagcgguucaguuggaguggugccuuuggaacccccggaucccccuuugucucacccaccccgcucucuucuuccaauuguuuuuuccccucugcugccugcacaccacuucggcugaugauggccauaaagcaaguugccaucucuguaccacuuuacacagaggccaucagacagucacggugcuuuaccccuucaucuuucagguacauacuucacucaugaagccaaaggagccgaugacgcagcagacgcagacacagcuauaaucaaugcagaaggaggacagaacaacuccgaagaaaagaaagaguacuucaucuagaucagccuuuuuguuucaaugagguguccaacuggcccuauuuagaugauaaagagacagugauauuggaacuugcgagaaauucguguguuuuuuuaugaauggguggaaaggugugagacugggaaggcuugggauuugcuguguaaaaaaaaaaaaaauguucuuuggaaaguacacucugcuguuugacaccucuuuuuucguuuguuuguuuguuuaauuuuuauuucuuccuaccaagucaaacuuggauacuuggauuuaguuucaguagauugcagaaaauucugugccuuguuuuuuguuuguuuguugcguuccuuucuuuucccccuuugugcacauuuauuuccucccucuaccccaauuucggauuuuuuccaaaaucucccauuuuggaauuugccugcugggauuccuuagacucuuuuccuucccuuuucuguucuaguuuuuuacuuuuguuuauuuuuaugguaacugcuuucuguuccaaauucaguuucauaaaaggagaaccagcacagcuuagauuucauaguucagaauuuaguguauccauaaugcauucuucucuguugucguaaagauuugggugaacaaacaaugaaaacucuuugcugcugcccauguuucaaauacuuagagcagugaagacuagaaaauuagacugugauucagaaaauguucuguuugcuguggaacuacauuacuguacaggguuaucugcaagugaggugugucacaaugagauugaauuucacugucuuuaauucuguaucuguagacggcucaguauagauacccuacgcuguccagaaagguuuggggcagaaaggacuccuccuuuuuccaugcccuaaacagaccugacaggugaggucuguuccuuuuauauaaguggacaaauuuugaguugccacaggaggggaaguagggaggggggaaauacaguucugcucugguuguuucuguuccaaaugauuccauccaccuuucccaaucggccuuacuucucacuaauuuguaggaaaaagcaaguucgucuguugugcgaaugacugaaugggacagaguugauuuuuuuuuuuuuuuccuuugugcuuaguuaggaaggcaguaggauguggccugcauguacuguauauuacagauauuugucaugcugggauuuccaacucgaaucugugugaaacuuucauuccuucagauuuggcuugacaaaggcaggagguacaaaagaagggcugguauuguucucacacuggucugcugucgcucucaguucucgauaggucagagcagagguggaaaaacagcauguacggauuuucaguuacuuaaucaaaacucaaaugugaguguuuuuaucuuuuuaccuuucauacacuagccuuggccucuuuccucagccuuaagaaccaucugccaaaaauuacugauccucgcaugauggcagccauagugcauagcuacuaaaaucagugaccuugaacauaucuuagauggggagccucgggaaaagguagaggagucacguuaccauuuacauguuuuaaagaaagaaguguggggauuuucacugaaacgucuaggaaaucuagaaguaguccugaaggacagaaacuaaacucuuaccauauguuugguaagacuccagacuccagcuaacagucccuauggaaagauggcaucaaaaaagauagaucuauauauauauauaaauauauauucuauuacauuuucagugaguaauuuuggauuuugcaaggugcauuuuuacuauuguuacauuauguggaaaacuuaugcugauuuauuuaagggggaaaaagugucaacucuuuguuauuugaaaacauguuuauuuuucuugucuuuauuuuaaccuuugauagaaccauugcaauaugggggccuuuugggaacggacugguauguaaaagaaaauccauuaucgagcagcauuuuauuuaccccuccccuaucccuaggcacuuaaccaagacaaaaagccacaaugaacaucccuuuuucaaugaauuuuauaaucugcagcucuauuccgagcccuuagcacccauuccgaccauaguauaaucauaucaaagggugagaaucauuuagcauguuguugaaagguuuuuuuucaguuguucuuuuuagaaaaaaagaaaaacaaaaacaaaaacaaaaaaaaaaaaucacaccauugcucacagaauuggcaucucauuuuugggaccucccaucuuucuguuuugaaaaguguacaguagugcaguguuccugauguaacuuuauggcuuacaauguugacaugucucagguucauguguugcgauugguguuuuccgucucagguagauugcaaaguguaggccccacacauuggaaaaaauaauaauaaaacaaagcaaaaacaggaaauuauggauuuuaguuguauauugguuuauguauuuuuucuuaaguauacagugcacuguuugaaauguauuguugaguauuacuuuguacagguugaucacuuuuuuuagagugaagaaagaacaaacuuguuuuuuguguuuuuuaaaggaauauaaaauaaugaaggauguauaauugaugccaaauaagcuuguucuuuagucacaccgacgucuuauuuuucccuuuaggccaguucuguuuuuaagguguacauggacaauguuacaguguaagaaacuccauauccauauguucccauucgcauuuuguauugguucauguauaccauuuuuacaaaaaaaaaaagaaaaaaaagaaguacuauaaaauaucugucuucuuaauaaaaaaaaauuaauguuacaaagugauccuuua

SEQ ID NO: 15979 - RNA, 953 nt, Homo sapiens
cccucccuaaccuggccaaaaggucguggccgacgcacccacugcgcauucacggaagccccacguccucacgcucccuggcgucacaaacgaaaacgcccguugcgcuugcucucagcgggcgacgacgugcgcggacggucugcgcaugcucgccaggauaccccucguuaaaggcaaggcggcuucuggcucuuccgcaggcucaguuauggguuccugugugcuuagucaucggguccgacacaggcuggacugaucuggggagccgcgaagggccugccuucacaaagggacguaacgcaaguacugcgggcaguguuugaauauggcccugaacaaugugucccuguccuccggugaucagaggagcaggguggccuaccgcucuucccauggcgaccucagaccgcgggcgucagcguuggcgauggucuccggagacggcuuccucguuuccaggccugaagcgauucaucuaggaccucggcaggcggugcgaccaagcguucgggccgagagccgucgaguggaugguggcggccggagcccaagggaaccagauggccggggccggagccgccaagccagauucucaccuuacccaaucccugccguugaacccgaucuccuaagaagugugcugcaacagcguuugauugcauuaggagguguuaucgcagcucgaauuucaguuuaaacgaacaccuuuccucuggcccucacuuagcuugugaacaggccuuuuuaaaauccuuucuugguguagcagcaaucguguuguuuuauuuuuagauggauguauuuucauuuaauacgugggaguuauaugaauauguccuagcacuaagggaaguguaacaguugauugauuuaggugguuuuaugcagccagaacgauuggaucaggaaagguguggaagggauauucuuaggucgucacaaagcugagc

SEQ ID NO: 15980 - RNA, 317475 nt, Homo sapiens
aguccugggcuauccuuguguugcaaggaucuuagaaucgaaauggagggauuugacaacuuuaccuaaccaaaucuaaaauuuugcuuuuauuauuuacuaguuaucaaaauaugcaaacugcugauuaaggaaggcuggguagcaggagcgccugcgaaggcguaggguagaagugugaaaagaaaucccagcucucccagggagacugcgugugaaagagcccggcucccccaaaagcuccaggccgcguuuugcaggcuuccgcaucugccucccugucucucuuaccuccuugauguucggcacuauuuguggccggcgugguggaaggacacagugagguucucacccccgccccccgcuccucgcucccaucccaguuccaucaaaacgaacccgggccagcgcaaggaucuccgaguugcgagugugcugaggcugggacugucacucauucuccgaucagcgcgugaacgcagcucggcugccgcuggcaggaaacaauucugcaaaaauaaucauacucagccuggcaauugucugccccuaggucugucgcucagccgccguccacacucgcugcaggggggggggcacagaauuuaccgcggcaagacaucccucccagccagcagauuacaaugcugccaaacuaaggauuucauuuggacuuuguuuuuccugggaacugcagguacauuuuuuuuuuuuuuaauucucaaucugguuugcuaauuaccccuuccuccuacuccuaggaggaacgcuauuauuuugggugguuuuacguggacugcuaaggcuggucauuuucguuuagcugugaaaggagcgcgucgcccuugcugcccagccgaaccccgcucccuccagggcugcgcugcacggggcugccuccccgagccgccagcgcccggcgccccuccggcgcguccgcccuucccacuuugugcgcccgcggcggugggagcagagccggccggcuccuggggacucagcggccgcgcuggugaugggcagcgcuccuuccccaaaggcgggcggcggggcgggggaggucgcggcucggguggugccgccgcacgggcucggauuccgagggggaaguggcuugucagccccggcuccgggaagagugaacaauaaggcuagggcagccgccccagaucguuauauuccugggucuaauaaagucaggaucgcugcuuugcuucccccgccccagaagaauaacgguuugcaaaauggggcaaaaugggcagaaucgcacggccguuguuguuggugugaccguuguugcaccccagucgacaugacguuaguuuuucauuugccaaauugcugguuaguugcaaagccuacccucggccgcgagcacugaaggaugggagggucgagcgccgcguuuugacaggaggaagugcggaggggcggagggcgaggagggcgugauuggggcugccuggugugugcgcgcgcgugugcgcgcgugugucuuuacacgcgccgcgugcccaguguugcacggggcgggagaagaauggcagguagccgcccgaaacaccucgcccugucuccuuucuuugggcgagguucccgauccuggcaaagugugaacaauagggagcugggaggaagacaguagugaugcugccgcggguggcggggguugcgccgccgcccagagaaccucggcagugugcagggaggugcauuucauuuuggcuauuuccaucccggccucccuggaaaauucuucugugcgugcccacccuccccuccagcugucauccccccaccuccacccaaggauuugcgcuuuggcucugauggacgggagggaaggaagaaaagcaggggccgcagagagcuggguggguugggcggacauucugggcggggggcgugugcugggaagcgaucgaggaaagccgggcggaggggcugugugucgcggucgcagcuccagguaccguuguaccugcccuggacggccgacccccgguuggggagcgcacggggcgggccagggagcacccagugcgcccccuccgcgggcggcacaagagcagcgcucggccgccgccuccagccaacucgggucccucccacggcgaccaaucagugcgaagcuggcugggcgggaagccgcgagaggcuuuuauugcggcgcggguggcggccaggagcugccaggacagucucccggugcuucagccuaacggucucgcucacucaccgccaagagaaaccccgcccugcggccggucccccgccugcccggcaguuuccgaggaaauaaaauggagacuagguggucaccgggagugcuccugguccggccgcccgugcucgcccacucucgccucuuucacgccgacuuggagcaucccaccgcccccgccagcgcucacucucgcgccgcggaauccgggccugagcgcgucgccggggagggcauccuggcaggcacaccuacgcgcgugcgcugaccggccgaccgcgggccgggggcucuacugacggcggggcggggccguggcagggcccggagaggagggguggggaccaagccuaguccgccuggcccugggucuccgcugccaccugggcgggggccaccccgguuaugccccuuuccgcggugcccgugggugccgcgacgcgaccuguccacauggggcgggggaagggggguguuuuugagacauccucgcccccgggugggagcgugacaauggagcccggauauuuggugggccuuuugggggaucgccuggcgguccuuuccaucaucgugauggguacagucaucaguauuuggaucccguggaaguugcaggcccaggaauucccacugggauguuccuggaugcccaggcaggggaggcauucuaaccaguguucccuggaaugaaagcgaccucuuuccuggcccgguaccuugaggaugggaagaaggcagaacgugaaacacauacaagguugcuuaacaaaagaaagaaguugaaugguuuuccaaagagaaauaauuucccauuaaaaugucuuuuguaccauaguuuuuuuuuaaaaaaaucaaagaauucaagucaaaggguuagaaugaaaaugaaaacauaacaacaaguauauauacauauguauauauaucugagguuuuuuuuuuguuuuuuuuuuuuuuguuuuuuuuuuggacucaaauguagcauguccagggcagugguaacugaguuugugugcucggcugggugcauaugaaaauuuacauauaaggcaagcuaaccuuaauacgucaagugaguccgaugggcugccccucuccucuuucuguguccucugcucuuuagaaauacaaugaaagguugugcaauugcauaguaaauuugaguuuauucuaguauaaauuuuggauguuuugaagaauuguucgcuugaacgaucuggaaugguuaagucacauguuuacuugauaauuuugcagucuucugccaguuaaacuugcaagagucaaggaauggauaggacuggguuucuaacaagauaccaucgguuaagaacaaagagcuacuuuacaaaagcuaacauugaaaucaaguaguauauauaauaucucucacuaagcaaauuaaggugcgcuuccacaaaguugacugugagcacaguuauagugagccauauauuuuuguugauuuucauuugaagacugagaauguguguuuuuaaacagaauuucacugaauguaauaaaggcuauauaagaauguggaaaaccuuucacaacucuaaccaaacccuagaaagauuauuuucuuucaauaaauacuagcauauuuagaaauauuaauaacugauaauuuguuuuaaauccaacagaguuauuaaaaacagggaauauaauccagacauuguagacgugugggcuaugauuuauguaaguuuuugaguuacuauucccucuauaaaggucuuaaagaucugcuaaccuagcuaagcuuccauuagucuuuaacuguuuucuuaaguuaaugcuuuaugaacgcccucuuucuuucccuaaauuguugaaccugauaacuuccuuccagauaccuuuaucuaggauuuuuuuuuuaaaaauggaauaccagaaaauagcaggacauauucuuguuuaguaaaggaguuuccucuaagucuuacaaugauaauugauuaaacuaagaauauguugauuuaacuggugacugguuucuugaguuugauaguucaagaauuaagauaguaauugcaaagaaaaaaaaaucccacaucaaaacugaaaaaaaaaugaugugggugugcuauuuguaagggauguggguguuuacugaaggcagcaauaagaaggagaaauuagucuguagcacccccaaauuccaaguuuugaacagugcuucuguuuggaauccauuuaucauuaauugaauuccucagauagguaauauguaauuuaauggaaguaaccuauaucuguauuuuucugucacaaggaacaaugucuuaauugccuuucaaaguaaacagcaccauuuugucacucaaaagcuaaucuuuagacauguuuuuguucacuacagaacccaguuucucaaauuauagagagcauuuuguaaaauuuacacugcuuaaauaauggacucuggaauuucugaugcaaccacuuaauuuuucaaggugaugaagccucuguuaaguaugaguuugauaaauuucucauaauuuugucuuuaguauuaaagaacuguggcugcucuccagacugaaaguggcuucaauacuacuggcaggcuuccaaagacauuuuacagacaguccuuucugacuuaguguaaaauaagugauugaguaccuguugcuaaagaacggguugcacuuuuaggaucuugagcuugugauggagagcagaaccaauuggcaggccagggagagaagggaucgcaccugcccccgucagucugcgggaagaaucauagacuaggaggagacaaagacaucuuauaaaggcucuccugcaccaguucagcauugcuuuuuugagcacacacauguuuucuggugucaagauaaauauuuuaauguaaauuccauaauugaucauuuuucaguuuagcaguuauaacauauagacuaaggaaugucuggaacuuuaaaagaaauggcagcacauuacagggagcauuuuacugaucuuaaaacuggguuacaaauuacacaaaauugaaaacauuaaucacguggcuguauaaaaugaagucauuugagcuuuuaauaaaagucacuaaggugaaaauuccuuugguuaaaaagaaagaauucuaaguaaaauucgaagaagaaaauuuuuuacuuuucauaauauacucagugacucugagcaaugcuguaagagauggucuuuuaggaaggaggaaauguccaaggaccucugaauccuaaugauuagguuucuaugagcuccagaguuuucacuauucgaaaacauuguagugaaacuauuuuuaacaauacagguagauaugcuuacuacuuacuguaggguaauagaauacagaagucaaucugaaggucauaguccuguuaccucuagccucuuuuguuauuaacucuuggggccaaaccuuaaaaccauuugcugauguaaagggauguaaauuauuuggcguuggcaguggugccauuaugccuuuucauuucauguuguugaaauacugucucucagcugcagaugcucauuaggagcauugcuuuuugauguuggccugggugccaaauggcggccuuucaggcaguuucaauacguuacauuuaaaacaugcucaggccaugucuacaugcagccacugaguuaacggauuuucaguuggguagacacacuuuuccuuuccugcaguauuaauuuagcuucuaagcaauuggagacuccaagaggacugcacuaaaaggauaagcuauuugguguaucuuguguaugugugcuuuugaaaaacagauuguaauaaacccauuaugcauucuauuuucuuccauauauacguaacacuuucuugaauucaaagauugcauggcugauaugauuuaaaaggcuucuauguaaccuauauuccacuucguacucugaggacuuuuugauuuguagcugcaaacauggguaacagcugaucuuccguuuucuauuuggcgucauuccugagauaagguguaaaaugccuuuuguuguacauuaaucaccuccuuugguaucugauuaccucaucauuuaagaauauucauaguaaugucacacuguuugagauuguguuacauuagguauucucuuaaauaguugaucaaauauguuuauugagugccagcuuuuuaucaucugcucuguggggaauuaaaaggagugagaugacauaauuucugcugucagggaaccuugggaguaguagagacuagagauuaagagagguagauaacccuggguugaaaccccagacauaucccuuacuagcugucugaucucagacaaaugauuuaacuccuucaaguuucaguuuccucuuccgugagaucggaaaauuaguaaugccuacuuguuagaguuauaaauauuuuagagaucuuaggacuucagugcauguaggcaguguucauuagugagcaagaaggauauauauggaucuggaaaaaauaauuauuuagacauagugcccucuuuuuagaaggauuuuaaaaaggguauuaugauacacaggacuccuucagagauuagaacuaggcuuaaaaaauuggucacuaaauaugccugcaauuccauguugguugugaauacuucagagaaaaaaauggccugauuauaagguugaaaaccaucagcacaaggguggaucuaggucuuguugggccugaaggguauauaauuuugagggccuucuuuaaggaaaauacaaaacucuucuugcuuuugcgaagguuaguugaauacaugaccaugagaacacauugccaagucccagucccccagagccuuggaaggaguccaugcaguugaggaacccugaaaacuucugguccuucuuuagcaacuauccuuugguccacuuggacccacuugcuugggaauauaaacuaaucguuccaguuuauuaaacguggaccucauagagguuguauguguagugcuuugaagauuagaaucauauauugaagucaaagucauuuuuagaaagaaguauuucacuuuuauuugacagaagaucuuaaaugagaucugagcugauuugauauuugucacugccgauauucuuguaaauuacuaacuagaagaaaauaaagcaauugcuauuauuauucaaaugagugagauguaagugcccgauuggcagggcaagaaguaguuuugccagcuaaaggcauaugauauuggagaggagacugaagauuuuguuuuagcuaucuaaaaggagauaaacuggauauauaauaccaauaauuauaucuuaaucaucacguuaugguuuacaaaacacuuugauaugugcuuaaucuucacacuaauuauuuaguaaauauugacugaguacgugcucugugcugggugcugggaauacagcggugaacuaaacguacaucgucccuguuuucauggaguuuccagucuaguaguacagagaaauauagacauuaaaaaguaacacauacauuuauaauuacauauucagauucaagucuaagaaaaacccaggaugagagauuaucaagggggauugggugguuggggaggugaagauguaacauuuaaacaacugugaaauaggaagaacagaugguauucucauuuuagggcaugguugauugacuacuuaauucaacaaacauugaauuacaacaaacauuccugaauuccuuaacucaacaaaccuuugugaagucuggagaaggucagauagcuucaggaaucguguggaguuucacguuaugaaguccaggaaaauaauacaucugccuuuagagcuuaccaccuggaaggaggggagacagacauacuauacuuauaaacagaggcaugaaguaaaugcuguugggccacaagaaaggaagcaauuaauucugccugggacucccucgagcugggcuuggggaagaauugcuuucauuagauggagcaggaagaaggggugaucugggcagagcagacacccugagcagugguugagaucugaaucugguuguacauggggaacagugugagaguaguggggaggaguagccagagauaaggagaaaaaaaaauucugcaaguccagauuguaagucuuuaaauggaaacugagacugagaaagguuaaaugacuuaggcagguggagcugggacugcaacuuacguucguugucugaauuuuauccuuuucuaaggcaaggauaauuugaauauauauagcaucugaauacaugccaagcaaacaggaauuccuguggcuucuggacugagucugaccaaagugugggaggagugauggggaggaagggcacuauucagagcuguggucugaaggaaccguccugccauucugcaaguugcugucguucugagccuguuuccccaucuguaaaaugggguuaaugacacuucccuugugggucuuggugagcugaaauaaaaccacauauguaaagcagauauaaaguauguacucauuaugugcuuuaaaaaaguucccuguggucagauauuuuauuugaaauguuuguuuaaaaagguguacaguacucugaauaugaugugcaaaguucugugcuagaggcuuagaggaaaaacaaaauaaauuuaagguuacuauacugacccuuucaggugguuggagaggaagcacuuuugcuuaguucaagcugcgaagaaaucaugaaagauauuauaucaguaagugcccgaaugaagcaggcagguaaaaacugggaaaauugagaggcaaaaaucaugucuauuaguuuuaaugucugggggaaaaaagagguauagaaaagcuagaacugaccuggaccuccacagauaugaagguaaauagggagagagggccuguuuuccuauaggaugagguggaucuggccaaagaauugcuauugaagagcaguuaaaggcuggaacuuggggcaagccauauuuaaaucuuaaaugucagacaaaggagaggaguccugcuggagaugacagagaaauuaaaaauauauauauauguuuaagaggauaguuaacaauagcaacugagcgugugcugccucaggcucuauguuugggacuagcugggaauuagcagagaguuaaguaggaacaaauucauauaguucauugcagcacuaaaagggaauucugguuuuauauagcauccacuaugguggucggacaaaaugaagggcuaacgaagggauuuuuauugcuguaugaaacaucaacuagaugauacuaggagaagggaggcuagugaaguccaaugaaaguaucuugcuuaaucaguaggaacaccuguaugcggggaaaggacaccauugggcuuagauucgaaagaucuggguucaagaaguugcucugcuacuaacuagccaagugaauuuauaucaguuauguaaccucuuugaacuguaacuuccgcaaucgaauauaagaacaaaauaagauaauauaugggaaaugcauuguaaaugaaauauuucacagcuauacauuuuauuaguagacauguugcugaaaaauaaaaaucaaauuuuauguacugcuagaggugcuuguuugauuaaagaaacccaacuaugauauauuuucuaaagcaggaaauuuuggaaagauacacuuguaaugauuuuggauaaggauaaagggggcauagcugagauguuagaaauaacaaagcaaccaaggguagaugauagaucccaaaugguagaugacugagagggagaaagaucuuugaaguuacaaacucgaggaaauuaaauaaucaugguacuguaaauaugauggagaaauuaagagacagguuagguuuuagaaaaaguuugggccuccuaauaccuuaacuuguaggucaguauuuuucaaacuauggaugaugaaaucuguuuaacgggcuuccauauauauuaagaaagaaguaagagaggaaggaaaaaggggaggaaggagggagagaaggagggaagaaguggaaaaagagaguguguuuuauauaaggguaaguacugcuuugaguacuucaauuucucucucucucucucucugucucugucucucucucucucucucuguguaauauguaacuugguuguaauggaaaauacauucuuuuggcucaggucaaaagaguuuggaagcuacugucaucgaaggaagaaugugggaucaaagagagggugaagcagucuguaguggaguaagaguacgucagaagguauagaauagaaacugaauggguugugaggguggggaggaagaaaugacagcaaaguuacguauugagcaucuaagcagucaguuaacgacagggugugaaaaaaacaaaacaaaucaaacucuaaauguuauaccuuuuuuugaaaugguaucucacuguguugcccagacuggccucaaacuccugggcuccugccucagccuccugaguugcugggacugaaggugcacaucauugugcccuaaauaugguaccuugaccuuacagaucuuacugucuguuugggaaugaaaagauaacugggaauaccagguagcaucuacagccaaaauaugaggcacuuaauguuucagagucaggauaaauauugccugggaaccagagggugguuacagcuguacauucuauuaguagacauguagcugaaaauuauauaaaaaucaaauuuuguguacugccagagguccuuguuagauuaaagaaacccaacugugguauauuuuuuaaagcagauaauuuuggaaagacacacuuguaaugacuuuggauaaggauaaaaggggcauagcugagauguuagaaauaacaaagcaaccagcaaggguggaugauggaucccaaaugguagacgacggagagagagaaagcucuuuaaaguuauaagcuugagggaaugaaauaaauaugcagacacuggagaauucacacaacuuuaggugagaguugaaggagacuuugaaggaagaauuuaucuccgcugagaggaaggguugaugagguaaguauguguguucccuguuugggaggugaauggaggaaucccaguuaaagagacuaggaagacucaaagaugguaguaaucuauauuuuuauauguucaguggagagaaaaacaccaugaguuauggucaguacuuugcgggguuuuuaucacgcccacaaguauuuauguggcaguguuuauguagcacacagaaugauaucuugccuauaauucagaagguaauagugaacaaaugaagagaaccagagcuuaguggcacaaaagccuagguuagaaaaguauaauaaagugaagugaaagaaaguuggaaacaaauaauauauauagguauaaucccaaucuuguuaaaaaacgucuuucacucacccuguaaucaagacuggaagacgguaaaucacuauuuauguugucugaguuuuugauaaugagcacauauugcuuugcaaaacaaauagugcaguaaaaacaagggcagcaguacuaagggugguuaaaaguauaaaguaggugagaauuaaguagaaacuugggauuugugucagaggagaguagugaugucagagggauuucaguugaauggugaaauucaaguucuuuauuuagagucaaagacugaggaagagcugauguccaggacacuuggcaaagaaagaaggaaaggagggcugcuaguuugggugacggccucaucaugaagcuuccugggcgcauugaacuaugcaucaccacggaaaagagccagagggaggggagaggugaugagcaaccuuugcaaaggacaacaggacaauuuuaugccagaggaaaugaauaaaguuaaggguuuuccccagugacuucauuuaucauaugaguugauuauuuuuagauucaguuuugucuucuuaccucauugccugugguguucauacauuuauuucuagaccuuuaaaaaauguuucuauagcaaaaucuuuugaagcuuguucugcaugucacaaauuggaugugcuguuuuuaucagaucagcacaggagugauugauuacuuuucuaauguucguuuagucauuuucaauuugaguguccauucuguucacaugagaggcugccagucaccaguuaagcugcaauugcuauaugagaauuggacuuacaguacuccauaaagguguacuuuaagcagccuuaaaggccuguuaucaagggcauaagaagauggaaauccaaugaaagcucuuugguuuggguacauaauuauaaauuaucuuucuuucuuucugaauuuaguaucuccuuuugguguuggaggcagugcauacugcacagggugccccauggaccuuugguaucaaacccacauuucgaacugugacucuccugcuuuucaugaccuugagccaguuauuuaaucuccaacggucaguuuauuuaucugugaaucagggauaauaccuaacuaauaggguuauugugaggaugaaaugagguaguuuauacaacugucuggcacauagugagcucagcaauuuuuucccauauccuuucuuucugcuaaaguucacagugaagggauauacaauucgcguuggauuuaaguauugauucuaaugagaaucacauuuuccauuuauuuuucauguucugagaguucaggaucacugugaauugcaacugaguuggaaaugccaugcuucauuguggagcuguuuuaccuccuaugaaagcaaagccuaguagaucuugauuuugacaaaaguaauaguuaaaaaauuaaaagugguuuaucuagauucuccuuuccauuugcauaggguuaauaucaaaucugucaauucacuauaaugguugagccauaaaauuuaguguauuuaaauaaugguugcugcuaaagaucauauuggugacacuucauuaaucuggaagucacuuaaucuggaagucacuuaccuggcaacccugauucuuugaaacaugaagaaugaagaaguaacggaaagaggccucugaagagcuagcauagcaucuuuuucuuucuugaugcaauaucuuucauaucgcugaggaguucauaacauuucucuugcuucuugucucuuuuugucugaauuccucuuuauuauguuugcuguuguaucuccuuuuguguuucauguuguuucauuuaacuccucaaauucuaaugaucccuggcugccuauuaguaaagagugagacccugaagagcuguggggcucagugugggaugucacacacugaaagacugugcagaaacuugguuuauugggugggggacauccauguauauucaugaguacuuacauuuucuuuuggacugauugacuuaagagaauccaaaauuuugcagcaggcacgguauaaguccaacuacuauuuuucucuaagcugaauaagaaauggauuggggguaauuuuuucuucuguagucuagacuucauuuaauucuccuauuuucaguagggugcuucugcccucaacaaagucugguauaugcaaggacaaagugcaucugguucaaucucucuauuuauaaaaauugagccuucugcugaggugaggggaguaugggagaagagacauauggcugccacccuccuguagcuuacaguuuguguguguguguguguguguauguauguguguguguguuugaauuagugguaucagaggcucuauugacuuuaauuuuggagcagacucagaacccacugaugaccuaucuccuucaggguuucuaauugcuaaaguccaaagcgggcuuuuaaaaucuuuuuugaagucuuuuaucuugcacguuuuaggguaggaucguugagacugaaagaagcuugcaguucuuaaaggaaaagggacaugcucuaggggugcaucaaaggcaaaaacccgaacagaggaauguucagacaacuucaagggauugacaauuuaaagaguuuugaggaaacuuuucugaacugaagcauucucaagagauuccaagguggccugagauuccacauuucuuugauagaaagacguggacuuggcagugauuuugcaaaucagaacaagaacaauuuuaugaacacauuggcaaguggccaugucucagacuuguuggguaguuaaauguccacuagaaacauugacuuaauccaguauuuaugaaauaacucccguauucuauguaguuggucuaggaauuggaggugaaagaugaauaccauucagcuuugugaaaaauucuagaccacguucaaaaaguuuuuuguuuauacuuguaauauuuaugccuguggaaugacacaaaagacaaucuugaaaugucagaaaaugauaaauaagaguuauuuguuauuuucucagcauuuuuuuccuuuuguguguguaagugaaaguuacucaucacguuuaaaauuuaaaauuuucaucaaagaaaaccaucugucauaaugaaguaaaaaagggacauuaugugauuuucuuugaagauaagggauugaaagugagucaguuaacugcccuagguuaccauuugaggucauuuugaacuaaauuggcuuuggaaucagaauuuaaauuaccagucagacucaauuaagauaacuggucaugaaggcaguucauucgccugccuuccuucuuauaaaaagaauauuuuuauuauuuguauuccuuuauagccaaguuagacauaugcauuauuuuugagaauauaaacauuucacacaauaauugauuuaggcauuuaaggguaguuuuguaucuaaauaggaaaccagaaaaaucauucacuauuuuguguucuagugauauucacaguagauacuuuugaagucacugggagguaaaucaauauauuacugaguuauauuuuugcugcccugugcaauauuaagagaauagcuuucacaaacaaaccccaguuaaaguuauuuagucacaauaauaaaaguacaauuggacauauuuuaagaaaacauaaauuauaaauaugugcaguuauuuuaacaauuuaugaauguauuucuaaauacuaaacuuuuuguuugugauaagugaguauaaaaauauauauacaauuauauacucuuaacuugcucaacaugagagauuuaaaaugaugaguuccacugugaguuuaaucuucacuuucaucuuuuuauuuauuuauagacuggaacaaauaaaucaauuuuuuaauuauaaauuuuuaguaauugaaaauuauuaaauguacaaaggaggagaacuuuuagaauuuagaaguacaaaggaggaaaacaauuuaaaccuacagauugauuuggugggauugguuguaugucugcggcugucuggagaauccaggugcuuaagugccuuggacuagcuggacacugaaacuucacagggaaacaaaaaugucuggaaugacuuguugauguucuugaaaugaugcuaauaucuauucuauaaaaccugaagguauguagauauuauugucuguuucgagucauguaucuugggauuugggacuguuggagagaagaucgguuugauuuagaccaugauagguauugaucuauauauauuuuugaaauauuuuggcuaaaaugcaauuugaugugguaagucuuauccauaucuaacauuuuaucuuaaaacuauaucuguagaaguuguuuuuuaaaaagaacagaaaaaucgaguugcauuuugguguuuaaugcauugauuuuaaaaaauuauauucagagcaaaauguuugaguuuucaaugauuuuuuccuuaaagcauuaggugcaaacgucagguaauucuaugauuagaauugugucgugauacuuugugggugaagacaguccaaaaccaaaaaugaugagacaagugaaaucuuuauuaaggaaggccuaacagcuguaucagauaaguuugcuuuuucuuggaaacuuugguaaaaaaaaaaaaucaccugggaaauaaugugauuagagaugcuucuuaaaugugcauauguguuuagucuguucuacaaagauauuauuuucuuuguagcauuguuuuauugaacaaauuuuguuaaauuuucuauuaaaauagucuuauagugauuuaauaacaauuuggaaaagucgcaaucuuuauaagcauauguguaagugagauggauuacuauuaaaaugcaauuucuaguauuauagcucuuuuauaauuugucuagcagauuuucugguuuucaccacgaaagaaaugucauuucuuagucuucauuuggaauuuauaaaaaauuuuaaaaaucaccacauuuuccaaaaguuuaugccagaaaaucauucacuauuuaaaaaugaagugcaauuucuuaauagaaaaguauagauugagucuugucccauauaaaugaguuuccuagauuuggaaaaaaauuaauacauuggaaucaauaguugaccacagauuuaaauaugauacaaaagguuuaaaaaucuaaauugucauuguuuacaaaauacuggcaaauuagagcuacagcgcuugguguuauuguguaaucuucuguuuaaaaauaaacaguggaaauaauuguagaaaccucugggcuuagaaaggcuuguuggugguucuucacauccuacuaaaaaagcaggcugucuuugcauauuaaucacucugugaaaggaagcuugccuuauuugcauugugcaugcacuaagaaguccaauagugugccugagaaaaaaauggggggauuguaauuguuguucucaaaaggguuuuuauuccauucaaguggaaaagcugaauacuggagaauuagugcaguguuuuguggaagaagagucccuuuuggccacugcauugcauguggugcaaucccaguguguaaggauccugaacguuggggugaagaggaaagugacucaucuuucuaugaugcaauagucuauguucuuguacaucucuauaauuuuguaagcauuuucuccuuguuauguauccgaaaagagguagaaugaaauucugagaauauaugccauauuggaaaucucaggagaguuaaacaugaaccaaaaaaucuaaauugguguuuagguuuugggaguggggugagaugaggacacacaacauaaaauuaagcaaauuguauuuaaguguuauuguuuuuagaaaauacgugauucgguuaaugccuggaagauauuuguccaccaaauugauuuuaaaugauauuuuugacauuauuuuaguaauaauggcauguuuuuuucuucauuguauuuuaagacucagugguugaauguaaacauugagaauaaagagaagaaauguucuuaauauuagugaggcuuucuuuuaauaagacuguguaagaugagcuacuuauaauguuucucuucuaugguaaaacacucuucaugaaagcuuuuccugaucuccuaguucuagcuggcaacagccacauuagccaguacaguuuccaaaaccucaaaauguacauuaauuauuuuggaggucuguuacuuuggacugguuuaauauacuuuacauauuuuuagcaucuuuugaaaaauucugcacagauuauggcauuuccaaguagauuugaauuucacaagggggaaaauacgccauugucuguguucacauauuuugacaaaaugauuguguauaaucauggagacaaagcuuauuguuuuaaaugauuuuguuaaauacuagaaaguaguucacugaguuaaaagguuucauacagguuuccuaaaaaccauuuggcuuagauauauuuaacuaucugugaaacuacuuguuauuauccucuuuacuauuguauggguuugguuggauuuugucuguugaacacagauccucugauuuuauuucgauuuuauuugaauugcuuucuguaauauucaacuacauggaaauuguguuuaauuugggcuuauguagagugguccauagacuuugaguguguguuuggguugcuguucugaagaacagaaguagccaagaaguagucugaaaaaguaggaccauaaaaaauuagacugguagaacaaaaaagaaaaaaaaacaaacaaaaaaaaccuguaauuuuuaccauucaaaaguccuuauauagguuucauaauaaauuuuuuuccaaaauauuacugauguacuucuccaaauguuuauuauagacaugucaaaagacaaaauuaugacaaauuuaguuauaaaucaaauugucuuuuauuugugauucauaaauuggggcagccuccauucaacaaaauagaaugagagcucccacugagcaauggcagaacaguggguuuggaaagugggaacaaggaaacaacuauagaaaaaaagaaacugguuaacaucagguuacuuccggugacucuuuugcaaguuaaagcagaggagacuucuuuauugcacugacucaggucgacuggaaucuccuguuuucaggaaaacccaaucuguuuugggaucuaucugcuucuuuaacguuucaguuugauuauauggcauuuagcuugagugacuccauuuugguuuggucuggucucuugggguugggugcagaagcucagucuaaaacaaugggcucccauaauuuuuguuuaacggacauaauuuuuagaauguauacuucauuuaaauuugaaccuuuuuauaaaaaucugaaaugcauaacacauuuuuagaauuguguagacuucauaaguaugcaaaacaaaaacagcugguaucaagcaccacuugaucaccuuuaaauucagaaaacacacuugacaaaaugcgacaccccuucaggaugaaaacacucauuaaauaaggaauagaaaguacuuccuugaccugauaaagggcaucuaugaaaaauccagagcuaacauacacaaaugggccauaaggacaaauggccaaaagaugucaacaucauuagccaucaggggaaauguaaaucaaagccacagugagauaccacuucacacccgcuaggauggcuagaaucaaaaagacagguaacagcaaguauuaauaauguuguggaaaaauuggaacccucaaacacugcugaugggaauggaaauggugcagccucuuuggaaaacaagucuggcaguucuuaaacagaguuaccaugugaaccagcagcucugcccuuccaagagaaguaaaaacauaugucaguauaaaaacauguacacuaauguucauggaacauuauuaauaacagucaaaaaauggaaaaaaccuaaauuuccaucaauugaugaauggaccaaaaaaugugguauauuuauacaauaaaauauuguugggaaauaaaaaggaaugcaguacugauacauacuacaacauggcugagccuugauucagcauuuuaguaaugugagcuccuuaauuguguuagcuguuuguuuguuuuuuuguaaccaugaaaguuuauuuauuuauuuuucaauaguuuugaggguacaggugguuuuuuguuacauggauaaguucuuuaguggugauuucugagauuuuggugcaccugucacuggagcaguguacauuauacccaauauguagucuuuuaucccuaugaagguuuauuuuaauccuagcacuuguuaauauuuauccuuaauucuuacuaacuuuuagauuguggguauuauaucuucaugagaauagcuaaaauaauuuuauuuggauauuccucaaagaacuauugaaugugagcaugcuaagauuaccccuggcaaaauggaaaaugccuagcaccuggaagcaucuguuucugccggucuucuaggagagaggaaauauuuaugucuuccauuuauguauuuugacuggggaaaauuuucccuuuuauucuggggagcuguuacucagcauaagagaauguagaggagaaucaccccuuucacauaucuaauagcuuuaccacauuacuacaguaguaucuuauguuguaugcauugauugucaaucucuucuccucaucuccaccauuuugauagcuuaaggcuuaucauucauucucugugcauagaaaaaaaaaccgaaaugauguuuuccaguauuuuguaaucuuuccuucaugaauugcagaagaaaaguguuuggguuuugucccauucaucauaaagcgguacacaauagauacgguugcauuuuaaagcaaggcuaagauggauuuaagauguauuucuugucaugugaaacguccuccucaguggucuuaaauaaaauauuaauuagauaauucugcagugauuaauaugaaaaugguuacauaauucuuagaugguauguauuguguugggcuaacaccacauugcuuuucuagaauacugguaucuaugggauaccauagauaccccauagaauacugaauaucuuaugggacugcccuuucacuaaaagcacaaaucuuuacuaguggucuugagcuaacuggaacugcuguagaucacuugcaaauuuuccacuaggaugcuuugguguauuuggugcagcuauucccacaaucacuuagaguaggcaugcagagggagcuaacccauaggaaauuaaggaauuugaagaaucuuugaaaguucaucucauuuaacuucuuuaaaacaaaauuugugaacaucucagauaagaaucugucuuuaaaaauaagacaucuuagacauagagauggagguuaaaguucaaagguuuuuugcauucaaauaaaauuaguuguugucuuucacuagguggcucucuuuuuuuuagaaugaguucaguauuuauucaaguaaacaaucaaguuuugaugugccuguucagacagacagcuuauuuuaugauacagguggcaucaagcccauuaugugacuuuuccuccgcaagaaguuuguaacuuccuuuggcaauugggaugcacuucccuauaagauguuuuauguggugguuuuguccggauuaaccaaaaugcaaaucuucauauccucuauagugccuagcaaagggucuugcacauaggugcaaguugucagaguuggcucaguuucacucugagccccuuguagauagccuuuauucauuccugcauucuacauguauuuaugccuuugacugagagguaagaucuaaaaaaggaauagauauaucugaauucauuuguaaaaagggugcuagcuggcaauguaugcaaagguuugguggcagugaguaaacaagaacuggggauggccuugcucaucagauggggaaguaaggaggucauuggaagcagcagauucugggaaugacuugaugggagcauguuuugggaaguuggauuuguugcucuucuuuuggaagcugggagagauuacagucuggaaaaccaguagucaggggguaggaggagcuacuguagaggcugugugaggugaugggagguggaauuggaguucugauugugagauguaaaggaaggcauuaugcaagaaauacuacagagggaagauugaugaacuuagugacugauuuggauaugcaagagaggaaagaauggagauuauuuagauuucaggugaggcgcaugguaagaguaaaugucacuagcaacagaauugaggaaggggaaaauagggacuuuuaauuuuuuaaaaaagguaauaguuuggcuugggaaaggugacccugagauuaaaguggacugucuaggaagaaaagccagguauaccgcuggaaauagaagucugcaguuuuuaggagagaucacguuagagacauaaaucuguaguuauuuaaguaguagaugguucucgaaggauaaguccauuuagagagagaagcagagaggaccaggaacggaacuuagccaagcacuuauacucugaagaugggcaguuuucauauguaauaguuauuaaaaagugguaccaagucauuuaagcaaguuacuguuuuguauauuuucaaaaagaauuaaaaccacagagcugcccuuuuuauauggugguacugcuuucaauucuuauucucuuuuuaauucacucugucucaguuuuaaugaaguuuguuugcaguccauaccaauuucuuguugggguuuuuaucuucuagugcuuuugguaauaacauagcugauacaugaaagauuguguagcucucauggauuucaaaucuuuaggcauuaaugaaauuauauuccaggauaccaggagaauuguaaauaaauccauaaacagcuacagaaaaugauuuugagaaaucaugaaaaugaacaaaaauuuggauuuuuuuuuucaagugggaagagggugaauucuucucccaggaagaugggggaacuuaaugcccauccuagaaaaguuuuaagaacugacaauuaagcagauuauaugggaacccagagaagaaggcuggcaucuaaugugggcucaguaaggacagguuguaucagaacucaauucugucuuuggcaagauuuccagacugaaaauggaguuuauauugcuuuaucauaauagccaaauggagaaauacaagcucagugcaaguaauuggucaaaugaccaugcuccucaucaacuuggaauguguuggcucugcauuuugcaggauuuccuuauuuauuuacuuuuuuaauauuuaagguguuaacuaugauguuuugauauacauguacauaacaaagugauuacuauagucaagcaaauuaacauauucaucaucucacauggucaccuuuauguauguauguauguauuuauuuauugugaauagaguucuuaaagucuacugucuuagcauauuuccaucauacaauacaacauuauuaccuggugaucauguggugcuuuaggucucuagacuuauucauccuccauaauugcaacuuuguacccuuugaccuacaucuucccauuagcuccucuccugacuccugcccugguaaccaccauucuacucuguuucuauguauuuaguuuuguuuguuuuagaauccacauauaaaugagaucaugcaguauuuuccucgugugucuggcuuauuucacuuaguauaauguccucuugguuuaucuguauugccuuaauggcaggaugucccucuuuuuaaaggcugaauaauauucauauauauauaugaguuuuaaaauucaucugucgauggauaaaguuuuuucuguaacuuggcuauugugaauaaugcuucagugaacauaggagugcacauaucuucaugagguggugauuucauuuccuuuggguacauauccagaagagggauuuuuucugggucauauaguaguucuauuuuuaauuucucuaggaacccccauucuguuuucuacuguggcugcagcagucuuacaugcccaccaacaguguacaaggguucccauuucucuacauggcuacccacacuuguuaucucuugucuuuuugacaaaagccauccuaacaggugugagaugcuuucucauugugauuuugauuuguauuuuucuaauaauuagcacuguugagcaccuuuuuguauacaguaucuguugguuauuuuuauguguuuuuaggaaaaauguucagauccuuugcccauuuuuaaauugguuuauucauuuuuuuuugcuguucaguuuguguguuccuuauauauuuugaauauuaaccccuuuucugauauaugguuuacagauauuuucucccaacccauagacuuccuuuucuauuuuugauuguuuccuuugcugugcaggaacguuuuaguuugauguagucccacuuguuuauuuuugcuuuuguugccugcacuauccuauuuuuuuuuuaaucauugccaagaccagugucaaggagcuuuuccccuguauuuccuucuaagaguuuuauagcuccaggucuuuaauucauuuugaguugauuuuuguguaugguguaagauaaguauccaauuucauucuuuugccuguggauauuuauugaagagacugucuuuucccuauuaugauuucuuggugcccuuguugaaaauuagggcauauaaugccacauaaugcauguaaugccacauauccuuggguuuauuucuggauucucuguccuauuccauuggucuauguaucuuuuuuuuuuuuugccaguaccauacuguuuugauuauuaucacuuuguaguagauuuugaaaucagauagggugaugccuucaacuuuguucuuauugcuuaggauuacauuggcuauucagagucuuuugucuuccagaugaauuuuaagauuuuuuucuuauuuuuguagaaaaugucauuguaguuuugauagugauugcauugaaucuguagcugcauugaaucgguagcucccuuuugguaguauggacauuuuaacaguauuaauucuuucaguccaugaacaugggacaucuuuccauuuauuugugccuucuucaauuucuuucaucaauguuguguaguuuucuguauacagauuuuuaccucuuuaguuaaguuuaguccuaaguauuuuauaauuuuugaugcuauuuuaaugagauuguuuuuagauuucuuuuucagguaguuuguuuuuaguguauagaaauauuacugauuuuuguauguugacuuuguauccugcaguuucacugaauuuguuuauucuaacagccuuuugguggaaucuuuaguguuuuuuaauauaaaagauuauguuaccugcaaauaguaacaguuuaacuucuuccuuucagauuuggaugucuuuuauuuuauuuuacuuuuucuugucuaauugcucuggcuaggacuuucaguacuauuuuaaacagaagugguaagaauaggcauccauaucuuguuccugaucuuagaggaauaucuuucaacuuuuuaagguuaaguaugguguuaguuguaggcuaacauauaugaccuuuauuauguugagauacaguccuucuauaccuaauuuguugagaguuuuuaaucacaaaagaauguugaauuuugucaaaugcuuuuucugcacuuauugagaugaucauaugguuuuuguccuucauucuuuuaauauaguauaucacauuuauugauuugcaucuguugaaccaugcuuguuuucgaggaauauauccccuugauuauggugaguuauccuuuuaaugugcuguugaauuagguuugcuaguauuuuuuugaggauuuuugcaucuauauuacuuagggauauuggccuguaauuuucuuuucuuguaguguccuugucuggcuuugauaucaggguaaugcugacuuaguaaaaugaguuuggaaguguuccuuccucuuuaacuuuuuggaagaguuugagaagaauugguauuaaugcuuauuuaaauguuugguagaauucaccauugaagccaucaggcccugggcuuuucuuugauaggagaucuuuaauuacugauuuaauaucuuuacuuguuaccugucugcucacauuuucuauuucuucauaauuuauuauucauagguuauauguuucuaggaauuuacuucuaggucauccaauuuguuggcauauaaucuucacaguagucucuuaugauccuuuguacuuucaugguaucaguuaugucuccucuuuuauuucugauuuuauuuauuucauucuucucucucuuuuuuuaguuagccuagcaaaacuuuugucaauuuuuaucuuucagaaaaaaacuaacuaguuuguugauuuuuaaauguuuuucuagcuuacauuuuauuuauuucugcucugaucuuuguuaugucuuuuuuaaauuaacuuugugcuuaguuuuuuucuuaauuuuuaaguucuuugagguauaacauuagguuguuuacuucaaaccauuauucuuuuccaauguaggcauuuauuguuauaaguuuuccuuauggaacugcuuuugcugcauccuauaagauuugguaaguuguguuuucguuuuuguuucucucaagauauuuuuugauuucucuuuugauucuccuuugacccacugguuguucaaaagcauguugguuaauuuccauauuuuugugaauuuuucaaaauuccuccuguuuuugauuucugguuucaugccaucaugguuagaaaagauacuugauaugauuucagucuccauaaauuugucaaaauuugguucauggccuaacauauggucuguccuggagauuguuccaugugugcucgagaagauuguguauucugcugccguugaauggaauguucuauguaugugugugaguuggucucauguguagcucaacuccacuuuuuccauaaugauuuucugucuggacgaucuagccauuguugaaagugggauauugaggucucuuauuauuauuguauugccuucuauauuucccuucagaucuauuaauauuugcuuuauauauuuaggugcucugauggugggugcauauauauuuacaguuguuauauucucugaauuaauugacuucuuuauuauuauguaauggccuuuuuugucucuuuuuacaguuuuugacuuaaaaccuauuuugucugauguuaauauagcuaccccugcucucuuuugguuuucauuugcaugagaucuuuuucuaccccuucaguuuuauucuauguuuguccuuaaagcuucugaagugagucucuuauagguagcauauagucaagucuucuuuuuuaaauuaauucaaccacuuuauaucuuuugaccuuuuggagacucuaauguauuugcauucaagguaauuauuaauagguaaggaauuacuaugccauuuuauuuguuuugugaaggcuuuguuccuuucuacuucucuugcuuucuuccuuugugauuugauauuuuuucuaguggcauacgucuugauuuuuuucucuuuaucuuuugcauauuuacuauagguuuuugcuuuguaguuaccaugaggcguacauagagcauguuauaauuaugauaguucauuuuaagcugauaaaacaaacuuaacuuugauugcacacaaaaccucuacacuuuuaugccccaccucccagccuuauuuuacguuuuugugucacaauuuacuucccuuuauauuguguauccuuuaacaaauuauuacagcuaugauuauuuuuaauaguuuuggcauuuaaccuuuauauuauagauaccagugauuuacacaccaccauuacaauauuagaauauucugaauuugacuauuuaccauuaccauugaguuuuuacuuuuauauauauuuauuuuguuaauuugcuuucuuuguuucaacuuaaagaacacccuuuagcauuuuuuuuguagggcaagucuaguggugaugagcacucucaguuuuuauuugucugggaaugucuuuauuugucauucauuucuguaauacagcuuugcugaggauaguguucuugauuggcacuuuuguuuuguuuuguuuuaaauccagcacuuugaauauauuaacccauucccuucugguuuuaauguuuauggugagaaguccacugauaccuuuauggggguuuucuuguaugcgaugaguuucuuuucuuuugcugcuuucaacauucucucuuugucuuugacuuucaacaguauuuuuuuuuuuuuuugagauggauucucacucuguugcccaggccgaagugcaguggcccaaucucagcucacugcaacucugucucuuagguucaagugauucucaucccucagccacccacguagcugggauuacaggugugcaccaccacaccuggccaauuuuuauauuuuuaguagagacaggauuuucucauguuggccaggguggucucgaauuccuggccucaagugauaugcccaccuuggcuucccaaaguuuugggauuacagacaugaaccacuacaccuggcugacuuuugacaauuugauuauaaugugccucggaauguucuucuuuggauugaucuugacugggauccuuugagcuucauuaaucuagauguguguaccucuuaugagauuuguggaguuuugagaugauuucuuuaagugagcuuucuggucccuucuagcucuguuugccuucuggaauucccauaacuuguauauuuguaugcuugguggugucccauaggccccuuauccuuucuucgcucuuuuucauuauuuuuccuuuuuucccuauaauuggcuaauuucagaugaccuaucuauauuugaguuugcacauucuuucuucugcaugauugagucuguuguugaagcacucuugaauuuuucaggucuguuguauucuucagcuccaggauaucugcuugguucuuuuuuauuuuauguuucuguuuauuuauuacauuucuuauuuuguucaugcauugucuuccuaaacucauuuaguugucuaauuguauuguuuugcaucucauugaacuucauuaauaugauuauuuugaauucucuuucaagcaguuauuagaucuccauuucuuaggaguugauuguuggagcuuuauuaguuuccuuugguggcgucauaauugccugauucuuuuuuaucccugucgucuuguguuggugucugcauuugaaggagcaaacauaucuucuagucuuuuuuuggaaagaguuuuuuaaauuguauguuauauauuagacaaaauuauuuaaagccaguaaauuuuuauucaaggaauuucacaugugauuccuucuacuguucaucaagguuaccuuaauuccucuaaagaugcagucaagauuuaucuucaauguaacccuuuuaaaaagaacugagacuuaauccacaauuguccugucagcccugucacaauuauuuuauuuugccuucuuuucuucuaguuuuaaugggguuggagcugggucauguggcugcuacuccuuuugcaguggggccuguggguggccagccuguuaccaggugguuuagugggcauggauccugcuguuuggucucuggauggacuggacugucuccaggacuuuggucuacaaggcuaguucugggaugaaggucagcuuuacagucuguagagagcaggcuugauuacuagguucauagacaguuguguuuuucucugggucccugggacaucuucccacugggucacugguuggguccuugggcaaacauuacugcccuggucuaugguugaagaaggcugaaacugaguugcaggguugcuuuagggcccacagcugggacuaagcucagcagugcuaccuggaagacucaggaaggcacgucuccaucuugucucagugcugcuggcaugacuuaccucugaccaccguugagagggacuguagccagucucagagccauuucaggguuuuuugugggacugaggucagcaacccugcuccggggacuuagagagauauauuucucucugggacccuaguagaucagcuggacugaucucagaccacugcugagagggacugaagccaagucucuuggccauuucugauccacagguagagcugaggucuguagguuuaucauccauggcgcaagugggugugauuuuuucugggucccagggugaaugguuuugauagaaggacaaugaucaaacagagcuguagcugaguccacaggaguauggaagccauuuuugggucuggagcuagggccaugguaggagagucugucaccucgguguagugcuguccuaucaaaagguucuccuaggccuugugcuccaauauuuucuccacuccauuuuauguaaauuuauaccauuaccugauuuaucaauuuaucacaaucucuuacuuggcuguuuaagcuuccauaaaggcacuuuugcuguagagggcucucaaauuauuguuacuguugggagcuacgugcaucuguuccaccaucuuaccgguguucucuuguguuuucugcacguguuuugccaucuuacugguguucucuuguguuuucuuauucaauuuuuacauuaguauuuuagguagaaugccauuauagguggcauggauuggaacugagaauuaauaugauggguaauaguaucaggauucaguaucucaguaaguucgauuaaugagcuaaacaugauuaaauuuaauaggaauaaaagcaaaauucacacuuagguccucagucugcuaccccagggcacaucaaaugaucaauuaaauaaacaaacuagaauuuagaggcagcacuuugaaaaagccucaguaacuucacucagguucaacaaugugaugugguuuauaggcuauuauaguucaucugacuuucacaauaaguacguguuaauggcuaugaacugauuacauccacuaagugauuuuuugcuguuaaauuuucucuagugcauggccugaaaagaaaaaaaaaagugauuggagcuggcagguauuuuagagauuauugaguuuacccaacucacuuuacaugaagaagugaagugaagaagaaagagagcagagcuuacuugaccagguucgcacaaauagcuacucauuguucugggacagccucugggacucccgaauuuuaaauuuuacucucaacauuagugauuuuguauuuuuuauuuauugaaggaaguguuuuugguaauaauuuuagacauauuuuguacuaucaucaguuacuauuugugcauaaugaaacauuuuaugauuggcaauauggucuguaaaaguugauacaguaauuuagguuuccauuuguuuuaaugauggguaauguaacaguuuacaucuguuuccugccucauuuauaaaaguuuuaaaggagaaauagucaguuuuauuaacuuuauuaagucuuuaaggcauuaaauauauuuuuauauuauuuuuauuguugaaguaucuuuuauuggaaauucuauuguaauuaugaauaucucuugagaggaacagggaagaggaagccauggagaaaacgggagagaggagacuguagaggaugguucauuauuuguauucuugugggacaacugcuuccucccaagguuuccuuucuuaaagaagccuguuauucaauaugagauuuuucuuuauuuuuaugcauuuuuuucaaugaaaauucauaaucauaaauuguuaaaaaugcaagugaguuuaugaugaaaaacacuaguucacugauuacuauuucccaucugaagaagaaaccacuuuuacaucuuguaguuguuucauugggugguugcuugcauauugcuaaauaauauauuuuuauguuuuaaacuuaauaugucuaauuguuguaaaaugugacucauuuacaugguucaaaaaugaaaagcauaaaaauauauauacugagauaucuccucuaaacacagaaaaaucaugaacucuuuuuuuuucuuuuuuuuuuuuuuuugagacggagucucacucuguugcccaggcuggagugcaguggcgugaucucggcucauugcaagcucugccucuggguucgcaccauucuccugccucagccucccaaguaguugggacuacaggcgcccgccaccaugcccggcuaauuuuuuuauuuuuguauuuuuaguagagacgggguuucacugcauuagcuggaaugaucucgaucuccugaccucgugauccgccagccucggccuuccuaagugcugggauuacaggcgugagccaccgcacccggccugaaaaaucacugaacucuuaucucuucuagaaaauauuucauauuaauguauaagcaaauacaaaaauauuuucucuacuccauuuuauguaaauuuauacuauuaccugauuuaucaauuuuuguccuuauuuguugacuucaugcuaugauaaaagaaguguauaucccuaugucacccuacuucacuaaauuuucauuucccaaaacaggucugucaguauuuaugauuccucuguugguuaaauucuuaacuuuaagcagucaacugauacuuugcuuuuuguauuguuuuagaccauucuugcauugcuauaacuaucuggcacuggguaauguauaaggaaaagagguuuaauuggcucaugguucugcaggcuuuacaggaagcacaguacuggcaucugcuuggcuucuagggaggccucaggaagcuuacaaucauggcagaaggcaaaaaggguacaggcauaucacauggggaaaguaggagcaagugacagagaguuggggguggggaggugccauacacuuaaaugaccagaucuugugagaacucacuaucaugaagauggcaccaagccaugagggaucugcuccaugauccaagcaucuuccacuagaccccaccuccagcauuggggaauauaauucaacauaagauuugggcagggacaaauauccaaaguauaucaguugucaacuguagaugaugucucuugauuccucauuuugugagaugaggauuaauagcaucccuguacucccuucagcucuccuuuuugucauucuucuuccaauuguuaacauuuguuuuuaaaauuuuuauauuauugaugucaauaacaucuacauuuuguucuuuauccauaauuaaguuaucagugauuauaguuuaaaaaguugaaaacuguacuuuuuacauuaugaugaacaaguaaauauuguucacugaggagccaagugguauacgauuauuguauuuccuuuccuaugaagaauuauuacaguuucuacuagucuuuuuugcccuuucauugucugccuaugugaccuucugaaguuuuuuuagugucugcacucucugauacccaaagagaguaucaaaucuugaaaucccuuauuaaagaggaauccaugauucuucugccugucugcuacucucuucuggguugauugacccuggaucagcugcacagcugucacccugggaugaccuuucauugaucuucuugccugaauccaguuuuggcaauauaaugccuuuuucuuucugcuuugccaucuagcuuugagcaaaauuucaaguuauucccaaaggaagagugaaugaaagguaaacuuuaugcauuauuagucaauacauuuauaauaaugucuauucuucccauagauaucugauaguaucuuuauucuguccugcugauuacaggguuaacaaggugugacuucuagacugagaagaauuuccacauuguaacuggaaggcauuacucaugaucuuuuagccucuaugauucugaugagaagucugaugccaaucugauuuuucauuuuuuguagaugacuauuuuucucucuggaaacucauaggaucuucucauuauccuugguguucuaaacguuuuaaugcaaucuaaguguggaccuuugaaaauucauuuucuuguuuaugugguggcucuuuucaaugagaagacuuaugcccuucauuuugauacaucuucuuguauuagccugagauccagaaaccugguaauuuagcccacagugaugggacaauggggaagaggagucagcagucugcucuguaacuuauuucuuaguccccacuaauuaguacccauuguugucagccccuacuucaugcuuagaguacccgggaguucugcaccuggaggcuaucuugguuucugcagggcaggucagcuccuuccuaagcuguaggucccccaaagauguauuuucuacagaguuucuuuacccugcuucuuuaggcacuauuuuguaccugcuuuuguagaaaucuuguaaucuuuguuugucaaugguucuucuuccauucucugcuugugugcuuguauguuaucuuuauccuuuuaugauaaagguauuggagacuuggugagaaaagaaauaaacucaugugcucugucaccccaaaguuugagggacucaguugaucacaagcucaauagggcuguccuauagccuugucucaguaacuggagguagggaccuugucuuacuuaucuuuuuauauauccuggagcuuggcacauagucaacacugaauaaaugcuuucguaccuacugcugaauuacaguaguuaugaaaguugaauugcuguauuuaggaaugaaugcuaaacugcauccuaccccccgccacuggaauacauaagcauuaaaaggacauaugaaaaauaaugagauuuaugguggauuugauacacauccaccuuacuuuguauuaacagaauugucggguuuaguaauuucauuuuuuauaucauagcugucugagaaguaguucuucuaaauacauuucuguuaauuaccuaguuauuuuuugcaauuagaaagcugcuagaacuugacacuccauuuuaauguaagcuaaacugaauguuaacuaacuuaagagucuugugguggcauaaacuaauguuuacaacaguacuuuuuacacuauaaagugcuauggacauuugaguuuuuguugauauuauguaggaauagccagaauuguuuuguaagcugugcuauuuugagcagagauuaaggcacuaauuagcaugcuauuauuaucuauucuuguacuuuaaauggagaaggagugauuuuauaauguguaguugugaacuguagcuagcaauagcaaagauagagcaacucugcauaguuuuuugauuauuuucagaugcaauuggcuagcuuuagggaauuauagaggagugagccugcugugaagaucuuuggccguaucucauauauaaauguaauauagccucagugguaaaaaucuacugacccaugucuguuucuguuuggcuaguucuauugaaguaaucaaucaacucugccugacuggaugggagugugguggagccugaccaccggcagggcugaggcauugaguuaucauugaacauaagaaucaagcucuuugugcaagucaaaacuccugguggcauuuguaccugaggaccuguccuccuccccuuuguccacuguuuugauuuuuuuuaaaagucauuaaacacugaaucaauuuagcagagaaaagggaauauaauucauuuaaaucucuguucaaaacauuauguuugcuucugguuuucaucuguguguuuguacacuuugcauuguuguaaacuguguaauaugaugucuaacuuuuccuacuuagcauuauuuuauauaugguuuauaaaacuaugugcuuaacauaggcacugucuucuauuuugugguaaggacauuuaacaugagcucuacccucaacaacuucuuucaguauacaaucacaguacuauuaaguguagguaugacuuuguauagcagaucucuggaucuuaaucaucuugcaaaauaaacuucauguguacuuucuuuuaacauugguaaggcauucacugauaugacauaacguacuuaaccuuucacuguuauaaauuggcuuguuucuaauuguuuauuaucauaaacagcaugauauaggcaucuugauacaaacgauuauuuugcuuugggauuauuuuccuggaauuaaacccaaagugacauuaucaggucuaauguugcauaccucuuguuuaugcagucauuuuggacuucagaaugacagggcagugcaguuguuuuauucugcauuucaucauuaaggaggcuaggcauuuucuccuguaaugauuuaucauuugucuuuacugauggaaugggagagccccuaguuugcuacuuuuagcugaaucugauaauugcauggaaaaaguuggaaugcaggauaacaaugucauccaagggaccccgucccuuuucuggccugcucaucauacagugguuuucuagggagauuucuccagcuaaaaugcagacauuacugguaaggguaacagaagucaaguuuugagcagcaaaccuugugguaaggauuacuuuaucagcucaauuuccaaugcgaacagcuggcuaagagcagugccucccaacaacaggacacaggacugguagggcagugggcaugggaagcuuggguaggauagaauaaugagggagugggcacaaggaugcacuaggcaggguucacucccuuuccugggcuuccuccuguuuaugagaaaguuaaucaggaaagaaggauacuuacugcaugagggaguggguguuacugaacacugucugggucagagacaugauuauuuugagaaaauaacgacucagaauuaaaaggcuacuuuauuuccaccaaagucaaacauaaaaacuagugauaauuaaaaugaaggagcauaaauuuauuacauaguauauuaauucaccgcaagaauagauuuauagguguugucaugucuuuuguuuuuagggggugaauuuucaaaagagagguuaaugagaccacauaaaauggucguaugaaaaauguuuuugccuucuuugguaaaacugcucuggggacaguguucauuauuuucaauuuuccuuuuauaaagauccaaaugauagggucaugaguucaaggccaggaacaaguugauuuuuuuccugaauaguaugauuuaauuuauuagauaauaagauacacguuaccauauguagcccccuccucucuuucuugcuuucucucuguguggcuggaagguaaaugaaugcaucagagggacuuaagaccuaaagaaauuauuuagggcugcugcuuccuggaauaucucucauaagaacuguaauuaaauaaaguaauaaguuauccccaugaaagauuauuuucaaguccaaagcaguauauucugguggcagcuaauugaugauucuguuucaaagaguauaguuuugugaauauuuuguucucuucuuaugaaagccuaaaaagugauucuuuucccacgaagacacuuuugcuucgauccuuuccagugguuugccaggagguggguuggccugccuaaccuuagccugcauguccgagggaaggaaguaccaguucaggagcucagcagagggcagagcugggguuagauuucauccucagguccuggaguuacuaaaugcuaggguugaaaaggacucagugaggaacuugaggcccagaaagggaaagugcucauacauaugcacauaauuuuuaguggccaacaagaacuuuugccauuugauucuacauucaggcacuuuuuuggugccaugugguguuuucaucauaaaagagguugaaauugcagaguaauuucuacugaacuguggucaguucaccaaggcacaugccuguaggacuggagacucacaugagguagugucugauugagaguccuggaggcaguuagacuucuuuaaggauggauggcagagagauggggauuccugcuuaguuaaucugacuuuuauauucucuuauuauugauuugauagaauaaauauuuaaacuuuauguucuacuaauaaauuaugguguauccuaguuaggaaaaaaggaaaaaaaaauccuagguguaagcguagucccugaucucuaauucuccaaauaauugccccacccucaccuagccccagguuauggucccaucuauccugcuuguguucacugccauuuaaaauacaaacauuuacuacuuuccaaacaacucucgacacuaagaugcuuuccuuuucucccaguuucaguuaccacuuuuuagucaaaaacucaaaacgauuaucuacccuauucuuaccauaaauuccgaaugucuuucauacacacacgauuuaaucgugugugcccagaucucuuuuuuacuuucucauccagaacauuacuuucaggggaauuucuccaucaguuaaaaugguuuuuugaacuuuuggauucugccaaauaaaguaacguguuuuaaaaacaaagcuaaagaguuuccucuauacuucaaagacacaugaccaucauaguuucauucuugauggacugagccaaaaauaaaaacaaaaacaagaccccucccccucuuuauuucagaugcuaauuaaacuacagauuaggucccacacaccuaccuccuucagaggguauauuuacaguaaaccaucauuugguaugaacuaccauuccauucaaaaugggggaaggaauuuaaaauagugugaugaauuuuauaggccucccucugauauuguauguaauacugauuauguauguugugguaguaauuuuuucagaaaagauuucucaaaagaccuucacuccucuaaguggaaaauguauugcuaaaaauaaaacuuaaggucucuucauuuuguagcugugucaauggcucaucuugguaauuuauauuccauauuguucaaagggaauaaaagugccacugaaacauaucaguaaaguuaaaagaugguucauguuuucuggaauauuuauaauaucccuacauuaugaauuucuagagaaucuugaaaaaaacuauuuaaaauauuuuauuucuuuuuuuguuuuuuagcucucuggguccucauuuucaaauuauggggccuucgagucugucugcauuucauguuuugcagagauuuuuuuuaaauaaaaaaauagagaaaaguggaugaugccaauaacccuaauuaagaggaaaccaggucccacauggauauugucugauucauuauaaauuacagcuuuagaauuuagaaaauuguguaauaaaucaugaugucauuuccagguaaucacauucgagccauguuuccccugagacagugugccuguuacaacagcugugucaucccuagggcugcaggagagguuugggcaauucauaauuguagaaugaaguguauguugauuguauacuucuuaccuuugucauugcucacugugagaaguaaaguuuacuuacauuaaaacaucagcuuaugaauaaacaaaguuuguuuaaauuaaaacaccauuagucaccauggcaguugauuguccugguacacuuucuauuauaaaauaaauucaaauuagugaagacucagauaaauaacaggcauuguuacacagacgaaagagugugcauccuggagguagaccuggccugauauucugccacugauuaauuagcuaugaccucauauauuuuacuuuacuuuuuaaacuuaauaucacuauccgaauguugguuuacuuauucauucggcaaguauucuuugagucugucuuauaaccagccauuaacuaggugcuggagauaacaugaugaguaaaaaggaaguaguccuugaucucauagagcuuaugguuuagcgagagagccagguguggaacagagaaucacacaaaugauacaaugacaguugugauaagugcugugaacagaaagaauacagagcuaucuaguaaaauugggguaagauugccucuuuuucaagauucugacacauaaaaagcacagugaauaguaguagugauuguuggaaguauuauuaguauuauuauuaugucauccuaaaccaaaacaugaucaggugaggacaggaaguacggauaacgagaugcaggcuguauaaugagauaauuaaauauggugaauucagguugaagagauauaauacaugacuacgugaauuaaaauauagccuccuaagguacagauggcaucuucugggggucagaauggcuguuauauugauggaucuuuggguguucugugguuaaugcccuguuccuggaaggcugaugggucaggauugcuguaggaagguugcauucuagugguuacuuuuuaaaaaaugcuuuuaagcucuuuggcauuuggaggcaaccuauagaauuauauauacauauauauauauauauauauauauauauauacacaaaaaauauauauauauauacacauacacguauguauguguacguguauauguauauguguauguauauagccaugucuuucucuacaggauauaggcacuuugguuauaauuauaugaaagaaggaauguuuccaugucuucaauguaaauuugaaaugcgugcugccccaaaucccaaaauagaaauucucugaagaguucaccuagaggugagagaauccgugagcccucuagucaguuuucagaacagccauuuucuaugugugaccugcacuuuuugguauagcagggugaugaggggaagcagugucccagguguucuccuaggucuggagcgaucaccacuuugugauaguaugucccccacacagauacugugaacagcaagcauguagacugugggcuuuugaauagccagguuuccuggagcauagaaguuauuauugaaaugcuugcccuaguucaaggaauuacuggauguaagagaacugaguucuccacucaaaugauguggaauuguggguguagaacucaaucaaguuucucuuacuaauaauggucaugguuuauugggcauuuagcuaagugauuuucaucuagaaucucauguaauucuugagacaaggcugugaaguagguacaacagugcucauuuucuagauggagacaauagaagguuaucuaguaaauagcacagcaaagucuggaacuugggugugucugguugugaagcuggcucuuucaacuggacacucuguugucccuguuuguucucuuagugugaaagcugcacugauaccuacugacuugucucauuugccauuguaggccgaaggcugguguggugccuaaccuuguguuaggugucuuagugcccugaguuugcaggugacagaaauagaacucagacuggcauaaacauaacucagacuuuauuggcucauuuagauaaaaaaaaaacuccaguggugaggugcaguauuuuagacauggcgggauacagguggauagaugaugucaucaggacagucuuucuuuccaucuuuuggcugugcuucccuccacguuggcuucauucccaggcagcuucucuccguggagaggcaauuagagcaacccgcaauucuagacuacucagcccagaaauaagagguuaucuccuucuaacuguucuaacaaaagcccuaggggugacucugguuaguucgguuuaggccagauucccauuucugaaacaauuaguaagcuggggagaugaugccccuaaccccugaaguuggaggguggaagagucaaccucaccuuaaucucaugggcugaaaaugggggagcaguuguuuccucagagauacuggcaaaggagaaaccuguguucauugcaaaagcuguugcauaaauauuugucaaguaaaggagugaaggaagcaacgaauuucugcucuguucuagggaaacuucagagaguacacaaaucuaaaacuauuuccugcuggccuuagugaaacaaaaacauccuguuuaauugaaucuuaucaauguuagaaaauuagguugaauugagaacagccaauaucauaaaugucuaaaauauuaaaaauuaggcuauuuauuaagcuuguaguaccuuuuuacaaaaugaaugugggaagaaaugaacaacuuugagagggaagauuagaaucuguguucuacagaagaagaagaucaaauaaaugcuccuucucagaguaaugcauauuugaaggggcuuccaucaaguccuuucugccuauguuccucugcaccccucagauauugggaucaguauugggauaauggagggaaaggaaguccagcaaugagagaauuauauuuuucaagugggcccuccagcuaagucuccuguggcagagaggaauuguagacaccuugaggacuccugcaaagggaaagucaagugaaauuuccuggaagucucauguuuuaucuuaaaaguuuaugcaaauuuuggauucugcuuuaugauauuuacauacugcuuuuaauaaguuaauguuuaaaguuaauuaccauugagagaaaagcaaaaauaguucccacuggucuuagugagacagaaagaugcuguuugauagaaucuuaucaauuucagaaaauuggguugaauugaggagagccaauaccauaaaucaguuucauaguucaggcauuuccuucagucuuaguuucuugguauuucagauacccagauccacauaaauacaaacuucaucaucauuuagaagagaagcuuaaaauauugccaugagggcaucacacucccuguuaaaggaauaagucauuacucagagucucuuguccagcgaucucucuuuaugugucucucucucacucuguguguuagggaaacauguucaaaggucucuccauaucagaagaguacugauggucauaugugucauuuuaccgcuaaugcuuuuauuuguuuuguauguggaugaaugaaaugucccaaauaauucauagugcucaugaucagcacucuucauccaacucucaaacuucauuuuuauugcaguugucuuguguuguguggcagaaacacucagcuugguuuuucuuuuuuuaccuuuucagauguugcuugaguuuaagcuguuaagguacccugacuuugugaaccacuauaucauuagggugaagaguggauuuuuuucagcuuguucagauuuaucuuaugauuaugggauuuccccccuauguggaaaaauauguauuaaacccuucauucaaauauuuggauuagugcuuucugcuaagccaacauaaaagucacuuacuugugcauuacagauuugcuauagaagagaaguguuccauuuacaacacacacauauugaaaguaauuuuaacugucuguuugaucaugcugaaccaauugggcaucagacucuuugagaucuuugcaaugaucggggaaggggcagugguuuuggcacgggcucuugcuucugcaguuucucuguucguaaauuuguccacuuuuacacauguauuuauaugugucaguaucagucuugcuaaaaacuccuaauuguauauaagauuucuucaccaggugguuucacuuacgaauuuuaaggacgguugucuucagaacacaucuucguugugaauacgucagggagaggagaagaugacaaaucauuguugcgcaugcuuucuuccaaccguggaaaaacaauuagaugcguuuuaauauagaagcagcuauuugaaaacuauuuuucucuuucuaaaauguuuuuguuuauguucuuauuuuucuucugcuguguguacuuacacacacauauauacacuuaaaaauguuuucuuguggccgggcgcgguggcucacgccuguaaucgcagcacuuugggaggccaaggaggguggaucacaaggucaggaguucaagaccagccuggccaagauggugaaacccuguuucuacuaaaaauacaaaaaucagcugggcaugguggcacgugccuguaaucccagcuacucgggaggcugaggcagagaauugcuugaacccgggaggcggagguugcagugagccgagaucgugccacugcauuccagacugggugacagagcaagauuucaucucaaaaaaaaaauuuuuuuuuuuugccaggaugaggaucauacaagaauuuucacucacaauuuugaaguugucauuuccuuguucucaggcuuccaacguugaugucaggaagucacguggcuuucugauucuugcucuuuggaguguacccuauuuuccacucagggugauauuucaguaucuuuuuucuauccuuacuauucugaaauuucacaguucuguggcuugcuguggucucuuugccuuuauuuuguuagacacucaaugggauuuuugcagucugaaaccccaaacccucaauucugugaaauguucuuguacugauucuuugauuuuuuuuuuucugucucugccucuucucuaauuuuuaaaaauuuauucuuguccuucagauuuggggccuucuggauugagcuucugauuuucuuauuuauuguuuaucuuuuggcccuucuguucuuaauuugaagggaugucuuucaacuccaguauugauuuacuuuaauuuuugcuaucauauuuuuuaguuuccaagagcucuuucuugauguucuguccucccccaagcucuuguuuuauagauguaguauauuccuuuuuuucuagugguucuaguugauguuucuuuuucacuuuuuucuucucccuagauagucuucauucuccgauauccuuucuucucuuaguagaagaaaacuacuggucaguuagccuaauuaguaguuuggcuucucuuucaugugagaggcuuuccccaaauuucuggugaucauuggcuauccauucauaaucauagaacauaccaaaaagccacagagacccuauguggauggcugagacuuacugaaugaugagcuucguuauaggguuaugggugaccagcuagacuucucacauccauaggucuuuuuugggcggugguuugguuccuccuggaaaagaucuuccagucuucugccugggaaauggaagcuuugcucugguguucugggacugaguacaaggaaggagauuaguggggagaggucucaucauucagcuugcagacauucacuugaucucccuguaugcaucuccauuucuguucauaccuuuuucugggccuggugucucccauucaguuucuguugacacuagcuguguaucuucuguucaggaggaguaguuuaacuguaguauugagauggagaccuggcaaccuaucugcucauuuuacagacuuucagacaaugcaucuauuuucagcuucugucuccagccugauuuucuaguuuuugagacuuuuaaguguauuuacucugcauuuugaaaauagaaguuaagaaugucuuucaagcacauuaaaacauauccuuuaagagugucauucaacaaugauggcuuauuucaauuugguuauucugauuuuuuuuccccuugaaacuguuuucacuacgucuccaguguagaacuucaaccaauuuucucuaaacauaugaacuuuucuucuaaagagauucuguaagcagucucaaaggcagcuuugagcacucuucuuauuugcuugguggaguuuuguaucauauugcuccuggcuaauacauguccuuuuuugguuucaaaaaauucuggcaguuucucuuuugauuuugcaugauugguuuuauaaaaugucauucuaaaaugaauggcuguguguacuucuuggacauauuuucacgcacaagagucauccaugugauccuuauuggcaucugcacauaauuaaacucauauuuuaaagacagccuuugccuuuuugauugacugcugcuauucacuagggauucauucauugugguaaggggaauccuacacuaucaacucauucuggggacucucagggacaaugaauuccaugucucaguccucaauacuuucagguuguuuuuaauuuuaaucacugucuuggacauuugcaugguucagaaaccucuauuucucauuuccugcuugaaaccuacaauugguauucacaguuguaaauauaauuuuaaacuguugcacuuuaaacaaguaaauaaauaauaucacacaagugcaggcaucaugagguuugcuacuuuugugccguggugaauuggauuugagaguaguuguauguugguaaagagaacuuuugaucagugucaauuauggcagaaaguugaaccaguagguuuuuguauagucaaaauugaaacacacaaaaucagacaaaaugcuuccuaaggugauaagacaaacauaauuuucaaaauaauagcccugaggggauccugggaguuccgagcugucacagauuccagccgugggacaggugguggaacagcacuggcuguggcaauuucuugcauaauauaaucuuauugaaguagugcaccauuuccacuuuaagaccauagcugugauauuuaaaggaugauacauuuuucagucucuucuggcuuucaugaagaaacaaaaagacccaaaacaaauuagccacuaugaaagaaggcauucugcuaaucuuggugagcaugacacacauuuuuaagaguacagaaauucgaaaccugcuccccuuccuucucccuucagucacagauaggaaguguugcauuaaucggggcaacuuuccaaauaauuacacuucagguuaggaccuauugucuacuuccacaugaagggagcaggggaauguaagaucugucuguauccucucuuucuuuuuuguuugagacaggguuucacucuguuacccaggcuggagugcagugggugugugcucauggcucauuguagccucaaccuucugggcucaagagaucuuccugccucagccucccaaagugcugggauuacaggucuaagccaccaugucuggucugucuauauucucaaauuguuaucaaauagucuaaaagcaucaugugauaacuaggaauagaucugcccaaacaaaacaaugcaaauaaaaccacagaauuuaaaccccuaagagcccuuucugcuuaucaauuagcagaugaaauccaagcuaagggacgugcacaaggucccaaaacugccauauuuuacugauucuaagaugccuacauuuccauuugaacaauuuugaaaacgagauggcuucuuuuagcugauggcaucuuacaguuacucagagccacacagugguugugauauaguugugauugccugugcaugcaugaauaucccaaguaccagcagugcaauuugcaaaauggaagaaaucucagagacaacagugaaacacucuuaccagaugcugcauugccaguguucuucaaggcuuagagaugguaugacauggaaaagcaugggcuugaaugguuuggagucaaaauauaauucaaaguuggauucugaaugugaagaaggguuagagauacugaaugaacucauuguucugauauuuucuuuuguaccuaagcuuaaaagugauauaugguaaaaauaugugucuguguauaaaauaacuuccauaauagguggaaaauaaaaaaauuugaaguaauaaggcaccgugucaauuuaauugacagcuuuuauuucuuucuuaguccauaaaauaauggugcaucuuacaacacauggagacuuagaguucauuaauuaugguaacuaagaguugcugaaagucccucuucuucauagucuuauuccaguauggccucaucucauggauuaugaauauaaguuaugacacuuuuugauagaggaucagagaauuuagccucaaaguuggacuguuuacauuaugauacuccaauacuggcuuucagaauaaucacagauaggggggcaggggucacauggccauuucuauggcuuucuuccuugcaagcugaggagaucucuccagagcacaccucaagaaaagcaaagugguaauacauggcuauaaugaauguagccaagacaguuucagagcaggauuaacaaugacucauuucagccguggaaauauuuuagugguccacaugucuaauuuuauuuccugcaaaacucuccccauauauuaguugcaaauuaucccccuaaaugaauuguugguuuuaagccaguuaauauuggaggacugcuucucaaaauuaugguuuugauuucaaacugaagccauucuucuugauacuaaauaguuccaucgagucaccaauugucugucaaacuagugaaacuaaaaucauaucaucuggagguuacucaucucucgauuucuguagugauuuuaaaucaguaaguuaaaagucagaaagaaagggaaccaaacaucucuuuguuuuacacacugaaauguuuucugauccccuggagaucauucuuacugcucuuccuuaaacucuggcauuuggugauagacacaacaucagcaguaucugggcucaguauggcccacugagccugaauagagcugagucaagugcacagaauggaagaccaaggaaaggucaacacaagcugcaaacuguccuguguuuuucugaccgaucucccaugggggccucaggggugucacagcgggagagugcaauaaccuggucuaaguauuuugcuauucauggagaauguuaguuagccugagaaacugagccuugaacucaguuucugacggaaacucauagacauuauguuuggcacacagucaucucaauucguuuuuuucuuuuucaaauaggacagacucauguaggaccacgucgguagaauuaucaaaaaauuggcaaacaauuuaccugcuuagucagacuagaccuugaaaucugugguggcaggaagucuccauugggcugauuuaauuggaaggguuuuuucggguuuuuuuuuuuuuuuuuuuuuuuuuuuuuauugagauggucucacucugucaccuaggcuggagugugauggugugaucauggcucacugcagccucaacguccuggccucaggugauccucccaccucagucacccgaguagcugggacuacaggugcccaccacgccuggggaauuuuuuguauuuuuuguagagcuggguucucacccuguugcccagguugguaauuggaagguuuuaaacagucucuguaugugagagugagcacaucuagccauccagugaggauaggagucuccaugcaaccgaaugugauuuaauguuguuccucucuaggacucaucucuaaacuccacucacaggucagaaaacuuuuccaagaccaugucuccacauuuugaguuugaaaaaaugagaucagggucuuacagauguuuugggauuguagaagauaaagggaguaauauggguuuggaagacccuguuauucaugacaaugcagaagggacuagagcaaugcuuauguuuuugugucugugaaaagggggccuacuggaagggaauaaagucaacagaugcauaagagaccaagaucuucaggcacauggaagcuuguauuuauccacugucuacaauucccaguguaagcagagaccaguguacaggcuaagaaguacugaaacuuucuuugacuuaggaaauugagcugcaucuugaaaaaaaaaaaagaacaguuaauucaguuuaaaaaggaaaagcaaaaccaccuaaugaaccaauuucauauuuucugaaaguaggaaacugcaguaaaacuaggaugucaggcauucucacauucgauccugaacuaaauuagcuuucuaguugauucaugucuuuggcuaugauaugcuaauugcagacccuuuuuauauauuuauuaaaguaggaucucaccuuuagcaauucauuaugauuugguuuuaaaaaauaacucuauacuugaaagaauuaaaauguauuuccucagaaauauucuauaaaucagacuucucuauuuuagucagaugggcuuuuaauaauaugaaugugaauuagugaggcuugauuuuaauugcuucauuuuccuuauucugaugaauaacaggauccuauagcuuuucaauacaauagcugauaauaaaaccaccucaccuguuauuuaugagucauauucuauucuccagagugccuucagcuaaugagcaaacaucagcuguaucccugaaagaauaauuguucuuauagaaauaauuacugauugauaauuacugacuuuuuugagauugaaagaccugcucucuauuuuucuuuuaugcuauacucaacaggaaaagucaguuggcgagaguaccaaguauuuaauuacucaaaauauuaauuuaauuaauuucaaguaauacauauugaguguauaguacugccugucagggggacuuugguaagauaugacccacacacaugaaaaguuacaugacaauaaagucagguuaucauuaugugucaaaugaacacuuaagacaguagcuauuguagaauucaagaagcggaggagucauaagaucaggagucacugaaggauucaucauugggggaggccuuuuugagggccuuuacuugggguaggauuuuuuuuuuaacuauacuuuaaguuuuaggguacaugugcacauugugcagguuaguuacauauguauacaugugccaugcuggugcgcugcacccacuaacucgucaucuagcauuagguauaucucccagugcuaucccuccccccuccccccaccccaccacaguccccagagugugauauuccccuuccuguguccaugugaucucauuguucaauucccaccaaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuucacuauugugaauaaugccgcaauaaacauacgugugcaugugucuuuauagcagcaugauuuauaguccuuuggguauauacccaguaaugggguggcugggucaaaugguauuucuaguucuagaucccugaggaaucgccacacugacuuccacaaugguugaacuaguuuacagucccaccaacaguguaaaagcguuccuauuucuccacauccucuccagcauugggguaggauuuuuaagcaggugaggagaaggguagaaaaauagagagaugguagcagugguaccuuguguagcauaagcaaccauaaaaggaaaugacuguguuuggaggggaucguuaagcagucugcuuugcucugccaaacaaggggcuuaugcucaucaacacugucaaugucuugaaggacaaggaaaggcugaagaauugauucagauggaaggagacuaaggcagcaugacaacuaaaugcaaagugugauucuggauuggagacugguuuggaaaaaaaaauuucuuuucuuuccuucuuuccuucucuccuucucuccucuccuucucuccuuuccuuccuuccuuccuuccuuccuuccuuccuuccuuccuuccuuccuuucuuuccucuuucuuuuuuuuggugugugacagauucuccgucucccaggcuggagugcaguggcgcgaucuuggcucacugcaaccuccaucuccuggguucaaguggcucucaugccucagccuccugaggagcugggacuauaagcgcgcaccuucaugccuggcuaauuuuuguauuuuuaguagagauggguuuuugccauauuggccaggcuggucuugaacuccuggccucaagugaucugccugccuuggccucccaaaguuugggauuauaggcuuuuccacugugcccggcugggaaaaacaugucuauuuaagacauuauugggaaaaauuucugaaauuugaauauagguuguacacuagaugccaguauaucaguguuaaauuuccugaacuucauaaagguauugugauuguguaucccuagguguucuguaguaaugcaccacaaaccagggaccuucaaaaaacagaaauacauucucuuauagcaucuggggccagcagucugaaaugaagguguuggugggaccaugcuucccuugacagcucuagggaaguauuucuucgccucuuccccacuuccaguaguuguuggcaauccuuggcauuccuuggcuggcaacugccucacuccagucuuugccuguguuguuuccugguguucuucuugugugccugugucuucacauggccuuauaaggacgccagucauugaguuuaguccccaagcacaugugacagcaucuuaacuaauuacaucugcaacgauccuauuuccaaauaagguaacauucugagguuccaggugaacaugaauuuuugggagaacauuauucaaccccauccagauuauauaugagacucuccuaguuuuuaggagauagaugcugaaguauuuaggggaaaaggauaaugaugucuacaacauacuuucaaaugguuccucaauaauaauaaaauuauggucauauuuauggagagggagacaaaauacaauauggaauaauguuaacaauugaugaauuucagugaaguguauguggguuguauaauuuuuggaaauuaucuagagguuugaaauuuuucauaauaaaaacauuuuuuaagaagcaaaagaaggcggggugcagaggcucacaccuguaauaccagcacuuugggaggcugaggcggguggaucaccugagguuaggaguucaagaccagccuggccaacauggugagaccccauaucuacgaaaauaucaaaauuauccaggcaugauggcgcgugccuauaaucccagcuacccgggaggcugagcugggagaaucccuugaacccaggaggcggaggguugcagugagcugagauugugccauugcacuccugccugggcgacacagcaagacucugucucaaaaaaaaaaaaaaaaaaaagaagcgaaagaaaaaagaaaaauccacaaaaauguugaucauauaacauuuuuccucugaacauuguuaugucuggaauggugccaaaacugcuaacucuauacugcuucaagucuaaggagguagcaguaucaacuagucuugaaauuuauacugucucuguucuuccucuaugggagauuuuuuuuaaauggcuuaaacagguuugacucaggauuuuaguuucuugcagcugaaaacaucuuaccucaaacaauagacuauugcaagacuguguguuauauuagccaaguuaaagucaauauuagccaaguuaacgucaauauauuuccuuuauuugaaacaaacaagaaauccacuuugauacuuucaugcuuuaucuauauuuauaaaaauaggugaacuuuuaaaaaucagaauuccaaggcaguuuucuuaagugaaauguuuggcauauugcccaagauuuugauacaugauaccuguccuaauugucccuuugaaugucccagauaaaacuacauuucuuagagacaaguuaaaaggucuagauuuuuuuuuccuugugacuuuuuauucuuuguuaagaaauagcucucagcaagaauauugggcuuuaguggggaagguacauuucuaauuuuuguaacuuuauguauuaauacuacucagauaaaugguauacuacacaggcuuggggaacacauuuaaaaggcauuuuggguuuuagcugagaauacuuuuagaauauaaaaugcaauguauuuugcauuuccugaaauaaauaaaacagagcuguacaaaauauacagugcagcccuuuggaaaaagagauauccuagcucagggcaagccguuugauggaaauagcauuuucuccaagcagauggggcuggcuccacuuaguccugcagagggccagggggacuuguuugugugcagagccuuggucuaaugccaggagagccagcuuguaaaguuauucccauagggcucauucccgucugcccagcaucaccccugacacaaacaaaacagccacgggccuccuucauuucuuuaagaugaaugaaugcugccguaaagaaggacuuuuauugaacugugugacaugaugcagaaagaaugcuguagugaaacacaaaacuauauguuauaaacgucaacauaagagaaguaguuuggggugcauuuucugaugucuaccuuacuauaagauguuuugacggauaaguuauaguaguaaaaggcugucuccauaguauuggaaauaccugcuggauuuuucugaggucgucuugguuguaaggacagaaauacauucaggcuagcacacagcugagacguuaagugaaacauaagcucacgcaaaucugagagugggaaccaggggacagggccuagcagugcugggagcuugaggcuuuauucuggauccagagcugcuaucuggggcccagagcagcaggugcuucuggaucuugcacucaaaggcugugaguggauguggcccagccaccgucugcuugggugugcugccgccagcuggcuuccagccuucugcucuguuucaucaccuugcagucuccacccccucaccauuucuaguuucucuuaaugcucuccaugcaucucuggcucauugcagucccucuaaaccauuuacucccucuuauccuuacagcuucucuucuugcaccucacccucucauucccucaguauuuucuaguucagcccccuaaggagacagacaggcuuauggcccagauugucuuugugcucugggccaugucacugucccugacccucccugguccagguggcaguagcuggcaagccauagggguucagugggacagagaguagucagccaaggcagcuuccuucagcaagagcuuuggacauagaccugauugacacaucugguucaaccaaauauuacaaaauaguuuggguguaacccucugaugccauuuuaugauagacacuuuaagauagaugguuuaggucaggugugguggcuuaugccuguaaucccagcacuuugggaggccuaggugggugugucaucugaaaucaggaguuagagaccagccuggccaacauggugaaaccccaucucuacuaaaaauacaaaaauuagccaggcauggucauggguaccuguaauuucagcuacuugggaggcugaggcagaugaauugcuugaaccugggaggcagagguugcagugagccgagaucaugucacugcacccagccugggugacagagacuccaucuaaaaaaaaacaaaaacaaaaacaaaaaaaagaaaaaaagauagcgucaguccuaauucaggaucuaagaucuagauauauaaccaggaguaagcauuacacuuaaacucuucaugccagagucagugccucugucuuaggauguuugucauaaaaggagggcauagagaagaauguuuuccuuugagacagagguggugagaugagagaacuuagcuucagcagccugauguuaucaggugucgagugggcuuuguaggagaaaagcgggaucaggaugaugguggugugccgaguauuaaauauuugacuaaguugauuggaauacgauaacagcuuuaauuggaagaaccuaaggacaugcccauaaaugguucaauuuaugaagcccauucauggaucuauuuaggagguugaguucaugcaaacaauaacaguaauucuugggucucuacuauaguaagucaagcacugagccaagaucuuucacuggccaccccguuucauccucauggcagccuuuuaggacacuuaggcuuguuaucucuauuugacaacugcagaaauuaaguuuuagggaggccaagcaacuuucucaggguugcaaggugaugaccuggcugaaauuuugaauuuuggucucugccuaauagacagacauaaaaauaggacacugggucucauuuuuucuggugcugcucucaugccaccuccuuccacccaagcagcuuuugcuuagcagugacaauucaccauccagccuuuaggguucuguauaguggcuuaagacaggaauacuugucaugcggugcagaacuugcugggaagagcauccaggagggaaagagacacuugggggcagacaccagagccuuguagggugugccaguugccuguuguaugacagucuccuaagagacuuuacuggugcaagcugguggcccuacacacuaccaggucacacacagugcucagcuagaaggagggagacggugaggaggucauucuguuccuuuuaacacuucuggaggguguguagaggugugcucucacagucagggcaggugaacccucaaauuuuaugaagagcuuaggugagacaggggacaugugugaaagcagucaugucuaaaguagaaauuauuucugcaugcaccggcaaaacauuagcacccauaaaagucucugcuuuuuauugcuacuucuucacugaugaguguuugugaggagagggugcuuccaaccgauguuugcauuaaaggaauuuguuaggucuaagaacauaccaaauacaguguucucaagguuuggagcauuaagccuucuuuaauucagaguuuugucaacguguugcaacaaccuaugaaucagaggaugacaguuugaauccuugacucuucagcaguuuccaugagguagaagaaacugcuccaccuucucucagaggaccugagagacacucuucguuuacuacagcucgagagguuuguuguuuggucccuuggagcuggaagaggugaaugaggcagacuggaaaaauaaaacaguuauuauacaauacacuuggauggaaauuuaauuguguuuagacaugaacacacuuuuuuaaaaggcagauacaaaguuauuaugcuuuucaaaucuuuagaauguauuuuugaagauucuccuucucuucaaccuuuaaauaagaaccaguagaaauagugcaacuuuuugagaaaacaaugguuaguauuccccugauaucacagccagcuuauuuagcaagcaaguaauucccagggcuguggugacuucaucaaugcaucugaugcacaaacgaaaacauccuucacuucuguccaaaaaauaaaacgauuauuauacuuuuauguugauaauaaagucagccaucaguacuguuuuguguguguguguguguguguguguauguauguccccaggccuugaggauuacuugauuuguuguuaaauccuaaccagaagcuuuggauuuaaaggaaggaauacuguauacacaaaaugcaugaggcuuuuuucuuuugauugguagcaaugauauacuacauauguuauaucauaucaguauauugaaaaguucccaauauuacaauauuugaauagaaagugaucuuggccuaucuaaugcaagugauagggcagaauuuaaguuaaacaggauuccuuugauuccuuccaacaaacaauuauaaaauacagaauuugaaaaggagaaaugaaacaaaccaaaaauucuauugaccaugugcuacuguuaguuccaacuguaguuggaguaaguuuccacugggcgaggcauagaaaucgaaauacuucugagguuuagaucuuacuucucuuaugcuguccuguuggccuaugacuuagccaggcuuguggaaugccauggcauauucucugucuuuaauuaaaagaaguuuuaauugugguaaaaaaaaaacacacacauuacacaaaauuuaccaucuuaaucauuuucaaguauacaguccuguacuguuggguauguucacuuuauuguguaacagccaugccauuucucuuacuuuuacauuuuuuaaaaccuuuuuuuuuuugccugaaagaaguggggaaugaaaagggauuuuucuaaaaggugccugcgucuccaagggaacuuauuucucagcaguauaaccuguugggccauguagaugaaucuguuugggcaacccuucccuugagauaauauuguucaugugugcguuccccauagagcaacaucuauucugcuuuugaugauucuuaccuuggggcuguggaugaggcuacacaaacaaaauuaccccauaguucaccucaucuuagucaugaagaccuaggccuuguucauucaguaugcccaagucagccacugcauaauaaacuugaaauauuuggcucuauuauugauugaucauauagauaauggccccagauucaaucagccauccgaaauacugcugugguugugcuugguuuuuaauuuuuuuaagucauuuaaaacagacauagucuuaaaugcuuucucuugaaaaucugauuuaauagagucauuauaaaauugcuaggugguuuaguuuuauuggacuuuuauauuugguggagaauuuucauuacaaaaauuaccuauuuuuuuuuccaauguuggacuuuuuaugagaagaggaaagugcuuauacagauuuauauaaugaacaaaggugagagaguuaaguuucuaauuuucuggaacaguaaaagaugguuuauccccuaucuuugcucuggucauagaugagaggaucccuuccacgugaaaugccccaaaugaagugugauagugauacucggucaugguuagggagaggugaugcuuccugugucacuauacugacagcugugugucaggacaccucugcgccauucgauaggcugugaucccucuggccagcccaccaagagcaaaccuuaauccaguuguguuguuaaucacacagauauuuagggacuuggcuuuaccuucaacagucuuccaaggaguucuuaguucuaacauuugcgugauuucaauagcugaugauaaacucucugcaggcauuuagggacgucgcuuuaccuucaauagccuuccgaggagcucguagugcuaacauuugccugauuucaauagcugaugauaaacucugagcagaugaggucucuuuuuugaagaccugccgauuuccacauuuaucuuuguuuccuacagauacugucuccugaauaauucauauuuuucuuaguuuccuuuccuggcuccuuuccucuauccauccuuaaaugcugcugcaucuuggccaucuucuuuucuuuuacacuguucuugggccaucucugccacuucuguggugucagauaccacuaauaacauauguauguguguauacuuggaacagauaacaucaccugaguucuaggucccacguauuccauugcuucuuagauauauuacaauuucuagucaccauagacacauaagauuucauauguccaauauagaacucauuaacuuucccuucgcuucccucccugaaccaaauauaccacaugaguucucuugucuguguuccugaucucugugaaagcagaagucuagacgccaccuuuggcucuuucauugccguuuuucugcaucugugugguagucuuuguuaaugauguuccuguuauuucugaaauuguauaauaacauagcauggcaucuguugcuucacauuucacuucccauucugugauuauaaagaggucauuuuugcaaggauguucaaggccgucaucagcuucucaaggauccuccaaguccuuugggagacagccaugcaguccucaucccaguucacuuuaaccccuuacuuguucgcuggucccucccuugucaacaauguuuuugugauuugagcaguuuuucagcacuccuuacauugccuuuaugaaaucuuauaucuuuguaagauuugugaauauuuucauugcauuugcuuucuauccuugaauaccuaccucauuugaccaucaggaagaggcugggugagggugcuggguugauggguggaagaggcccuugcaugaggcagggcuguuucaguuggaagucauuuccucaguacuuagcucaccccugaguguugcauucuuaaggcaccauucgcuuccccacccacucucuuaaccguaggucuuggauauucacagacaacgaucucuugcauauuaccuuugaacugucccuuauauauuuuguuauauuuuuacuuuagaggcuauaaagauuuuucaauagcaaaggaugugaaaacuuagggagagaguggacaacuuaguuugcuaucucagagcacaacauaguuugcuuccagaaggagauauagggacauaucucuguugaugaaaccguucuuagaauuugaaaagcaauuuuaugccuaccauuuuauuggauuuguuacuucauuuuggguagcuggugauguucugcuguuuauuauuauuauuauuauaauuggaaggggucucaccuugucgcccaggcuggagugcaguggcgugauuucggcucacugcaaccuccgucucccagguuccaagugauucuccugccucagccucuugaguagcugggauugcaggcaugugccaccaugcccgacaaauuuuuguauuuuuaguagggaugggauuucgccauguuggccaggcuggucuccaacuccugaucucaggugaucugcccccaucggccucccaaagugcugggauuacaggcaugagccaccgcacccaagcuuauuauuuucuucauugguggcuccuacuagucagcaacugcuaacuuguaggguaagaaauuaacaguaauaauaggaauaacaguaagacaauugaguguuuaccacaugccaggcaguaugcuaagugcuuucgucacauuugaguguacaaauugacugaaugaaucagaucaucacugcaaaggaucaugaguuagcaugcuauagcccauucucuguccaucuaaguucucagaccacuuuuauggggcauucagugaauggaaucaguuguuaggacugcaggaguccaggaaguuaacaugaauggagaagacauuauauaaaugugucuagagacauguuuggaagaauaaagcuauuaugacauccuuuggcuauucauuuggguuuaagucauauaguaguugguauaggaaaauggucuuaagagacaaacuggaguauguuuguuuucauccuuccuaaaucucagagacaaucagcuuugguaauuccuguggauuuuuuccaugcuuaagaaugugaggaaaauauuuccuauuuauacauuauaucaauuaaagcccucaaaaugucucuguuacacaaaaugcaacuaauaaugccacagcgauuuucccauugucaugucacuaaauaaguuggcuuaugcaggcuuacacaaauugucauuuugcaugauuauaguauuacaagaaauuuuuguggcuuuaaaaaccugcuguagaccauuuugcuuugcuuggcuagccuuuaggauaauaaugccauuuacuagacuuugcuaaaccccuaaaauagcaaagguagauaauuaaacuaagccacagcuacugcaaugguuguuucugugcaauagggagaagacgggaagcuugguaauguuuugagcagaaccagcucaucauugaaaugcuaagaaugagcuggaaaaauauuuuaaaauaggaauuauauagucaaagccaaugaaacuaacagaaacuccuaacaguuggucugguguuaguccacccacccuaaauuugaguuuaaaagaugcuuugggacuaagcauauguuggaaggaguugauuuaagccaacaggccucugacuuacuucgcuuaagauaaugcacucaauacaaacaccucguuuggggcacucagucuaauucugugguucaugguuuagagagccauacuuuuguaguucucagagauaaauguuuugcuuguuuaugacucuagggaagaggauaauacauuucugaacagcaccaucagagcugaugaagucucuacacuuuuguuguuucuauucuggacaggguaaauucuucugaaauugcauagaugauggaucauccuaagauaucauccuaagauaaugcugugcuugccccuuagacuugugggaugaaggaauguagccagcggcuucauauaaacuugcgcaauaguauuacagauccuacuuuucagaacugaguacagauggguuugagaauagaaucugguagagagauggccaaggaagcagaaguagaaugcugguguuaguuaggauuggguuuggccacauguaagcaaauacuuaauauaaugauggcuucaacaaguuaguuuauuuauuuauuuuucauaaaagaaauccaaaggcaggcagguacguagguagguagguagguaguccaggauuguuauggugguuucaccaugugaucggggaaccaggauccuaguuuuccacucucaaucuuuauuacuaggaucuuaccuuguggcucaacauggcugcuacacuccagucaucacacuacaucugcauucuagcaaacuauaaggaggaagugacaaaaaggauaaucuuuucuucccuaugaggaagcuucuaggaaguuacauaucucuuuagcagaaacuuggucaccuuaccacacccacugcaggaaaggacagagaauguaggcuuuuagcugaguagcaguauaccucacuuaaaguccaguucuuacuacuauguaauaagaaacaagugaauaucaagagaagaguugcagacccuggcacaacugcuagauacuauacuguuuaugcaaauaucagagcggcacgaacuuuaaaagauggcaucauaaguguggguuaucuuucucaccauggagaaaaacaacauauauguugaagcucuuauuagaauacaaauauuggguaguugauugaaauugcccauugaaacauugauucccucuuaguagucugacagucuuaugcaagccaaaaggaaagauguagcccaggaacagagaaacggaaaugauuaaaugccagcuccgugacuuuuauagcaguucauucagcugccuacccacaaagcacuucccaaggaaguuacagccaagaauucacuuggcugggcuuguccauuuuucauucauuucaaugaccaucuccaggaauaaaaaacauucugaaagaagaaaaccuauugaaggacuugggaaguaugaacacaguuuuccuuuaaaagaaaauuuuaaaaagaaguagcuuuaaaccaccuauguuugauuaggaauuuuagggucccguuuuccucuguguguuuguguuuguguaucuaagucacuacaaauauauacauauguauucaagaucaaguuaugaauuucauagaauuaggaacuuugucgguuuucuuguuuuaaugauguugagugaaaacagaaaauaggaggacauucuuuuaaaauagccuugccgaaaaccugaaaaggacucuagcauucaauaaacaguacauuucucccucauugggggucaaugaauguuuaaugcauggggcaagauuuuggucugaucugcaaaaaaaaaaggaaaaaaaaaugguaaaucacagacacagguuugcaacgacuucuuggauagaucccauagcucuccaguugcuuucagggauuuaaaaaguuggguccgguuuucuucauggcagguaccuugaucacuuuggaggguucccuugggguaacacuuacucagcuugagguaggugagugggcaaggucagagcacugcuuaugcuugugcauugcuugugccucagagaaucuacuagcaacaaccucuagucucuuacagaaguguggcugggccaaggagcaguuucaguaucucaggaaggucugcggugauguguucaaaguuaggguaauuugugaucuacugcccucgguuuugaacuuuagcgaaaauuuggaggcaacaggcaaacuuccauuccauauccagucauacauguaguaaguuuuauauuuuagguauuuuuuacucucucauuuacuauucacccauuuuuguagucuccucucaauucauuguucacuucauucuguguuuguuggaguaguuuauuugcuuaucucuaguauuuuagaaguuuaguguaauuuagaaaaggagguuaguaccagcuaauguguggcaagcuuuuagaguauagucuuguagaagguuuucuaggcuuuaacuuaugcugacaaguuguuugcaaaaguaacauaagaauauauauauacuuuuccaucauuauggaguuuauauuuuuagcaguaaaguggggauuaugaaacuucagacuuaugguauggugaaaaaaaagaaaaaaaacugaagccagggguaauuugccacugguguuguguuucaugccuauucaaaagaaucugaaauuaacccccucuauuuuuuugucuaaaaaugcaccacauuaggaagauuguuuaggauauuuucacucacugcuuaaaaaaauguaagugaacugcugcaaagugguaggugguuucaaaaaccuuaagcaauugcuucaaauucuguagucuucugaaccaucuguucauuugccagguauggacaauuagggaaagccguuugaaccaauguugaaauaauuuaaaaucucauuggaaguaaauggcuaacagcuuccaaacggucucaucauugauuccaggaaaugcuguagucauuugaaaauggcuuuguuguuaaaauauuugaccauuuaguaugcaaaucaccagaauuaaauaauuugcuuaacuaacaauaauuuagauauuucucaagucauuuuuuuucaucaggauuugcuaaacacuuaaaguauacauagaauuauacuggacauuuuaugaaauagaaaauggaaacaaggucuugcucauguguuggguuauagcauauuuaaguuaguuaugagacauaacuguagaacaacuacaaaaacagccauauuuauucauuccuuucuuccuuuauucacauauuauuugccgagcaccuacuucugcaucaugaaugcuggguuacagugguaaccuauaaauuaagaugcuguucucauagaucuguuauucugauuggaggagacacaugguguaaacguaaaagagugaaugaaugaaugaaugaaugaauaagauguuucaaauaguaagaauuccuaugaagaaaauaaaaugcuguaugcuccagagaguaagugagcagagaagggggugggugaacaaagaaagugcccucugauucagcccaggaggcagaggcugcagugagccaagaucgcaccacugcacuccagccugggugauagagugagaccacaucucacaaaaaaaaaaaaaagcucucucugauauuggaaaugagauuggaacgacacagggagccgagagagagagagagagagagagagagagagagagagagagagagggagagagagaacuguaaacauguaagcauaaaguaagaaaaaucagcguggguuggcugcuuuauggaaacuuuuuuugaguuauuuugugguugugcccaccacacuauacaucuugauguaguuugcauauauuuuuaaaguggguuagcaucaucagcuaaugcuuauugaacugucagcaaauauuuauggagagccuccugugcucaagaacccuuauuaagugcagagcccugaauuaugaguuacaaggauuuucagaagguagaauucuaggguuuaagggaaauauuucaaaggaauuacaaauuaauuugaaaaaacuccagggccuucuuagagaagcacuguacauuccagacauagcaucuaaagccaaaagauuaaaccagaugggcaaucauuuucuuucucauuacccaacuaauggggacugugaagaugggcagggacucaugucuagagcccaccugaagucacaguggaccuagaaugaaguuaacgucgcaguuaagauuuucaccggcuacuuugcuuccccaggauuuuauauuuuuugaggaaacggaaugucucugucauacacagagaggugcugacuucccugcaugccguguagacacaggaggaguggucacagaggggacaugugccaucagccuucuucuugagcuaguggcacccuuaaggaugcaggcggggaauaucaauauauuauuuuggaaaaaucagaagcaaacauuguauaaaguuuaaacaguggcgacagaaggugcuggacacuuuaaaauguucuuguguggauaaauauuuuguaugggagaaagcacaagcucugaaaacagccagacacaugguuagauggaugacuuaucaucuuggagucugugucuacucaucuuuaagaucguaguaguaacgaugauagcugucauuuauuaagcaccugcuaggcauuuaacguacauuauagccaugcugagcuggacguuuuaaucucuauuuuauagcuggaaaacaggcucagagugaguaggcaacuuaccucaugccagauauuuaguauguggcagaccuggacucagacccaguucccucucuuccagggucuucccacccacacugcagugucccuugcaggcuuguucagauuagcaaccuugaaugcuaagugcugcuaagcaggcucacagagaaggacaacgaugaggcauguucccucacugcuuuuuccuccuacaucccaggaccugggaucaccuugagauugucugugaacaaagaaaucaauaugacucaauauaauucucuguacaauuacauuuuaaaauugacagccucuuucacuguugcuucaccaaaaaauaaauaaauaaaacaaaagccuaggaauuauguuuauguguuuuccaaaugaagaaaagaaauuugggauccuaaagaguauauaaaauauguugauguagcauguaaguggaaauggcuaaaagguaacagaacauaaccaauguuguaggaauuuaaaauauuagugucuuguuuaaugacauagauaacacacaacaauggugcuuugcaugugaagucccauuauaguaugaugagucucaguacagguauggaagcugcuacucaauauuagguuaauuuuggucuucaucaagaccuuuaaagaugauuuccuggauuuuaguucuuauaaucacuguucugccuucagcaaggacuugguaaugauaaauuguugguguagauaagucauuggcaugaaaguugaucucaaacagcuucuuucggcauuuaauaauuacugcagugaauuuucaccugaauguguaagaacugucucacccugaacugucaaaucuaggaaauuauaagaugagacacuuccaaauaacgaaagaccugauucauaugacucccaugagcuaacuuuucuaagaaggaguuucuuuaauaagauuuuauuucaauuuaagguaauuuaaaucaaacuuuuuacauuccuggucuugaugcuaauguaacuuaccagaaauugacuacgugucagcguuuugauucauauagaauagaaaggaaggacauaauguuauaugaaaccagccaggcacagaaagacagcuacuucaugauuucacucauauguagaaucuaaaaaagcugaucucauagaagcagagaauagaauagcgguuaccagaggcuggagaggggaaaggggugggcaagcugggaaaagguugguccgcuuauauaggaagaauaguuuuggguuuucuauuucauaguagggugacuauagcugauaucaauguauuguauauuucaagauagcuaacgaagaagaucuugaaaguuaugaccacaaaaaaauaaagguuugaggugaugaacaugcuaaucacccugauuuggucauuauacaacguauacauguaccggaacaucacacuguaccccauaagcaugaacaauuauuaugugucaauuauaaacacguuuuuugaacuugucaaaaaaaaaagaauagaaugggaagccgcuuuguguauuauugguaucagaggacaugaaucacaccuguauaaaagacauucuuuuaugauggagggaugcacuguuuauuccuaaauuaccaggagguguggauuugacucauacuaaaccaaaucuaugaauuaauguuuccuagaaaguugucucgagauggaaaaaaggugucuauauaauaccuuaguuucuuugucaaaucaugccuaccuuucugaguugcuuugcacuauagcauuauaaaguuaucuagugaaucaaacaguguauaugcacauuuuaagcauucaguauugauacuuuugugcaguaugaaggugguuucuuucuuccuaaguuaucuggguaauuacaucaacuggucauuugguuuuuacuuuauaaauaucggcuuaaguaaaauagcauaacaguugcucagagaguauuuacuuuacauccacuuuuauuuuuccuuuuauucucagcagcaugucuaguuuuuuuagccaaagucuaaaaauaucacuauaguucagaaaauaauaccucuuaaguagaacuagcaaaaauauuucuucagaguuaagaggucaucucuuaaugcuaacagguuaugacaugagcagaacugagaauuacccagcugacguugcuccuuuagcauagaacaaaagcaucuuuucugugacuaauguaaaucccaaaaguuaguguuuuucagguauacagaauaaaacuugggcaguaaugacugaauugacgauauugucagucagugguaauauccuaggugaccguaaucacaggauugguuggcaaucaauaacuguauguguuucuuggaaguuaucugggaugugcuucagcaaaauaagggagaaaauuaagaaaggaggugaggaauucaggaaaaaucuaucuacagauaguggugaaauauuccauugaaugaauacacgcaaugggguuaagaagucaaauaguuuaacagaaggcucuauguuaaaaaacaguggugccaugucccaccccuucucaguugauuugcauguaguauuacaaaguuaucuaaugaaucaaacaaguguauaugcacauuuuaagcaauucaguauugauacuuuugugcaauaugaaggugauuuuagaacgcagugggguuaaaggagaaccaauagcaacaggguuaaagggagagccaguucagaugacagcaggaggagucagggcuccuggaggguggacucuggaaaacucaagaaauauccauuuaaauaaaguguuuagagauguggaugucacuuuagaagaaaguauuuuaaagacuuaaagcaugcuuuuuuuaaacauaaggccuucugcugaacuauuugacuuuuuaaccacauuacauguauuaauuuaauggaauguuucauuaaaaauaauacugugauuaaaaaaauuuaaacugagcugguaagacugguggaggaaaaacuuugccauucuuauuaaggaugcuugacuuuggccugggccuuggcauuuucuagggaugccucagguaugguggaaaaaguguaggcuggggacccaaagagacugauugucaguccucucccugcccuacuaguuguguggcuguagaugauggcaauguuguauuuccuacacaccugcuauguaccuuggggguugguguuaucuuuauuugauaaaaaaaagggagcaccagaagcucugugaccccaggcaaguuauuuaaaacuuucugcaucuucguuucugacacagauaugaguagugccugucuaauaccguugcugugauggucagagauguacucuaugggcagcagcuaacccaaugccuggauuauaaacacuaaacaagugcuuguuauuguuacuaaaguguaugguuucagccauccuccuggcuagguauuugacuuaguuccucucuucucuaaaagaugaaaacaguaauuccagacuuguauugggguguacuuuaggaguauauauuggaaguucucucaacucugugauaagaggaucuagcagucuaagaaaaaagaugagacaacaucaucuacagauaccaucucaaacaugguuucuuccagaauuaagauguuaucucucauugaugguuaagauggagcaauugacauguaaauaugaugcauuuuauucuccuguuuaguuuuuuggugagauuaucaaucucacuggaaaacaagaagggucugcagaugucugguaaggaaaacauuaacaucaguuguacauuagacauauuacuugcuuuccagaucuuguuaagguaucaggaaaucccuuuauccuuugguauacaaaguaguacuugaauucuugcaauauauuuuguacuuccuguugcaaaagggaagauuuaacuaauuuuuuucuacuagggauuuguaguaggauaugagaauaaauaaagcaguuucauugacucacuuaugcagcugaaguuuguaaaaaaccucaccuagauauuucaaggaaguaauagcuaauuuuuuuauccccuuauguaugaaaccuuuuaacauacaucaucuccuacaauccucacaacaacucuuaaggauacuaucauagucaaugcguguuauuuuugguaauuacauucuacacagucaccacaaacacugaauaagggaacacugaauuguugcuucuagugaaaugcaggauuaguuuccugggagccucuggccacaauauuuuugucaauggaucaacauguuaacuuguuuuauguguguuucuguuuaaagacaccuuacuuaauauuuauuuuugauuaguuaaaauugaacucauggccgucagcaugacuauuaauauucugugacuguaugaagcuuagcuaacacuuauauuuuccuuguaaggcacaucacagauuucuuguacuuaggaacacuagacagcacuucaccacuaccuugggaggcauuuuaaacagcgacaucaccgucaaaagcacaaaaaugugaaagaccugacacuaaauagaccguagaaggccaggcacgauggcucauaccuguaaucucagaaguuugggaggccgaggcgggcagaucgccugaggucaggaguucaagaccagccugaccaacauggugaaaccccugcuccacuaaaaauauaaaauuuagccgggcgugguggcaggcuccuguaaucccagcuacucgggaggcugaggcaggagaauugcuugaacccaggagguggagguugcagugagcugagauugugccacugcacuucagccugggcaaagugagacugucucaaaaaaaaaagaaaagaaaaagaaaaagaaaaaaggacacuuguuuauaguaugagagcugaggcaggaaggcagagcaucgccuguucaacagcagcugggaaggacaacacucugcacaugaccaaggaaguacugcaaguauugauuuggggguuacaaauaaauuucagagaguaggugaauuuguaaaugcagaaucugcaaauaaugaggaaugacuuuauuacuguauuaucaucguuuuguuuguuuguuuuugagauggucuucuuuggaggggucucacucuguugcccaggcuggaguucagcagugugaucacagcucccugcagccugaccaccugggcucaagugauccuccugccuuagccucgugaguagcugggaccacagaugugccaccacauccaucuaauuuuuuuguuuauuuuuagagaugaggucucucuauguaacccaggcuggucuugaacuccugggcugaagugauccugccagaauuuucaauuucaaauaaaaaacuuaauuugagugacuugccuaacuuccacgcagguaauagauggggaaacugaugccuauacuuuuggacuuucuuuguucaggguaugccaucuacugaaacacucccuuccacccagaucucaggggcuuaccacaggucagcagggaugugggacugcagcaagcccugcuccauacagucauucagggauucaggcaccucuaucccccagcccuucccagaauccccugcaucccgucggcugacucacaggaaagagggaguggcaaggccuggauguaguuuggggacauugcuguacgucuauccauacugcauugcccccacuuaccugcaagggagccugcagaauuucuuuuccuaugugcccaggcagaaaaaggagugggguuuggugagcaucguggcguuuucuuccuuccaggagcacauaaugauguuuuaaucccauucuuauauuccuuacgccauuuuucugugucccuuugagaaguguucgagacuuacagcuucuaccuguugggauucaauuuaagaaaagaguggaaguggagguuuuguuuucuaugcaguaaguuuccugaauuccaggggaaaugagcugauuauuuucuuauacuuagcuggauauuucaacagagucuuuuccaaaauugaaagaguuuucuaaaugaaaugacuugauuuaaaauuaaaauagaugcagagauguauuuuucccccucaauaaauuuucugagucagguucuugccucccauaauugaaggcaaccauaauaacgaauuugauugcauggcuuuuacucuuacuuuugagguaauugccagauuggcauccacaguaauuuguaugugagaggugaucagaugugaacauuuccauucagucaacucccuggaauucagacacaucacugcuucugguuuuagaauuaggaccaguaauugcagcuguggggugagcugcgcaucugaaauaggcuguguuucaugugugauaguaauguuaucagacuugcuuagggaggcagaggugagcagauuccuauucuucuccauauccuaaaguaguagugguaauaauaguaguaauagcaagagcagcagcaguuguuguuguuguucuuaugaaaauacagcaggaaaugugcagauggggguggaguugggggugcccagcuucaggauguauuaaaacaagcguggagacagaaugaagacugaugaaagauuaagaugaaaauauacaaguuucuuacuuuuacuuuuaauccuaaauuagauacuggguuaauuuuuucuucaguagaaguggaaacacauuuuuccucuacuaugcaaagagaauaguggcuauucuucagaggauuuaaaaaaaucaugugaauuaaagguuaacaagccauauggcuguggaucuacgcuuccuucuggagcugucuuuuaaagggauauguuuuccagcuuccuuacucuuauaaaaagcacuuucauucuccugcuuguuuuuaauuaguuaauaugcauuuguugaacuuccgcuguguucacagcauuguaacaagcacuucugguggauacugaagacaugacuaagacauuuagaucaauccuacauaucuuguagggauuuauaaaguugguuggccaguaacaucuucaugcugcaauccuguuaccauuguuuuagacauacuguguuugauauccguaagagagagaaaacugcugagaguuauaaucugcuuuuuuucaaguucugacuugcaauuuauucugauuucuuuuagauuuggccuaguuucuuugaggcuugggccugagguccaugcuaauuuauaugauugaugagcugucuuucauuuugugcuguugacagaaaaggaaaauuaaccucaaaucuagucgugauaaugaggccacagcuuaacucacucacauguccugggggucaguuucuuucucugucuguuguccagucaugcgcaggcagguggcacauuaguaccugggcaaagaaacucuuccccuggggauuuguccuugaggacaauagacuuuuuuuuuuucacuuucaccuacccuuuaggggcugugaacuugguacggagauuuaaaagaaaacccuaaaugcuuugcuguagaguauucaagauauaaacacacuaauauuugacuggagucuugguguuaccaugacucuuucccuuuauuaagaaaggaaaccauuuuuaaaugguagaaaaacucaauauccagccauauuccagaaggaagagaauucaucuguacauaugaauugcuuaugaggucuugugguuauuucuuuucuucuuuuucuucuucuuucacugcuucucuugaauggcccugguuucuguagaccuggacgaugugugauugggugacagcuccaaucuguuaacaucucaugguguaggaucguacagaagaugaagauuaaauauuguuuuaauaugcccuuuccuuagcugucagcagcuuuagugauucacaaauagcuugugguuuauaaauauuaaaucaaggauucauuauggggaggcgucagugugacuaaccaaaccccaaaccccagggaucuagcuaucacgaugccauuugugaugagaaauucagggcugaaaaauaguuucuauucuccuuagacauuuaaaaacacaugggaaauauucuguuauuaucauaaaguagucuggaaucuacguuaagaagacucuguuaauaaccuugaaucaacacucucgagcauuuuauggugaagaaggcaauauaauaauacaacauuuaccuggggcgguuagacuuuuaacaccuuauucuuugaauuuguagagacaagaaaaugaaacacaguaaaaauaacuaagcacugaguaaaacaguuguuacaaaacccauacauuccuaguuaguagaagucuuacagaaacacccuuagaccuuauaacuagggcccauuuuguuauaauucuucuaugaaaacagcaauucugguuugauaaguuugauucucaauuuuucccuugaaacucuuaauucaaguuuauauggacaacauauuauaugacacaucucaccuugagaugagacaauugagcagcagacagcagaaucacuaacaauaaugacaucgagaucuuggaucccuuauugaaugggugaguaacucugcacaucucaccaccccugaaggcauucucguacuauauuguccaggauagugacagauuuuuauaaagaugaccccaagacacgaaggagauauuaaauuaugcucagccuacuggggaaauguauuguucuuuuuuaagagcccgccacugaaauauuuuuuaaaggccuugguguucuaggaagaaagcuucauuauuggguaauucacaugugugaagcccauaucaucuaacagagcuggauauaagaagcauuggaauauuuucuagaugaaauguaacacuaccccugcuuuccauauuugcauuuauuaaguauguuugguccaaauaauuacuaugucacuguuauuuuauuauuacugugaucuccucuuuaguuuuauuuuccucuuaacaucugucuuuccaagacagaggcaugucaggaaggaauguagaccaucuccacgccuccuggaauaugccuuuggcugggagguccugaauaaaacauuuagcacuuaccagccaguuuaaggaugugacuccaguccccgagaaguccaagucuguuucagagccugccuugucagccucacgucagcauggcccagucacuucucugcuccuguccugggugccugggagaagucuccaaucucagggagcccuuguagccuugucuacuugacucccuaucuuaguccccacccgggcucuuccaagccauuuccacacuccccaagcccccagcccugagccugauccugccacucuuaguaaauaacaucaccucugguuuggaaguucuaaucuaccugacaugagcugcuuccugcuuuuuauucucccacuccaaauuucuggaguccuuauuacccucucuucccagcucaacagaagagccacccuuuuccuuuuccaggcuggacgcagcagcccucuccagcacuccaccacccugaaccaucagcuuucccuucucucuggccugccuggcucgcuccucugcucuccucuagggugccucucccccauuccauugccugaaccaccugccaagccacugcuucccccugccuugccccugcacucaccucccacucugcccuuucuguguugccguugccccugccgccucuacuuuauagaugccuucccuccgggucauugucuacucccaggucccccauccuucugcuguuuuggaguucauccuucuugccugccgucuuuauuuggugcuucugaccaccuuuuccuucuggaacccucuuuccuuggagcccuuugcuauuaucauaauucucacuauccuugcaaaccauucuaccuugcaagguaagcuucuaccccgccccaccucaaauauuucaaggaaauugaugcccuacagauaggcuaagauuucauuaccauuuugcuugucucuguaggucccgggggcacccacaucugaauucuggugccugggcuucuugaucccuggcccagucuuuuuucuaaugcccacauugcuugccaggaacaggugggcauucaucucaguucauuucucagcuuuuuucacugugcuuuuuccauuuacccuuucuucuguacccaugacuuuaacuaccauccuuauuaauacgacuuccaaacuuaucuuuagcuagauccuccuccuccagucuuuauaucugaguuuuuaucagguaccugauaccacaccaaugccuuagaauuaacacccacaucaaaucacauucauaaagcauuuugagauucacaaagugcucccacauuuuuuagcuuauuuaguccucauuauaauuuagagaggacguuauuaucagccaccuuuuuaagaugaagcaauugaagcucggaaaaguuacaggauugcucagaaugacacauggagaaaaacaagaggguuggguuugugagcuguaaucccuuugcucuuuuccugcccaggcagccuggggucuguucccaggcuaguucaaggcugaaauugccauugucccuccucucgucuccuugauaacaguaauaaaauaacagaaacaaggugcaagccauuagcagccucagacuggugcugguaugggaacgucuuagcugcagagaccccgucuccaucaucacuggaccccugaacacagggucuguuauauaggaguucauuuaagaagcaucugcugguuuggauugaauuguuuaguguugaguucuugucuaaugcacccagacuuacagccuuacggucagucacguuggagucccuccuuacuguucuucacuaaaugcauaaguccgauauauuuuuccuuuuucaaugcugcgggcauuucuauguugcucccacuuucugcuucagauaccauacucugguccucauguugacaugucucuuguacugugccuguagccuccuccguaguccuuaggcuucuggccucuggcuccaugagugccagauacaucuccugaaaauacagcucucuuccuggacucagacuuuuucuucgagugugugggaauuuuagagauugucuggcccagccuccaaggaaagaaaaaugucaaaacacagucccagagggccaggcucaccccugcggguggggagcaccacuaccaaccaggggcuuccugacacccagucccgggcuccugccucugugucauugugcaucuugucagucccuccaucugaagucugcaccaauucuccccagccaaaaaugaaguccagguuucuuuguccagcauugaggcccucuccaugacccaguucuaacauguuguucgaauuaucgcucacuaaucccuaaaucgaugucccagccaaagugccccacucacuguucuccagcaagcccacugcucucuggccuccuugccuuuuguagauaauccucucugugcagaaucccuucaucaucuuccucucaugccauccuuuccaaggaaaauuuccugauuauuuguaguugaaaagaaagggacucucccaucucugagagccccauagcacuuugcuucuuuaguccggacuugacuuggucugacuugcauuguauuuauuuuuauucucgucuuaucucccuacugauucuaaccaucuuuagaucaagcaagaauuucauuuguucaccauugguaucccuuagcauccagcauaguagaucugcuuggcuuggggcugguaccaauuuggugauggguaguugaagacaugacagagagacggugcuguggagggcuugggcccacauuuugggagcguuggauuuaguucaucuccaaaagaacucuaggauuugggcuccacugaguuaaaauuagguuaaaguuuugaaaacaucauagagauguugagggggagaaaugcuuugcuucugccauuucuugccccacccacagugguugcucaguggugagaauccaucagcuuuuauugcagucacacccuuauggcugguucugugcuuucuugggagaaacgaguguugguguuccaggaagguguauuauaguucacaaauacugcggauaugaugaaaugaauagacaucgccagggcugcagacuucucuucacguauguaaaugucauccauuugucuacuuauacgacauagauuuacauggaaaaaaauaugccuaaccaaagggaaaacucacugauuuaaaaauacauaugcacucuaaaucuguuagcuuugguguuaagugaggucaauguuaagcagaauaugugugaaucugcaauaauaauuaaugcauuauguaugauagguuguauuguccagauuuguuuuuugcaauuggcaaacagaggcucacuugaacuuggcuuuuccuggcgagguuuuugugcucuucucuucuacuccuuuacuuauuaaugugcugcaggaaacuuacuggacgugagaguuugcauuguucuuaccucuguaaugcgggaagaugaaaggauguaauuggucuucaccaaaauuuauugcucccaggcaguuugauaccagcaacuuacacugugucgguauguugccaauaauucaacauuuucacucauuuucuucagucaucucaagaaccaaauuaaccagacaaguuguacaauuuaguuaugaagcaaaccaaaaagcagaccaauuaccaaucauuugcugucuaaguucugggaauauagccuagacacaggauguaaguugaauuauguuauuucagcgucagacccuggagaaauauaauuuucagaauauuauuugucuggggccuagacucuaggcuacuucccuccaggagaaauaaaauuagagcuucauauguauuuaaaaauuuucugguagcuguguuaaaaauagaaauagcugaaacuaauuuuaauaauauauucuguucaacucaauauaucaaaaguauuaucauuucaacauguacgcacuauuuuaaaaauaauuggccaggcacgguggcucacaccuggaaucccagcacuuugggaggccaaggcaggcagaucaucugaggucaggaguucgagaccagccuggccaacauggcgaaaccccaucucuacuaaaaauacaaaacuuauccgggcgugguggcaugcgccuguagucccagcuacucgggaggcugaggcagggagaauugguuaaacccaggagguggagguugcagugagccgagaucgcgucacugcacuccagccugggcuacaggugagacuccaucucuaaaaaaauaauaauuuuaaaauaaauaaauaaaauuaauugaugcgauaucuuaccuuuuugcuguuguuuuacugacucuuuggaaucuggaguguauuuuacaccccucaauuuggguuagcuacaauacauuccaaguguacccuggucgcaaaugcaugguggcugccauauuggacagcacagguuuagacugguugggaugugauugucugagaaggaaaacagguaaaggaacaauuguaucauuacccuuaaaaaggggacagcaaacauuuucaguaaugggcaaauuguaaauauuuagguuuuaugggcuguguggucucuguugcucugcugucauagcacaaaaguagccauagacaauggcuguguuccaaaacuuuauguacaaaaacagaaggcgggugaauuugacuugcaugcuguaguuugucuacccuguucuuaacuuuaaaauacauugcucucucauagaaaucaaaauaacuuugguuuggaauuguuuguauuuuuaauaauuguguauuuagaaaccaucaauacaguaaaugauagccucugucauuuauuuccucucuuauaaagugaugggugauucuuacuauguuuuaaguguuguuuguugguugguuuagaaaaugaaaguguuuuuacaucacuauugauuaccacuuuucucuuuuuuuccccuucuacucuucaucccuucuggcuggaauaacaugucuggaugguuuggcuacuguauuccuacucauauuauucuguuacaauagguaagacccuuuucuuuccuuuugaauuauuauucugccuaauguuauaauauuaauauguaugguuuugcuuuuaauaaguguucaaggaaauagcauggcauaguuuccauaaauuuauucuaaauuaaauuauuuucagcuacaaggaaaugucauugguacagaguauaaguggagauagauuccagucaacuguggaauauccucuuaaaauauuuuauaaaacaugguuuacacucaauacacaauaaaaaaauagauaugugcaggauuuuacugucuuauuuuuuucauucucaaaucggauauaagacagacauaaacccauacacgccuuuauguuuguuaaugugguuauguuuaaacauuuuuuugagcuuuuucucacauuagaagcgcuggcaagagauguuucuuuguguuauagccuuggguagcaugcugguauauagucugugaagccaggagaguaacuauauaaugaauugaccauuagguuauguaauggggaugacuaucuuuauagccuuggguagcaugcugguauauagucugugaagccaggagaguaacuauauaaugaauugaccauuugguuauguaauggggaugacuaucuucagauuuauuuugacaacuugaugcgaaccaaugguagacccgcucaucaggguguaauaggaacauuuaaugaaagaagauauaaugaagaucuuuaggucucuucuugucauguaauuuuauugugucugaaaaaaaaauuauuuuaagauuuguucuccaccauuuaaaacaacaacagcaacaucacccugaaccccuccagggugaggucugacugguuccacugcuccucccaugggugacacagugaccacugauagaauccuccccacucuuccccagaaacacuuuaccccuuuaccugucccucugucccucuguggcuguuacacauuacgaggaagaaacagugcucugaaaagaguccccucagcuuuucucuucucucucuaaaagaccuucuuucucuuaauucgcuuucucuuucuuucuaauuucauggaaaaaaauaauccaucuuucagaagcugaacuuugcccuugucacucccgccucccuccucugacuuccucugguaccuauuucaucaguuaagucucgcccuguggcauuugauguuuuuucuucuccagcagaucccugagcccagaguccagccugcagacaucacagggcuuccuugugccugagagggacagagaauauccccuccccuugcuccuuuguccuuccuuuccucaccacuugucugaagagauguuaucaccuccuuuuccuuccacuccugacucccugccccugccgcagccuuuccacuagccauguccucccagacaccgaauucaguggcgccuucucaaccucggccucaggccucugcagcaucuuccucccucugcccuuuggccuccuucccuguucuccucugguuugccuucucccuuucugacuucaccuuacuuuuguucuucuugggcuucuucacuuguucccaguccccgaaugcagguguucuugaaagcccuccuugugaucuuuccuccuguccucauugacuccugagccaccccuaacucuucucucucaucugcacugcagcccacacuuccagugccugccugggagugcuuugcauggaauauaccccagacacauccaucaccuuccuuccuccuguuagggccauggucauucccuuggucuuuuccucaccugucccagcugucauuugcgaaggcuuagaucugccucagcccugacuuuuccauucccuucuccauaaccaguguggccuuugcagggucacugccagauuccccgcucgccccuucacccguugcuguuagauucaucuucauaaagcucucaucccaucccucuccugcuccagaaaguguccuugacuuuucaucacuacuuagauuagugccugacacauaguaaguacucagucaauacuaauuuuccuccuucucuucuuccucaucauuuguauucucaaauucuuauuuugccauuuaaaacuuucugugaucuagaccaaccuucuuuuugacuuuauuucccaccaguggaaauagagugggaaagacagaacugcagguaguuccuccccagggugguaaaugggggccauaggagaugaggcuggcgagggggcacuggggacagaucagggaggggggcuguaucagguuuuagaacuucauccugugggugccaugaaggauuucaaauagaggugugauaugccuguguggucaucaauacagaccacucauccugcugacacauugucuguccccucuccugugucccuauugaaauccuaccuuuuuauuuauuuauuuauuuauuuuuugagacagaguuucacucuuguugcccaggcuggagugcaauggcaugauccugggucacuguaaacuccaccugcccauucaagcgauucuccugccccagccuccugaguagcuggauuuacaggcaugugccaccacgcccagcuaauuuuuguauuuuuaguagagacaggguuucaccauguuggccaggcuggucucgaacuccugaccuaggugaucugcccgucucggccucucaaacugcugggauuacaggcaugagccacagugccuggccugaaauccuacuuuuaaucaaagguggauuuggaaugccaucacuuuuaagaagucuucuguucucucuccagcugguaacaagcauucccuccucagagucuccucauugccgugagcauguccagcuuuccagcuuguaguacaucuccuuacgccccagucauaucucccuccccaaccugcagggcccccgccugacacagccuccagggccaugcuccaccuagcauugugucaugugcucugcaggugcucugcaaguguuuguuggaauguaaaugugccuagauguuuuugaguaguuuccuuuuuuuuuuuuucgauuacacagcagauuuauucaggcucacuauuuuuagugauguuuucauuauaauauuuagccucgguaauauuugaucaaugucaauaacaucuguuuaacuaaaggaaauaaaacuuugcugggucaaugagaggucuaccaaguuugaaucguuucuccccaggcaaggaggauacucugccugguuccuuccuguucaccuguucuuucucaugccuuuccauaucaggcuauugucugaacaacuuuggacccauaacuucuucugggcauggcagcauaccaggauggaucuaguaaccuucauuugacuuuugagggaggauaagaaaguaauuaguuuuaguuauuuguuucauuuugcugcacuuugcuaauuccuucugugugugacacacacacacacauacacacauacaugcuguaaaacaugauuuguaggcugggugugguggcucaugccugcaaucccagcacuuugggaggcugaggcgggccgaucacuugaggucaagaguucgagaccagccuggccaacauggcaaaaacccaucucuacuaaaaauacaaaaauuuucugggcaugguggugcaggccuguaaucccagguacuugggaggcugacguaggagaaucacuugaaucugggaggcggagguugcaaugagccacgaucgcgucacugcacuccagccugggcgacagagugagaccucugucucaaaaaacacaaacaaaaccaugauuuguagacccuagcaaugaaaugccagcuugugagcuuuuuuuacuuuuauuucuguuuuuugagacggagucucgcucugucgcccaagcuggagugcaguggcgcgaucucggcucgcugaaagcucugccucgcagguucacgccauucuccugccucagccucccgaguagcugggacuacaggcacccgccacgacgccuggcuaauuuuuuguauauuugaguagagacgggguuucaccguguuagcaaggauggucuugaucuucugaccucgugauccgcccgccucggccucccaaagugcugggauuacaggcgugagccacugcgcccggcccuucgcuuuuauuucuaaggcauggaaggauggcagauauuugagcgaaaacauccccaguuuuaguguauucguuaaacacauacgaaauaaagauacaaguguuuacaagcgaggaagaugacaauugguuuaugcuauaaacauucucccaggacaaacuugcuggguuuguuuccccugucaguaagaaaaccagcacugguggacucccuccaccgucauggccuuccugagaagagagagaggauggccguuuucaggggauggaugagucacggcugggcggugagaacuucucagcgggucacagucaggcuucggcagcucggcaggugagggagcacccacuaagagaguaaucgugguaaaggaaggaaaugcacucagacaucuuggcgcccugggagaggcaauucccuucccacuuuacucccuaaaacagcccucugggaaccacauucgcgagcuugccgugggaucacgcacgccgugacuacaaaauguaaagcaauagaacacacagaacacacuggagcauuaaucugagguucuuaaaugccauuaugcauuauuuauacuuccugauacgauaauauaucgcaaaugaauuuacaugagagagauaauauuucugcuuuuccccugaugauggauucagaauggauaaauuccuuuauuuuauuucaaccugucuucuaaaauaggccagcauguuauagaaauaggcuuuucucuuugaggugagugaaguggcucaacucaaggaaauuuuucuuuggauaaaagaguuuuuuuuuuuucuuaaauuggcuuucuaacuguguuacauuaucugcugaucagcuuuggaaauguuagaaauuuugucauuuaaagcucugaggugagaugaauagagccacaaagcuauagguaaaugaugagaaaaagaugaauugugguauguuucuaaagacuuacucuguucccuuuaacagcauuuggggaaaauaacaugggagagacagcacaguuugauaauuauuugucacaggagugcccauuagccuacacuaauuugauugcugugaaaaaaacagauuaaaauacucuguagaaggcagagucauaacauuauugaguguccaguagguuucuuacuuauuuaauucccuggauccagucucagaaguuggcauuaauaucaccuuguuucacagugaaacaaacggaaaagcagagaggucaggcaacugacuuaaaagcacagagcucguaagagaggagggugggcuuugaacacaggcaguccaaugucagagcuugaacucuuaacuauaauucuauaauuaccgccuccccaucccaaaacagcacuggccuaaggcacacagaauccauaacuuccccuuuauguuuacagacaacucucaguuaccuuaaauugaaacauuacuuuuacagccauagauaaauaggaguugacucuuuucaacaggagggccaaagguaccuggcauggaagauauccuguccacaaccauaaauguuuugauguuagcaacauugcagaugauagacaggugaaagauagaugaaugaauggaugaauaaacacaacgauagcuagauggauagcgagauggaugaacagacagaaagacagaugaacaggaagaaagaaaggaagauagaaagauggacagaaagauaaauggaugaaagaaagaugauagaauaauagaugaaagagaaagaagaaagaaaagagagagagagagaaagaaaaagaaagaaagaaaggacauagauggacagacagaagaaagaaaggaaggaaggaagggaaaggaagaaaggaagaaaggaagaaagaugauagauagauagaugguuagaucaauggauaaacagcuaaauaaauggcaguucauagauguggaaauacacuggcuguuaaaguucaugcuuuaagcuuuguauguguuaggcuuucauguaaacaacauuugcugaugggaacagcaacguaggcacucaggagauuuguggcuugauacuacugguauuuuuacuggaaugcauguguacccguaaggcugguaauacaggagcuaacuuuuuuauugugccacauuuuuuucugaauaauaacagaugagcaaaguaaauccuauuuucccauuagauuccaauauuuauuuaacuaaguauuuauugacuugaggaaauucucauccuccauguaauaaaaucaugaugaaaaguaauaucacacuuaaaauaaaaauaaaauaaaaucacacuuaaaauauuuuaaaaauaacuugauuauaagcaauacuguaaaaauauuugaaauauuaauaaagucuuaggcucaacccaacaaauaacagaaaauaaagccucuacuucccaggccauaccggguuggaggcaaaaauuaaguuguacguauagucucagaacaauuucccugucccaccugcucugggguaacaggguucugcacuguuccuggugucccugaagucaacaucaugucuucuugaucuuaauccucuguuuuggucuauucucacgcugcuauaaggacauagccaagacuggguaauuuagaaaggaaagagguuuaauuggcucacaguuccccagggcuggggaggccucaggaagcuuacuaucaugguggaagggaagcaaacagguccuucuucacaugguggcagcaaggagaagugcaggggaacuccccuuuacaaaaccaucagaucuugugagacguauucacuaucaugaaaacagcacaggaaagaccugcccccaugauuaaauuaccccccacugagucccucccacaacacuuggggaauuaugguagcuacaauugaagaugagauuugaguggggacauagugaaaccauaucauccucacauauucugguccugauggcugcugucuuccaaggcuccagcuugcugcaguaacaccucugcuugcaaugaaucucucugggcuucagguuccaugucuggaaaugggcaucagaacagugauggugacugcugcugagacuuaaauaaucagacacucugacauugcuguccuguuuuuuccugagaaaaggagacaaaacuuagagcuuuaaaauauugaggagggaaauagacuauuuggauuggcauugcuaucuguuccaagaauguuguuuuugacagaaacguugaaaacuuuuaaaacaauguuaaaacaauggguauuuaggugguuagcaaguuauuuuuaacucuuuacaauauuccagaaaugguuuugugcaucacuugcuauauuagguuugccuucuaguaacaccucuaguccaccguagaauucgugcacacuugcagagaucaccagaagauaaacugcuaccugugguugaauuacugaagagcaaggacuucccuuguggacacggaugucagcucacauuuuguugguagcuuuacuacccauccugaugauccauccaucuugcgaggccuacaguuucucugauucccuugguucucccugcuuuugcaaaaugaguaaaggacugugcuuuggacuuuaauuuuucucaucuguaaggcauccauggucuaguguuaaggaguauggacuuuggguuauccugccugcccccagcccuggcuuugacacauaccagcucagugaucucagacaaggugcuucucuaagcuucagguguccccauggagaaucaaaugagauaauguaaagcuucuaucacuuagguaugucugagggaaagggauaguaguuuacuagcuuaguaccaacuccagcugcuugguacucugcuugguuuacaauccuucaguauuccuugaagggguguuucuuggggugcucuugugagcugaguauuguucuacgggcuaagggugcagugaugaaccagaccccuacaguuccugcccugggauuagagucagcuuagaccuuuugugaacagaucucacugucagaccugcuuuugagcucaagauucugugaucugggugugacagcuucauggguacaggguuuucuuuuggagugaugcaaaugucuuggaacuugauagagguggugauggcacuacuaaauggcacugaaugcacuaaauggcacugaacuguacacuuuaaaauggcuaguuuuauguuaugugaauuucacuucaaugaaaaaaaaaugauucuaugaucaacucccuggccuucacuccaagcugugauucaucccgggccugauucauccugaucuuagguaauuucuucucugaaauuuuauuucccuuuauuuagaaaugccuuugaaacucauggaucaaggccagaaauuagccuauguaaugugucaucagcuaucuugcagaguguuuugcacauguaaugaguuaauaauaauuaacuauaucucccaggaaugccugcuuucuacuucugcuuccauuauuugagccagggugaugauucuuuucccagauacucuuuggagggcucccagggaagggaacagaagagcugaaagugcugaaggugaacuuaguuucagcuugaguuuccuagggcugcccugccacaaaaaguguaggucuuugcguuaaaacucugcuaaaggcagaacagaaaaauagcaggggcucuaacagaaggccccccaaccuugugccaauguucuccuuucucuacacuccccugagcuagaacaguuacaaucauuucccauaaaacuaaacagcugugugucuguccuauugacaaagcgugcuugagggccauucagguggcauggcugaagcaggugugagagaaagcuugauugaguuaguugucuuaaagggacacaaguccaccauucuaaugggaaauccauuugauucaggcauuuggcaugagucugaaugccugaaaaagaaugccuuggagaaagucugaaacagacauuugucuccucguggcugguauggcugucucagauucagucaauucuguggggcuuuucuauuccauuuuuugcucuguggugagaacgcauggugugggguggggggcagaaacagagggugggggggaaugagugacagaaagagaauuaaugacugaggaaaaaaagaguuuauauucggcuggauaugauuuaugcuaauagaaucaaaacaguacauaggagaauguuguccauacuuaaugguaguaaauaaaucaguuagaaauaaggcauuuaagugcuuaugcaauguagaccagaaagacugaaaaacuacuggcucaggcgcugacucaaauauuuaacuucuaguuuuuugucucaauagcaccagauaauuuauuauaggagguuugagaaauuccacucuuuccccuuauuuucuucaaaaaguauaaugaacuuuguggaauaucaguugguuguagauauguggcuuuauuucuggguucucuguucuguuacauuuaucugugugucuauuuuuauaccaguaccaugcuguuuugguuacuauagccuuguaguguaguuuggaguuagguaguaugaugccuacagaaaaaaaaauacacaaaauucaaaacccaguacaaaauuuaauguaaaaaaauguaguucgauauucacuuaaaucacccagaugcuguuuugccuccuagugcaggauuuuuuaaacuuggguuaaugagcauccagggcagucacuuucauauucuuuaacuccaaucaaugguaauaaauauauuuuauaucauuaucuagaauacacaagcaaaucauacaguuaaauauucuugugauauauucagauauuaaaaauaauuucugagacaaaauuuucacaaaauauuacuaacccaucuuauacgcaugcuguaguuuauauuguucaauuugguucuucuuuauucuaucauuuucuaucuuguccuccaauuucaugucacaauguacagcauacaacacacugcuauagggaacccauggacuagcuuugggguccuuuugaaccccugaaccaaugugcuaaauuucuacuaggucaugugcauuuuuccaggaagagcauuugugguacuugucaaauauuucaaagguagcuucagugacccagaaaagcugaagaacugcuacuauagagggucuuuugauaaguuacagguuauuuugauaaguuuguaaugcacuuaaguuccaauuuaagaugauauuaaugcaaauagugacuuaaauucuuuccccuuuuggugggagaguuucuuuuuucccccaacaugacuuuuuaagcaacaccaucacucuaugugaaaugagguguuggguuagauuauucuuaagucucucuuaauucuaacuuuacccaaauacuuuauuaguaucaaaaaguaauacauauuuauuguagaaaauuuacaaacacagauaaacaaaauaggaaaauaaaaauugcccauuaaacuaccaccuaaaaaaaauaagauuaacauuuuggugucuauccuucacgucuuuuguuuauguacaaacauauauacuuuauaaacuauauuuuucauauuguaguauaaacuauuuuguaacauuuugcucacuauagcaucauuucucugugucaucauauauuuucuacuguauuauuuuuaaugccugaagauaccuauaaaauauuuaauuguauaauuuaaccaauagcuaacacugagcaguaguuugcuucaguuuuucucucauaagcaacauuacaaugaccauccuuucagcuuuuuacauuaauuugauuuucauagucuaaauuaauucauauaaauggaauagcugggccuaaaguuguaaauguuuuugagacuuugauaccuguuacaguuugcccaccuaaaaggugugcuuagcguaaguucuagguaccgcacuggucuuccagaugcaaugcuccuguggccgcaugaacucugaguacuguguagcauccaggugcaacuuuaggcaagagagucuuuuaaguuucccuucauagggaaguguucaauaacaugaggauuucauuuggaacugaaucuguguggguaguaaguuguuuaccugacaguaaucgaauccaauccuuagcugaauuggaugugcuggugauaccuaccuaagggaauugcugcaagucgagucaauaaagcaauuucaaaugggagaaaacuugaacuuccuuuuuaauaauaaauagacaaaggacuuuucuuuugaaacauuguuaauuacaauggaguuugaagaacccuugagcugugagaagcagauuugguauuucucagaaaucaucuuuuaugaaaugugacuugaauuucuauuuucugccuaaucugaacagaagccuagcagcagucccuccccacccccgcaccuccaccccucuagagaaguggguuucacaugggacucaagguaaauggggaaaccaugaguacauaagcugggaaaugccauaguaugucacuaaaaggaaauuuaguuagcaugauuuggcuuggcuugaugauggaaguaguuucuuaccucacaauaacugaagcaacauuuuaccuuucuccaaguguaaaaaaaauuuugugaaguuuagauuuucuguuguuuauuaguauuuuuauuuuuaaguuccaggguacaugugcaggaugugcagguuuauuacauagguaaacgugugccauggugguuugcugcaccuaucaacucaucgccuagguauuaagcccagcaugcacuagcuauuuguccugaugcucucccuccccuuaccacccaccccccgacagggcccgguguguauugcuccccucccuguguccauacucuuuggagggcucccagggaaggcaacagaagagcugaaagugcugaaggugaacuuagcuucaguugcauuuccuagggcuccccugccacaaagaguguaggucuuugcguuaaaacucuucuaaaggcagaacagaaaaauugcagaggcucuaacagaaggcuccccccaacuugugccuauguccucuuuucucuacacugcucccacuuguucagcucucacuuaugagugagaacaugcgguguuugguuuucuguuccugcauuaguuugcugaggauaauggcuuccagcuccauucauguuccugcaaaggacaugaucucauuccuuuuuuauggcugcauaguauuccaugguguauauguaccacauuuucuuuauccaguuuaucacugaugggcauuuggguugauuccaugucuuugcuauugugaauagugcugcaaugaacauacacguguaugcauauuugucauggaaugauuuauauuccuuuggguauauaaccaguaaugggauugcugggccaagugauauuucggcuucuagaucuuugaagaaucaccacacugucuuccacaauggaugaaguaauuuacauuuccaccaacaguuuaaaagcauuccuauuucucugcaagcuugccagcaucuguuguuucuugacuuuuuaguaaucuccauucugacugguaugaggaugguaaagaaaauuuugugaaguuugggguuauagaaaaaaauuuucuaaacuuuucccaguacgaauaauaaugcuaaugauccagaugccucuggucugucccugcuuauaacuuaagugagggucacacugacaguaaugauauuacuuacucuugcccauccgcauaccacgaucuuagcugcagaaaaauuccccucagucccuggaagucccugggggcuugugaaugucccuauguuacugagagccccuuaucaaaaaagaccucuuugguuuucccauguccgccuucucuucucaggucccaggccuaagccauaggucuaggcagggguggacuugggccgucucugccaugcuguguucagaaucacuguuugucuccaacucugggucagguugguggcccagcucucugucaccuuaggauagauucaguugcuggaaggaccccaaguaucucauguccaaagauauuugacagaucccccaaccccaaguccaccaaauaugcucauagauguuggaauccagauucaggcuaccagccgagugaguuaacugaggaaauaggcacguuuuuggugagagacugaggcccagagaauugaaaugacccaaccaacuaguaagugaagauugcucugauccuaauguuccauguucuuuuuaaaauuccuguacuuaauuggaguccggugucagccaguauagugccagggcugguguguuuaccaacuuauaauaaaagucccacccucagcauuuuaaagccuuaccugaggcauuagccacccucuuuagaaccugguccuccccucgaggaaggauauuuuuccaauggaauccucugggugcaauugaauuucauuggguagucccugaaauucuaauugcagauaauggcuacaccucagaaauuacuuauagccuuaaaaguuuacuggagaauucucuccuuauuccccgauacagaacuaaagagaggccugagagaggcuguuuucacugugaagacuuuaaccuccucggcuuuuugggggccaaauugauccagucuccaagucuuuuuagacaauugcuaauagcugcauguuuuugauggaaagucagaagucauuuuuuuuucuuuuucccuuaucuacaauguugcuugaaaggcauuuggggcccucuccgugacugcgaugauuaauucagagucugagggagcaagagagccacucaaaggggaagcauagcauuuauagagaggauugaagcccuuuaaaggcaggauaugggaagguuuugagacaaaguuauaccuuaaagugaccccugugucauuggccaucuuagggcgaccuggcuggagaauggcaggccccucacaacuuugucacaggcugcuguuugcugaagacaugauacagcccacaggaacacguuuaaagauugcuggcgcaugaagcacauucuuuauguuuugaaauguuuuacuauacuuccuugacuugccuuauuuccauaaauuuugcuuucucugaggaaaauuugaacaccuuucacuuuucaaauuucaguuuuuaugagguugacauuuuccuuaguguauuguuggcuauaaauuauuaagauauauuuaauaaggcucugccuccuaggccccaaacacccuauaaaauggauggaaaauaaaugauuuaagaagauucuagcugaucuacagagcccguuacaaaaauaaugaagcucagaggaaugcaaaaguagaaaauggucaacguuuuaaacuugguauuugcacccaaacccugaguuaugcuuuacagaaauuuuuagucguagaauucucuaguaaccuaaaagucauauccaggaagauaaaaagauuaagauuguaugguaauauuugcacagaaacauauuccuuuuucccuuaacauauuccugcuguucucaacccacuccuugcuauuuuagcuagguagccuuucugguguggaccuacuccaagauggccccugugauccccaccuccuggucuucaugcccuugucuaaucuucuucccuugaagugagaccugugauuuguuucuaaucaauguaacgcagcaaaggugaugagauaucacuucugugauuauauuacauaagacuguaauguuugauauggagguuccucaaaaaaacuaaaaauagaacuaccacgugacucagcaaucccacugcuggcuauauacacaaaagaaaggacaucaguauaugaaagagguacuugcacuucuauguuuaauauagcacuauucacaauagucaagauauggaaugaaacuaaauguccaucaguggaugaauggauaaagaaaaugugauauauauauauauauauauauauauauauauauauauauauauauaaaauauauauauuauauauacacacacccaaugaaauacuauucaucuagaaaaaagaaggaaauccugucauuugcagcaacauggauggaaccggaggucuuuauguuaagugaaauaagccaggcacagaaagacaaauaucacauguucucacuaaaaaguggaucucauggagguagagaguagaaugcugguuaccaguagaaugguagagacugggaagggagaaagggaaaugaagagaaauugauuaaugguugcaaaacuauaguuaaauaguaaggaugaauucuuguauucgauaauacgguaaggaaauuaugguuaacaauauguauuucaaaauagcuauaagagaugaauuguaauguucccaacacaaagaaaagauaaauguuugaaugauguaucuaccaguuaccuugauuugaucauuacacauuguauucagccaucacauguaccccuaacauagguacaacuauuauauaucaauuuuaaaagacugucauguuuaucuugcugacaaacucucuuccuuucuggucauguugggaaagcccaugugguaaggaacugggggaggcauccagcugacagcccucguuccagcagcccacaaggaaaugaaugcugcuaacaagcacaugagcuugaaagccaacccuucccuagaugagccucagaugagacuacagcccuggccaacaccuuaauggcaguuugcgagacccugaaacugaagacccagcuaagcuguguuuggauuacugacccacaguaacuauaauacauuuguuuuguuuuuuuuuaagccacuaaguugauuguaauauuguugcacagcgauagauaacuaauauauuuugguacagauguauccccugagacuuacauucauagaaucguuuaaucauccaauuauuaaaaauuccuugagcauccacuacaaugccaggcuugguguuaggugccagagaaacaaagaauacguaugucauagccucuugaaacuacauuaguaaugauuguuguuuaagaugcuggagauguaguggcaggaguaguccaaguaucuuacaggagcaaagaggcaggggaccuaacccuucagguggugaaagaugaagaguaaugucaggaaugacuuccuagcagcagagacacuugagcuaugccaacagugacgaggagauaaccaggugaggugugagaggaugcagaagugaggagcgcccagacagagaggggacaacauuggcaaaggcauugagguucugggaacugccagcaaugaagugagauagugagggaugacauacuguacauaagagaugggaagggugagauaaugaaggaucuaguauacacuguuaaggaacuugggcuuauccuauaggcaaaggggaccauggaagaauuuaaagaaaaggaugaggacauauuuguacuuuagagggacaacuauggcuucuuggaacucugaauuuggaauccagcuaguucugcuauuuugccauagcccacuaaugagcuaacagaugucuaaauuaggacuacacuagaauggaggagaaggacaaguuuaaaaaauacauaugagaggaaaucuaguaauuuguuagugauuaugcuuuuuggagugagaggcagaaagaagucauagauaaccccuaguuuccuagcaugaguaacugggcagaucuuacaaauuaaauagaaaauacaaaauaacagguuuaccauggaggaagaugaaucaacucaguuaugaacauguuggauuugagugcauguagcucauccaaggugaagauugcuguucagcagaccgcaagacuucuuaucuuuugccccacuuuauggccuggcaguacagaagcuauggaaggauauguagauuuccuugauuggagcuaugggggaagaguuguccucagagaagagccugguugucauuaagacauggaugugggguggguuugguggcucacaccuguaauuccagcacuuugggaggccgaggugggcguauuaugaggccacgaguucgagaccagccuggccaacauggcaaaaccccaucucuacuaaaaauacaaaaaauuagcaggguguggugaugggugccuguaaucccagcuacucaggagacugacgcaggagaaucacuugaaucugggagguggagguugcagugagccgagaucucaccauugcacuccagcccuggcaacagugcaagacuccaucucaaaaaaagaaaagaaaaaagaaaagacauggauguggagagauuguucuauaaaauauaaaggagaagggugguauguuuucaaugagaaggaaugucagggagcccgauagaaaagguuaugagaggaagauugauaguggaaggcacagguaagcauuaggaaaugcagggguuuugauugagaugaauguucuuccuuugcacagaagcuaugccaugaagcacugacuucucccugcaugccuguauuuauagacucuuuauauuaaggcauacaggcccagcuuauugaguaggauaauuugaaauuugcuacuuucuucaauuuagaguucgacuuucuuucauuaugucauuguuuugaacagauggugcagaacugcuucuucuugaccuuuaaaaaaacuauuaagaguagagucagucgcuuguccauuucugcuucuucaugccucucauaaugauuccaccagcuuaacugcaacugcuuucauagccggcucagccugggcaugcaccauggccuuuuuccugaagccacugggagcacguuauauucuccugacagacacacuuucaucugggggaagccauuauucauuccuacagggucaccuaaauuggaaacauaacuaugaugaacugaaaucuuuuauaucuguuauuggcuauuuuuuucuagucugaagccuugguucuccauguauuucauuaauacauuugugcucuggacaaacagcuugaaaaaguaacuaggagaauggcuggacggcacuaaagaagugagagaacagaguucuaggcuucucccccacuugccuaugacaaggugauugauacauucugcuauccugggcaagccauuuaaccuuuaugggccucgguugcuuucuuaguaaaauaguauaaauuaaacuuuaccaagcuuaagauagugagcucaaccaaaaucucuuuaaaucuuuuaaggaucuaacacccuuccaaagccaagcccaugggacaguguuacuauuaucuacugcuguguaacaaacaaccgugagauuuaguggcuuaaaacagcugccuucuuuuccuccuguuguugugaaucaggaguucaggaaggauuuaauuggaaauuuugugccugauccucuuggcagucauguugaugauuggggcuggaggauccacuuccaagacgguuucuucacuugcacaucugauaccuccaugcucuuuggcaucuccuuccuugugcuggcucauccucccaggccuuucuauguagcucaagauucucacagccugggggucgcagguggacacuucuuacauggcagcugguuuccaagagucaggaagaagccacaggucucuuaagggcuucacauauaaccagcaccgcaucacuucagccauauuccaucgguccaggcagucacagggcccgccucuugauggcaacaccacauugcacaagagcaugugagauugggacauuguggccaccuuuggaaaguaugacuugucauagccagugauucccucccaaugaauggagaaaaagcuugauuuuaggggucauguauguaaagcacuuggcacaacagcaaguguuuaauaaauaauaccucuuacuaguccaguggaaacaaaagacaaacaggaaugagagccaggacauaucucccuuauacagggaagaggguguuuugcuuaagagacagaauggaugaauaagaacauaauacagaagauugaauacugggugugagauucucaaaauagacuggcugaaauaaaagaguugaauguuuuuaagauuaaauuauuccugacuuuauaauauuugucucuagguuuuguagaucuugguugcuucacuuaaaaagacaauucagaaacauuuucagacaagauuuuuaauaugugaugcuuguccuuucugcuuuugcgacaucaugguuuaugauaccauagugggugauuccagggcauaauugagauugcugcugccuguuuuuuggcagugauuuuuugcccauuuuaugaacuaaauuuggguauuuacauucauuaggauacaguguagccaucuucacuuaaaaguccuaauucaggacauaacuuggacccuuuaaucaacaccucuccauuuccuaccucauuuagaagguacguguacauuucuuuuaaauauuuuaugucuuuggugaugugcgagguucagcuuaugaagaauucuagcuuugaaguugguuuagaaagauugccccuucuaugaaugcauaaaaauaguuuaaauuauuuauaguucuagaaaggcuguguuauuuuaugugggacacaaauuaugggagauucggaagguuucccauugcuuccuguccaaaacugaaucucaauuuuuugguugcagauuuuauuuuuaaaauuuuuauauuuaaacuuuuauauuuggaaagagaaugcauuuauaucuuuugcauuucauuuccuuggugugccccaauguuuucccuggauaugcaguuuuaguucuugucacuagucacucugaauuuuuucuagaaccauggaaggguuuacaagauagcgaucaagauguugaaaguaaauggaagaauacauaaagaauggugguuaagaacacuugacguaagaucugcucucuuagcagaguuuaaguauauaauaccauuuuguuagcuagaggcccuaugcucuguaacgaaucuccagaacuuauguaucuggcauaacuuggacccuuuaaucaacaccucuccauuuccuccucccuacaaccccuagccacuaccauucuacucucagcuucuaugaguuugccuauuuuauuaacagguuccacauuuaaaugagaucauauacagaauugucuuucugucucuggcuuauuucacuuagcauaauauccucuauauuguugcaaugggaagguuuccucauuuuuaagccugaauaauauuccauucuauguuuaaaaaaaaaaugguuaauuuacugaccagccuccuuuguaggaacauauguacuuaacuggagguuccuuauaacuuuagagucuaaguaauauuuuaauugaacaauuucuugcaauaccugccucccagaccuguguuuuauaaguaaucucaaaaguaggugaauuauggaagugguauaccaaauaaaaacgaagcucuuaaauaguuaagaggagcuucuuugugguuuauugccacuugcaaugggaaugacagucacagaagagggaaaggaauacuggaacagaagccaucuccuucugcuuugaaaucucccauguccuguuccccauugggccagcuugguuggcucgcacaugggacaaauacguggaacucacauccugucccccguauguguaaaacaaaugaaaugcaacaaagaucauuuauucacuuucugcuucuaaucgugcagcuuguccugagcuugaauuggcccaugacaauuaguauugaucaugacaguaacagaaaagaaaugauuggugugcuguagucugauuugaccauaauauuaggagacuggaaccugggguuccauauuugacuguguguauuuacaacccccugauuuuccuuggauuaauuaacuugacaaaaguagauaguccaucucgaugguucauuuucugaggaccuagucuguugcugucacauccagaaaaugugcaaccuggcaugagucuuaggagaaguacccuaccuugcagcugucaucugccuggaaggugggggaccaugugagcacaaugcaugcacguagaaacugauugguuuucuauugugguaaaauacauguaacauaaaauuuaccacuagcgauguuuaguaaauugacaaccucaugcaaccaucacuucuauguaguuccagaacauuuucaucacuacagaaggaaaccuuguacccauuaaguggucacuguccauucuuccuuucucccaguaucuggcaccacugagugguguucugucuccauggauuugccuauucuggacauuucauacaaauggaaucaggcaaucugugaccuuuuguugucuggcuuuuuucagcgagcauaauguuuucagcacgacuaauuuuuacugaaugcccgugauguucugggcgcuggaucuacagagaaaaacaaaaccaacguguuaucugcccucaugaaucucaugucauagugguagaaucaggccaaaaaccaaguaaaggaacuaauaagaugacuuuaaaccaugcuaagugccaacagacaucaaagagugugccaagcaguaaaauaugagagugaagaagggguuugcuacuucacagaggggucagggacgaccucuccaaggagaugacaucuauguaaaaaauuuaaaguuuaggccaggugcgguggcucaugccuguaaucucagcacuuugggaagccgaggcaggaggauugcuugagccuaagaguucgagaccagucugggcaacauauugagacuuuaccaaaaaaaauuaaaaauuagcuggaugugguggugugugccuuuauuccuaacuacuugggaggcugaagugggagguccacuugagcccaggaguuugaggcugcagugagccaugaucauaccacugcacuccagccugggcaacagagugagauuccaucucacaaaaaaggaaggaaaccaggucugugaagaaugggaggaaggaauguuccaauagaaggaauaacauuugcaaaggccccaaugucauaaagaaucuugcagccuccgaaagaaggccagguuucugaagcagccggagggaccagaguggcagggaaggcucuggguuuuacucugaagguaaaggaauaucagugaaagauuuuaagcagaggaggauuaugaguaaacucaccuggugcuguguggaacacucaauggcuguuccagugguuugcagagggcagauagcacuuuccugagauucauagccauaugggguacacagcuggguguggccugccguuaaugccgagauagccuuccucccuuucugauuuagacucugcucucugccacugccuagccuggccuggcagucauugacaagccuuaugcucagaagucuccaugaccagaagucuccacugacauuccacccacuagcacaggcugucucugagccucauucugccuccucugcagaccacuuagcauccaguguuacucaucuagagggguucugcugaguucuucagaugaacugcuucauuucaagaugcccaguucucauggcacugaggaggcacaccgugggcccauauaauugacauuacuuggaugggguucagacauucugcucaguuccuggaaccacucacuucugauggacccauaagcccuuccaacacacucaaaccuugucuaugcuaagaacauaugauacuuugguccauaagaacauaugauacuuugguccauuauaacccuguuagaccauagcccuuguagaaacaauacaaaauuugacuuaguuuaagugaauguuuaaauaaucuuuuagagcaccagaauaugcccaucaucagcauuagcuugaaaucaguccacagaaaggagaaucuguauucugugugacuaguaucucauuugucccuuuguaaagagauaaugcaguuucuuugccaaauguagucauauuucuugcuuuaaaauauggaagacucucugauuaugucauuccauaucuauauggacagguuuuacaacuauugaaacaguucuaaucaacuguaggaauugaaauuauuuucuaugggaagucugacuuccuuccauucaguggccugccugauauugaaugauugacauucugauggaguggggagauguggaaauugcagucccacuucucauugcucucuuuucuuccucacugugacgaguguuuuuaacccguuaauaucccuugaaaugggucaugagacuguguguuaggaaaaccaguuucucagugccuccaggcaggaguaacaugacuaguaaaauuaugacugcuuaaucuuucaagaggacauacuugggguaaaagaauacaucuaaaccaauguuaaguuuuaaguuagauggcaaaaaugaauacuacagucaaacauaaaggaguucuagacuuaaaauuauaccaauauaccuuuucuucuugaaauuauuuuuccuuaaacuauauuuuuuuuauuauuuauuaaauguuuauugcauguuagauucuguuuuaaaaauuuaaauacaucaucucauuuaauucuccaguaguccuuugcaguucguaucauuacuguccccauuuuuuaggucagcagacuguggcuuacacacuaaugccagauauauuuuaacccacucuuaaacuccgaauuucaagucagcaaauucucauggaucacccagugcuaggugccauggcaaauuuaaaauguaaaugacauaauuuucuucugaggcacuuuuaaaaacuuaaagguguuaauuuuuuuuucuggagaaucaacaaaauauaacguuuaauauagaucaagaugguuucauauagaauauuuauagguauguguauauacacagguuaguauacauacauauauuucuuuccagcugagagggcuuacaagaaaugauacucuaguagcaacaagcacaucuagcacccauaucuugguuucugaugcuaggacugguggggggcaggaaguauauaagaugagccuggagcaucuuguagugccugaaauaaggaagugcuacaaaagaaaaacaaaaauccacaauggguggagucuguuaaagggacacagaagccaaaugaaacaauccccaauguccaaagcuaaaacaauuuagcaccaaaagaaauaaaaguauuggauuauaaccuaaagugcaaaauaaauauccaugaauccauaccaauacaaauaaaugacugaauaaauuaauuuauucaggagaagagacaaauuucacaugcaaaagaauuuuaaauaaauuauguagauacuccauccuagaagggggagaacauagcccccuccuuaaguggggcuuugcauagugauuuccuuccugcagcauagaaaggggagaaaaaagaguaacuucacaggggagaaaccugguaaauaguacccaagccaugugaccaagggcaauuucaguaguugcaaaccguugauaguauguagacuugagaugaugcaaugaaaauggcacuuuacaugugugcucuuccuacccaugccauaaucccagucuaauugugagaaagacaccagacauagccaauagcaggaaguucuguaauaugccuugccaguacuccucaaaucugucaagguuaucagaagcaagcaaagucugagaaauugacacagaaauugacaugugaggaacuuaaggagauguaacaacaaauuauaauaugauacccuggauaggguccuggaacagaagaagggugguagugaauaaaaggaaauuugaauaaucugcaucaauauugguucauuaauuacaacaaauauaccaugcuaauauaagaugcuaauaauggagaaacguugcgaguugaugaaguguaugugaacacaauuuucccuacaauuuuuuaaaacaaucuaaaacuguuuuaaaaacugaaguuuauuaaugaaagaagugugcgugugaacauuuuacugugauucaugagacagggucacuggcuugguucuugcccauucauuuucauaauucaucugucuaauuuauccugugaguguaggaugaacauaugaauuuauuaaaguggagauugagagauaaguaauuuuuguaaaaggaagucguauaaagaucccuugaacccauccaacuuuagaauauggacaguucagugagaaaaaaaaaaucuguaggcaagaaaugauucucuaauuuuaaucucguaaauguccacauaaagguauuaagauuguuuauguacagaaauauauuuauuuuuguaauaguuguauuaauagauuuuaaauuagcauuuggucuuuucuauuuugcuucacuaauuacguaaggcuuugacuauuaaauuagguuaauuuaucucuauugcauccauccaggauuggguagaaaagguaaaaaggccaaguguuuuccuaggaucacucaggaucaaaaccaggcuucaggccucucaauuccugguuucugugcuuugccuaccauaaagauauugguugaccuucaaaucgcauacuccuuuaaucaucuuuucucuuaugacucuaauuuucauuuucccuugugauuuuacaaggcagauuuuauuaugaauguacuuugaagugagaaaugugaagcccuuuucccgucucuuucccucuaaaaagaauuagauuggccaggugcaguggcucaugccuguaaucccagcacuuugggaggccgaggcggguggaucacgaggucaggagaucgagaccauccuggcuaacacggugaaaccccaucucuacuaaaaauacgaaaaagaaauuagccaggcaugguggcgggcgccuguagucccaguugcuccggaggcugaggcaggagaauggugugaacccaggaggcgaagcuugcagugagccgagaucccgccacugcacuccggccugggugacagagcgagaaccccucucaaaaaaaaaaaaaaaaaaaaaauuagauugccagaacacaauggcaucuucacauuucuugugauagugcuuaacauaguuuguuguuacaucugauugcugguuucuuuccaccacacuacaggagaggcuguguuuccuccuuagcguaagaguuuggcauauaguagguggucaauaaagggaauuucaauaaauagcaaagagugauucagcagaauugccaaauacuguaaguuauuuguaacaaagacacuuuuuccuucagccuuuuacuauccgguuuuccagacucaugugcuuuacuggaagcccaagguuucacugggggaaugugaguguccuagaagggaagaaaguguggcaagacuggaaaaccacauaagcagacacggauaugaccucacaauuagaaaaccauggcaccaauuaaagagucuguauaccuuugccucuuugacaaauugucuuuuugaauuggcuuugugauucaugggcucaaauuugaaacauuaguguuuaauucaaugaauggaaaauacuuuucauuugacucacgaauauugucaccaucguuaugucaccuggcauuugagauugugaugcaacuagcucacuaguucuaccaccuguaacgaauacugcaauuagcugcuuucucuuuccuagccucaguggguucauaaucccuuuaguuaucaucuaaagccaaauugcauuuugcaaaacauguacucccugauaaauuacaaaugauuccauuacaaaggcuccuguagucaaauaaguuugagaaaugucguguuaacaaaguuaaagggcugucucuauugggagacuucugagaguccugacccuguuaaugcaugcagaacccuccaaguauggcauucauauaacaaguuuuuuuuuuuuuuuuuuuuuugagacggagucucgcucugucacccaggcugaagugcaguggcgcaaucucggcucacugcaagcucugccuccuggguucacgccauucuccugccucagccucccgaguagcugggacuacgggcacccgccaccaugccuggcuaauuuuuucauauuuucaguagagacgggguuucaccguguuagccaggauggucccgaucuccugaccucgugauccacccgccuuggccucccaaagugcugggauuacaagcaugagccacugugccgggccucauauaccaaguuuuuaagacuugccugaacaugggcuuguugauaaguacaacaagagguuaagaacucuagcuguagagucauguucaucuggauuguagagccuuagggaagcccugugauuaagcaucgguuuccucggcuuuuggguggguauacuaauaacagaugaccauaagguucuuaugaaaauuaaaugaaauaauuuuguauaaaacacuuggcacagugcauggcaccugggauguccuuaguaaaugguagcuaauggugauauuaaugucuuggagaauauuagaguucugcaaaauacaguuuuggaaacgcugaucuguaaucauauagguuguucauuucauccaguuuuacagauaaggccaauauaaauuccugugauuaauuccacggucuaauccuugcucuaucucuagugcaaaugccagaucuucagucuuacagaacauauugugauguaaacauucuaccaaaaggaucucauuucgaaaccaggcccugcuugugacuuuagcaaccuuaccacuggaauaugugggguuuugaugauuugguccuagaggugcgguuuagucuauucaguuguauuguuauggccaucaaauauuaucuaguaccccuuaaaugagcauaauaguauguagucauauugcaucaagguguaauauguggcucaccaauggagagaagggguaucuggcuaaacuugaugcuugugcuuaauuuagaugugaguaacguuugugcuaucuuaacagaugucccagcacaugguacuuuguuuguauuuauuaauucauuuauugauuuacagauauuuaaugauugccuccuaugugcuggguauggggacugcaaagaugaguaggaagugggcccugucuccaaggcuguagagucaccuuguggagcugauccugagugugaaugaucagaguacaguggagggaagugucccaaggaaggacagagagaugucuagagaaaacgaggcacucaaacucaggcagaaaagucuccaagguagaguaggaauaugccacacagcuuauaaaagaaaagagcuuuggggucuuucaaguggucugguauaaugccagcagcagugggcaguagggaaggggcuaggaaugccaggauauaagauggaaguggaggcaagagcagaccaugacgaagccucagugacagggcaagggguguuguaggaguuuggacugugacauacugauuagguugcuuuuaaggcagauaccuggaagcaguauggagaaggacccggaaggaaccaaaguggaugcagggagagcaguucagagagaugaaccauucaggucugggcuggugcauuugucugggugcaggacgaggugcauuuguguuuaggaaaaagaggcaggugcaaguuuuuaaaaacucaagcaacauuguucuaagcacgugaagagggacuuaugaggcaauggcuauggagauggagaggugaggagagguuuaagagauucuuaauaugcaggauugacagaauauggagacagucuauugcuggcauuauuuugguagacgggagggagaaaggacaucgaggaugacucagguuucuggcuuugaugauuggagauacagugagaccacugacugagaccuggaaugcaguggccagagagaaagaagcaguuuguuccugaaggaugggauccagugaguuggaaguaccugugagguagucaggaggauuuguccagcaaaaaaugcaaauacggcccuggcacucccacaagcucuggguuggagaugugaauacaggauucaucagccuauuugaagagaggggaagucauggggggaggggagugguucaggcugaauuggagugagccaaugagaaggucauagcuaggauaagccuagugucauugcacguugauuccuucucagucuuaagagcauccuggcuugggugcugaaugacgugauuaugcuugauggaacccuaggacacaucaacauuuacagggagaaagagagauggaaacuaauagccagggaggugaaagaaaauagcaagaagagugaugugauagcaagguggggaguguagacaaaagguggaugacagugccuuugggauuaaaggaaagaugcagaaacaucauuccuccaagaaguuugccuagaaggaaaaaaaugcacagguagcuggagagaggcacgggguugaaggagagcugcuauuuauuuuaaaguggauucuacagaauguuuuaguggacugaagggcaucaggcaguguaaagggaaagaugagagauagaggagagagaaaugauggacgggaucgcagaggaagacaggaggagaugaaggguacaagugggagaaguauaccuuaaagagaaaguauggcuuuugcuuuuucuaauuggaggaaucauaaaaaggauugauaggaauacgaauaaauuuggaaguagcugggaagcaggccuggaagcugagaaaauagauuccucaguggccucuauacucacuauaaaggaaaagauaaggucauuugcugauagacaggggagaaaaggcaggagcuaggugcuugagaaggugguaaaaauuuggauaaaugggaaagggagcugacuggaugccucccucacagaaauauuuuuggggugugcugaaacuggaaaucacaaauuuaucgcuaacgcagucugcaucauuuauuuuucuucugcagcauguggcaagcccugugcuggugagacauccauagaugguuggguugauccuauucugggaauaggcugugugugguagagagaugagggcugaagaacuaaggcugaaggugagcaagcccuacggugaaaaguaaagucaaugaggccaauuggaagaaaaaggacaggaagaggaaucccaauagaugacagguguugguaugacuggaauagaugaaugaaaaagagcaggaauguuaauggguugcuguuggauauaggaguauccaaauuuaagauuacagagauggaacaauucccaguggcaacaaaauccaggauguagacauagcaaauuauugcuuaagugaaguaaaaacuguuugucaagugaauaacaugauauuccuugaagcuuuucacuugagcaaccuuuccaauuuauuaguuuggaauuugccauuguugguuggauuuuuuuuuuuuuuuuuuuuuugauacggagucucgcuuuaucgcccaggcuggagugcaguggcucuaucuaggcucacugcaaacuccgccuccuggguucacaccauucuccugccucagccuccugaguagcugggacuacaggcgccugccauggcacccggcuaauuuuuuguauuuuuaguagagacgggguuucaccguguuagccaggauggucucaaucuccugaccucgugauccgcccgccucagccucccaaagugcugggauuacaggcgugggccaccaugcccccagccuguugguuggaauuguacugagaaccugaaucuuucuaugacuggccuagacagaaugcuuuguuggcgguaggcaaacugcaggacuguuuucauugguaacucuugggaacuuaaaaagaaccugaaguuugccaguuagacaccguggcucacaccuguaauuccagcacuuuaggaggccgaagcagguggacgauuugaggucaggaguucgagaccagucugggcaauauggcaaaaccccgucucuacuaaaaauacaaaaauuagccagguaugguggugcaugccuguaaucccagcuacucaggaggcugaggcaagaaaaucacuugaaccugaaagauggagguugcagugagcugagauugcaccacugcacuccagccugggugacagagcaagaauacaucucaaaaaaaauuauugauaauuggucauuaauaacuuguuccuauaguuguguuagcucuguuggauuuugauuuggccaaugguuacacuaauuuugaauaagcuuauuaauaaagacaaaaauugaagaaugaauuuggaauaaucauuuggaggaagccaaagggcacugucguauuucaaauaaacgaugucaucaaugaaaugguaguuucagauaaaugugguauaaugaaugcaacaaauguuuauuuucaguugccuagggauucaggucaacauccugaacagugaagacagagcauuuuaaaggagacuuuguaguggugcuugggauaacuagagagagaaaaaaaaagccaaauaaaucuagacuggacccguuuuguugaauuaugucguuucauagucauguagauuucucauacauuaccuaaccauagaggguuaacguuuugggaccaaccucaucuggugcacauuuauuguguuacuuuaaauauaaucugugacuugauuuacauguuuauugacucaguaugcauacuugagacacuucccaaguugguugcuauguugcuagagucaucuuuuuuuuuuuuaacuuugcuauaguaaacuuucuuacauagauuuuagacccauaaucaugauuucuaaguauuuuacauuguuuuuuauuuuuuuuuucauuuuuuugacuaugguaaacuacacauaacaaaauuuaucaucuuaaccauuuuuaaguguacaguuaaguaguuuuaaauacauccauaguguuguacaacucccaucacuaccauccaucuccggaauucuuuucauuuuguaaaaccaaaacucuauacccauuaaacaaugucccccuccucccagacccuggcaaccgccguucuacuuucugucucuaggaacucaauuacucuaaauaucucaaagaaguggaaucacacaguauuuguccuuuugugacugauuuauuucacuuagcaucaugucuucaggggucaucuauaugaacuucuuuacuuuuuuaagacugaauaauauuccauuaaauguauaggccacauuuuuuuucuugccuuuauuuuauacuauucuuuuuuucuccugcugaauauaacugcaucucuauggagaaaaaaauaaaaaggcccucuuucucaaaaacacaucugucuuccacugaguccaagauguguuaaccaaacuaaagaggguaagaaagagagagcuauguguagaaaaguuaucuuugaaauuuaguuuaggaaacauuuccauaucucacaagccacaggagugccucuaugggaaugugucugccuucauaccucucuggcagcugccccaccuucugguguucccaagaguauuuuuagcauggcauucgacuuacuggaugauguuucucaauuuuuuacuuauaagguuauuuuauguuaauuuuguuauuuuaaagaguuuugcuaacuuuuuuaauauccugaggccauauggaagcaucuugcuccaauuaaagcuaaugaaaaaaaccuuuuacaaaaccuuuaaauccgcaucacacauuuuagaacacccgagucagcuggugguguggagguggugguggggauguggaugugucagaagugaggaacacaccugcugcucuuauuucuucugaucaauucauuugcaaccucugugcaaagaaaguugcagaaggaaaucugaagcacucaccuguaauucuagucuugaaaauguucuuguaaagcauccacaucugauauuuaugccucuguaaguggcagugccuagcuguuuucugagugggaguugauuucugcuguugaguaaauaguaggugucagagaagcauuuguaaugaaauuuagaaggagaaacacgucgguguggaaguaauaauaguauuuacaggggagcaccuugaaaauaagguacguuauuuuaaaauuacuuuuuggugcugcugcuguguccuucucuccagauucccuuugagcuucgcaguauaaagucuccauaacuccuaaauaugagggcaugucguggagcaauugaagaagaaauaauaaauuuggagucaucaggguugcuguagggagcuaugauccaggacaagauauuuuaacaugcauugugauguaaaugguaccccuggauuuguauagccugguggcccuggcuguggcagaagggugcaccugaggaaauaaucauuuauucagugguguguuuugggcuuacuuugaagcaacuugaguucuuuaugaguuaugccuaaaauuaaaaucuugggucucauggugaaaaaagaaaacagucuaagacagcccuguccaaauagcacuuucuuugaugagggaaguauucuguauuuaugcugccaauaugguaacccuugucacauguggcuuuugaacacuugaaaugugcuaguauuauugaggagcugaauuuuuaauuuuauucaauuuuauuuuauuuuuuugagauggagucucacucuaucaccgagguuggagugcagaggcaugaucucugcuuacugcaaccuccgccucccagguucaagcgauucugcugccucagccccccaaauagcugggauuacaggcccaugccaccaugccuggcuaauuuuugcauuuuuaguagagaggagcguucaccauguuggccaggcuggucucgaacuccugaccucaggugaucugcccgccucggccucccaaagugcugggauuauaggcgucagcaacugugcccagcugauuuuauucaauuuuaauuaguucaaauuggaaugaaaacagcuucauguggcucauggcuacauggcuaauugauagcaccuguguaaaaagagccccuuccugaguuucugccccgcucuguguuguuguuguuguuuguuuuugagcaggaggcaggaucucacucugucacccaggcuggagugcaguggcacaaucauggcucacugcaugcuggaccucucuggcucaagcaauccuccugccucagccuccccaguagcugggaguacaggugcacacaaccacacucggcaaauuuuuuauaaauuuuuguagagaugggcgucucacuauguugcucaggcuggucucgggcuccugggcucaagagauccucccaccuuggccuccuaaagugcugagauuacaggugugaacuacugcaccugguccugauuauaaacccucugcuucccacacauuuuagaggggauaacguuuagcauaaggaaagcugcauauggcaucuggaaaugguguuucuguaucggaugccuggucacuggccacccuaucauucucacauuccuuagcuaucuuuggaacucagcuauugauuuccuuuuugaaucacuagcuggggucuuuagaggaaggcucucagcuuuccuggguuaccucuacaaauaugaguuugaauagggcuacauugggagaauuuuugaggcccuagauaggccaaggaagccaggauugaaggaaacaugaugggugauucauaagaaauuaccagcaucaaguacccuuacuagccagaugaccuggagucauucacauacccuccuagaaauucaguuucucacacauaaaaggggaggaauaauagcuguucugccuacgugugugguuguuaggaaucacuaaugaaacaaugucaacugcaaagugcuguuuaaaugcuugucaucauccuuggccaauggccugugcuuacagcuguuuuuuguauccauucacugacuccuuucccuguuaaguagaaauaaagcuaaaauggaaaaaaaaagaauuucagauacuaaaagaaaugccuaaaaccaucaaugucuucaccauugguucaaagaaaaaggccugaugucuguugggcaaagguucccaauccucuuuugaacugacaagugucuagagaggcugggguucuggcauggcuaggacucgggcagcgucaccaaacucagugucccuggucagaaggccccacacacagagggaaucuuggccuugaggggaaaguucuugcuucaggagaaagagggacccuuuucuacuuucugugauccaggaagcagcagcaguuugcagauuaguucugcuccuugccaaacacacucgcauuuguccaucccuuucuggguuccaguuuucacucugcagguugugaaaacugcuugcucauuuuuccacccaaaugcauagccauggccccucuaggccaauggcaacacaacauuagcugccuucagaggggaaaauaauauaugaagaaguagaggaaaugauauccucauuucugcacagauuaugagcauuuccuaaaccuagacacuaaaaaacaugguuagaaucugccccaacuaaauaguugagugacuuuuuucuuguauucuauuucucagcaucaaaccauuucuucuaaugcuagacugcuuagacagugguagaauccaaaauauucccucccucuaaaugcaaaauaaaguaagauauuuauauguaccucucccuucuggaaaaaaauauaacagauuuguuucuaggguuucaaaggauugugcucagcugaauagaaauugauaaauuauuaccuuuugcugcaucauguucagcccacuuuauuauauauuugcauuuaauacucuugauuauguaccuagggagaauguaacauuggcacugaauuacaacugagcagaaaagaggagaaaaaauuucuauuuugauacaagaauaugauucaauuugauugugaauaugacuacucaaguaucugaccuaaaaauauuuuaauaccugauuauuauacaugugucaacaugggaucuugacucaugaauaaauaaucccaagucacucauucaaaaaauacuuugagcaucucuugugccagguacuagggaugcuaggauguaucagacacagccccuucuuucuaggaaccuguaauuagguggaggaggcagaauugucagcaaacaaugacaaaacugcaugauuagugcuauuauaaagguaugaagagacugauggagauauauagagggagaaauuacuaguuuuccaagggaguccgucagcaaaguuuucauggaggagauuguauuuugaucuugauauaaagacauuuacugggcaaagaagggaagaagagcaagccaagaaguucuuucuauagggcuugggugagugcuugacuuauccuaggcacacugcaaguguuuaacuuaacuguauacgcuucuucucugaaugugauaugccuguccccagggauccagcuacagaguaucagccugcuuugucauguucaucuuuuauuuaggccaguuuauucuuguguacugaccauacucuaucaugagguuggaugccagcccagcccauaugccaaaauguguuuguugaauucaccuuuuccuuaucucauccaacauguuccucauguccugcauagcucagagcuuggcauguaguggguguuaaggaaguacuuuuuuuuuuuuuuugagacggagucuuggcucugucuccuaggcuggagugcaguggcgcgaucucggcucgcuguaaccuccucuuccuggguucaagugauucuccugucucagccuccugaguagcugggauuacaggcucaggccaccaugcaugacuaauuuuuguauuuuuaguagagacaggguuucaucauguuagucaggcuggucucaaacuccugaccucaggugauucacccaccucagccucccaaagugcuggaauuacaggcgugagccaccgcaccuggcuugaauggguaaacauaguugcuuauuucagagucuacauuuguguccuagaacugucauaacaauuaguacgaucuugguggcuuaaaacaacagaaauuuauucucucccaguuuuagaaccuagaagucuaaaaucaagugucggcaggacuguggucccucugaaggcucuaggggagaauccuuucuucuuucuuccagcgucugauggcuccgagaguuccuugguuuagggcugcacaacuccagucucugccucugucuucacauggccucugugucucaaaucucccuuccccuuuucuuuaaggacacgagucauuggauuuggggccuuuccuaaauucuggaugaucuuauugcuagauccuuaguuauaccugcaaagacccuuuuguuuuuuuuuucaaauaagaucuuauucaccggcacuggggguuagaacaugcacauguguuucgggaaggguaucaccauuccaccagcuacaggaugcuugccaaggccuaaggcugaguaggguauaguaacuauagaaagcuuuggucaaauagcuguuucgauugccauguuuggauggggaguggaggguagugaugaaagaagauuuuuaaaggugucucauauuucccucugucuuaucugccucauuuugaggaagggucuucuggaagcgcauuuuagugagucaucuaggccaucccauguggcuguucuauagcuccuuugaccccaaaggcuaugcgguaguccacaguagcucacuucuaaucacagcugacuugagcccgguuggugaccugucucaagaucauccaaucuucuaggcuguccaguggcucguggcugauggucuuauuaggaaauugagaugauccacuuauauuuuugcauggcaacuugaguuuugaaacucaagagacugaguuaguugguagugaacucugcaacugaagggucccagggaguuccuccgagccgggcuggcuacugggccgagggucagcaggagugucaaggaagccggucaguagggagagcugacucaacaacguggagagagcugcagaggcaccaugauggaggggcacccguggccucugaaaaagaccagccuuggaccucagccaccuucgaguuuacaugaggcugugauuuuguguuuccuauucuugaaguuccacgaaauauaaagauacaccuacauaguguugauguguuaagcaugcgcucuauauuaagcuuuuuaugugcauuauccgauuuauuccucauugaauagaugcugagauggaggcaacagagaguaagggacuugucuagagucaguccacugguaaguuguagaguaagccucaaaccggggauccagcuccagagcugugcccgcagugaccccagcaccuccucuauacccguguuucugucccagcuuuuauaagccucccugguuuucucccaaaggaacuggguaugucccaauacuuauaucccagagacagauccugaauugauuagccaaauuaguaacagacuaaaaaguucgccaaguuuuuugguguacucuucauuggguuaaugugaacaugaagguaaucuaugauaagccauggagauguagaguuuuugugauauacauuuuuuggaauguauuuauauucuucauaauaaauccauuauaguuuuuaaaaaauuaaagcaaccuuguguuugauggaugucaugccaugauacccuagcaccuucaacucaaucagccagucuagucggucuguuucacaguggcugaaaacacugcccugacuguuuuccuggccauuuuccuguacugggcagacauggccacuguaauauaauaaaacuauuucgagauuggcauauuagagaaaugugcucuugccucagcuuacuuuuucuucaaaacgaauggucuucguucuuuggaaggcuuugugcacaaagguaucuguaaggguuuaaaguccuaaaaauauuacaauacauuauaauuuagcuacaaagucuuccaggauaauaccagagauucagauucugaaauucuacagagaaccgucugagauaucugauuguguuucuggaaaagggaauagauuuggguuugaauaaggcgugugaaauuauagguuaucguuuuuuuucuaucauccacuuauauaauaaugaaaagagaggcuggcagaagauaauacacccuauugaguuaguaauauagggugugauuuucaagugcccgcuacagaaaugugauuuacuugauaauuugaaacagguccucagguaagcauauaucuuuccccaaagucugaaaugucccuaaagaaacacuguuuccugaugaaaauuuagguucgcaaaguaaaaaucugaaaguauuccaucuaaaucacauaccgauugucaaaucaaacacauaaauaccugaaaauuaaaugcucugaauagagggguuuuuuuucuuuuuuuuuuuuucuuaaaggccugccugucagucaaguuugaugcgggugguauucacaugcagccuugcuuuuguguauaagagcaagcaucugcccaguugggcaucuaauuggugaucaaggaguauuaaguuaauuauuugaauggagacuauaacugauauaauuucuaaagcucuggauuauagaacaguauuuuuauagugauaggaagaaaagggacauggcugugacuacauugccaaaacauuggaucguacacauggagccauacauagagucacauuaguggugguuuuguuuuccuaggugcuugaagggcuccugagugccaagucauuguauauguaguuaccaagguaaauguaaguaauuaagggaacagagugcaguggcuuccacugugcuauuucucacuuuguuuugcauauugcuaggauccagagcgauaugauuggcauuugagggaagauaagcaccauacuuguguugcuuauuuucuuuuuaauuaaguugccgucugacaaucauacuuucugacauuuauuuagccuuuacauuuuauaaaucacuuucacauaugcuguuucauuuaguucucucaacaucagaagguagugugauuucucuuccagaagcuaaguggagggagagaugauuccugauaaacauuggggaugcccguaagagggguggcuggcacacuguuucucacuggaugacugccuacccgcugcgcuuaccuuugugcuaccagagcagggggaaggagacuugcagugagauggcaggacgggggucccgugagguaaaggagucuaagacagccuuccauccuccaguuagccagaucccaguuuccgagaaguauggcggacgguuccccggugcuugccgguccuggaguugggcaugaacaauagaggaagucaggagacacagucuugcugaauccucuacaacaugcugggcagaaaggcacucgccaaaggaugcuacguacaaggccacagacaguggucugccugcagaucugccgcaugccacaagcgaccaaauacuuuuuaucuuuucuuuuuuucuuuuuuuuuguuucgcucuugucacccaggcuggagugcaguggcacgaucucggcucacugcaaccucugccucuggguauaagugauucuccuaccucagccucucaaguagcugagauuacagguguccaccaccacacccagcuaauauuuauauuuguaguagagacagcauuucaccacguuggccaggcuggucuggaacuccugaccucaagugauccacccaccucagccucccagaguguugggacuacaggcgugagccaucgcgccgucuuuucuuuuuuucuuuuaaagaaaaucucaucuggauucuuucuguuaaagaacuaaacccaacuccaauaacgccuuuacuaucugccuauuugcaguuauacucaacuugcacaaaauuuguaugccauauacaaauauacacacauucucuuuacacuauaugcacaugaauggaaaucugcuguacuaauauugucuuuuaauguguauguuuaaugugcuguuucgauuauaagcauaucaaaagcugcaauugccucuuuuuuucuauuaucauucuucuuggucugauauugauuauaggcuugguacauuuuguuguaagaccaguugguacuucagcucgacaauggccaguuauaauugauaacugagaaaaaguuguuggaagcgaaaacagaccaagaaccacacagauuguucccgcauacucuuaaggcuacuugguauuuaaauaggaaaagcugugauuauacauuuuuugauaugcccauagacuuguacguguaucuccugagaugcagauuaaauuuugagaaaauguuuugagcaauaauuuaauacagcgcugugguagucuuauuguaaaaccacagggcuuaguggaaauuuuugucguaucaccauagauaccaaaaucuaauuugauuacucuugugaauaguugcuaacuauaaucugauauugacuguuacuuuucaucggcuggaaguagucugcuaauugagcuggaggcaagccagggaaaucuuucaaaggaguaguuuuauauacagcaguuuuaauaagcaauucaaugaaaccuuuuauaaaaacaacaaaggcaagaagggucuggacgcucugagcgugcuugacacaucuaugacugaacgcaggacaaugccggaucaugucggucccucagaccuggcucggcaagguuaaauaagaagagcuuaauuuauucagcaaccgugaguauccuuauuugcuuaacaacucugucaaaagcaacccucuaugucccuggaguugaauaaaugagcaaggugccucuugcgucaucaaauuaugcacgucuauaguacugugaggagggcaguuugcugcuugauuuuucaaucacaauuaaaguaauaucagauaccuuuacugggaagagaguuuuuucaaagaggcagccauaucuuugccuguuaucaccuaggagcucccaaaacacagugaauguuguuuuuuuuuuucuuuuucuugagggaagacaaauuccauagggcaaauuguuagaccaguuauuugugcuuguuuaguuuaacaagucucugcuccuggccaugugguggggugugcuauauuuguugagcuuuuccuacgugccauacacuacuaaacucuuuacaucccuucuauaauuucauccuuauaacauacacuaucaucuccuacuuuuguuaugaagagacucaauuucagaaaauuuaauaacuggcccaaauauacacaguuaauaucaggcuguacguccuggucuuuagucauuuuaacuguacugccucccaccagggcuugaucauuagaugggaggugaguaugacacuauuuacaggaaaaagguguaaaagugcuguuucauugggcugaagugauugguguaccacuucuacuugggccauugaauuuaaaugaauuaacauuuauuugucuauaugguugcguguaauggagaugcccuauggaaagcacuugacagguauuaggugcuaguaaguagucguuuuugucauuggaauugcuuuucaguauguuuggcaugauuuugccuaguccuguguuucucaaaguuacugugcuuuucggucccccaagaaucuuguuaaaaugcagauucugcaaguccagagcagagccugagagucuguaguucuaaacuguucugagccaauguagugcugguggccccaggaucacuuuuugaguagcaagggcuuugucuuugagugcagcaaugaauuucccaugagaugguguguaguuuuuaacugagauacagcaaaaucaccagcccagagcagacguuugucccuggucucaguaaaaaagugaagagccaguugaacuaacuaggaauuaggcauuuuaauagaaaugagaagaagcuggggagggaauagaaaugaaaggaaugcuccaagucaaggaaauacaucuuccuaggaaacacgaaaguaguuggaaaaaguugcucugaagugugaacagguuaucauggaaagaucuugguaggaaaccuccaaagacaaacugucucaaucccacauugcuuucaucaucaaggccccuacuaaugaggcaauuaagguugcuaggauacagacuuuaaggaggcgcccacucucagggcccauccucuguuugcaccacccugagaguuagugcuucauuaaauuuugagcccuagagacuuuauucuccucaccccuguucuaucuaucuaacauugucaaacuggaagugaucuuaguaaucaccguauucagcccucuauuuuauagauacagaaacugggcuccagguuaaaugacuuguucaauguaaguaagagugaaaucauauuuaauggauuccaagaugcacauuucucacugacaguugaacugacaucaggauugucuuaucauugauggcuuuugacuuuagugucauaguuugauuggcaguguuucaccuuucuucgugguauaaaaauaaugauggugcaucuuaccguggauggguucuuauguaccaugaaacacaguauuagagagucagguccucugccuccugauucggugcuccucugcugcacacuuggugacaagguuauccugaugucugcaugguuacuuuggugauuuuagagacagcuuagcauuguggcugagagcaugggauguagaaccagacuucccucccacauaccagccaucuaacuucugcccaagcagcuuacuucucuguaaucaaagguggcaaaaguguuaacuacccaguaguguccuugugagaaugaaaugaauuaauccacacaaaucaguuggaacaguugcugacacauaguaagcacucaauaaacauacuguuguuguugaugacagucucacugaccaagucacccuggacccccgauggugucuguacaauaacuugaaccaaauagguauuccucuaugcaugcuauaugaauguaacuguauugagaguccuguuaaacccuggacaagauuucugaguaucagcauauuucacuucuuaugcuuacuaccaagggaaaccauagcauuuccacccauaaaggguguuaaaagcauaaauugacaaagauuugucuugacugauacagauguuggccugucugcaaacagcuguaccaggugaaauccaugacaguucuguaaucuucuguuaagugagacccguuauuguuuuaguacuaauuccacaauggccagggaguucugacuagauugcaguuauuaugagccuugcucagaugagacaugguuggccacugugccuuccuuuacccugccuccagcucugcaguuaucauucguauuagcccccuugugugauugccuaauacaguugucuugaaaagugauggauauagacaacaugauuguucuucacacuuauucucaaacuuuucuccuuauuuuuucuuucuccucuugugaucgcuguguuuaacuaggugauuggggaaucuggguuaagccucuccuaaaucucuucccuucaccaggcaggauacaguuucuccuccugaacccccaggggacucugcagcugucuucuaccauuuaccacaggcuucgguuuauguguuuacuuguuuugucugcugcucugcugcuugguuaugaggacccuuaaagaagggaucuuggcucacucuuuaucauccugcagcagcugacauaguacuuuacgguucuuaguagacauucacugaauggauaccuuuuggguuucugaguagaucugggauagauuuauuucacccaguucauauauauucuauaaauagauaauagcucaucugggguuaugccaaccucccuaauuaucugccuuauaaaagcagggcaaguuauucucccacaacauagcaaauuuuauccaacuuccauaagccgcauuacacauuaauaauagcaguaaugcuauaccuugguagaugauaauagaugacuucagaccaauuugcuucuaacacccagauuccauacaaugaaccucacguuguacugaugcucaguugucagggagaaaaucuguucuguugguggugagaguuucaaggggcugagccuuggaaggcaaguugaaggaggcacuuacuuucugugauguagcugugaacaagaaggugcaggcuaugcagggcuccuggccccagggagucuagcagaucucaugaaugggauuuuggucuuccagaacugacaaaguagggaaugcuuuuggugaacauuuuuuggugaaugcucuaaaagaccccucagacucccugccaaucuucagguaacauuuacuaaguuugcaacgaaucugucuucuuaaauacacuuuucauugaucgguggacauauauugggaagggcagagcaaucugauauugaagauuaaacagcuauaucuauuugaaaggacucuacaguucagaugcucagggaugugucuugcuucgaaguucuuguaaacauucuuaaggaagguagguguuaaaaguucauucauuacugaggcauuucacugucucuuauuuaugucuuucaccucuaaaagugucagccacacauuuugguuugccauguuacuuugcaccaguuuaaggugaaaaaggcuauuccuaacucagagaguugggaagaagcgugaacagaggauuggauuaggaaacuuagacaaauuuccagcuucuggcagagucuuuauuuggcaacuuaaaaaaaaauaauacuugcaguguuaaaaauuaucaggauauaaaucauaaucucaauacaagauaagaaaaauaacagguuuuauuuuugauuaucugaauaacuucucuucaguuuucaugaguacuuauaaguugauuguacuuaaauccccuuuguaacaaugcaagguaaguaaauaauuaaaacauggcaacugugcagauuaguucaagccuacagauauauuuuucgacugaggcuuuagaaucaauuuuucuaaggcuuagacaaaugcaaauuuuaaccagagagaaagcacauaguuauauucuaguuauucuuucgugagguggucuuucuuugcaaacagauaaacuaaauguauaguugguaaugcauaugagaaucacagagaaucauuuuucacaggccggaggacuuuucuuuguauuccuuugcaaugacagcugggggcaggucaugaauguaucuccuauuucccugucuucccaucuuaccucacuaugcuuacagcauucauguuaugggcuaaaaauggaaggaauaaaaagcaaaagagccuaaaguacgauccacagaugaccucagcugacuuuguuuuuuguuuguuguuuugcuuuuuuguucaaagugaacuuuuacguucauaauucucuagcuucucaacucauaguugcuacagaucuucagcaguuugccauucagucucauuuugucuguuccuuucugaaguuguccacaccuuagugaccccagaaaaacccuuccugauggcaugcagcuaacuuaagggugucaaacuuccuauugauaggagcuguugaacuugacagccucgauagagggugaguaugaggcaugaauaacucaauuuguucuucuugaucacuuagggggcuucauagcauaguucucucuauuagcaucauaaaauaaauuugcaugaaaaugucugugcauugcucuuuuggccuuuucagagaaagcagauuuacuccugcuuuaaggagcucagucucuacuuucauuugacuugaggcauuauagaggucagaggacauggucuauccuuagcggcuaagaucgcaaggcauucugcaugacuguagcuggcaggguagcauuucaggccagugcaguguucuuuucaggugucauagugauugccuuccaaagcauuugaaaagaaaaguuaacauuaaccaccauaacaagugguagcgucauucuaauguugagaucguuauuucaacaaaacaaaugguucuggagugauacuauaugcugaagaaucaaaguuuaacguuagucuugaguuuauuugauuuugaaguugcuucaucagaaaugaauaaauagacuuaaagagagaaauaccacaagcuuuaaacauaaacacuaaguagauugacaucuugucucuaacuucaaaucacaguaaaaucagcaauucacaaaggaauuauauauauuccucagccauugguagguggauuagaagaugguaauucgggcuaaugcaagcuaaucaauagaauuuuacuauccuuagaagacacuccaauggccauucuguuguagucauuauaagaaacaaucauuuacccaguaggcuuuauucugaguagaagcugaaaccacauggugggauuagcuugaucaguccaaacugacugaccauguauccccgcugccccugccccacucaaccauuugauauggcauagcgaucucacugaucauuggguaaaacacuaguaccuagcuaacaaauucaugugcagcuugcaaagcuaaacuuuaugggccugucuucugauguucuuauuugggcagugauaugaugcgaguaacaaaagauggacuuuuauaggcuacagguguauguaggaaauuugucauauuucucucacuccuuuuuuucuagguugcuuuuaaauguaucauuagcaucucuauauauuaaugaguuacuuuuugaaauccaguuccuaauaacaccauuuuucauaaguagauuauaucuuuagugacuuguuuugcuggaguuuaauggcaguguugaaggauauuauuuauuuuuugauuugggcuaagauagcuauaauuggcaacaguaugcguuaaaaauguaaaauuagcaaagcaguugagaaaucuaaauguaccagaucuaugcauuucauuaaacucuacaucuggcucaaaaauuauaaggcagccgggcgcgguggcucacgccuguaaucccaacacuuuaggaggccgaggugggcagaucacaaggucaaaaguuugagaccagcccggccaacauggugaaacccugucucuacuaaaaauacaaaaauuagcugggugugguggcuagcuccuguagucccagcuacucgggaggcugaggcaggagaauugcuugaacccaggagacggagguugccgagaucgcgccacugcacuccagccugggugacagagcaagacuccaucucaaauaauaauaauaacaauaauaauaagucuuuggaucuuucccuugaaacuaaaaaauagaguggguuuaguuuuuuuuuuuaaucagagcauaaaagcuauuaauuaaguuuacguuuacuaaauugaacaacugugguuaagacaguguuaggcuuagaauuuucuuuucuuuaucgaggucuuguuauguugcccaagcuggauucaaacuccugggcucaagggauccacccaccuccaccucccaaguagcugaaacuacaagcacacagcaccgugccuggcuaugcuuagaauuuucucucuuuccugacuuuaggguggaauauaauucagcaggaugcagaauaaauguauugcaagaguuuggaaaaguuaagauagcuguguguuggagaaaaagaacagaauguuuuacaaaaaaagcaaccggggaggcauuuuggaaagggagaagaugaagauacauaauaaugcuaaucauaacaugaagaaaguauauuuuucccaagaaagauuauaaugcuuguuguuuugaugaaacaaaccaaagaaguacaaccaaggauucagauccacuuuuccucccaaaaguaauuggaaagguucuugucuauaagauucuauucuauuacaggagaaagaaauuuuucaguauauucaacuuaauauuaugcagagugaaauacauagauugacgaaaagaguauccucaaaauuuguaggauuuugugugcauucaauaauuggagguuuuccagcuauucguagauugugguauuuccaauucuuuuuguuucauaaucucaacuaguaauuaugagaaaauaauuuuuaacuguccucucugaccuaauuaguauuacauugugcuguggacuacuaggugauaaguuugaagucucugacaggaaaaaacuguugguuguuuguuucagguaacauucaugaugacuuugucuugcaugaauuauuacuuagaguauuacugacccauauuaaugggaucaagacaaauacaucuucuguaagggagaaguuuugcaucacugaacaauaaagcaggacagcauaguuuauggaaaagaagauuuagaacuacauagcgcauuauuucacuuucugcgacauaauuuguagugaaaugcaaugaaugaacucuugaacuuguaggggauauaugcaacauuaaggccaaagaaguaaugauauuuuccuccauagaugcaaugccuaaugucacaaugccaccgcaucaccacaucagcugaaaaaacauuuggggaaagucaggucugcaugucugacuugugaauuacauuaacuaagccuaaaccuaauagcccaaguaugcuagagggaaaggauaaaagggagacuuaaaauugcuuugaauuaaaauugggaaaaaaugagaacguuuguagaaacuuaaauuaucccaaaaacaugucuaccaaaaaguagcacuucuaggcauaguuugauaucuauuucaucaugacugucauuuguuuguucagcaaaugcuuacuagcaccuacugugagucagcuauuguguuaggcacuugggauauggcaguaaaagguaugggaaagagucauucucuugagcucacauccuaguagaaguuuugaacaauagacaguaaacauaauaaaugagcaaaugcuauaguauguuagaaagugguaauagggaaaagaaaguauagaacagaauaauagugacuuggaguaugugugggaugagcuagugugugggcaguugucacaaguuugauuuccuagaagauccaauccauaucauggcaucucucccccgccacacacacuuuguagaauaaaucuauuuuaagauauaagccaacugcuucucaaaaagguuaaguaacuugcccuagaucaagcaucugguaagagagaaaucuguuuacccuaaaauauuuuuaucauacccugcugccucccagcucaguggcucccugcuccccuguuucugcugcuuucugccagggauaucuuuggcucaaaggguuaucucaggaugguaugcugcagauguuuuaucggacacuugcuuuuucuaggccacucaggguucuagugccagacguaguucacugcuauuguuauauccuuggaaauagcagcuuauaauaacuggaaauuagacaugcaugagaggguaagaaggcuaggaucgaaauguuaagauguagaaaguagguuagaggccagagcuguauaauaggugaagggagauaauuacuuaacaagaaaauuguguccaggguugaugcugaggacaguaaauaaggcaugacucauaaaggaagcaaaaucacaugaagaguuagugcugcugguucuuaaaacucacaugcaguaucucauucaguccuuggggccuggaaaguagggcuuauagccccacuucauggauagcuaaacuuaagaauggaaaaaauuagguggcuugccuaauagucgugaaggcggaugagaauucaaauguaaguucucugguugcaaagccucuuucuuucuacuacaccagagaguaagauuagaagagaaagaaacagaggcaaaaggaacaaauacaucaaugucugcccuuugguguccuccaccaauucuuucuuaaguaaagauugaguucuacucgaguucugauuuaagaaauauugauagagaggcagcaagauuuauuuccaccccauccaccaguuuucugggacagccuuccucucgguggaaacuaacucacaauucucauauugucuuuacagcaacuucuagagcugcagcuuuuagcuugcuguggacaagaauagcuagcuuuuauuaagcacuuacucucugccagacaguguucuaaauuuaauucaauuaaacuucauaaugugccuaugaauuagggucugguauuuucuacauuuuacauaugagcaaauugagguauagagaaaggaucuuuccugagauuucacaaguaaaaggaggaccuguguuuuaaccacaaugcuaugcucccucucaacugaaagaugaguagcuaccauaaacuaauaguugccagugcuuugccgguaauugaaucauugcaacaacucuggaggcagguccuuuuauuaugaugauuuuauuuuacagguggggaaacugagucacagggagguuaaauuauuugccccuaguuacacagcuaccaaguaguggaauugggauucaaaucccagcagaacugagccaguucuugauaaaauugcaauuauaugaaagucuauuauuggucuuuaaauucuuaagauguuagugaacuuggaaggugaagggaaucugaucaucuuuuuuccauccugcuugcuuauuaauugagggcuacagaaucaagauuguauggacuagguguagaacugcuuuuuuaucucaggcaaauaaguaauuacacucacuuguggaagaaaggagugagauuauauggcaucucuuguaacugucacuaaagaauaccucuguguuuagcaucaggaaccagcacugucccacaauugcuccuucacagcagugguucccaaaguaggcacccacaaaauacuagcauuaaaugcugaauaugaaaauacuaaaugcuaaaagaaaauaaugguaggccuaacuugcagaaaacaauuaugcagauagaauuuucuucauugaguauuucuuucucaugaauucuugaaucuuuggagccuggcuugucagcgagugacaauauaaaugaagaacaaacaccgagcauuagaaauugccugcucugcuccagcuauauuuugggaguauccaagagugcaguuuccuauuacauucauaacauggaucaucaucuuuggggguuccucuaggagcacccuagcucccagauggaggccguaaggucaagcagccagcauggagcaggacauuugauggaaaaugggucacacaaucuacauggcuuuucuuucuggcaucugguuuaguauagacaaggcccacucaaggaaagcuuguuucaaagaaaaacgcucaaguaggcguucagagaagcuuugcuguugcauugcaccaauuggaaugggagacuuuuuuuuucauuuuauucucaaacguaguucacauccuggucuuccuccuuccuccggccccacaacucucauucagcuguguugugaagguuccacaaccccuuuaagguuuauggucuuaugaagcacagcuggauagagguucuuuauucuuaagccuuuggaaggcuucccuuugaaaguuuacgaacgccccaucucuuuucucuagguaggaacauuaggagcagauuuaguggaagugaggcaugcucaguaucuaccaacacaaucagguacauggaagucauuccauuucugacugcagggauuguuucccauucuuuuacuuaaaagcaaguaagcagauggauuggagcaaauaacaauagucaagguccucugcagacugguggaagcacucaggaauggccucccaucccugugggccaugaagucauuacauucuccugauguucugccuucgcucuguggucuuccagaccaguuggaagcugcagugugcugugcuucucugcaggagcuccccuucaacucccaccccugaacaaacacaccugcaagcugcuuuaguggcuguuccaucuguggcuuuaaggauagauaaaacaaucaauagcagauaagugguaucaugcugcuucaaauacagagggaaacauaggguccccuuuagacaguuaagacggcagcugcaaaaaugaacagcaaugacuugggggagggaccaaucugacaucuguugaccauuuggccaguagguaguggugaaccaaagagguaacuuaaacaaguucagaauccaagaaaaaaagguugaauugauuuggauaucagaauaggggaaaacauucuaucguuuggcaccauuuugaucagaguuagacgauagacaucaggcugauuugucagaaucacuguagagaugauggguuuuguguuuuugaauaggcagcuuuggggugcuuuguacaccuucacauagcuggccauuucaccuucagagauugaacuacauuguucccuuagucuuccucauugucauagaacagagaaguuuuucauuugcugugcuugugaaaccuuaaggcuuuuccauugcucuuccacccucaauccugcauuucucacuccuccucuggcaaaaggcuuauugaggcccaugucugggugucauuccauguuucacaagcacuuagggcuuguaauucgcugcuguggccccacacucuuguuaacugcccccugucuggggucuauuuuucaggccaaggcucuaccaguccaugcuaaugagccagcggcagauaggucagcaagggcaucugggcuaucugaauuggaauuaagggagaacagauuuguuguuguuguugacugucaaacaacucuguuagcuguggccuaagucuuuucuaagucacauugacaagaacgaaaaaugucgaaaggaaaaucuuuaauauuaaaucauauuuauuucauaugcaaacagccauagguguauuuuuauaugagggcuuuuauaaauagggaaaauaguaucggguuuugaaugauuaauuauuuuauauuucucuuauucaagcuucuagaccgcuuacagaaaaugagaccuucgaguucuugcaguuaagauuuccucauaaccuugagcacugaaagaaacuaaaucuugauauuucauggaguuuuuaucaaaacucaauaauuuuguaaagagaauaugauugaagagcggcaguauagcugauccaucauaaauuaacauuaacuaaguacucaugagggauuugugcugugucuuuaauuccuuccaaaacaaaugacgacauucucagcuuugcauuguccucugauauagcacugaccuugcuguaauagaaugcguguguguguguguguauauguaugugcuuaucuaacucauagacugagcaucuaagaugaguuuacccagcuuucagcacaguggucgauaaucagugguuaaucagugcugagcaaaugaauagcuacacaguccagcaauugcuuggaugugguucuuuuaacgcaggcagcccauauucaggccaacucugugaaaaggcacuggcuccucccagggguccugaaacauacuagggaagccauggggggaccacaccgagcuaagacucgccaaaucccuucuccagaaacuggaaaccauucaauuaauagcaauagcugacguuuucugaguucucauuucauuuuauccuuacaacaaucuuacaaggcagauuuuauuaaucccauuuuacagaugaagaaacugggucuuaaggaggcuaaauuuaaguugggagccaguuggauuagccuugugcuuuagccccagacauucuggguucacagccugugccucaccuccuaccgacugugugaccuugagcaaauuccugucaucugccagugccucaguuucuguuucuguagaaugaauaauaauagcuguuuuuaaaaaucugcugcaaggauuaaauaaaaugacguaaauggaauaucuaguauaaugucugagacaggguaaacauuuaguguuuuuauuauaauuaauuauugcuauuaggcccacaggaauucagacacagaccugucaggcucugaaggaggucuguaagcaagacuuggcaaggucaggucugacuucaggaagugcacuggggucacagagcaaaggauggccuggcuugggauagcuauugacugugagagaagugggcacuuaccuaacaacuccaggcugagcugggucuccagcagugggauaccaagugggggugguggaguugaacuugagauaccuuucugaaauagaauugacaaaauguguuaucaguuaaaaauagggaaugagagacagagaaaaauuaaugacaagggagccugaggaagggaggagcuaccuuuaagaagcagaauaaaggagagagaauugucagggugaacgugagagauguuaauguguuguuaauguguuuuguaugguaaagguauacacaggguuguguguuacguucagguuaaugcggacaguggguuugaaaugccaacugcagcccagcuccgaggucagggaaugcuucucgauggaaauugaacccugaguauguuuucuaagcacucuguucaucacuuuccuucucuguaaaaauguggcuauuggacaagaucaggucccuucuaacucuaugcuuuuucuggauuuuuuaaccuuuuguuaauuauuucaaugcaguggaucccuuuuuaacuggcaucacugaugacaaaccccugagccugggguucagagcccucaucccacgacuacaucuuacuuuucauucuccuaucuuguugccucagccauccuaauguagcuaacagagugacucaccaucccccagauacacccucaugcuuuuuuuccagguucugcucacaaugcugccucuaccuggagugucuuccagcugucucuccccugacaaguuuguuacacagcaggcacuacucccugcaagcucccuuccaugccagacccugauuaccauuuguugaacccccccugcccugugccaaucccaugcuuuacaaguauccuaucuaaugcccuaauggaaagucuugcaagacggcagacuucuuaucuccauuuuaugugggaccaaacugagucugacauguuaaaaagcuugcugaagccucagaguugagauuccaucuuggcucacucugauuccaaauuccaagcccuuucuacuucuucaagcugcaggccuugggccacuugguaaaucuuucuuauggcuuuuaucuaauguugacuucugcuuuaguggauucagcauaguuuuauugagcaucuucuguaugccagacaccugcacaaaugauaacucauuuaaggguagguuuuaugucuuacuucuuauauuuuuccaagacuuaacagaaagaugguaccaagguagaaauugaguaaguuuguugaguucaacugaaaugaguagagucgcucaucuaacauagagagcuaucaucaaauuaggagucaacaaacauacccucccguuagcugaaugaucugguuaccuguaggaugacugccagcuucauugggaacucuguuaaauagaucaguugaaauuuauaagaggugacuugggcuuuuuuuuuuuuuuuuuuaacucuuuguucuuaagguuaguagcuguuuuuuagaacauacuuuagauaauuguuagugaaagcaauuaaaugguuccuuaaaggacaagaugaauuuaugucaaaauaaauugacuuaucauuaauggacauguauuuugacauaaauuccuaaaaucauggugggauuacuacuaucaucaucaagauguauuuaaguugaauuuguacaagcuuuuguguuaaguguaugagaaagaaaacuauagagagacuuuauuuaucuccuguugcaggggcaaugaagcuuucuucauaccuaaauauuugagauagcugaagcuuaugcuaccaagcgccaaggccuuuuauuuuaaacauaauuuauaaacauauuucuuaggcaaaauguaugagagaaaaauuuucuaauauucaugcauugucauaaaauucaugacguggaauguguucaacaaacugagcccacuuaggauacuaagugaucuaagugccagguggugaucuaaauuccaaggauaaggcaauaaaugacacagguacuuggucucauggaacuucauucuaacaggaggagcauggaaucaacaaauaagcaaacacaguugucccucgguauagaggagauugauucuaggauuacgccccuuaucaggauaccagaauacauggaugcucaagucccugauguaaaauggcaauaguauuugcauaaaaccuacauacauccuccuguaugauugaaucaucucuagauuacuuauaauaccuaaggcaagguaggugcuuuguaaguaguuguuauacuauauugcuuuuuauuuguauuauuauuauuuuuucaaauauauuugauccacgguugguugaaucugugaauguagaacccauggauauggcaggcaggcuguaagugagaaagguaaccucagauauagugaucacagcuaggaagaaacuacaacaggauauuaggacagggaauuauuugcuuuguaccaggggcaggggaagaggccccuuuaaguagaguggucagauaaggacuccuugaggagggacauuaaaucugaaacuagaagaaugaccaucaugugaagaacuggaguagagcaaagguccugagaugaggggagcacagugcguuccaguuugagcuaguuuguugggccugaaaugcucaugaaacuuucaagaauauagguugggcaggucuaugaccaugggaaucagaagcaugggagaaugauggcauaggaguuaggacuggacaguccucagguuccuggagauaauuaaaaccauugaacaggaucauuguuuacaagaacuauuauggaaguugcuucccuucucugacguaucucucagugacaguaguaaguccuguggggaauuauuguaaacauauuacaaauauuaacucauuuaaaccucaaaacaacccuagaagguaggcgcuauuacuuuccuuccauuuuucagguaaggaagcugaggcacagagauguucauuuucccaagaucacguuuauuuagugguggagauuagaggcaaaccuaaguaguuugguugaggaguccaugauuuuaauuguuauguccugcagccucaugcauuauccaucaagaugggauagauaagaccuuagagaaaucagagauaaagaauaaagaaaacaucaugaggagaugggaggggaguuuaguacagugauauauucauugucugcugggaaguagauaggguacccauguuugaauuugguucucgugaguuuaucacuccacgguugcauaacuguuguucucucacauucgccauaugcuuuccuggaccaguagcuagaauaaacucauuguuuauaauaaccucuucaacuagcuaacagaggaaugugcguuaacaacaaacaaaccagaagcaugaaaggagcugacaaaaaugagcaacagcaaaaucaaaugaccacccaaagccaucuuuagcaaagaggaagagcacugguuccccaggcugcuuuugcgaagcuugcuucaagggcuuuuuauguauuuauuuuuauuuauuaucauuuuugagauggagucucucucugucaccuaggcuggaguguaguggugugaucucagcucacugcgaccuccgccuccuggguucaagcaauucuccugccucagccucccaaguagcugggacuacaggcacaugccaccaugcccagcuaauuuuuguauuuuuagcagagacgggguuucaccauauuggccaggcuguucucaaacuccugaccucgugaucugcccgccucggccucccaguugcugggauuauaggugugaaccaccgcucccagccccagggcuuuuuauuuuuaagaggacacaaaggcuguuugaaguccuggucauggaaaaaucccaccuucuuuucaaccagagccuagcacccuaaauuuugccuauuguacuugguagaagacaccaguacugcccucuccuguuauuuucaucucuuaacucauccugggguuuguuguugagacagaagaguuacuugguccccuucacagaacuuaggacagggguguggcuugcuuacaaggggugugguucaaaccccuuguggaaggggagcacacaagcaagugggugccagggcuggggugagcacuuuugggcucuggccccacaguagcaucuaggguuuuguuauuacaauuaaugcucuuuuagcaguugcugucuguggauggcuaaguguuaaccagcucaguagagggucaggaugacagccuuuuacaccuugcccuguuggucccuggguccuugucuggcauccaggaagaagcaggucacgugcacuugaaggauggugaaugcagagauuuuacugagugauggagguggcucucagugggauggagagcuggaaaggggauggagugggaagauaaucuuccccuggaguuugggauagcugaacuccuuuccguucagcugccucuuugacauucaauuguuucugucuucucuccuucucugccacaccacucugcuccucugccaguggaguuugggguuuuuauggguagaagauguggggggguggguggcacguggcaggccagggugguuuuggaaaaagcaacauucaggcaggaaaacagggaugugaaguucucauuuauggccgcgggcccaggcuugugaguggggcuuuugcgaaggaacugcccucuucugcccaauauuucucugccuccugucaguaucacuguggccacucugugauggcuucuguagaaugucucuagaugacccuuucugguccuuuacacaacucugaguuugcaaaggagaaagugucaaaagaaggacuuccuccuguucugcucaguucuccuuguccccagaaggagccugguuguauucaaauuaggagauuccaguuuauguuaugccuggaggaguagcacugcccuuucuugggagaguuaaggaaguuucccugguuugccuuugaccuggaaaucccucauugugauugcugucacucugccuugguguacucacuuacuuucaguguauucuuuggugaccaccuagaguuccuauggccuccacuauuguggcagugccaggaaauuuuaauaauuauuaaaaccuuuaaagugaaaugugaaagaggcugcaaauucuucugucacagcuucaauuccccuguuaguuguuagcaccgcugagcgugugaccuuguuuuuaauagcaugguuauuuuccuuuguuacuuucauacucuauuucuuuccauauuuaacuuugcucuucuaugaucuguucuaaauuaugguugcauuguguauuguguauugcuccuuaauuauaaauccuggugucacacuuucuccuguuuuucccccauuugcuuucugauuaucuaauuucuccucuuugacuggauuuaugcucauugaaugaaccauuuauuuucuacuaucucuuuauguaucaaagaaguaagauucuucagaaaaugugaucaaaacuuuaggaauaauuuuauuaaguaagaauaguuaacaccugcaguguuuacauggugcuagacucuuuaauaacucauuuaauccaaacagucaggcuuugcaaucaucuucuccauugggaaacugaggcccagaaaguuauauaacuuaacaaauuuggccuugcuauuucccaagaugugcuuccccaaugauguguauuauuuuaugacauaaauaaguugauuuucaaacaugguauuucuucuuuguuugcauacauuaggcuauuuacaugauguucuguuaguuuuuucuacaaauugauuaagaauacuguuauguuuguuuuuauuuuccccuaaguauggguuaauaccugauuaacaaaaugaaagaaaaugugauuguuuacuaauucugcaaacucauuauuuguucagaagauuguaauaaacucuacccuuguauaaugucgagaauaaucauuacauuuuuuagucaucugaaaaaguucuuuaggauuauuauuucauccauauuuaaguuuucaggaggauuuuuuaaugaaauauaaguuguaaauguguuaaggauugucuuacagaaaaaaauggagguuauaauccacaggaggacacaccugugcacaaaugcuuucacacacuaugcacauguacuagaagcaugguugaacuauuacagcuacaaaggcaguugaccauuucacuccauaggaaacuugaaaucaaauuugcugcagacagugaggugaggguugagugucuuuaaucaguauuuuuuucuggccuaagcacuagucuugcaauuccuuuagcuggcauggaggcuauggaggugacauuuaucccagccauugucagauuggaagccacuacugggauuacuggcucuugggcauauugauaugccagguggacuucucauagauaucuguaccuguuugcaacuugguauuuaauauuuacuuacuuacuuucuuugaaugauuaaaaagauuaaaaaggaacugaagaguuuaaacgugagcaacguagaccauuauucuacuauugcacuaaaaggagccauggaaagcugaccauagauuagcaguuccaugggaaugugaaagggacaccuaggauuuuuuggagaaacaucuuuaagacaaggugagcuuguaaaucuuuuaauucucauuccagacuuuggaaacaguuagaaucugaguuacuuccuuuguucccucauaagaacaaaaacauacuugcuugauuauuagacacaaaauaaacugggugacauuuagauuaugaaauuugguuacagacauguuucugcguguuugugauuagguagaaggugcagagcauugcauucucugguuaaguacaggauaguguuaaggaaacaugaguagauagggacugguugauaaacacaugcaauuaaugaaacuuugacaucauagcacuuuggcuguugucagugagcuugcuggccucugguuucuguucauuauuuauucuauuucccuaguugaaucauuccuccacccucacacaggcaacauuauuaaagcauggauuaaaauggaguccaaauugauaagaaguaguuauccaguguuucuggaugaguuugugacuugaaaaaaguuucaagcuaaauggagugauuugaaauguaaauggauuccuuuuccuuuuuguagauaauuguacuaaaugcuaauuugugggcagcuaauguguccuuguguucacugauaagcuguguggcuugaaacaaauuuauaaaaggggacaaguuguuugucagcaaaaacucucaacccagucaacucuguaugugugauacuuuuugugcuucugugaacagguaucccaucuacguuaccugccuccacacgugcagaacuccccacucaccuccccagugauaauggguggguuaucacuggcucucuuucuuugagauccauuuuaaagauuugggaugaaauguccacuuaggauaggcuagacaagggguccccaaaguuuaucugugaagggcuugauaacaauucauuuugucuuugcaggccauauggucucugccacagcugcucaacugugccuuuauagcccugaaguaaccgugggcgauaugcaaaugaaggggcagggguguguuccaauaaacuuucauuuagaggcacuaaaauuagauuuuuaugugauuuucauaaaucaugaauuauuguucuucuuuugacuuucuuccaauaauuuaaauauuuuuuccaauaauuuaauuuucuuguagcuacagggccuuacaaaaacaggcagugggcagauucagcugggaaacccuggguuggaugcgucguuucugcugugaguguccaaguccccuucugaucucuucucuuuuuagcuuucuaaacuuaucccaguacugccuccaggaucuuuggguuuuguggcuuugcauggaagcccugacuaguuuucguuuuguucuguuucuccuguuggagaacaggugaagaggagguggggugggggggggggcgggguggugguggcggugcaggggaagggaacaggcaaagcuuuuuuuguuuacaggagugaagagaagaguaacagugauuuauacugcccuacuacaagggugaagaguuuagacauauagcaucugaggcugcuucugaggcuuuuuuuuuucuauuacaagaaauuuagaugcaauaauuuaguucaugaaaaagaucaugaugaaauaugugugaaugaguauaaugcauuugaaacuuaucuauuuguuauugcuuuuguauuccuuaaaaaaacacgcagauccaauugugaaaagacaaccaggauugacugcaguguuauugggcucuggcugccuuucagcuugaaguccuuucuaaugagagcaaagcugaaucggggguaaucacucgcuguccucaggcacuaguuagcaaaccaccucugguaauuugaacgaugcaaaacauuuuuuuguccuacauagccuuauaauuacugaucuuuugaaccugucgcuuuggaauaaauugggucuuaugcagcugaguccuguaauauuauuuuacuugagggugaagaaguuaauguauaaccucuuuggcuagcacuucagauacuucgaaaaugccuuugauauuuaaucaacauaaaaacaaaguaaauuuuaacuguauguccuuuccuaggaauauuuuaaucaaauaggcugugacucuuuuauuaacuucucuguuuauuugaauccucucuuuucauuugaaugagguggugucacagucgaagggaacauuaauaaaaaccugauuugccuauugaucugcuucaggcauuagagaguacauguugaggucauuugagaaacacgucaaaguuuggcucaaacaucucuuugcacuucauguuggaggaaacagugcuggauuuuggaggcuugugggugggauguacaaguuuugcucauccuuggcuaugugcaguugagguuggcaggucugugggaccccaguagcagauggaggaagcccagagaguucugcugugcagcaagacuggcccaggaagggcauggaccucaccuugcacucccuuaucuggcuuguucauuucuguauccugcucuaucacaauucuuaccauuaagaccuuuccuuucauuggcauaacauaacauauuucuuucuuugucaaagaaagauugugauuuucauaaaaaaugagaugcuugacauacagccaagcaaaaacguguacacaaauuucauagcagcguuacucacaguagcugagaaauggaaaucaaacaaauguucaucaacuaaugaauggacaaaucaaagauauauauauucguacauugaauaucauuauucaggcauaaaaaggaaugaaguacagauaucuugcuacauggauaaauguugaaaacauuaugcuaagugaaagaagccagauaaaaaugaccacauaguguaugauuccauuuauaugagauguccauaauaggcuacucuacagacaagaaguaauauauuaauuguugccagaagcuaggcagggagaauagggaguggcugcuaagagguguguuaugggaugaugaaaauguucuaaaauuaguggcgcugguugcccaacucugugaauauauuaaaagccacuaaucuuuaaaaggcugaaucauuugagagauguguauucuauuucaguaaagcuguuauaaaaugaugaguuugaaaaauagaaaaauuauguuaauaucguuuugucaucaccaaaaacuaauuaguuuuuuguauaaccaguuacacaauuugugacauauauuuuaaaauaauucauuuauuuacuuuuuauuugacuaauugguauaguagucaacuaccaaacaaauauuaucugaaaaaaaacaaguccugucuuauggaugaaauauuaaguuuauuauucagcauauugugauuucaguaauuucuaaauauuaccaggucucauuuaugugaugaguacguugugguggcaaaguacucaaaugugaaagaaaauauuugguuagagauccgaauucuuuuuuucuauaacaacaaacaucuuaacucaguaaacuucugaguucguggcauuaugguucaaaauauagccaacacaguuugugguuuguauacauuuuccuuucuggggagucuaacaguugaugacauaaaaugggcaguuucgugagacauccuacauaggguggcucuuguauuugcugaagaagaagauaaaaaacaguugaguugucucccaucuugauuuuccuuuauugugacagcugaagauaaaaaguccauuauauaccaaauauuaucaucugguauaucugcuuccacuaagacaaaacaaagaucagguggccuauaagauuucuucagccaaaacacaaacggacauugugguuucagauaaacugaaccguggcucuuggaaugggaagaaugcucucuaggcccacuaaggggguuauuauaggagcagcagcaguuguuuguggcaggagaaauuauucagaagauugcuauuucugcaauucugggaugcuccagcugcauagguuggaacugauaauaccaagucaguagcccaucuguuucuaaaaaagcccagagagaaauguaaaaauggcagucagaacagaggcaguuaugugguguggacuaagacacacagucaacaguugcuuguggucucuccuccucgauuuucuaagugauggaauuggaaucggaauuuuaucuauuuguuucacacaaugauuucuguuacaauauuugcaacuuucaauucaguuuagugaauauuuaaugaugaagaugaggauuaagaauaggauuacaucuugaaaagagacuggauggcuucaaccauuuaagcucagaccaguagaagacagaaauacuugggagagugugguuauaugguguaguugagaaaguuuggguuuuaaaguuagaaauacugggguucuuguuccugcucuaccucuuccuagcugugugcuuguaggcaagacacuuaacaucucuguauagucucugaagguucucaagggguugaaauacuaauuuuauuaggugaugagaauuaaaugaaauaauaugugcaaagcgccaggcuuuucgaguaaguauuccauaaaugcuuuugagauuuaacaugaagaaagaaaagacuacuacuggaaauguuaugccccucguauuaucccuuuucaugcuggugauaaagacauaccugagacuggguacuuuauaaagaaaaagauuuaacggagucacaguucuaagugucuggggagaccucacaaucaugguggaaggggaaaggcauuucuuaugugcugacaggcaagagagagaaugagaaccaagagaaagggguuuccccuuauaaaaccaucagaucucgugagacuuucauuaccacgaggacaguauggaggaaacggcccccacaauucaauuaucucccacugggucccucccacaauaugugggaauuaugggagcuacaauuaaagaugagauuuggguggggacacagccaaaccauauuaccccuaguguugaccaaauggcauaaauuaagggaguguaguccucugcaguaauucuaggacauaacccagcagaaguccacaagcaaacugcaacuucuguguuauuaaaccugcauuauccuuuugucagagauuauuauuguuaacuccuaggucaaguuagaauuuccuggaaauuuuauggucauuuggagauaaguucccccaagcuccuuagcaguuagaaaauggguuguauuccuugagucaauugaagaugaauuaaaccaacguugcccauaaguccccaaauuuuaauauuggacuuuaaagauuaacuuauaggaauuuggcucuggcuugaggaauuuuuuuuauggacccuaguguaugcauaacuuuuaauaauacaagccuuaauauuuucaucuguaaaaugggcuuaauuuaccuugugugagggcgagguaagcaaaggcaugcaaagccacacaucaggaaaucagugaauguuaauuaucucugagcagggugcuggagugugcuguaucuuuguucuccuaacuuuuaaauuuuugaaacuuugaaaaagacaagagaugccaaauuagaaugaauauuguucaaagcucucugacuuucggguaauugcuuucccagauuuagagaggaagauaccucuccauacuugauuugcauauucuuucuugacuaaucucuuaugcagauuguuuaauugauuaaaauguguaaguuagcugugauuccugagaagacuaggguauuggugucuggacaaaaaguucuuuguuaaccugaaagcauauggcagacauauccuuucuucauaugcucauaaaucccaaucuaagcacuuuguacuaucugaaauaaguuucuucuuuaacuugauacucaauugcuuuuuauuuuuuuaaugggguaggguccagagaugcuaugaaguauaugauacaucccuugaagguuuuuuuuuguuuuuuuuuuuugagacagagucucacccugucgcccaggcuagagugcaguggcgcgaucuuggcucacugcaaccuccgccucccagauucaagcaauucuccugccucagccucccaaguagcugguauuuuuaguagaggugggguuucaccauguuggccagccugguuucgaacuccugaccaccugccuuggccucccaaagugcugggauuacaggcuugggccaccgggccuggcuccuugaaguauuuuaacaagguuuuaagaggagugaggaggccgggugcgguggcucaugccuguaaucccagcacuuugggaggccaaggcugguggaucaccugaggucaggaguucgagaccagccuggccaacauagugaaacccugucucuacuaaaaauacaaaaauuaaccgggcgugguggcaugcaccuguagucccagcuacucaggaggcugaggcaugagaauugcuuaaacccgggaggcggagguugcagugagccaagacagugccacuguacuccagccugggugacagagcgagacucugucucaaaaaaaagaaaaaaaaacagaggagggaggaauugucaggaauuggagauuagaauauugccaaagacauauuccugagucauguauucuggccugugcagcuagugcuaugugaugagagcaaaaauugaugauuguauuaaaauggaaucaaauauucauuuauuucauucugaaaauguauauuaauccccaauuuuggacaaagugcuaucuaagcuaggcacuggggacagggagauuacacauaagaauuguccaugggcugugcuuucaaggaacuguuuguuuuguuguucagagaagauguauauaaauaaugaauccaagguagaaaagagaaaauuacuguuucuagugcagggaaacugggaagaacuugaugaaaaagugacuuuugugcugcaucuugaauggggaggugugaucuugaauguggaucuugaauguggagaugaugagcuuuuuagucaaagggaccaucucaugcuguuccggaggcaucagauaguguggaccugauguuugggagaucauuccuuggccccugagauuucucaguaauguaugauccgugaacauuuuacauacauacauauauacauacauauauacaugcauacauauacagggagauauacaugaauguguguauauaugaauuaacuguaauucauaugugguuguaauuuguuuuuuggccaaagugcauggagcuaauagucguguuuuuaauauauguauauauuuggccaaagauggcaggcauauuuuuaauucaguugccauuuauuauaaaaauccuggaucaguucagugaauuaugaacuugucucaaggaugaggauuagauguucuauuuuaaucaaaacauuugggagcuucccagcagagacagauagacuuacucacuuccuggcauguauuauggccuugggaagauaaagguggaucauauuuguuuuuucauaaacucauuucaccccagaaucucugacaacugaaaaccuggcagagaugaacaucuaugauugcuuggccucuuuaugcacugaucuuaaauguuaugcucugguuuaaauuuggcuagcuuuauaauugauuauccucaucuccccuaaauucaugcccuauugugguaugaauaaagguuauaggguuugggucauucauauagggggagaggagaguuagacaaauacaaauguauauuuucacuaaaggaucgcuggguucuaaauaguaagaaaauauugauuaaaguuauaaggguggcugguguuuacuauuaauauucccaagguaaugauuucacugagaaaucauaacaaaacacuaagaacuuuauugugaagaagcagaaguuuuaaauuuucuaaaacgaaaugucuugaauuuaguuuugagauuuaaaaguaagcuuguggccugguuccaugccccugacaucacuucccucugccuauagaggcagagaguccuuuccuauugggauagguccuuuccuauugggauaccucccaaagccucaguaaugguaguacuaagaauagccaaauaaauaauauacacaauucuagugcuaaauuuuaccaggucccagugaccuaaugcacauccucaucuaaucccuauaaugacuuugcgagaugggcacuauuuuaaccccuaguuuaaauaugaggacaucgaaucuaaaagaugauaaauaaccugcccagugucacacaacucauagcacagcugggagguuugccuugcuguagcugauuguccauuaccuuucaagguuugggugaaguaauauuccacaauuuaaauaucauacacagcauuugugugugauauuuaaacaaagcauuuguuuucaucugugcuuucauggcuuuaucuacuuccauaauggccugucacaauuaauuaaauuuuuaccuuuguuuuucuaaauugcaaaaguaauuauguuuguaguaaaaaauuagaaaauauagaugagcaagauaacaagaauaaagaaaucaucaugaucuauaaucccuauucuaggaaaaaaaaagugcuaaucaaaagaauauuuacugucugauuccguauguaugauguuugagaauaagcaauacuacaaggaaagaaaacagaucagcagcgucaggaccuggggugggaggucuggaccacaggaggacacacaggaacuguuuuagaguaauggaagcguucuguaucuugauugucgugugguuauaugacuguauacauuuguugaaacucaggauuguauacaaaauagggaauuuuacuguauguaaauuauuccucaguaaacgugacugaaaauauaagccgauguuaacaccuuguuguguaucccuccacacauuuuucuaugaauauccauuacaaauauguaucacauauauauaugucuuuaaaagagagacucugucuuguaaccuauuuuuucacucaaaaauguaucaaaagcauuucugaucaguaaucauucaucucuaucauuaaaaaugagcaugauuauuugaauaaacguauucauuauucaaauuagcuguugucuggauuuucucaucgcagaucuuauuuuuaagcuuuauuggcacauguuuacuaugcgaaaaagaaaaucuuucucccagaacaugguugcuuuaacugaaaaauaaugaagguggucgguugccuaagguaaugucuuugugaacauucugucuguuguuagccugcuagugauuagguagcugaagacuccuuuucaguacauuuucuuugaccuugaauuagauguagggcuaaggcaggaccaaccuguguaagugagcagucacaagaaguucuuuuuaccugauguuagucuuuuguaaucucacuuuuaaaaacaaacuucucuuucuuauguuuugccaguggaaauauuuaccauucgaaacuuacucuuugggagucuaaugaauguuauuuccuuuaaaaggcacaauaaauauuuuccuucugaccucuaaaaguagauggcagaaaauaaaauugauuguuuuccucauaaauuugaauagacauauuaccucuguuucaaaaaugacaucagcuagaugacuucccaggcuaaugacaguuuuccugccagacagaacacuugauuuaccauugucaugaagucaccgugccaccguguuucccauucccauugcaugcuugaagaauugugauacuuaagguuuccuauaaugaaaaauaagaaaaaacuggacagggcucauuguucaccauuauguagagaaagaucucuccacagcaaacauuaugagagugucuucauuggucuugcugaacguggccagccuucucuguuccccacccuguuaacacauucucugccucuucuauguggauuuuuuuuaaguacauauuaguuucaugaaggucuuucugccuggagaaguggaaucccccaacuuuuggaaagccuuuuaaagucuccaugaguccagccagguguggugucucacacccguaaucccagcacuuugggaggccgagacaaguggaucauuugaggucaggaguuccagaccagccuggccaacauggugaaaccccgucucuacuaaaaauacaaaaauuagacaggcaugggggugugcaccuguaaucccagcuacucaggagacugaggcaggagaauugcuugaacccaggagacagagguugcagugagccgauaucgcaccacacugcauuccagccugggggacagaccaagacuccgucucaaaaaaauuaaauaaaauaaagucugcaugaguccaauuagcuaccguguuucauaucuuuucuguaucuaaaauuguuauccucugaccuaguagaaagggucuaaaccucugcuuucuuuuuagauaaacccauagauuauuuuggggggugguugugagguuuuuuugcaaauuagaugaucaguaagucccuagcgccauagacugggccagaugcacugggcaauguaaagaaauaagccauguccugcccuauaggaacuugccauuguucauuugaauuuguugacuuuguuucucucuggaauuauauauaauuuccuguuugcuaugauccuuaccuuaaaauaaaccugcaguauuaucccauucacuccuuggaauguucugauuuaugacuauucagcaguucugucccaucaauaggcucucaggaauguccuaaauuggcaaucuguggacugguggguuccaucuagagccugauaggguggaaccacuagacaaauggagagugucuuuuguugucguugcuuguuucagcaucccuggaaggauaauuuacuuuccaaagcuucauuagcuaaaugaaacucaagucuugccucuuuaguuuaagacagguucuuuuaaaaaaaaaaaaaucuugaugugucuuagauagauauucucuuggauuaucuucccuuuuacaugauacagggcuuuaaaaucaaccuuguguuugacacgaucaauggauggagauccaggaagaggacuggugcuuuaggauuucacuucacauugcuguccucugcagagccuucucuuccaguugacaugcugagggacuuggaaagggcuaacaaucugcuuuuaaacuagcgauguauucugaugcccagugcuucaagcuguuucccuuuuuaggcuuaaguuugccuggagaggaaaguggagaccuugaauauuaaacucuuuuugccuugugugauuugauggugguuuuguggagaauuauuuguccuuagguggacucucagcccaguuuggaaugaagucaucauagccacuugugccaggccccaaacaacccauauagcugaucuuuuccccggagucagagacacaaauagaacuguuucagagcauugcagaggggaacucuagagagguuuggccguggccacucuccuuucugcuuuuaagaugaggugcauugugcuuggacugacuccacauugguaaccaggagacaagcagcucuagaagauguugcuccuagggcauggggcuucucugccuaagaagccuuaggacauuuaagcagcaggaaaagaaaggucuguuuuggcuuuaucuagccaugucacugaguauaaugaccccacgauuucuucuucuucacauucauuuugaugccaauucuuuuuugcugugcuuggggauuuuuguuuuuccucuucaggcacuucccaggguucugcacaaguguccucugcagugggguggcaucccugcucccucugguggaaggccugagccacagugcucugagagcaccucacucacugcagugaagcaaaaaauccugccuagccuguguggcgcagcuuucuauuuugcagucauaaccuuuuacucagcuagucaacaacagguauucugugacugcccaaggcuggagaaucaacaguuccuaucucauggagcuuguauuguagacaugcaucaaaauuuuguaucugaagugcaaauaccagaaauauauaaauuaagacgagcucuccucucccccacugaaaauaaaggaagucuuacucaauucuuggggggaauugcacccaacucaccaauguuuuguaguaggaaauucaaaaauucagaaaagaccguuauaaaucuuagguuauuuuucaagagacauaacuaauaaauaguaccuggggaggccccuggacagucagcaccccccagcugguagcauccugggagcaagguggcugugccuuuugaguuccugaguugcuguuacuuuagcacuuuacacauugccccaccaaccagcugaagugcagaaggagugcaaaaaaaguuacuuuaacccagauguccaucauaaaacguacaaaacagcuuggaaauagguacugugucaaggaagcuuuauuaugauaauauuacuaauggaaagacaaaaguugaaccaagauauauugccuccacauuccugguaaagguucaaaacauaagcacagaguuacuaaugugugagcugucuuuuccccaauucugugcuaaggaagugaaauugccaucaguuuuaguuuuuauaauuucugagcauccacaugaaauagcaagaaagaaaauacccuacccuccaccucacuggcaagggugccagcagugucuuuuagauucuguaagggacacggugaccagaaagucaggacaaauggauucuaccauuagccaaccaacaaaaugaauuuucagauuguucuagacaugagaacaaaagaucagagaagccacaacaaugagauaccuguuacacauguauucuuggaucuccuucuuccacucuguggaugcucugaaggaggcuuuauuuacaugcacuagucgagaaacaguuuuuguugaaaacagauaacaguuacgagaaucuggccaagcuuagacucacagauucugcccagcuaaauggugggaugucucuuucuuaguuuuuaauugugggaaaauacacaugacauaaaacuugccaucuuaaccauuuuuaacuguagaguuuagaauauggaucuccuuuaaggaggaauuaggcuacuaacagaauaaaaaguuuaauucuuucucucauaaguuuaaacugacuucucuaauucccaaauagacacagguuuacggcaaauacaaaaaucuaggcuuaaggugacaaagcagaaauagauuaugcaaaaauucaugggaauaauaaagguauucuuguauguaguugauaucugaucaccuccuucgccuaaguggugagcuuuugacaguaagggcugucucauacuaauucauauauuuguagcacuuagcacaaugcguuacucaaaaguacucuaaaacuauuuguugcuugaguacuaucuauuuuucaguaaauaaucuuuuguccauucaggcaacugcccugaaauuuugcuguguuaugccuucauuauagaagggaaagagaagggugguggacugguagugccagggcucugaggcugcagugcuuucuccaagggaccaucacaacacugcaaagccgcuagagaaaugacagcccaacagaccugguggacuuuaaacaagagcuaagcuaguucagcuggcacauauuuucaagugacuccaaaauaaaaugcguauuugcaucaaacaacuggaaucauuuuagcuuuggaguuauuuaaauuuaucgacagggagaagagcuucuggcuuuuucuauggguuuguccugucaaacauuagucugcucauuucaaagagcaagacugaucaauaaggugcccaaaaagcugccuccagacaaggcuggcaaagagagugguaccucuugugguuucugcguggaacccauuggcauugcacauugacauucuucaagaggcucuuucuauguccuuucuggccuuuugaaaaggugccacuguguuuugggaaaggguccaaagaguagaauaagaucuaguauuaugacuguaaccuuuuuaacaaggugagauuucauagaaaaauguuuauuaaaauaugccucuuuaugaauaucgaagauuaaauguucuguaguuggugagcucaagugggcacucccagucaaaugaauucuauauuuuccaccucaaauccuuuugaauaagacuggaguagacauaaauuacauguuucucuuugcaaauuggccuucaauauuucaugugccaagaauauguuacaaaauuggggcagcauuaauaucuuuuuccuaaugcucucuaaacagacuuuuuuugguauuucaucucaucugcauaagccauuuaguggccagcaaaaacuguuaugagggagcaaacuaauacaucagaagcaaaacccaagauauauuuagugcucagaucuaaguuauucacaauuuaguguccuuuccacugcaggggucuucagacaguguucuaggaaacaugguuuaauaaugucauguccugccuucagguaaguuacacuguuguuagugaacaacgccuuccccucuucucagcauucagccugggguacacagaaccugaaucuucaaacuccuaccuucccgucccccacuaauccccgcagcucagaccaacuauuuguguugugaaaggucuuauuggcguuuuugcuuuaaaccuaaccaaaaugacuacaaaaauuuuggugaccauccagaaaugucuuuggauuguagacuucagggauaaugaaaauuauugauuuacucagcaacuuuguacagcuguguugagggaaaacgaaauuguguaugagaauuuaaauuggcaaaacaaccuaaauccuuauaaauuucauaccacuuauaaaucugugagacuucuuagccuucuuagccuuuuaguuuaaagccagaacagaauaugaagacacugaccuaugaaagucaaguaaacaugcaucuuuuuaucaucacagcaaacugcuugacauugucugaaauuuugaggggaggaggaaaaaggaagacagauuuuuaaauacacaaauuauuacaaacuggcaucucaggcagucauuuggucuccauuuguaagaccauccugggccauuuagaccugagagugaagugauuaauagcacggauugaaagaaguuauuuuaaaaagugcauuaucaccuuuuauuuucaugagguuuagggaucaggagguuaccaugauacuuaguuuuauuauuuaaauaacccacuauaaauaaggauuugucauauuuuuccacuugaaucauuuuuuuucucugagguuucuuuuuuuaaucauaguaucuagguacuuagaaucuaaaaauaagauguuaaaucuuuuuacucuuuugugcucucagaggacauucauaagcauuuguucuucagcugugucugucuuggagaggaguccugcuucuguucagcuguucuuuuagccugacagggagauaagcccaaaugagaugcauguaauugacaaugauaccuacuaaugauaucucagaaaagggcccugccuuuauuggggaagauuuucuuggacuuaagaaguuuuagcugggccaguuucuguggccuaaaagcaccugccucauucacagcccucggugcuuuugagaaugaaaaggggagccuggaccauugcagggccuucuucaucucugauuauuuuguguauuuauuguucacuuauuuauugucugucuccccuucugguaugcuugugucaugaaacaaugaauuccccagugccuggcccgauucguggccucuagagguguccagaaaaaaaguuucggugaauagaauugacgaauggguucagaauugaaaccugugagucuauggaagacaaacgaaucuauacagaaaaaaauucagaagcuggacuacugaauuuuaguauucauuugaggcauagagaaugaaaaugagccauuaaaagacagaaacacaaggaaagaaaagaccuuuauauucaaaacaagucaaggauaguguuucaaauaccaaaaucaaaugauuacagggcacagacaaacaaaaaucaauuguguuuaauuccuuuaaaaauguuuuuggaaagaaauaagaaauauuuaaauuaccuucaaauuaauagaagaacauuaaaagauuucucuuuauggcuaguuuuaaaagaaggcaaaugggaggaaggggaagaauuggaagacaaagcaaaagaggggaauggggaggaaggauaaaaaaggauauaaaaggaaguagaggugacauuagacaggaagggagagaaagacgcucugaaaacucaggccacuuagaggguuggggaguucucccugcccugugaaaugcuauuaguugagucaucacaguuuagagcccuagaccugccacaugggagggaaaacugcuuucagagcugcagaacuacugucuggaacaauagccgaugauauccauggagcagaugaaauaaagccagaagucagacuuggccaaagggauagagguuucacacacuguuuuaucagccacugguucuaugaucuggaagcccucaugucaucugcacaguggcguggaaaauggcaccauucacagugaauugucuuguuuuuguuggaauggcugguagcagugccccuagacccugggacugaccuaggggccaucgugauggaauuuugggacgugcaaaauuugcuugcugagacuaauacagguuccaaccuugguggaggaagugauauuuaauaucacauaaaaccaaaauaaauuauucucuagggaguugucugguuggcauuucuuuccuauuuuucuuccuucccaggccagcucaauucuauuaaaaauucuguuagcuaaaugucaauggguucagcaugucuccucucugugccuacacguugaaauuuuccuauaaaauacuauuuuaauguauuagagauaaacagaauuuuauuaaugucagccccauagaucuacacacaacccagcacccugucugggguuacauuuaccagggcuaguuuauuauuauucucaauucaugaugacaaaauacuuauuuggaacacagaaaaaugaaaguggcuuugcuacuuaaacuaaauugcuggaggaugaagauuugcauugaguacucuagcuguuagacuuaauuaggcuccacaguuuucuaaaagaauugaauauagaguguucucucaguugucuaagaagaauuagccagccuugacugugccagguuggaaaauuuacugguuuaugaagaaaaggcauuuuacagaaaccacgccaaaggguuuuaagcuaugcuggcacuuuuguuuuguuuaagaauugguaguguuaauguuugcucugaggaacuucccugggccauuagcacccugugggcugacauuauccaaggguaguguuaaaagugaacucauuuugcaaaguuggaagguuuccgguagaaguauccuuaucuuuuuuagcacucagccauuuaaaaguaacaaccaccaucuauaucccucuaccuuauaaacagccaacagccuagccuuaaugaaggaccuuuagcuguauucagauauaaucaucugacacuaaauaaaauugugacccaggcucauuaggaauaccacaggccccucacagugcugcuguggccacgcuuugcacugauucaugccucagauugauuuuauuauccgaggauauaaggcuuggcuuggauggaaucagugaaagaggcaaacaccauggcuacagaaagggggugaucuccuuucuccucaucauaagggaucacagcugacacccuuguaacaaaagacagguuaacaagagaaaagaauaacaaauggauugcaugcacauaugugcacaggaaucauacaaaauacgaaaacucgaagaaaaugccagaggguugauacuuaaaucccuuaaaugcccucuucauuggggagagggaaggagggcagcgagggcuguaaaugaaugaggcugaagaccagucaaugguuuguacaugaugcuguuugggaauugaaugggaccugagaacagaggaugguuugggaugauuagcuaggcucuaggugugauguuuaauuuucagucucuuccucugugauaugaguuuucaucuuuccugguuaaugaaauuucagggaagcgauugaaggcaauugugucuuuagggguccaguuucuggguagauaaggaaacuucaaagaacugugugauccugugcuuugggagagacagaggauuagggggguggccuccuuaguucagcauguuaaagugccauauuuugggauaucauuuucugagcuccaacaacaccaaucuuuuuuuuuuuuuuugagacagucuuguucugucacccaggcuggagugcagugauaugagcucggcuuacugcaaccucugccccccagguucaagugauucucaugccucagucucccaaguagcugggacugcaggugcaugccacuacaccccgcuaauuuuugaauuuuugguaaagaugggauuucaccauguuggcuaggcuggucucgaacuccugaccucaggugaucccccugccucguccucccaaaguguuaagauuacaggcaugagccacugugccuggccaacaccaccaaucuuacaaaaaaaaaaaaaaaaaaaaaggcacuguacuccagaaaggggcuuuugagaagaauaacaaugaucccccucaaaaaggagacaggaguagaauuuacuguggauuucggaguuauuauccccaacacuccagaggcuccuucuuaucuuggucagacuucaugaguuucaagauccuucuccaggaaaauagaaucaacucagaaacuaggaauggagacaaaauccauuccuuugggugccuauccagagauuuuugaguugucuguaaauguggaccuauuuacuguguaaugucuuuuucucuacaagcaacuauuuagaaaacauggcagugcuuccauuggcaaauguaaagcagaucuuaaauucuuaucugguccacaucacagcuguggucuugcuuugcacugauuccugucucagguugauuuuauuauacugaggagauaaggcucgguguggauggaaucagugaagaaagcaaacaccauggaggcagaaaggggguaaucuagucuauuucagucuauuccaagugcccuuacacaucucucuaagcccauaacaguugccuggugucaucagcuugccuucagaucccauccccuccuguucaaucucuagguccuuuugcagaacucaguguuuuugugagagcaaaacuuucagaaagaaguuauuuaaucuuugaaagcuguugaaacugguuuaucgacuagucugaacccaguagaaguucaguaguuuuauuuuucuccacucaguguauuaacugcacuguauuaaaucucucuucuccauaaguaacaggaaggcugggaucuuuguuucauucauuagugucauugucacucaagugccuaaaauggugacugacacaugguggauccucaaaaaagauguauuaaauugaacauuuuugguggaaccucacuuguuuucauuaauuaaaaagaaacucgccgggcaugguggcucaugccuguaaucccagcacuuugggaggccgaggcaggcggaucaccugaggucgggaguuugagaccagccuaacuaacguguagaaaccccaucucuacuaaaauacaaaaaauuagccaggcaugguagugcaugucuguaaucccagcuauucgggaggcugaggcaagggaauugcuuggacccaggaggcagugguuacagugagccgagauugcaccguugcacuccagccugggcaacaagagcgaaacuccgucucaaaaaaauaauaauaauaaaaaggaacucaggguugucuaguuuaaagcaccauucucauauucuuuguaaaucucaucuuuuccauucccuccagcaccugccuucuuuaguuuuaaaaggacuuggauggaccuggaggucauucuguuaagugaaguaagucagggacagaaagacaaauauuguauguucucacucauaugugggagcuaaaaaauguugaucucaaggagguagagaguagaaugaugguuaccagaggcagggaaggguguguguagguggaggaaggaagaggggaagaauagguugguuaauggauacaaacauacaguuagguagaagcaauaaauguuaguuuuggguagcacaguagggugaugacaguuagcaacaauauauauuucaaaauaguuagaagauuugaaauauucccaacacaaagaaaugauaaacguuccuggcgauggauaaucuaaacacccugguuugaucauuacauauuguauguaugcaucaaaauaucacauguaccccauacauauguacaaauauuaauguaucaauuucaaaauaaaaauaaaagacuuggauuggggagggggugcuuacucuuuccaucuuccuccccuucccuugccuuggaaaaggguaaaggaauuugauuuaguucugggacacucuuacucuguucuucuucucauucuccuucccuuccuguauuuuaggguggggcggagauagugucucucacaccacugaccauggcugccauccucucucuggagaugugccugcuucugugguaccccugacugguggugggugccugccaggugggagacauccaaauacuggccuuuucaugguacucaagggaggucuccuuagagccccuucaggggacucccuguccuguguuuccuggcuguaggagauacaaugucaacccggcuuuaucaagccaccccucagcuccgcuccuggugguacagcccacagccuuuccuuccugagcucccuugacaugcaggcugcccccuugaguaggacccuggcaaagggauguagacccacuggugcuugggaagcucgcucauccuagccuuugcuagaugguuccugaccccucuugcccuaccauuucucuccaauucacuuuuugccugcucagggugguugggggacucagggcugaucagcaaagcggcugacccugcagucauccagcugggaagcaggaugccagguucuccuucaagcuggcuccuccaaaguaauucucuuagauagucaccuuucucuugcuuuaguugaaagaaaggauaacaaugcuagggaaagaagaagggaaagcuguagcuacucucacuaggcagaagacccggagcuaauuccaccugcugucuucuuugucuucucuagacugagaaggaggaaggaggggcaaguggggaguguggugucgcaggacuauucuaccaucucccuaagcuuuuccggaggugucuuuucucaaucauuaguacucuguagacugcagugcacuugcccaucucuuugaccuuagcuuugcuuccuuggucaccaacauagggcaacagaacaaguccuacucaggacucugcugcacagcuaaagaaacagaucuccaccucucuuuucugacacuuuuaaauccagccaagcaggggcugacagcgccauagcuaagucccucucuguacaguagaguggcugcuguguguuuacagucacaagauauuucugaauucuuugcuuuuagucuugcgguucauuacauaugggaaacugagguguauuucauucuuuggcauagcuccugaugauaacuauuuauuuuggaagggcuuuccuuggauuauaacuuaucaaaagauaccagagcaauaagguauaauacgucaaggaaaaaagaauucccauuuuuccuguguguguucauugggcucucacuacagcauucaagucaguauaagacacguuuacugacagcuggauuacuccgggucuggcaaaagagcuugaaucgacacuucugcuaaauuucucagcaguacauugaauguauauuuaacgugugucauaaagaugugugcagauugcuugaggccguccgucauuaaaggccugaauguauaccauuagccaucacacuggugguaccuccaauauaauugaaaaagguuuagcaauauaugagcauauguaauguuugucauuucuauuaguacucuaauuaaaucagccuucuaaucagacaacuuauaaaaucguaaguaauaugauuagagcaauauaggaugccacccucguauucugaagcacaguuggguaguaacuuuuugauauuguuuugaugaauggauggcuuugcucaguaagcagguaguccaguguugagauucugacaaagcuggcuuucucugaguccucuaaagauuccaggcaaggcgguuuccacuguuacaccuauuaaggaauggaccacguuuccucuguaaugauugcagcaguaucuuagaaauucuaaacccuaacaccauuuccuccagaaaaauaccagcauauuucauuuauaagaaaaaugguuguagauaaaucaauagaaaucucaauuauauuuauuaaugaacaggauuaaguuggauuaacauuuaucgcccuuacguuuugauuauaucaaaacugcagcagagauugcagcuuggguugauccaagaguggcccuuuacacgcuauuggcuuucagcagacaaaauuguucagcagcaguggcuuauacuacauuagucuagaaaccacuguuugagucagccaaaggugggcggucugcucagagcccgcugggcagagugcaggaugccaggucaccagguuggacgugagggcagacuuucaaaggcuccaggccacccuuuggaauuaaaauauugauuaaguucaucaucuguggaaucugugcagcuggcuuuugucccacauugcaaagugugauccuaaaucuuugagucuuuccuuuccuacccuuaacaacaauaacaacaaaaaauaauaauaaaaccuggcugggugugguggcucacaccuguaauccuagcacuuugggagacuaaguugggcagaucacuuaaggucaggaguucaagaccagccuggccaacacgcugaaacuccaucucuaccaaaaaauacaaaaauuagccaggugugguggugcaugccuguagucccagcugcuugagaggcugaggugggagaaucucaugagccugggaggcagagauugcagggagccaagaucauaccacugcacuucagcugggugacagagugauacccuuucucaaaaaaaaaaaaaaauaguaagaauaaaacccuccccuacccuuaacaacaacaaauaauaauaauaauauacaguaauauaauaaaaacaguaaauagcugccauuuauucagugccucccauguggcaggcccugugcugugugcuuuccaguaucagcucuggucucugugccacucagagaggauugggcucagugaguguuuacagcuugcucaaggucauacaacucauccaaugguaaagucaggacuugaacccaagguacagaguucuccacguugccuccaucccagggugggccuaccccaugugcucaugaaacagacucagauguguuuauagccacaguuuccgaugcuuaucacccugcucuuuuauugcuuagucuuuaagcaacacaaaaagaucuauuauaucauuacaguucauuuuucucauaauuguauucucagcggaugcaauugacaaauuaucgaguuucucuugucucccugacauucuuacuuaguuuugaaauucuuuuacaugaacgguucucauaaaaagaaacauuguuacuuuucaauaggaauccacucaaguccccaacgcccacugcaaacacaaugcaaauuugcccacaacacagacagagaauaagcaaauucacagcagaaaaacucauccacuuuacaggccagacuuagguagaacugccauagugcccauuuaucccaggauauccaccacaccuccuaacagugugcaauuucagaccagccagacagaccuuggugcaagggacauguccagguuuaaacuuucucuagaggauaaauccucccuccuguuuguuuucugugccucuuuccugccuaccacaguggcagccuauauuccaacauggaacucagagaagauagugauguuugcugauugucugaacaacacauugucccuguucuacuaccucuuauguauuagaauugugauucccaagcuugauccuguaacagacucauuugggagcuuguuaaauacacauuccagggcucuaccccagaaucuccaggagugggguuuagaaagcauuuuuacaaaagcucuccagguaauucuuuuggacagacacugccguagaauaauaaauggaauuuaaaauaaacaagagcuuaucagagcucugcaaaaccuccguguccacuccugccugccauagggagcuagaagacuguguacagaaaacuguuucaggaguuaccagugcuuuugucucuuuucuuccggaagccauuuaaaauaaagcuugcaucguacuauuacuggucuaauugcuccuguaaaaagaaaggaaugaagauuauaauggaaguauaaaugcaacaccuuuuaaggcaggaacuaucuuuuagggauaguauuuuuaaacccccauugcuuuuagcaaaauuggugaugguuaaguaguggugagaggauagaaauuuuuaaaaauugauauuaagaguugcaaggcauugaaaauugguaauucaaucuccacuaaaagaaaaaggaauuauaacaauaaaaagcuuaagugauuagugcccaguaacaaaaaucagacagcugcucagcagcgucccuuccuacaagagacagaaauaguccggugguucucaauugaaagaugggcugccuuucagcagguggguuguauguuggguauguggaacucagaacauauuugcccuuagauacaaaguagccucacugugcuggguaccugucccacaaaggacugggcacaggagauuuugggagggcggcugcuuaucacauggggcguggcugaguaaucauuuugaccaaauacucccuguggcaugcucaccagacugcuggggccgacaguguggucccucugucuauagucuuggccuggucuuauauuuuuccuuggcuggugucuguuuuauuacuuaauccgugcaccauucaccccaaucacuuuuggcaaccacacuuucuuuccaacagcaucuaauacgcucagcaucgcccauuugcucaguagcucuucacugcucgggccuugcgugcaucacagaacgguuugggagcaggcagaccuagcuuugcaucucagaugugucacuuauuagcuccaugagcuuggguaugcaaccucacaucuccaggccucuguucuuaugugaaaggggaauaaaaguacucugugacuuauuaaucagugcacucagguauuagaaaguguccugcacauacacuucuucuccaggagcuuuggauacaagagucugugguaaaugguuccuccccuccauguucacagucuagugaaugaaugagacauuuguuuaagaagaaaagucacgauaagggguauauacuccauggugacaauggugacaacgaacucugcuuuuaucccuucccacagcagcguccuuucccucugcccccuucauaggcaugcccccuccuuuaguccucuuuauucuugggaugacuuacucacaucucugugcuuggcuuagaaguugaaaaauaggccucguauuucucauuuuauuggagacucuuuuuagcagggucaacuuggauuccaaagaggaaggaaugaguggagagauagggaggagaagcugccaagugggcaugggcguggggguacaggccguguuugucacuggggacagcuggaauuauugacauucaugaccugcaauuggagaguaacuaaaauacuucaaguugugagggugugugugugugugugugugugugugugugugugugugugugcaugcgugcaggcacacaugauauauuaaaaauuaauccuugggggagauuauauagagcaaaaaacgagagcagaaacauuaaacccaucuuuauuuuuucugggagcuguacaguuuaagggaggcuuuuugccuucucauuggacaaaaccugauaggugaagucugggaagagccaccagaauaacagcuuucuccuuucacuucuggauuggagaaguguagggccaagucuccuuugaauuucacauggggccucucauuucccuaagaggacccuuugggucugacaaaugaagauauuuucaauaaaaaucucucauuagcuugguaucuuagggccaaguuuugcuuuugaagauuaaacuguuguccuggcagauugguuucuacauaauuuucugugcaugcggagcuggagcuguacgucuccacuggcuacaucuucacuauaaugagauucuuuuuggguguguuuccuagggacucuauagacaaggaccuguauuuuuuuuaugccaguaacagugacuaagacauaugagcauccaucauuugcucucuaaaauggcugcucagucacagcugugagaugaacacagggaugaacuuggucaggaagacuaaauccuguucauuucauccacugauuaaauauggcguuauucuggaaaaacuccuuagaacugaucuuucucuacucaugccauaggagcccaaaaaugucaaaugaauacacuggcaccaagauuccuaggagagaggcaggaauguggauuucaagauuucuuaugagacugcgcagcauugugaacauccugaauaaagaagauauguguucagugacaagggugaacagccucaauucauccugcccuugagguucuuuucagcccauugcuaguuaaguaaauaggccagcaauuuagcauaaugcucugguagcuucagguuuugcuguguuagacacucauuucauguaggacacacaggcuugcccuuuuuaauguuauuaucacguuuuuuaacagcacuaacagcacuuauggcccucuggauguacacgugggugucuaagggcccccuuuuuggugauaccauuaauucaaauaagaagauggccacauagaagacaggcuuugcccacuacaucuuccaaaugucagugucuuguguuugacaguagagauccuuauaaauuugaagccucguucaguauucacauuggcgagcaggcucuagcuauuguuggcagagugucugcaaacaauauuuuuaggagcauuggaauuaacuuuuuuaaaaauuaauuucugguuuuagaagcuugucaugguuuuccuuugcuugacagauauuuauugugcaucuucuaugugccuagcacugugcaagacacuggggcacaacacugaacaaaacagagaaaaucccugccuucauuaagcuuauuaaauacauucaaugagucaauuaaacaguaugccacaaagugauguauauuaauagggaaacaaaucaaacaacuagggcaacuaggauugggagugccaaggaacagugguguuggcaaauuaggugaguuugaaaagaaauuuggauacaaauaauaggcugaauucugcccaaugacugggcuguagauaccuuugugacaucauuuguaccauugucuuguuauuuuauuugaucuuucaugcuauguccugcuucuguuaguaguuuguaagcaacuugaagacaggaaugauaaaucauaaguccuggcuuccccuaguaguacacauugcaacugcuccccaccuguggauuggauuaaaugcauuuauaccuccccaucagcaaaagauaagugugaccuugugcguggcuauuuccuaaaccuguaucaagugugugaugggggugugugugauauuuaggauauucuuccuaagguagaauggugguauuguugcaguccuucgucgaauuguucauaguaacucucuccuugcagcacugguuggacuaugaggaaaacuacuagagaccuuuucuuuucuauuccuccucuggaaaaauuugcuuccuuagccuaaaagucacaggacagacgguuaguaacggcuugaccuaaaccaacugggaacaguugccuccguauucauauuuagcucugaagagcuucagaccuuguggucugauccaagauauuccagcugcugucaggaaauucuuuuuuauguucuuucuaaauuuaauugaagucuauuugucuuuuuucgagguaggcuguggaagaggcaaacuaguugaugugauuagcagugagcccugucauggccugucaggagccuuucucuugaugcuuuccacccucugggcugugugagggaugacacaaaaccaccugucccaccccaaaagauagucugcugugccuccucacugggcuuccaggacauuuucuccaagcccauuuuacucagggauucauugauuguaaggaacaacacacaugcagaagagcuuaaaagagaaagagggauguguuggaagcacacagauguaucuaauggaagcuaaaccuggcagugcgccacccuugcaagggguauguaagugaagucaucauaacagaugaagccucagaccucaguggcucaggacagcagggguugaugucucgugcucagaaacucccacagcugggugaggcaggcugugcuccacacagucauucagggguccaggaugucaaaucucugcugucuucccccagacguccccagccaggcagcugauaggagagaugaguggaagaucgagcaggugguuuuaggggccagucacaaaaguggcauaaaugauuuccacccauaauccccuggccagaacccagccacgugguuauggcuuacuggucgggagaugaggaaaugaagucuagcuguaugcccauugguaaagggaaguagguuuggaggacaguuagccaucucugccauaaccaggaacuugaaguccgucuggagcuaggugagccacuuccuuugcccugccagaaaacugugugucuucugugcuuguuucuguucagaugaggagagggacagagaugguuuuuagugaguaaagaaacgcacauccucucccuccuccaugacuuugcaguccucuguguggacacuguuuuagcuugcuggaacaccaugcugggcuucgguaaggcccuucaucgccccuugcucuuggccaggggucaaaggucagcugaguuguuagcauauucugugcaggcucaucucagacagcuaacaacaggcacugaaauaaugucuguaaaauaugugagcaaagacaguucucccaggagacucugaccuaaauuuugagccaggcucugcaaauuugccucuuuaacuaggaaaagaugaaacaaaggacagguuccuucaauucacaucuguucaguccugccucagcucuagauaauguguguuccuuaaugcccccaagggagagggggcuuuaccuucucuccuuucgggguuucuacacuguaucuucuccccaguauagcagucaacacaacucccagcuccuaggcucagccgcacagcuuuaaggggguucagaugaguuugggaucaggcauauauuaggaagcaugugugugugugugugugugugugugugugugugugugugugugugucagagcgggggugggggagcuggagagagagagagagcguguuuaggaaccgcuggggaacacugcaguuccccagugaacacuguccauuuccccuguuuaguguuugaggcagcaaagcuauuacaggaauaggaaggacaguuggccugacccaccccauagaggucuguccuaccccuauugagacuggagaauugucaccaccuucccacaccagaggccucuuccacagggccauguauacugucuguuuuauaagccacaucucagaaauguuagggaguauggaaauguuggggccagugccaugguuguauguugagggagugaaacucucuucucagguucaggagaagguauuacaagaagaggaacccauacccagacagcccugcuguuguccugcauuguugagggaggaauuauguccuauguguuuguaguaacagaauccacagcuaagaaaagacaagcucaggagggaaguccuuggguagaugcuaaagagccuucucuuuguucuuugugccagaagcuauagguuucuaauuaugauggcaggagaaguguccuuaugaagugugucgcuguguauaaaaauaucucuauguuuuguuauugcuguguucuuugugugauagauguuauuaggagcacacucuguccuuuccaaggacguaaucugacuguuuucuguuuccucuucuuuuuugcuuugcuuuccaaccugaugaugugcugcuguguucuguugcaaugaaauuccuucaucuguuucacaucgcaacaaaaagguaaggaacugcaaaccguauuaacaugcugaaacagcaccaacuuauauaacaugcaaaaggagaugcauuuuaaucacugggaauuuuuuuacuuuaagagaaaaagugauggauugugaggaccucaauucucguauugguguuuggcugauggauuucacaucuccuggggccugguguugaauaagacucagguuuaugugugugaugggggaggaagucaggggggaaucuuuguguuuaugaguuuuugucagcagcucacaaacuuggagaaacauucacagacauuucacaguuaagcuguguaaagacaaaaauauuaaauaaaaaggugagagggauguuaauauugcuuuggcuccagacuuugaagcaaaaguaauucaacuaauaaugaguucauuaaauaugugucaugauaggggagaggccauuuagguucuuugccaaaugagaaaauuuguaauuuuguaucugcuaaucacauccaccuaccauauauucuuuuuucucucuuugccuauuuucgguggcaaaaaaaaaacauauaaaauugaccauguuaaucauuuuuaaguauacccuucaguagcguuaaguauuuuaacaauguugugaaauagaucuccagaaguuuuucaucugguaaaacugcaagucuauacccauuaaagaacuuuccuuuuccuuuccaccucaggcccuggcaaacacucuucuacuuucuguuuguaagaauuaaacuacuuuacauacuucgcguagguggacucacauaguauuugucuuuuuaugacugcauuauuuuacguagcauaauagccucauggcucauccauauuuucgcauguaaccggauuuuuuuucguuuuuuaagucugaauaauauuucauuguagauauagaccacauuuuguuuauccauucacccacugauggacaucugggcugcuuucacuucuuugcuacugggucgccgugaacauguguacaacuuucccacuguaucuuuugauuggaugaauggauggauguguauauccauuccaaaagucaauuuucacugucucuuguauuauuaaauuuucaacacagccaagccaagcauuaguggcuccuuaaggcugaacacucaucuugaggcuuaguggcugucagguuccuauucccuguccuauaacccagcauccuuucucuucccuacuucucuuuccuacaaauucagggcagaaggcuguggaagcacauguucccccugcaguccccaucacccucacacuggaaugauuguccuuuguggcacacguuguugcaaguauuuucguaauguguaucauuucauguaaaugaugugagcucaagauuagucaugaauucaaaucguguugcuuuguugcuuggaagaagcucauuuuauugcaguaauccauaccaagaagaagaaagcacccuaugauccugaguagcagacgguuccuguuuuuccucccacucaucacuggggcacacuggaucaggcaagggagaacaguaccugagcuacagggcuaugggaacaagaccuuacccgucauugaguugagguucugauggugaaaaagggcuguuuucccaaaguucucuugggugcugcuaacugugugagaauaguggaaagggugggagcuaaggaggugaguggguagggagauuuugguaacgcuggagcuuguggcaacccaugugccuucacugcagucccagauuuucucugggaacagcuucuauaggcagaguugggguucaccuucagauagccaaguuaagaaaaaaguaacaaccauucucugauguuuuuuuaaaugucaucuguaaaaaagcaucaagaaugugcuucuuaagugguaauauuagcagauuugagaguauguccuagacuggggacuugacacagaaaacagacuugggcaacagggucugcagagauugagcaugggaagugcgauguguugagcccuugugaggcuccagagcaagauaaagaugcgcccacuguucagcuucuuaaaauacgccagcugggugguguauucccuggguaggcagggaauuugcuccuuagauaggcccccugauucaggauguuuaguguuaguggcaguuuaagccuucgagagcuguuugggagcuauuuugcuuaccagugcuuuuguguacauuccucuguguucugcgugggaaaucaaggacgugcuggacuaugcaacugccagagccaccugcaaugccauggaggcaaggugauuuaacacccagaguuccacuuaccgauuagacuguuugcugagaaagcgagggccagcuauuucuugaagaucaguaauggggagauuggauaacagguuuucuggcauguuauaugggucuagggaguaccucuuuuuguaugugccccaaaauuaguaucauugauaaaaugcaaggaaucucccuugugguuucauuuacuuuuacauuaauuugcaggcacagguggacacuggacacuuaacuugcucaggauuuuuauuuuagugcacuuuaaauugaaauuaaaaaguaauacugggcguggugacaugugccugcagucccagcuacuugggaggcugaggagacagguucgccugagcccaggaguucaaggccagccugggcaacaaaacgagauccugucuguaauuuuuaaaaaguaauacauagcaugaguggcaagaaugggacugcugagaaaggagacaguuugagacaugguagucuucggaaguccaucacugcaaaacaugcaaguagaaagaaauacacagcugccuuggguuuuggcuagagauguuauucauauugggaauuauaaaugaguuaugggaggggaaaaggaacagguguguugggcuguggggugggcgagaggcagugaagggacccuggcuggguccacacucuccagagggcucuccuucgcauggugcaggagcaaggccccccagugagacagggcugggaacuaaggagaacuuaagcagacugggaaacagaauaguuccuguggggucugggucaggaagacgaggaggcaugcgugaagcgugucugagcaccauccaugcuucucaaaguuggugguguuugaaucaguaauaaggcagcuucacaaagauuugucuucucuccgucucagugaucugugacccaggcagaggaauggauagaguggauggugggaauggucugaggccaggaauuggcuugagggguuuaggaaaaugcuagcagugcaggaggcugggcuguggagaggguggcuuccaauuccuuaauccugagccuuggaauggaaagggaaggccggcaauagacaacagagggauaaauggucccagugcaagaggaggagcugaauggaguggaauggcgcugugggcguggucagacuggggacauggagagaggauguguccaggggaaggccaaggcugacacugaccaaacagagggcagcucuugccucuucugaggaaggugggaacguggacaguaugcuuagagagagucacguuucaauuaaauccaagaagggaaggaaagauugaaaaauagguaugggauacagaguagcuuaaaguaguccuaaagcagggcauagcagguagagguuguagaagggaauaaaucuuuccuuuaaaaggaggugggagcaggcaguggccaugguuucuuuccccuucaagaccagcaaauaaaagaacaugaguaaaauauagaaaucgcuuaaauaacaugaauauuuuauguucuccauguuaucuggaaacccagcuguuugcugaccauuaaaagaagacaguuauagaccugguaguaaguuauuuaaaaggagaacucagaaaauguauuuguugaaagauguuucuugacuugaauucuccauuaugcuuuuggccuuugcagaaagaaggaaaucacauuauguacaaacguuguuaauuacucauuaaucugacauuuugauggcauuaagcaacaaauauuaauuugcgacucaacauugugauuguaucuaaaauguaagacaucuccaaaaauaugaaaccuacaugucaaaauuacuuucuucaaagacugauuuuggcaaaacucauuauuagagccuucuguacuuuaaaaguuuuaaaugacacacugcaauuuacagaauucauuauggugcacaacuaauuagaacuuuaaaggaaaucacaguagggaauuagacauuuuaaagagcauuuucuugagcugaaguguucuucaggauaaagguuguuuugcaguaaacgagacacuuggauuuuacauacauauauagacacacacucugaaggguagcauguuugaccagucguguucggaaaucauucuuguucucuguuuagacaaaaggaaaaagcaacaaaggcgacaagggaggggcaagacagaaaugcaaauuagauguccguagcauacuugggagccaaacaaaaaaugcagacauaucuaauuaguuuccaaagccagcuuuacccuagggaaaaaaaaaaauucucaucuaagaaaacagcagugcgggccgugagucccagguguaugggugauuacagcagagagcagagaaagccacuguuguuaggcucagcugccucugugcuacacaaaugugcuuacagaaagaauauaaaaucgaccauggauaacucccucccuuuccccaaauugauuaauuucucgacgugcuggcagguuuuuccauggauggggaucgaguuugagagaugaauguguaaaucaacagcaggugggaaguugaauuugucuggcccagcugcuguuccccgcauuuccuauucuuucugguuaucucaguccagcaucugucauggagcaagacucaugggcuucugucaucucaggccuggggagccacaguguugccugugucuuccaacagcucagugcuuucaaauagcaaacggcaagaaugacggccccgucacuauuagcaggaacugccagagaauugaggaggguauuuuuuauaucauguguugagauuucucuugauucuugauguggacacaugcuuuccacuucaccuugcauuuggauacuugcaugaucugggcucuuuuuacaauacuuccuuucccaaauuuauugcauaauaacacucauauuugaaugugauuuucuuuguauuuuaaucuugcugauuguacaacggugauaaaaaaugaccugcuuucuugccccuuagauuaaguuuugaaggaacaauguauuuuccacacacuuuggaaaucucuguggaauuuaaucauccagccgaaacacaauuucagcauuucuuaacaucauacaguuuuaguguugggcguaaccuucagaggucaacuucucuacucuuccaauguaggaauccuucugcccgacucaucacagauggcccuccagucucugccuagcauaggucgaugagguugauucugauauggaggcaaauugccaaugccuaucuuugacagcacuucaccauuggggaauuauccuaguaauauuuagcuuaccuuucuuagacaauaggguugcuguuucuccaaggcuuucuuugaaagagcaaacagacugccuugcuugcuugcaauguugcuuggauagaucuuaucuucuaaauaaaauuacaguuacuaaugucauuuagaaauauucuacagaaaguauugacugauuauuacuggcagaaagaaagucagaucuuugauauuuauuauaaaagagaugggugacauugucuuaaguuuagcuacagcacaaaauauuacauucagugcuacagcaggaugugaucacucaacuauuuagcuuauguauaucguuuauuuuuauuauuugggcauugauuuucucuaccauuuguuuccacaugaagucuuuuuuuuuuaacaaaaucuaauuucucauaacaagcagaaaugcuuuuaaggaauuauucuuuuucguccugucaaguugcaggaaacaucaaauauugacuguaaacuguuaucaauuucauaugugacaaggucugccaucucuucauguacacauauuuucacggcccuuaauuacuuuuuuauucuuuaaaccuuagcuaaaguauuugguauacuacauuuguuuuuauauaguuauuuguaaucuuuuggguagagaaaauaaaaccaaguauuauuaucuacagcuuuccaacagaauuggcuucaaaaaucuuucuguacauuuucagcaaaaaaaaaagucaucagaaaggagaaaaaagauuuaaaagaaaaucccaaauuauuuggaaaauugauagaaauagacucucacccauagaaauguggaauauucaauuaaaaacuuguaaagaggcucaacauuguuuucuagugauauuuuaauuugucaaggaaaagauuauaugcagauaaaaaauuguaacaucuuagaguuagaaauucccuggagaucaaacccuugcagccucuucauaccucaagugauaagcaguuugucaccauuaucacaaauauuugcagagcacaaauuagaugccaggcaaugucuccaguauggguugcaaaauugaacaggacaaagaugaagaaacagcgcccauugucauggaaguacauuuguguggacuaucugccauguacacaacaagcugaguuguuuaaauuuugcuccucauaucauccagacccugccuccuguguccucagggacucauagagcucagaguuaagauuaucuuggaggucuucuaagccagccuuuuacagguguaggaaaccucucuguggaagccauaguugaacacugucccauggaugggcucaaauaggucaguguuucugguaaaacugagcacagccuuccaccugugguccagcauuaugaagugaagccauuuccucucuaguuuuagacacuagacaucccccaaggaaggcagccugagauuuuguuagcugcugcacauaguuaccuggcauaaagcugauggucagcuguaaaccuuaggccuuuuauaacaugcauugcuucggagucaagccucccacauccuguacuuguauauuggauuuuuugacccugaauguaggacuuugcauuaaucuuguuuauguuucauuaugguuaaaauuggcccacauucuagcuuauuuugagcuuuaugagucuugauuauuuucuccaaaugguuuugauugauuacuucauuuguaaguaacuuuugcguguucuccuuccauauauguguauuuauuguuuuauaaauuauauguaugugucauuagcuaauaccucaaggcacaguauauacuaaaggcaagauacaaauagugaauuaaauucauauuucacaucauccugaggauuucauuuuuuuuguuuuuuucugaucagauguuauuaaaucauuguuguuuuuaucugguaggacgaacauagugcucguacuaggaauaguagaacuauccauucugcuaucuuccuguuguucacuuaugcuuucauuauuaguauuaucuucaauacacuauguuuuugugggaaucuuuuuuguaagccagcuguucauuuagggaagauugguuuaguuaaaacuagaaaauguauugcauaaauccacuuaacagagcucaacuaaaaggcugugugugauaauacggggaagagaaaaacagaugagagaaggcccuccaguccucugcugugaugaccuacucugcccuuagacucgcaucccuggcaugacaugccauccucccaguuacagaccagguggcaguaucgcugugagucagggcauuuaaaauguuagugaagcuggccgggugcaauggcucacaccuauaaucccagcacuuugggaggccgaggugggcagaucaugaggucaggagaucgagaccauccuggcuaacacggugaaacccugucucuaguaaaaauaucaaaaauaaaugaauaaauaaaaaauagcugggcgcgguggugugugccuguagucccagcuacuugggaggcugaggcaggagaauugcuugaacccaggcgguggagguugcagugagcugagauugugccacugcacuccagccuggcgacagagggagacuccgucucaaaacaaacaaacaaacaaaaguuagugaagcugaagggauuuuaguuuaaaaauagacagaaagugcucaaguacugccuucccacaacguagugagccgccuugcauaccucucggugcuauacucacccugcuuuagugaucucuccucucguauaucaguugucugcaauuuuuuugucauccauauuuugacagcucacuuuuagguguucauuccagucguauauaaaaguaggaguugaaagaaggauuaagacaaauuacuggaacaauugcgaccucuuucuagguugacaucgauccauuuaucaacccucuugagguacgguuuuuuaacuagaugggaauaagcuuaacuguuuugacaaacggccccuaauuuuuccgucugggcuagaagauuaucauaagacauacagucaaacacguugauucuagugguaacugugacuaccacuuauugggugccuccccaguaacaggcuuaguacuaggcucuuuacaaauguuauuucauuuguuucucauggggagccuaugagaugggaauuugauuccuguguugggaggaaaaaguuaggaaacugagacacggaaggguaaauuugggggcagcuguaagugucacaugagcaggcuuuuugacauuagagucugucauuaggaaauguacuagggcauguccaccacauaaaucccuagagugaacgacaagaugguuucaaaggaugcagaaacauaaguuuuaaaucacuguguucucugaguauguaacacuuuacccccuuuugaaaauugggacaucugcaugucuguaauaugcuagccucccucuucucuuugccacacugccuaggggacagguaccaguguguuuuugguucauaugcaugcuccuuuaacaacccagguagagguugccaggaccuggacacaggaacaugugcaaaguagcugggugcccucuuacucuauccucaccuaccuuugacugcagucccccuuugcuguguuuaucugugcugguuggagaaucauuugaggaaacagagcuguuuucucugccaucugcugcugucuugccaccuuccggaaacaguggcuuucuguucucuggcggguguguauaaaccaagcaauuuagaguuaggauacuaacguaucauuucaaaugauacguuaguuauuuucaguuuuuacuguaaauuuucaaacgaauuuuaaaaaucgaaaaaauaguacaguggauaccuauuuaccaaccagguagauucaaauuaauguuuuccauauuugcucuuucuauacuucuuuuucugaaaauuuaaagggaugcagacaucaugacaccuaacuccugaauaaugacugugucucagaguuguaucugcuaaaaauaaggauauaaucucuaaaauaaggucauucgccuacauaacugcaaugccauuuucauacauaagaaaauuaacacgaauucucuaguaucguguaauacccagugcaauuaucccuccgaaauguauuauguauuuuuuuccccaaacuaggauucaauuagguuucauacauugcauuuggcuuuuauaucuccaauaguuuuagaauuuaggcuuuuguugugacagaggugagaauaaaagaucuggaugauuuucaaaaaaauauuuaaaucccaucucacaugaaggaugacuuuucagauuaaauagacuauugaucuagauuauuccggugguuuuuuacuugguaguaaauggcgccggauauguuaaaguuguaaaauauagaaaucucuaaaguguguacaugaaccacaucuuaacagaggcaguccaucaacuguaaauguacaugggaccugaguacuuugaugcuguuguaugugugagaccaucucauaagcaaauaaugcaucaaggguuuuggcucagcacugguaauggauuauaauagauugaaauuaaauaugauauaagugacaggaaaauucugccagguaaguaaauaauugauuaaucaucccccaguuaaaccuggcaaguuaaauugcagggcuggaaucgaaugcuugguagaagcuccucuccacauuuuaguccugauaaaaacugugcugaagaagaaaagaaaaaccagaaacuguucagaggaagggccugucccuugcugugucuuauuugcggcauggcauuguguguauucguugcgcuguggaaguagugauaagaaaaugaagauccaggaaagagcugucacagaaaacauaaacaaguagagauccaugguugcuuggaaaucaacaaauuuagaaggcaagugacagcauaucuuuccuuuuuucauuuuguuuugauugugauaagugggaucaauaugacuuagcauagcaaaacuggucccagugugugcguguuacuguguagcugccacuggacggucaaaugaccuuggcucagucacuagccugccaguagucugggugucugguuucuaaucuguaaauaauagacuuggaugggagaucucugaggugccuuccagcucuucagaucuaagauucuaacagccagaaaccucuguaacauagugcucuccugauuuccucgugugauuauaacuggucuuugucaugaugacccucggccguuacagucuuccaugugucuccugagucaucaaagaaaaauuaaggugugcacuuaguuuauaugaagcauaugauuuuguucuacuucuuaaagauuagcaguauuccccuaacacuuuauuaacgagaaugcuuuaugaaucagaauaguccauucugugaccauguagaauaagagaaauuuuauuguaauuagaaaaagauguauauauuuuaaaaaauggaauaaccacuaauacauuaaaguuacugcuuaaaagcccuuaauuuacaguaaugcagcaaccuaagugaaaaagagcugacccuacucauuacccaaggcaauguuauguuggauuuuaauuauaaagaucgguucagcauuuguauuuucugggucagcagaauauguccuguauagccuuuaacaaacuuuuuagacuuuuaaagcuaugauuucugcacuguaaaaugggaaaaauacaguacaugugucaaagaguaguaaaaggaugaaacgaaaucacaaaucguguauguaaagagccuggggcauaauagguguugagaaauguuaaugaucauagccauugugguaucacugaguccuuggcaauuucauucaggguggagaguccuccaaccaaucugcaugaccaggaaucaagacucauuauguuaugucagucaucuuaauuggcuagcaacauuggauugaccuuacagcaauucacugacuaccucauaaccugagaaagauagauaccuccacuuagcuuaauauggaaaauaagaauucauaauacacugauucaagcuacuugaacauuuugucuuagaaaagauugacacucauucauucacucuuuccauuuuacugaccccagaaaugccaauagcagcugccuuaucuucaaauguaaacauauaauaauaugaacaaagaauucacaaaacagaccuuugugguaaaaugugaugauuauucuuuauauuugaaucugagcuagaucaaaucacauuucccuaaauauaaaaagcacaaacggcaaaaacaugauacaauucaggaaucaugcucaacgcuggcaguacgauacccauucacuacauuauaugaaaugauuuaguauuuguuucuggaacaauugccaaaaggaaaaaucagaaucucccacucaaucuuucaucuuagaaacuuuaaaauacucuuauccauauuaaugaagacaacuccaacauugugaauagugggcaagugacacuauuauccugucuuauuggcucucuccucuucuuuuuaaacaccugucuauccguagucuucuucauugcuauacaauuagaaaaagguuagcuuuuaauauuuuccaaguccauguaaagaaggguuucuauuuccacuucaugugugugucaauugaggucagaauggcauuauccuugugugauugggagcauggaccccaccccacccccacuuuccuccacccccugagaaacaggccaugaagugguaagagucugugauaauuuaggcacaucuaaaagcaaauaacccucuccggaggcaguuucuugaggcaccagcaucaggauuuauuuuucuggaaacaagcaucgccauagaaauugacucuggugacacuccuuuuuuggguuggaaaaugucagagucuuugguuuuaaucaaaauugcucauaaucuggcuuaacgaugccauaaaggccuugguuugcucugccccaggugaaugaaaauauuugcugugaaaaauagguuauuaguuuuauagcucuaccuacuucaaugccucuaucaagaguacgagaagagauauuaaaucucaauuuuuaauaaaauuauugacaucauuggggagcuuuauaacacuugacauuugcuuucagcguugggggaagaaagagaaaguaaauugauuugauauuuauuuccuagguuggaguacaaguuacuuuaaacauaaaauauguguguugccuuugaauacaaugagcagaauggguuguugguucugaaaaugaacauaaauuuuaagauaaaauggguaauguaaugauaauaagguaaucugauugcuaaaugaaccuguuugauuauauuccucauuggauuccuguugccaccuagacacucuuccaaauugauauaaaguauuguuugaacccagaacauacagcucaggagugaaaauacagaucacauaaugaaguuaacuucuuuucaguaaugggcuuucaguauuauuuuuucuacaagaguuuaaaacaaaacuuucagaaaauaucuuugaaugugaacuugcuugcagagacuaucugucuauauuccaauggaauuugcuucuagugaaugauugugagauacuggggccagggcagcgauggaguugauggcaaugguugcuaggcagaggccaucugggacuggacaaggccuagcgaaggcuuugugggauagagggaagccaagggucuucuguuacuaccuuagcaggucgguuugccuaucacuggcugguucaaaucccagauaaucaauauggaaagguuccuaauacagugggauaagugaggggucugugucuuaggaaaaaaaaaaaaaccugcuuauuaaagugucaacccuuuaucaccauuugucacuggccucuaaagggagcuguucaggaaugggcgugccucuuugaaaacaugagauccauuuuccugaagaaugaucucaauugauaaguuuccuaguugugccauuauauugcuaccaaauucuuuugaaaauaugcuggcuucugcagugaucacuugcauuuucaggaaaaggccuacaaaacuuguauaaaggccagcugcaauucgguuuaucuguuccuacacuaugugcaacagacugucugaauucuuuuuccuuuccuuacuaaagacgaugccagcuuauuuaccccagcaguguucuuaauguagauguuaaacugcgcgauagauuuuuaaaugaauuuuuaauuacuuucugcuauucugagcucauugcaaucagcagccaucuugcuugaggauaaaacaaaacaaaaacggcuagcucaugggaggagcaaaggccuuugcaggaguggaggacagaagcccauugucagcgacagcugcugaaagcuuuccccaagcacaggcucaacugccagaggguucuggaggcuuugaguuuuccgcugaugguuccucuucucuaaugaggucaccucucagcacaguaggugggacgacucugcuaaugggagauucagaaacgcagauugcaauuacagucuuuguuuccagccaucucccguaguuucugaacaaccccagaagcuuguaacagggacagcuccucuacaaauacguaacacagccagauaggacauaucauuuauggggcaucaccucagugccagaugcuauauggugagaaugaugcuggccaggaauuuaugugacgccauuuuuauaacauuuaaagcuaugccauuuacaguuucauauagucagacaagucuuaucauccacauuacgccaugaaaaaugcacgguucagaggguauaaguugucuguccguggccacuacucuaggcuccauauucugcaaaaugggaauaauacaaucauaccugugccaguuagaguuuuauaaaauacuaugugugaaaacacuuuaaaaaugggugaaugcucuacaaauaucaugucuuacaacaauuaauccuaaaaugcauauuuuuugaguaccacacagagaauagaagcagauaaacaucuucucuccccuccuuucacuuuccuuaauggaaucugaggagaagcccgaccuagggaccuagggacgacagagcccuggucaucuggacuggggcaguucggacgugcagguguggcucccagcagccgcuuccaucucugcuuucccgucccaggauuaggaugcucaugucgccaugauaacaggccgcugcccuacucccagcuggccagaucagucaccugggccaguucuggcugggucauuuuuuguuuguuugcggagcuuuuuuuuuuuuuccuuuuuuuucuuuuuuucuuuuuaaguuaacuagaucaaacuccauaucucauuuggauuuuucuguccucuuaauuucuguauauuuuuugggucugauuguaaauuaguaauucucuuagugaggcagaaugaagcgcagaacaccaaacaagauucugcuugaauuccagccccaaggugaggaagugggcauucauccaagugaaaauuuuuguuaacguuagguaaggauucaaaggcucugacccaaagcuuuaguacgucuccuuaucuuagauugaauugaugcauaacuguaugaauguuuuugucaggcaucaccauagguacuuucaaaccugcucacucaauuccugcaguaguuuuggguggagggaauuauucuccccuuuguuuacagugaagacucuuccaagucucaggaaagcugcuuggcuccaaggcaagggcuccuccccucugcugcgcugcuucucugcacagccauaugaauggggcucuucacucuucucagagaggucagugggcagcaagauaaggcagaagccaaugagugacugucucaccuccucacucuccuccuugggcugagagcuccagcaucucagcuacucucuaaaaggaucuugcaguaaccaaaguggaacaucacuuucuggucuuccaagaccagaccaacuagucggggacuuccaaagggaacaaauugccuauacuuccuucagaccaagcauccugaaagucguuugaaguugccuggacuacuuugggugggagccaguaccucugcuggacccgggguggggccugccagcugggggggccuuccuccaagacaagggugcacauucccacagcaaagccuggcuagggcugugccuuucugaugugaugggcaugugacauccugcugaugagaacaaugacaagagcaaacauauguugagggauucacuggagcgccacaugcauagugauauuaaggaagagauuggauucaaaaaacccacugggaaaccauuauaauaauccaaauaagggaagauaacaucuggcugaggacagggcagaggaagugggagaguagauaaauggaagaaauaagaugaaggaaggaucagaagggcugguggcugaguugaggagguagguguaaaacuugcaagauuuagaacugggugccagugaugagaaguccucaagaucuccacaauuucuauuucccucucugucucuaaauaaaacuguuuuucuuuaauuacaaauagugaggaaaaauuuauuuuuuuaccuucacuuuuuaguguuucguuuaauuacuuauacuguuaccauauugcuuucugcuacuuuucauugcagauggauuagccaaacuuuguuuccuagccagagaacaaacugaauuacuauuuauaaugcaguuucuauggaaaaugaauuauacauuucaaacagccucacaaauagaauuuuggaauacggaguuguggacuucuuuuauugacuuuuauuugaaaaagagauauucuuauaguagaugugggauugacucucagaagaaagguaaaauugggcagcauauaugugggagucauuugcauaaaagugagaauuuaagaggaugaaaaugaucaaaaagugggcagcggggaaaaucaaggcagcaguguacuccauuuguccagcuaguuuagaacugaaaggaaaaugaauacaaagucugcuuuauuuaaaauaaaaaaauaaauaaacauuucuaagguaaaagucaauugcgaaaaauaaagguaaaucucucuuuuaggaaagaccaauuuuggugaauuuaucugugaguuguaaagaauauuaauuaauauaucaagcaauguaaauguucuuuuugaaaaaaauggauugggccaucauucuaguuuaaaaugauuuaugauuaauuuauuugucugaggcaaaggaaugguuuguggcaaagggcuggugguggcccugucuauauggaaacugcaugagucccucggguucguaugcaugccucucugagcugugacaucagccugcucacuugggauuuccuguugagaguauacuuuuacuuccaaguugcuauauuuaauucaacuccacaaggcuuuauuaagcaucuuucauucauaugcuagcaccaauauaggcgcugggaggagucaacagcauaggacccuuucccugccauuaagaaauuuguaacucauuuggggaggcaagacaaaccgacaucagccaguuagaguucauaaaagguggaguaucuucuuucuguucccaaacuguugggcaguuuuuauugcagggacauggaaagaaagagagaaugagagagagagagcaugcucuggaaacugaagcaguaucaggagaccuugugaaggaagagggauuugggaagaguuugaguggauucaggauagaauaucaucagacuaggaagaaggggaaagaugagcugggcaaggaggaagggaugaucaaagccucauccugauuguccacaucaggaauuaugggagaggaagcccagauaguugagguguggucaguuaaagugugaagaccucgaaugccuggcuaauuuaugugaccuuggucuaauaaguaguaggagcaggauauggccagugagacaaagcaguauugagcacaaaacugugcaaagccagguaauggugcuugugcuccucagugggaccucaugagccacguugacauucugagaugacaagccuaagaauaaugaaucugucaguccucuggcucuuaaugaccugaauccuaaauguacaaggggaauggcccuaacuugaaaaaugccagcugcaaccaaauggaaagaaguguaaaguccagauagaaaaucucuugcaaaagagagaaugaagcugugggacccuugucaauuuucaaaagccacaacccagucaggcagcacauaucggagcucaagagagaaaauauggccacauugaauugaccaucuucgugauccugaaagcauugccuguaagugaaaauauacucacuccuggggaggcugaaaaugacuagucaauuagauauggucaggagacauuccccuacuugagaaauucaaugaauuuuucacuuuuaaggcagguuugccauuguguagaaaaagccauagaacuuccugauuggugcacacauucugagagcccagcauuccacucacuauugcaugaaguugaaaugauaggaaaaaaggaaucugcagcugucucuuuuuuccugcucuuccgcuucugucgucaguuuucguggaaagcuuuuaaugcaggggcaagguuuugcuagcagagccaggcccauaccagcagcucuuagcuuucaguuuucugagcuuuguuacucaucgguuauaguggucuguucuuauccccaguguagcaaguucuaaaucccaucagcuuaccaauccacugggcugagaagcugacuugggaaggauggaaaauggauguaggagugaaccacagaacagaaagauccccagcagagcugcaagcuugggggugggaggggaaggggauggaggaggcacacugggcauuugaucaucucuaagugcauaaaacuugccugugacacaccuagaaugggucauuuaaguguacauuugcaguggguuccagaaaaauauaagaaaugguugaaagcauccaaaaauuuaagaauccuuucuaaugaguuucaggaaggcaucucucaugggagccuggggugcugcaaaguugcuguuggaacuucagcaucacagcucuggucuuacuucuuugauguaccccauguguggggcaucacaggcccugccuuugcaaacaaaacccagguguaaaggcugcagaagucuugcuguggaugggcuguguuuccaccauacugcaucugugcauuucugcuuugggcauuaugguuuccauuucuuuuaacaaguggcaacuacaacugccacaauccccuuggcaacuucucuuuuccaagccaauauaugaaacaaaucaguguaauaugcucuaaaaauauccaugugaugcuuuaaaaaugcguauuuccaacauguucuccuucagagcacuuugccuuggcagguaagcacuaccuuuacaugcuuuugcucuuuauggacuaggcccauccuuagccagguugauuuuacuuuuauucaugcucuuuaugaaauuggcucagauauaggaacauggagcauuuguaacuguuacuuauucauuuaaucaacaaaacuauauucaacauucauugcuguccauuguucuaggugcugaauauaaaaagauuaaaaauuugguccuuccuucaaggaucaugaaaggaaacaagcaaguacacaaauauuuggcaccauaggcagaaugaaauucuagaggucuuugcaugcuguauuaagagcauuuacucaguuaucucauuggcugggauagcaagccauugcaaaguguuaagaaaggcagugacaucauccucaucuuuaggcuuuauaaagaugacucugguauaagagaagaaugaauuauagagggucgagccagacagauucaauugcugguaguucaggugagguuuauaugagccuaaacugcagcaaugucuauaauuuuuuuuuuuuuugagacagaaucucgcucugucaccuaggcuggagugcaguggugcauucuugguucacugcaaccuccgccucccggguucaagugauucuccugccucagccuccugaguagcuggcacuacaggcacccgccaccacgcccagcuaauuuuaguauuuuaaguagagaugaguuuucacuauguuggccaggcuggucucagacuccugaccucgugauccacccgccucagccucccaaaguguugggauuacaggcgugagccaccacggucagcagcaaugucugugauuuaaaggaaaggauaguuagaggagauauuuagagagaauugacagaaaguuguuacugggauuuggcaguggggagggggggcacagagacagagagugagagagagagagagagagagaguguguguguguguguauguggcaaacgugauggauaagauguuugucaugauucuggcuuggcuguguggauagauggugacacuuuuaagaauaugaaugaaagaacugguuuuagugcaaaaauagugaguuuuguuagagauaaacuuucagguagaaacuuaaagugagcaguuguaugucugaaucugagguuaggaagaaaggccuggguuagauauguaaaucugggaguguguuuuguguguacagguggcagugaggguaauggaaggaaaaggaucacagaaagugggaagcucacagguuugaucauuguuucuggauuugaauccuggcucuguaacugugcuuccugugugacacauugagaaaguucuguaaccacaaugagcccuaguuucucauuuauuaaauggggauggaaggauugaccuuaaggcauuguuuguuuauuuauucagucauuaauugaacaaauauuuauugagcuucuaccaugugcuuggaucuggcaaugcauaucugaacagaacagacauaguccaugcucugaguuggcuuucagccuugacaauuacuguaagggaaaauaacaggaagaauugcauaagagaauaaauguaggacacuugccacaauuguaguauacagaauaggcccucagacauuuccagccaaaguuauaaccuuaauggaaugaugcagauagacuccgguuucugguggguugaggaacaaaugagagaugagaaauuggcaauaacgaauaaugauuacuaguucaaaaguuuggcaguuaagagaaauaagaauuuugagggcuauauggagaagacuagugguugaggacagaugugggguuuuucaagaugugagucuugagcaugucgacaugcugagggacaggagcuaguggagaggaugaaguuagaagaaagaagcagagaggucuuuugggaaauaagcagaugcaaagaaaagccccuuuuucugaaauaguaaaagaagcaugugaaagggauuaaaugagauagugcauuacaaaaugcaaugaauggcauuugagguacuuuaaaauuguguugauuuuggcugugagcauggauacacacauauccauauucauauccguguacuagugucuauagcuacacacacccgccacacaugaacacauagaguuaaacguuuuaguugagacugaaggaggaaagcugaaguucauaccuggucaccuuacuuucuugauaaaggaagaaggcaucugcugagagaugggacagaauuguaaggucaugaggauaagagugauggcuuaagcuggccucuuaaggaaugacacaaagaagaaggugcaccuaggggagaaccccugaaugacacugggggucugcuggagauuggagauauaacauauaucauauguuauagacacuuagggcuggggauuuccugcagcaagccccauuucccucagaaccuuugggguuggcugggaagcugugguguaacaaaaagcaggugagagagcaaaggaugcucaguacaggaaaugaagugguggacuacaggguuugagugcauagaacgaaaagaugcacccgaggagaucccagggaggaugacauuagauggcuccauaacauccaggagcaagugccugggcagugaggaaggagaggaacuggaagaauugaaaauggucauuagaggguuguauauuggaauuucaauuuuuaaaaagggaauggcuuggccgggcaugguggcucacaccuguaaucccagcacuuugggaggccgaggcggguggaucacuugaggucaugaguucaagaccaacauagugaaaccccgucuguauuaaaaauacaaaaguuagcuggguguggugguggguaccuguaaucccagcuacucaggaggcugagacaggagaaucacuugaacccaggaggcggagguugcagugagccaagaucaugccauugcacuccagccuggaugacagagugaggcuccaucuuaaaaaaaaaaacaaaaaacaaaaaacaaaaaaaauagucuuagaaugccuccuagguaaggaguugcuaagguagagugcaagugauagccauaggaaauugaggagcuuugaggcugcuccugcacccuccacccacacuagugaacugaaucuucuuucugcaaggucccaguggucuuuaguugcccaguuauauguccuuuucuucauucucaaaauuuuugacuugucuuagaguccuuuccuguugaccaacuccuucuucaugcccucugcuccuugagugucuggcacauguauguacucuggguucuccucuccuucccauuccuccacucuccuccccauuccuccacucuccuccucucagcccucaacuugcugauggagacguucucugaagacucuucugucuccacauucaugaucagagucacacugugacaaaggugugcacaaaagauugguggagggaaagaggaggcaagcagaccaguuacaacacugguucuggagucugagcaaauggcacacaagccuggaauuggaaaguggcucugggaaagagaauagagauggauguggaacauauuuugaguugauaauggaagucagcaggacuugacaacggggagaaacauguauauggggaaauggaaacagaaggacaaaagaugacuaaaauguugagacuuacuaagaggaagacauuaacagaaagagagaacaugagaggacagaggcuugggugugaggaucaagggagauauuggguucuguguggggcauguugaguuucagguaguagcagcccauugagauaagauguacaaaacauagaugaaaauugaaauggugacccaaagacagcaaggugaguacuagaaauauauauuggggguuaaugacccuaaguuaguugugcgaaugacacacuagagcagaggaagauaaugccaauugagaacuaguaggaagagaugauaggagagccaaguagagaaccccagagacagcuauauuaaagggguggcaugagaaaggcucucagaaauacagauuugucaugacgugggcaagaagcaaguagagauagugaaaagaaaagagaaagcaauaaucuugaggucuagggaagacuuaguagaaagacgagaauuuuuauggcucaggggaaggagaaaauaagggagagaauacaagcaaagagcuacuuguuggauuaagcuguaaucaaggaagaccacagcuguguacccuauuccucugaggugguagagaaggaggaacauaugggcaaagagggaaauguugagauggagaaacauggcaggcugguggucuucaacauucuuguuaaaggagaagguaggcaucuccacauggaaggcuuggaguagaugcuuuagggaauggaaaagguacucguuagaccuguaggugauggccugggaagaaauugggugauuggauguccuggguugcccaggacagucaugguuuacacauguuguuccagcauaauuauuuuaauuguaccucuugucacucaguuuggaauauauauugcaaggucacccuagagagaagcaaugaagacuuaaagacaaaagguguuucccugagacacacacacacacacacacacacacacagaguaagaacccuggcauguucugcuuaaaaagcugaggcacacagcaugucguuugcacuguuggguccaacagagaaaugaauggcucaaaagucuagagagagcaccuaggacauuugaaauuuaguucauuagaacuucacuguugagcagaugcacacauccaaguugaaaauguucaagguuuauucccacaucaaacaaaccaaauaaacaacaacuuuuucuuuguauugguucuauuuggagcaauugucaaugcauucuucuguccucuuuuuuccuacuuucuugguacauaauacacauacuagucagacaguggcauuagguuauuuggaaguuguaacuuuuuuaaaaucacccucuauaucauuaacucuaaguauuuuugguucaggcuucucuauacuccuacacauuacugaggaccccaaagaucuuuuauucugucggcuuucugaaucgaugauuauaauuauggaaaaacugaaaaacuuaaauauuuauuuauuaacucacuuaaaauagcaguaauacauauguuaucaaaaauaauauauuuuaugaaaaaccaauaaauuuuucaaaacaaaaaguaucaagaggcgcuuuuuuauuuuugcaaauuauuuuaauaucugccuuaauaaaagacaaccgauucuccuaucuacuucugcauucgaucuacugaauacccuucaauagaaauguaugaagaaaauccagccucacacagauauguagggaggaauauuuuaauagccgucaaagguaauugugggcauucuuuaauacuacaccaacauuugacaagcagaaguucauuaaaauuugguugcaauguggaaucugaaaucaucuauuggucauuuagaaaauauugguucacugaauuauacaguguugacaauaauaauauauauaauaucuaaaaauuguauacauugguaucaccacaaguucaucagacaagucuuuaaguauuggaaaauuguuaagcuuauguugguagauaugaguuuccaaaaagcaauucuucacuugaaagcuugaauuuuauuguuagccacaaauacuaccaaguuguuuccuuaaaaugacaggcuuacuucauucauuguugggaaaaugucuuccagagacccaagucuggauaacuuuguuucucugucaguaguuauuucaugaaaaaaugugaauccaugaaaaacguggcuaguugagcucacuacucaguugcaugaauguuuuuccccuggagacuauuguacuucagugcacagcagaagugcucuauucucccuuccccuuuggucacacagaauuuuaagaagauguguauguucucaugacaugcucccaccuuucucuucuucucuccccuugucccuccaucuuuguugcuccuguaauaagccaaucccugugcauuguacaauguccugguugcuuuuuaaaacuaucuccuuaaguugugguuuugcaagccaaauuauagaguucacccaggggcacagcucagauaucauuccuucucauuaauuaacauguuuugcugagauguguaguagacaugcuguacauagcuguccagugaacauuggaugaaugagguggaugagagccucuccuauuuauuggguuaaguaggguuguugaggguauauuuuugcucaauugaauuauuaagacaaacaacaucacccaauaacagcagacagcuuaauaacuguguuuaucuaaaacaucaaguuuuguguuucagacauauuucuuuaguaauaaauaacaccacacuauuucuaacaauaguuaucucuagagaccagugcuaccaaguaaaacguaaagcucagcaucuccuuugaugcaagaugaggguuuuuagauacaguguagaccuuuauagaguagugauuuaaucuuucuaaauuacauacugaugccugugagauuuccacaagauuaaucaucuaauaucaucgauagcuuguugcagcuuauuuguaaaagguaacaagauaauuuaaaaaaaacuuacauucaucuguuuucucaaauuugauagucauaaauaucguaguugauaauuaggaguuacauucuguguuucauauauuuaaauuguauauauuucuuaagugagauguuuauguauucuaauaauucacuuuuuuguguguaagcaccuguuggaaauaaaauaauacuagauaauuaggcaauauccagaauugcagaaauguuuacaguggcaaguaagucuccauuuucaguucaccugucucccucagaacugccacucugagaauccacugcauagcugggugaaacuuacuagauauugugaagaaaaugaagucugugguguagcccuuacagcugagaauuaaacuauccuuucagacuuuuucugcauauauaaacauguauuagagaauuauuucuauuacaugcauuuuauuuuuuuuuccuuuuaucguuuucuuuauagucaaagcaaaaggggugguucaucuacagugauucuuuuuuuguuuuuuuuauuauacuuuaaguuuuaggguacaugugcacaacgugcagguuaguuacauauguauacgugugccauguuggugugcugcaccuauuaacucgucauuuaacauuagguauaucuccuaaugcuaucccuccccccuccccccaccccacaacaggcccuggugugugauguuauuacacacaccccaaaagugagaauguaguuguagcuuuuagcaaugugauuuguaacauaucauuacucaguguucauuacuauauguauucauuacucaguguucauuacuguauguagcuccuuccuucccacugugccugaaacuagguuucacguguaccugcuaauaccauguagacagaaccaugugugccccaugccuggagagacuguggccagcaagaaggcugguuugcagcugauguuauuccuaucagcgccugaggucacacauagggcaggcccugcugagcuuccuagggcagucuuugaacaccaagcuuaggaacgcagcuuuggacaaucucucaccacauuggaguugacagcaugaaugcaaucauggagcuaaaugguguuucagagaaugagauuguaccuccucuuuaguucugcuucgcuccagguuaccaacugccccaguuuccaugggacuguucuaauagcaagacaugaaguccgagggccccuuuuauguugcccaauuuuccuggcacugguacaaaaucccaaaucaugugcagugggagugaacuuggaacugcagaguuuugcagggauuaugaaagaaucagacacaacccauguuacugaucuucaauaaagagaaacuccagagcauuucuuccccugaacugauuuuacuuuuugucaacagcagccaauacaaagccucaaacccacuuggcauucggcacuuuugcaucagaaacugccuguguuauugugccagugguugcccuagguguucaucaugagcacuuaaaaugauugcuuuugcaguugcagauggcuguaccgguuccaaacaaagagggucacugagggcucugcuuauagagugcaguuucuggaaggaauucaccacagauuguacaaugaagcccaagcucgcuggacucugcuggcccagggaauuuuuacaagguuaagucagccauaaauucugucugggccuugucuguucccugauaguuccucuagggcuuuuucgagaguuuaaauuaaacuaucuucuuguccauugagaugcacaacucccacucccuauggauguguuugugcaagcuccgucacaagaauacgugggaaguuggguucugucuucacugccaucucacaagagaagagaguugagggacaguacugaauuacacaugaucgugaucuacacagaccauccguuuuagaaaaaaauugaaaaucucugccaccuaggagaaaagagaguagggaaucaaaagagccccccaagagaugauuacuuucaucuuauaaaaugaaaauuauaaacuacagggaguuucuuuguagauuaaaaaaaucuuauuucagaacguuuuacuucuuucuucagaacguuucauuucugcuccuuacaucuacauaguauuuuaaaauuggugcaugucauaccuuggacuuggaauucuuuucuuuuuuuucuuguuauugccaaacccugugcccccgaaagaguuccagguguucauaagaggcugcuggaguguauucuuccugucaaaugugcaauuacugaguuaucaaaaauacaugggcucccuuauccugauucuguucucauuuuuggacaguuuauuccugagacugaucaaucuuguaaucagguuaaaccucuuauaaaaaacauuuagugcuuuuaucauagauaaaccacauaaaaucccccugccuguugaguauggucaguaugucaugcuaguaaagaaagucaccuuguuuccucuuaagcaugaggauguaguaaaagaaacucuuguugauuuggcuucccgcccacccccuuugcccaucauucagcagaaccuggaguguguagguuucuaguggcuugcagcagaacugagggagaagagaagguggagaagcacugugguugagcuccauagaguaggcugggcuucugcagagccuucuaugccagggagcagcuggucauuuuuguccauccccugaacugauuuuuuuuccccugaaaccuuggcuuggaucgcuuccugcaaacaacgugaaaucuugcaugugugccaggugaacugcuguucgagauauuuucagaauucaaggguguuaugcuaggaagucaggaucauuuaaguaaaacaaacaaacaagcaauuaugggguuuuauuucuguauaaucuguaauuuugaguuguaguuccuuggggggaggagcagccugagaugguuaugguguguuaccaggcaauugcuacaggaacaaggccaggggccuacuguaauuuagccuuugcaaacaaagcuaaaaauaucaaaacaugauauuauagcaaccccuuugucuuuuugguuuccagucauuagaagcauguuuuuugucuugucauuuauuuguuuaaaaaaaugaaaaaaaaaucccaucucaggcuccaggugccugcugcaguguaggagcagggcccugugcauaaugaagcugcccuugcuggcugcuaacauagaagucaggagaccaaggcgccugcuguuaucuuagagauuguuuuugcagugcuugcuucuggccuaauaacuacuggaggugaaaauggaagaauccauuuuucuuuucuaaauuacauggaaagccagcccaugaugucacucuucuagaacaaauaacauuuaaaaaaauuguuuuaauggauuuuugagauaaauaugaauugcuguggagggauagcagugauguaauggaaaaagaaaaaaaugaaugugggacugucuaaauguuugucuccaccaggaauguuauuggauucugcccuguuuguucuuccuuuguuaguuacggucacggggcauauucucagugggcagaccacaagacacaggcaguggagacgcgaucucauuaacgauucaacacgccacccuaguggccacccgagcacauauuccgcauggaaauucgaaauggacguucaguucauugcuuuggcucucugggaaagaggcucucagcuuggguugcaugggaaaaucaccuggacucuuaacaauuacuaacgcccucuccaucccuucacacucaaauuccccuagucacagguagggcucagacuuaaguauuuuucaagcucuccgugcagccagggugaagaaccacugucuuagaggaaagcaaguuugggcaaauccaagugcagccucaucuggcaaccucaaacucugcugaccuccuucugcucaagagaagaugucuucuugcccuccagaagaaaggcagagaagaccuuugggaauuggagucaggguuguaauuuucuuaggcuguggcauaucuuuuucugucuguaaaauaaauaccgcaaaagugcugaaaaagucuggaaaaaaaaccacccaugcugcuguuuugcaucaguauuggcucagcagccgggucagccaggcagauuuaaugccuuuguuauaauaagaaccuuuuucuucacccaggggaauaggaugucacaguuuugaccucugugguuucgcuauugaccugguccucaaagccagagaguucagagcuaggucugagguucugagguucuucuccugggaauugucaagaguguuauggaaagcaauuuguuagggaugagacaucucucuggugaaugguaauacucugaaaggaagagauguguccagccuugucucagagaggccaguagggagugcccuuugcugucugccaagagggaaaaccguauguugaggagcguucugcuuguuggauaagaagugaacaucuagaauggaguuaaagaaaaguuuugcucagaccuggcuaagaucgaaagaagaaagugucaggguucaacugcccugaagacguaaguguccaggcaguaugcccagugcugcgggugccgggcugugcaaaugagagcuggucucaacacccuagaguaugcagugaaggggagaagagagggagugagcaaguauugggaggaauuucacaagggaggugcugggugccaugagaagagacaacuguaggacccuacccacuggcauguucccagauggccacugaaugggauugccgaacaccacauuaucuugcaagguuggauggagcauccucccuccccuugugcagauaucacugcagguagaccagaugccucuggguacaugcucugcagucugcauuuagcgcuguacucugaacuaaggguggagaagaggacuccauggggguacaugcucugcagucugcacuuagcacugcacucugaacuaagaguggagaagaggacuccaugguaagaaacacaaacugacuuguuuucuccuacaauacccauacucacuucuaauacuucacuucugacaugagauguuggggcaggggcauucccacacaccaagcaauucuccagugaacaccaacaagguguccuauaauuuaaaucauuucugacacugucuaccuggaguuagagucagaucccacaggcuaaaggcucagucccacgagacugcccucacaucacauuucagucgcaagucccagguugugaccuuugcuucugacccuccagccauuaaucaggguucccacaacccccuccuuagguuccaugauugcuaggauggcucacagaacucagggaaacacauauuuacauuuacugauucaugauaaaggauaaggauauuacagaggauauaguugaacagccagaugaaaagguacucagggcaagguguguggaaagagguucagagcuuccaugccuucucugggugcaccauccucccagaaccuuugccuggucagcagcccagaaacccucugaacccugcacuucagagauuuuuauggaggcuucaucacguaggcaggauccauuauuaauucaaucuccaauccuuccacccuucucaaaggcuguagagcagggcugaaugcuccaaccuucuaaucaugauuuggucuuccugaugaccaaccccagccaggagcccaccgaaagucaacuaauuugaacaaaagacucuccuauaucacccaggaaauucuaagagaguaggagcuguauguuggcaacaggggucaaagacaaaauauauguuucuaauuuugucacgauaucacagggacccacugucugcucauuggcagcaagcacccagcaugacaauggaaacgugucuguggggagaacagaaguuagaaaaagguggcugugaaguagccuguggcauuguggaacccaccuuuccauuauucaggacccuccacaagguagaaagugacuuagaaagucacuuagaaagaaaaggaaauuuaaguaaaaccaccccauccacuuagaugaauuuggaaaaggccaaucgcuuucugaugcaccuguucaaaaagauaauuucuaaguccucuuuagagcuaagauccagaaucuccacuguggucucugggcuccgaguagacucacuuagucuguuuugauucagccucaggccuucugcuugucuuacaagcagagaaugggaaguacuaagaaucuccacuucucagacuaagucagggccuguaguucauuuuaaaagcagguucaagacuugcaguuuaaaccuuugagacaucuggucguagcugggaucuauauagccuuugcuucccccacccccgaugggaccauuaugagaguagaauguuuuccugcacccuuacgacccuauuguccaugccugagugaagaaaccucugguuucucugguuggggaaggcucuggcugucuguacuccucugugguagcucagccccaguguagagaagaccaccacuggcucucuccuggcuucucgccugguccgguuucucuugcuccuaaauagcaaaaccgacugauuuuuuuuuuuuugaaauggagucucgcucugucacccaggcuggagugcaguggcgugaucucggcucacugcaagcucugccucccggguucaugccauucuccuuucuccugccucagccucccaaguagcugggacuacaggcgccuaccaccaugcccggcuaauuuuuuuuuuauuuuuacuuauuuuuaguagagacgggguuucaccguguuagccaggguggucccgaucuccugaccucgugaucugccugccucggccucccaaagugcugggauuacaggcgugagccaccgcgcccgggcaaaauugacugauuucuuuccacgccuguuuauauuucccgccuucucccugggaaaugugauaaugaucagaaaaauagcaaaaaggcaacagcaggaagacaguggaggggcauagggcuggaucucaaccaugguccuagcugccuuccagcauaguugcuagggucaagaucugugaaagggauuugcagaugagggacucugaaaaucguaggaaaacacaguaauaacgcaccaaugggugcuaccugucuccacgucagugagccagccagaggcacuccucuaccauuacaaauccaguggaauagcuguuugaccuugggcaagucauuuuaaccuuucucagccucaacuuccucaccuguaaaauaggugcauuuuacuuaaagcacagauuguuuaaagauugaugugauaugaauaugagaggacauggcaaaguacaaggaauaauaaaauauuggugggagauguuauuaugcccauaccuugcugagugaugauaacaaauaaugacuuuguuagaucauggggaagccuuucagauccucaguucacgacagguaacuugucauagaaggaagucuggagcucucugucaggcaaguauaguugucacugcgacacacacacacaaaaaaaaacacuggcucuauucuaccuacuguaugucaacuucauagugcauaucucuacauagccaagaaaaaugaaauacaaauauaaucauuuuaagcacuuuuuaguaaucacaaauucagcuggguuaagucaaauuucagauucaaaacuaacuucuuauagaaucacucacucguucacuccuucauuaagucagcaaaaauuugauuucuggcucuuugggauuugguguaaugaauuuucccuugcauuuaaagagggcugcuguauugauaaacguguugacaaacacacaggauaugccacucucacuacacugacuagaaaguacgcagucuggguccuuccauaaucagaggagcugucaagcaacaccgaucugccagugugaagaauccagaacccugaagcuuuuacucuucaucacuggccuucaauuugccucauuucuggaaaagacucaaauguccuuuguauguauauauaucuuucuaagcuucaucacucccacacuuggaaaaaauaccauuguuucuaaaugguuuacgagcaguguuauagagccuuccagucuggggugccaugagggaaccaccuuccagagucugcugcccaaagccuccugauauggugcugacuugggucacccacaguggcucaggccacuucuccacaggccuuccugugaaggugggugucauuugcuauaggggcaguuggccgcuguuucugaauggcagaaacguguuuuuuuuuuuuuuaauuaaaaaaaaaaaaucaccaaacucuuacuuagcauucagcagucacucaaaaacuucaauuccaaauuuugcaugugggccuguugggguugaguuaguggugugcagaagucugcagaaggcucccuguggggagaagugaggucccacuccagccuggagcccguguucuaugcauucucaucaugugguucacauaacucagcucaaaaugugagcggcacuuaauuccuggcacucugccagguuggcaggcggacuuuucuagaauggauccagugugaccaguuugcuguggcuucauaauagcaagcgagauggcgguugggcaggguguauuacuguuguuguuguuuuuguccgacagcuugguuuucucuucucuccccaaaaaguugauccacaucuuuacauaccuguucuauaacuucuuuggaaacuguauguauguuagggugugacuggauucugaagccagaauuucacaguacacauuuuuccacaucugaaaggaauuggaauugaauuccgaauagcauuuagaauugaaucggacaaguaaggccucuuccggguuaggcuggauaaucgaguuaauucaaauccauuugaaggauguuccuugaaaaauguugccuuguggaaaggugcuauauacacagugaaugcguuaucugucuguauucugagaacuaaaaucuuguggucucgguccuauuuguauuuggugucuuguuuuuguuuguuuguuuuguuuuuguuuuuuugcccaauucacuuuuacugcuuuugugaacacggcuuuggaauuccagcucacaucuguuauuccaagggagaugcuagauggucgaugucuggucguggcagccucccugcuagcuugcacggucgugacuagcucaguucugaaguucaacacauuuccaccuaaugugccuuaugacaaaagaagggcagcguguguccucccagauugguuuacacccugcaucacuuaggcauguguaauuguaguucguugcaguguugauauccauuaccuaguaauuaauguacuaucuuccacuucuguuugagauguguuauuaacuucucagaucuguccugcugcuccugguuuaaucuguacacaguaggaagaaauucuguuucuuaccaaaaauugcagagcaauuugauccaguuucuuuuguugaaacgcugagcuaauuauauuuaaccacggaugauaguaaaguugcacuaacagcauuuuuuaaucaaugggaaauguuuagcuugugugggguuggggagcugggaauccagaugugggggaggccaggcaaccaauucuauagaaaaacguuaacugugugauuaagcauaagcuuucuaauggaguuauuacaggacuaaagaggucuuuauugcaugaacguggaggcaggauguaaaugugcuugugugcguauuaaagaggagagagaagauccucucucuuccucuuucugugugugugugugugugugugugugugugugugucugugugugugugucuuuguuuuuugcacaucuccaaauugcuuuguagaaguaacagccagcuugggaaacccaggacaagauugaccuagcugauagcaaccauaucccaaaaacagaaaccugggacaauuguuuaugugguuuaaugggcagcuagacagacguguuugcccacguuaugaggcuagcagaucauuucaacuugccuuuauugguggaacaauuaggguugaacucuccccaauguaaaaucaguacugcagauuggcuccacauuaauaaugcagagagaaaagauguuugcuuagaaaaagcuagaacaugaacugugauuugccuucuccugacccuguggcagcuccucaaaaauauaguucaagcuguaccucacauaggggaagagauaauacauauuaucacuugucaucaauucccugauuauuguuuaggcucuugaguguaagaugacaguugguucuaugaacacauggguccugguaagcuugcauugcuuuuucagugugggaugggagacuuuucagaguuggaugggaguuuuuuuuuuuuuuuggagauagggucuugcucugucacccaggcuggagugcaguguugcgaucucggcucacugcaaccucggccuuccggguucaagcgauucuccugccucagccuacagaguagcugggaugauaggugccugccacauguccgccuaauuuuuguacuuuuaguaaagacgggguuucgccauguuggucaggcuggucucaaacuccugaccucaagugauccucccgccucagccucccaaaguggagagauauuuuuuacagcuguguuucauuuguuuguuugacugauucuuuuuuucaggagacaugaaauaacacauccagaaccuuucuaugauuuccaggcaucuucauuuucaagugucucgauuccuacaacucuuuuguagaucaaagcuaccuuuucuugcaaauuauauuuauauuucuguggugcuuuucaaaucguuugacaauugccagauuauugagaacucauagcagccugaaaccaaagaaggcagauugcuaggauuguccuuucauggaagagcaagcagagaucagagaaugugcccagcacuccauggcuaauagagggagaggguuccaggccucauaccaagucaauagaccucuucccaauaagggucacagcacuuugcucuugauuugauuuuuagcaaacaauuucuucccaccauuaaaaaauucuacccacucuuaaaauaggaucgcuguccuuuggucauagccaguccucuuugguuuucuguaaaggcagugugcggugaaagugacaaauaccugacaaagagcaaaaaaacaagggaaaauagaaaugcacuggcuagauguuaagaagauaugaaaaaaugcaggcuuauguccucacuauuugaaaagaucaaaaggcuauggagaauuguguugaggaauuggucuuugggagggaagggagggaagugaaggaagaagagagugauuuuuguuguuguuaugugucuugcuuuguuuuuucuuuucaucucggggcugcuuguuuagguuucauuuuuaugucucccuggccuaguugguuauuaaacagugggccuaaaaaaacuaagggcaaaaagguguuucucuuucauacuacauggaauagacauugggagucaugaauuagaauucucuuugguggaaaaugaaaaaucauuaagguugucuuccaauaccgcuaaaagcuaauugcauuaaaauaauuauuuaugcuguaaguaagggccagguaaucugagccgauguugguguugcauuguauuuguguuuagaaaucuucaguaguauaauuaaaaguaaaauacagugacuugaucuuuaggggucuugcuuucugugggaagugcaggguucaagagggagcaggagacagacagagaaaguggauuaaugagugcugguuuccucugugugccagaggcugugaccuuauuuauucauguuaucucauguaaucgccacuacaaaacucucagguggauguuauuaucuucauuuugcaaagauggaaacagguguucagagacauuaaacaauuugugccaaagcauacagcucuuaaguaaguggcagagccagaauuugaacccagaucucucugaucuauucccccauauuguuucccaaaggauaguuuggggaggcauguggcuugaaaugcucaugagaagggauaacuuuccugggcaugguggcucacaccuguaaucccagcacuuugggaggccgacgcggguagaucaccagagaucaagaguucgagacaagucuggccaagauggcgaaaccccguuucuacuaaaaauacaaaaaauuagccaggcuugguggcacaugccuguaaucccagcuacucaggaggcugaggcaggcagaauugcuugaaccugggaggcggagguuguggugagccgagaucaugccacugcacugcagccuaggcgacagagugagacuuugucucaauaaauaaauaaauaaauaaauaaauaaauaaauaaagagaagagauaacuuauugcccucuugaagcuaacaaugaauuagauuuucugaucacucacuguccaauuggguaauucauugcuuuccuacgaaauauggguugaauucuguccgccccaaauuccuauguugaaguccuaaucccuaguaccucagaaugugaccuuacuugguaacagggucauugcugauauaauuaguuaaggugaaguucuacuggaauaggaucggcccuauccagcaugaccggcauucuuaugaaaagggaaaauuuggagacagacacacuuggagaucagaguuaugcuaccacgaguuaaggaacucccagaaacuagaagagaagccugggacaguuaccuggacaguaccauaguaccuucugagggagcauaacccuggggacacuuugaucuuggauuucuaaccuucagagcucugagacaaggaauuucucuuuacccugcucaguuuagaccaguuuguuucagccagcccuagaaaacuaacauaguacaucucaucucuuauucccauuagguccuuaguuuugucccgucagcccaggcuggguggugguacuucuuccaagcugucuguucacauacuuuuagcagguuccaggagcugccaucaaaaccauuuugucucguguauugcaugaagcucauccccucuacauuccaaauagccguccucaccuguauucccagcagucccccuccccuccaacugauccucauuguguucuggaauuauuauuuucugugccacaguggauuccguaaguacuccuuggcuggaugucaggauauuauagcuugaggauugaucuugguauguucuuuugucugggucuuuuauuuugccuuauauuguucauucacagauuuuagaagauugcacauuuuguuuaauuauguuggagacagacuggcauuuuagcuguuacagucugugggagagggguugauagcaaaaauuauguggaguuuaaauuguguucgguaaaggaaguagaaaugaauaaagcuguuuuaccaugaaaagucgguauuuugccuuggaucuuagaaugggucuuuuuuuauuuuuuuuccuucuuagcuggaaauguucuaagugcugcauugucuauuucguuugccuuuuacaagucugacuguuauaaaaaggaaauuuguaucuguauuugcaaauuugagccuggcagcuguguuuugaaggcuuaaucugggaucgaacugagaugcaaaugaugucgaauaguuuuucccaugauguugucaaguuuuacuuuucaaaaauacugcucguggcagcuccagccuccacacagggucuacugaguuuuagauuuuuaaguaauaggcaauuuuauacugauguucccucagaaaagcaauggcuucucguuguacccucccuacacaaugccugcacaacugccguggggcugagaaagaaucccuucucugcucuuauuacauuagccauguuuuugauuaguugaggggaaaaaagaaggccucacaaaaccacaaagcuuuuugucucucaugucugucaaaauguggcugauuuaauuugaaugaaauuuuaauuagaaaaauucugccaagaucuagcccugauuugaauauuuauagauauguuaagaaucuccguaaaccuggggucuaauuugaauuacuucccuggaccucagcccuaaugguacagaaaguggcgggggagcugugcgauagggcagauuacccacacacugggcuagaaugggggucuggacagggaagcagcuaugugcguggucucugcuguuuuaauagcagcaguuuauccagagauguuuuucaggcuugugagcacuucauuaugggaguggaaaacauaugacuaauauuagcauguuaccugauauauauauauauauauauauauauauauauauauuuuagagggugcaggguaugucugaaaaaccauggggauugggagagucagaaaaucccuguccagguucauucuugccuaguucaaggcuuguguucuugggcuuaaccugcagagcuucaauaucuuuaucucuagaauagggaaaaauaagaugugcgaggcucauaguaaaaccguaccagcagcaggagucagcacggcagggcugguggccucgggcagcagguuacugugcuuuaugaguaaagaugguggacuuggauuguuguugcuucuagcuagcucaaugccagaggccaccuguuccaaaucaucccuuagcccuaaugaaugugcuugauguuaaaaaaaaaaaucuccauggcauguuaccuuugucauuguguauuuagaauaaaugcuguguguccagugcagcagaaugaaagcuuuaacuagacaauagauuuguuaccauagucugccuucaucuaggagauuagaaguggaaaauccuaaauauaugcaaauauaaauauauauccccuccugaagauuuccuggcaauccuguucuuuuuaacagagcuacagaaaagacccacauaggacuuaguuccucgaaucugcagacucauagccccucaacacuuccugagugauugcugggguuucagcccuuauugacauuucucuuucagagauaagacuccauuuccccgacaaacaccagguauuucuaagcaaccucaauuucauuuaguaauguuggugcaaaagugcacaggcacaaguuucuuuguauauggcaaaauaaauuggcgagguuuuagugaaaaaagaaaaaaaucugcaacagugauuugcuccaguaaauauugucagcagauauggcugugacuccuggaauaggggucuuaugugcacaugaacuagucauuuugcacguugguccccuggcuccuccugagccagagacauggaaugucccuaccuggcucaucugaccacccauggcuaguauagacuuuaaccuuauugcaaauucaggaaugugaaaaauucauauauaguaugcuuaguauuuuuuccacuugcaaguggcaucaagaaaucaggcuucauuaggauuaucccugaggcuaagaaagagcaagugguggugaagagcaggaagcaacauggaagauggcuuaggguaggagggacuccugccaaaacccucugugugcaucccagaggagacuuuuggggaguacaaguauuaugcugacacucucacuccaggcccaccaacaacuguaucuccauccucagggaauaguccuuuauaucugcuggagaagguuguauauauguguggaauuuguacaccagcuaggagccaaaaggcuuccuccauggaacuccuacaaaauaagacuccagaggugccuuggcaacugagguugcugggugaugucaugcccuugugggagaucuguauuucuuagauuaacugaagccuuugaauacuaacuuugauguguuauguuaaccaucuggagacauuuuacaguuguugucaaaagguugacugaggucucuaaugcaacacgaggaguugauggaagcuuaauagaguuuaccaguuuugcugauuugugaaugacagcaccacaauaacccuuggcccaagagauggcggcuguguguacuguuugaaugaagguggcaagggguagaaugugaaucgugcauuuuguaacaauuuggaaagcaguugaauuggguacauccacccuaguugggaaacuuugcccuguugguuacauauaugucauugauuuauucaccacuuauuugccuuuguagaaagcccucuuaguuuaggaguuuugcacaucagcccucauuccucaauaagaggugugguauauuucaauaugccuuauguguauauuugguuuuagaucaaggccuagccuaagcuuccaggguauugcuaguaaggcuguuaugauacugagaagaaugaaucuuugagcuuugcuucuuuucuucacauggagaaauaguaagacaucuuuguuuuccuguuuuucauaccauucaccauuguggaaaaacaucaaucauacuccccacguaucugaacauauuuaauacugugucccuauauuuauaaucccaacauauuuaugcacauguauaauuaugcauauauaaaaauacaagagaggagaaaaaagcaaaaauaaugaaaaugggaauacuacuaaaauuaaauggaagcaagaaguugaugagaggguagaagaagaaaucacgguaagaauguggguggcaguuacccugauuugauuaugugaauguaugaaaucaucgcauguacucccaaaauauguauacauauuauauaucaauaauacauaacuaguauaaaauaaagaauguggguaguuggucaaacaaccaccagaugcugguguuuugauacaauuuaaugugucuuaggggaacaggguuuaaucaucagagacucuacuguugagaacaccaagcugggaauccagagauuagaguguguucauucaggucccuucaccaacugcacgaacccccugaucuaugccaggaauggggcugguccuagggaugcacagaacaaggacaagcauggccucuuggaggcuaauagauuuaggaggaguucucugucgccuuuuaaaagcaaagguguaugguaaagauggcuuauguuacucuaaauuagauucugcuuugauuguggugaagcaugaauauaaggaagggucccaaggucagaagggaugcuagguauucuagagcccaucaacauugugucauccacaguugauugaauuguauucuauaagagauuaggugaagguccacuugacuaucauccaauuuuuagacauuuugaaaaaccaucuggucuacucugaggucacauccccaccucagagaacacccacuagccugggaagaauaaacacaaaacacuccaugguuuucaaaggagguguuauggguuuuugcaaagguuucuuucuuaguuacauccuaagauaugagacaucuguaaauccucucauuguuuguuuuuuucuguguguuuaauuuaugugguuuuuuuuucucuauggcuaugggauggagccaaauuuagcuuaacaaauuccuaaaggcaaauacaagaaaugcuuuccaaauguuuccacuguaccauaaaaaaauacaccacuuguuucccagccuguugagaaaagcuggcccaucaacuucuuaugaggacugcauccuuuaugaaaaauuaacaugcagaagggcauaugagagugauaugcuacacuggguuuaccaggaauuauaaacuugacuuugcaagguugcaauuuauaaccugcuucaucuucuccaaacuccuccauagacuuucuugccugacaauguggcaggggucauuggcaagaucacaaaauguuaucucaggcauauccugggauguguuuuuucuggcugccuaugagucacacauugcauauuuuaacauaccccugguuagaauguucucagugcugguguugaccacacuuaugcacagaguagauccugguguaagcugcugaccacaugaguggcuugaagaacaucagcucuuccagccucuaucuuccccaaucaugcuaggaugcugcugcugccauccuaccuuaugugggcugaaauuccaccagaaaauaagaugggauuuguuuucgccaaaaaaaaccacuauuaaaaguuaccuaggaaagacagcauuacguauuaugucuuguuguuguuguuguuguuguugcuggagucucgcucugucaucaggcuggagugcaguggcacgaccucagcucacugcaaccucugccucccggguucaagugauucuccugccucagccuccugaguagcugggacuacaggcguguaccaccacacccagcuaauuuuguauuuuuaguagagaugggguuucaucauguuggucaggcuggucucaaacucccgaccucaggugauccccccuggcucagccucccaaagugcugggauuacaggcaugaggcaccgcaccuggcagagagcaucaugucuuuccuacaguuuguagccccugucaugggcagggucagauuucaauagagccuggagccgcugaggugggacugucucucccagcacuccguuucugcuuucucucuuuccucuuugucgcucuugcuuguuaccgucacauuuucccauggccucucccuucacucccucaaaaggaaugccuacagcagcagugaaagagggauucacuagaggagagugggugggaggaaugcuauuuuagaaaaguaacuaaauaaauggauagucaagcucuaaaaaaaacuuccuuaaagacugugugggauuuaacauccaagaaacgaacaugagauagaccauacagaugaaauaaaugcaaauacggucccaacauuacaaauuuccuacuuucuucuuugccccauucuccgggugcuuccauuuuagaagagaaaaaugaagaaggagagacaaaaagugaaccugagagcagaagagaggcagggagacagaaaaaugggggccaaaugggagagaaagacaucggagaagaguaaaauaacuaaggauggggacacucucacguuacaccacaucccugaugcauuaauguguugacuuaaaaaaggcugcaggggcucaucucccugcacaaggucuaccuuucugcccugagagaugauuuggaguuccgauguguauuucauuagcagauugaugaaacgugguggcacaugccaaccgucuggaagugugacagugcauccaggcuggucucgccucauauccguggacucugaugaagcuccuucauccgggaggccaauuagcaaacuguugaaugcucugcuuuuuugcaaguuucugacaaacagccugguuucuggcagauggaggguaaccaaagcaagccugcuugcugggguuaggaggaaaagcucauugcaaaaagaaagaagaugaauuucucccugaguaaauggcacauaagcucccugguugaugucaggacagaaaauguuugcuggguuucugaagagugaagaaccugggacuagaguucagggagugaugacacauggcagauuacagcauucgaaggccaacauucgaagaguccgggugcuuuagucucauuugcaucagcucacucaccugcugcuaacaccaggcuggaagaagcaggcucuuggugacccacuuuuauuucagagcccaggacuaggacuugaaugucaggcaggacaguauuaugccagagcugcuccacugguuugugagaaucaaccauacgcaucucuucccagcucugcauuugguaauaccauguugguagcuugaaauuucacggugggaggauuuacaccacagauaugggugaaugcuacaaaucaggacucccccaccaccaaaagccuuuugauaaauauucaccagcaugccacugggcaggagagagagaugaagaaacugucauauacuuuuuaauuauacauuuuaacaauuuugaagccuagccuuguuuucugugagaguguaugauuauguguguacccccaacuuguugauuccuaaguaaagaauuugcucuccuuuugcuauggagcaaaauaagagcacauuuccauuuucaggguuuguuuaagaauuuugcaacaaguugaaggaaaucaugucugcucagcuaagcaauuuggugucuguugauagccaaacagccuggaaaauuaucuuugccucagcucacccacugugcagggaauuaugcugacaagcuggcugcuuccagaggccuauuguguggcagcacaguggugagggagaggcagguaugugauuaagccaucucuugcucugucugcucugcuuaauaagugaacacugccagacugucuuugugugccuuuucuaucaacgcuugggucauuucuucucucucaucccccgaaggcaggauaaaguauagacaaucaccaaaagauuuuggaaagcauuuccagcaaacacauggaaauugcuagagauaagaggaugucugaaaccuccuuagcaugaaauaccaagauuucuuuugcuuuuaggaugcaugucuuaaaauauggagacacuuggcuuuugugacaguaucuuuaagaggcaucuugguuaauaagagacaguggauggggaaggauucaacucauuaauauucuagagucaaagaauauucacacucaaucucuaugauuuuguuaauguagaaacuggggacccugagguuauaugacuuuccuaagaugggcacacagaacaagaccccagauuccugggcaacccaggaacagcagcaacaucugccaccacugcugcagcugcugcuccuucuuuucucacuccugugauuuguggacgacugacuggcaggcucugugcugagcauucuccuggcuucucacuucaucucauaggcauugaacagcugcugggcacagguaugacugagcacucagagguugcagagaacagugagauauagccccugucuggaagaggcuuauaguauuauccugcuuauuggauauggacuacccaaauaaagagugaguuuagcgcuacagggguauugaaaggcaggagaaaguacauuugauugggcuuauagguaucuccaagauuccuucuugggaagcauuagcugcaggauaaaaacaaacuuuuagagguaaaaacuauaaugugaaguuuuucuuagcaugacacuugauacuaaaagaauuauaaggcauucucuggaaugauccuucauaaagccugauguaggagccccuaucccugggcagagcccacauaagggaaaccccgaaucucugugugaugugcaggaggccgucuuccuguagcacuaaguuuuucuuccacucuacucugaagcaaaaacagcaaggacuuguacuuagaguagaaaaaguagaagaaauaucuccucugaggccucacugcguuauuggggauggcauaguacaagagaaaggaaauggacuuuggagcagaauaaauccagcuccccagcugcuagcuguguaauauugagcaauuuacuuaaccucucuaagccuccagcucuucgucuguauaauggguggguggaugugagguucaaccacucagucaaugaguaugcagagaccaugcugcgucccagagaugauguuuguaaagcauguggcccacaguuaaacgcuucgguguugaugggagucuugcgucugggaugaggaccucauucauauugcaguuuuugguacaguaucaagcaagaauaaaaauaucccugaucugaaauagcaaugcugacucuacugcuggggcuucuuuaucauguucucaguuucacuaaacuguaaagaugaguuccuacagccuaggcugggagaauccacuuagaguaauuugcuacugauuuuaagagggcucugagaucuggucugcagcuguggugugggagagcccugggcagccucucgggcccugccagcccugugguuccaagcugcccacucucaagcugcccaagucagcuuggccuccugagcuuuguuugguaggaugccggcuguuuggccuugacaggugcagguucugaggucuaaauaccugcuuugagugucaguaggcuaacaaaugauggccagacuuuucuuaagaaagggguuuaccaaacaccgcuuguucuacuuauaagugggagcugaacagugagaacacguggacacaugggaugcggaacaacacacacuggggccugucggaguggaggacugggggacggagagcaucaggaagaauagcuaauggaugcugggcuuaauaccuaaguaauggauugaucugugcagcaaaccaccauggcgcauguuuaccuaugcaacaaaccugcacguccugcacguguacccuggaacuuaaaauaaauauuuaagaaaaaaaagagggggugguuacuaugugguuguaauccagaugaucuucucuccccucuuccgaaagaggacuggaccucagaagcaaccagggguccuggucccaucucuuugauugacagauagccacucaggauuagauuaaggaaccccacgcuauuuuugacauacaagccuccagaguuuaaaaauugaaugagaccacuuagccacuuuagcuucaaaaaguauuuuuugaaauuagcccuagggguacauucggaauacacaugucuaaguagcuuacugcugcauauacccaaaggaaagaagaaaaacacaaaucaauacagugauuuuuuucucuagcuccuugguuuuauuauagcccugguuggaaugauguuauuugguaaaacacaacuuacuguccucagagguauucauaucucuucccaucaguccauagggauugcuuaacacuugaagaaacaucaagcuuuuugacuguaccccaagagaaguaaaagccuugauagaagaauagucugucucguucucuauuucuccaagcucacucuccuaccagauggcaauauguccagggacgacugguaaugcauuacaaaagcacaccagggccagcuuguagaguucuuccugccggucaagcaggagguguggagcguggaucuguuccuuccuucacuguccucugucauccuggcccugaugcuucucuucugggcccugaaugugacguaauuaacagcugucuagaacgugccuuuuuaugccuuguauuaugguuauaauuauuccccuuugcagagugccucccacguacuaggcacuccaugugucauuuugcuugcucuucauugccacucuaugaugcagacagugcugccaucucuguuucaccaaagaagaaaagcugggaguagcugguuccuccagagcagcagcagcaggagcucagaguggcagcagaauccccccagaguuaggggcggugcuguguucuggguggacugucugguuuggacuagaacuucagccagcaguggagagucgagcgagcagagcccccgacuggggagcggggcugcaagaggucagcaccucccagauauuccaggaccucaggcuuacagcggcagcccucgcuuugcccagguggcuugggaccucugaugugcugccaccaucagugaagauuggcucagaacugggugggccugggccgcagauuggagccccacuuggcaggacuggggugagccagcccuggaagaaaaaugagaaaauugggaaacuccuugacaaauugucaguugggccccaguuguuugacuauagaggugaaaugaguguucaaaaucaguuaguccaaccccuuccuuucuaaaugagcgagcugagaccuuccuggcaagauacaguaacuugccucaaauccuguggguguuuguaggggcaagaccagaacaaaaccccugguuuucugguuccuuuucaacugcuuuucccacuuugccacccucugccucuuuuauacuaauucuacagcuggggcaccagugccacagaacccaggaggacguuagaaaccagaauccggaugcccugccacgugugcacagcaggccucuuucugugggaucugucugucccgcuccuccagauugaccaggcauugccauugaaaacaauuucaaaaugcauuuuuuacccaguaauuuaagaaacaauauucaccuuaggaaauacacgcaaaugaaagaggguuugcugucagguaguggagagcauuuauuagaaccugcuggguauaaaaccaacuacaaggcacuuugaaauuacagaaaugaccugaccucacucuagguaaauuauagucuggcuucuuggugugauuuuuuuuauccccucuuuuucuccaauuaacugcuugaggcaucucgaaaauauuguuaucaauuucuaauuugaagaccaagaaacuuucagcagcaaauuauuuaaccagcuagaacucgcauguccagggacuuauucguguucauaauaccaaccacuuggaaagcaaaugaccuccucaaccuugggaccaggaggcugcuuugaaucuugugggucaguguccucaggagagugagcugggguaugacacuucugugucauuugacuuucucuugaucguuuaaaauagggaaacaaaaagauuguauaggaaaauguccuuauauauuuucuucuauauuuucuacauguaggcaaugucuagggaguauguaagcuguagagguccaugcugaaugcucagaaagaucuaucauuccaauggaaagggcaucugcacuugugcaguggcuaugaauucccaaauucaaggaagagcuaacaaaucacugaauggcuuuuucuuuaaagugaagcaaauguuguagagaggaggggaaaaaaucaaucaacaagcauagagauaccaggaauaaauaauaaucuuuuacauauaaaaagagcaucuguccuugggacuccauagcuuugaaggcaagaugaauucagcuaggaacugagggaaacaauugaaauuuuucucuuguuggguucagcaggggauugagaguccuaguuaaugcaccuguagagguuuaaaauucaucaauauaacagaauaaagauaagaggcagguaguuccuuauaccauggaacagaaagcuuucuaugcucaaagucugccauuuagugccagcuauccuuuuaacuaccauuuugaagauacaauagcaguaauucaucuuguuuuaugauuuauagcuaacucagaauuucuaaagacuuuuuauuucagaaccccaaagucucauuuuaggaaggcagugucugaugccucauacauacccacaccuuucuuuuucuuaugcuuaacaagaauccgcucugagccucuagaaugcuucucacacuauauccuccuagugacuagcacauucgucugugggagcuuuggacaugacucacacagggaauaugucaggccgaccugcuuagcaaaucaauagaaagauugcccaacugaucagcugacacuuauggagaccuuccacuuguggugugugaguugucauccugggcuagguggaccaaggaugucaaacugugugcuaagggcagugguguccagucguaacguccugucuuuuauauuauauccauuuugauugcaagucauaucuacuuuuagaaaaauaugauguuuucauguauauugauguacuagucuggguucuccagagaaagagaaccaauaggagauacauacacacacaugcauauaaguguguguguauauauacauuauauauauguguaugugugugcauuuauauuuauauauauauagagagagagagagagagagagagagagagagagauuuauuauaaggaauuggcuuacacaguuauggaggcugagauauccaagaugugcaguuagaaagcugaagacccaagagagcuuauagucuaguuucaaucugaguccaagaaccaagagagcagaugguguaagauccaguccgaguccaagucugaaggcagaagaaaaccaaugucccagcucaaagauagucaagccgaaagaaagaacuauuuauuaaucagucuuuuauuuuauugagaccuucaacugacuggaugaggcacacccacauugggaaagucagucugcuuuacucagucuacccaauuucaauguuaaucucauucagaaacacccucacagacacaaucagaacaauguuugaccaaauaucugggcaccuuauggcucaggaaaauugaugcauaaaauuaaccaucacaaucaguuuuaguguagcauuguacuuccuaaaguguuacagggacaaacgugaaaacaaaugcaugaaaugggaguuucugcagcgcuaugucacacugcuuaacguaauacauggccaaguaggcagaacaacauuagaaugauuguaaaaauaagcaauuccaggaaggggcuugaagaguuuaacugaguuuaauaguauuugcaauucgucaguuaucccagguagguuauugacuaagccagugaccccccucaccuggcuguauguaaaaaucacuugaggagcucuuuaaaacuagaaccacaguggcccuaccccggagguacugauucaagauuuucaggcuguagcaaggaaaucuauuuuuaacaaguucuggaggugauucuuaaccagauaaccugccccugguccagagccugcccccgcugcauuuggggaccauuagacuggugugaaucucagaaaacaacggucauaauaugauuuucagguuauuucagcaacuaucuuuuaaggcauggccaggcacuaugcuggguauugggaaugcaaacaguccuuacaaaguucagucauuuaggccagggguccccagcccugggcugcagauugguaccaggccauggccuguuagaaaccgggcugcacggcaggaggugagcagugggccagugagcauuacugccugagcucugccuccugucaguucagcagcagcauuagauucucauagaagugcgugcgaggguucuagguuguaugcugcuuaugaaaaucuaaugccugaugaucacagcugaaacaguuucagcccaaaaccaccucccaacccucugccgguccauggaaaaauugucuuccaugaaacuugucccuggugccaaaaacuuggggacugcugauuuagacagaugauaaugcauuacauuauaacacaguaagagguuugauuaaggcacaagcuaauugcuauaggaucacaaaggaagaauugaccuuucuaccucuuuaccuucauuccacauucuuggagaacacuuggucagauuuugacaguuaagaucaggagauggccccgcaucggcacucugggggccuggguugguguuucaugggagaaagaauccagaagugucacauuuugaagcuuacaaagggucgcccucuauucuguucagucuagugugucccagcccucuggcagcugaucagggucucauggaguguccuagcaauagccucugaguucagagcaugcaacaggauauucacacacagcagaggugcgaagccagugucccagcugguguuucuggaaggcugugagaagcaacagaauuagcauagaggguggcuucuugcucaggcuccuuaggggacaugagugacacucacuaauguguccuccaguuaguuccaucucuuuuuguugccauaaugguacuuuccuucucaacugaaguucuuagcucccuuucuugacuaauucucaccuuugcagguuugccucuugcaacugguaucuaagggaguuccccagguaaggagaagccucauaucugagcugaauagcaaggcuuuuugcuaagaugcaaaaauaagccaaauucguguuugacugcagcagauuuuugcucugugaggaaacuagacccgaccuucuugacuucaggcuuuggucucugggucagucuuccucgugacauuacaaaaggaucuugguccaagacaagagccaacccuagaauugaauucauuuugggcauuugauggccuuuccccaaggguucagggaagguacaggacacagaggguaagcagucuuugauguggugguuauuuuuguuuguuugauuuuuuagccuuauaacuuaccuagaaguuuuggagaaaaauuugaguuuaucaucaccucuccucagcuagaaaacaggcaaauaacucacaguccagugaguuuugagucugauauuguguacacugaggaucuguguguguguguguguguuucuguguguguguguguguguguguguguuuuggcauuaagaucugcauaagcuauuccaaaugugucaaacuugcuuaaauggacucagugaggaacgcuccaugaaaugugaagcuauguguagaccccacacuggaaaagaggaguagacaguagucacuuauaccuccagagagcagaaagaaacucagcaacagauucguuguaccagagggaguuugaggaccgccacuggaauugugugcucuuuuuucucgggccauuuauucuggcaacucuggcccuuuagcagacuugguugucagguuauuaccauuuaauagcuuucuauaagauacuggcaucuuuaaaggccaaauaguguugcugacagcuaugacuuuauagaaauaaaggcagcuugccuuguuauaaaauaagguacauugcaugagcaggaguauguauucauauagaucagugccuuuucuuuuugaccaaaguuuguugcuacuguugcugcuguuggguguggaggacuucugucuguuugccaguccuguaacauauucagaaagcucacccugggaauuugagggugugaggagagagagagccaaaggggaaugaagguagggaugcuguuagacaaaagacgggcaugucggggagaucccagcccuugugaaaccagcagcccauuuuaucaccaucgucuguggaugaaagccugaaagccacaccucauccucuaugaugagacccugagaaccucaaaggggcuccucagucacccccaggacuccacaucuaucuaagagcagacagauguguuacuguuucuacagcagcagaaauuacagccuuggcugucugaagcauuagagccauucagcauggaguuuguuuggggaaguuucuuauaggaauagaagagaacugaaacuugaaucucucagcauuauauuucaaaacauccugcaugaacuccuuauuuaaaucuguucagauugauacuagucugagggcuucucaguuuuagagcugucaguccaauuuggaauagaaacuaguuauugcaccccauauuuagcuacuguugagguugauucuauuuuuaaagaagaaaauuucagugacuggugaccuggguucuuuuuaaggaacccaguuuugccuggucacugugacuugacacaaaccagugacuuuuggucacuaacauucccagggggaauucacuguccagggagacagggugaggaagguggugugugugugugugagugugagugugugugugugugucucccuguguguauguaugugguuucuucccauugucccacucacaucucuuauuuagaguuggugcugggaugccaggcagagucaccguggucacuguaaacuuccaccuccagaaaaggcauuuguucuccugaagauggaaggaaguuuucugcagaccuccccugaaaagaguuuguccucuccguaggcuuuucccuuucauuuagacagcaauaccagugauccaggaauaaggaagcuuaguuacuugguuuuaaaguuauaaauaacuagaauuugucaccuugguagggaaguuaagaagcauagccucggccgggcacgguggcucacaccuguaaucccagcacuuugggagacugaggcaggcagaucacaaggucaggaauuugagaccagccuggccaauauggugaaaccccgucuguacuaaaaaugcaaaaauuagccaggcaugguggcgugugcuuguagucccagcuacuuaggaggcugaggccagagaaucacuugaacccaggaggcagagguugcagugagccgagaucaugccacugcagucuggccugggugacagagcgagauucugucucaaaaaaaaaaaaaaaaaagaaaagaaaagaagcauagccuuugugaaauucuuccuagaaggagacuuagcugccaucugauuaacuugguuuguguuuguuucucaugggugagccucguuacuugucccugaccuuugaauugguuccuugggacuccauucugauuuuaguccuugaacaucaaagcacauuaugacauugugccuugggggugaggggcugucuuuaauguuucugucuuugauuucacagacugggauucaaaggcucucuugccuguuggaugaagcaaagcgaguuugucaaggacaguuggguuuggauugagggaggaggaaagucuuaagaaaaucgugaaagaacuuaguacugauugcuuaaauaaaaaauaaaaaugcuaccauaaaaacaaaacccaaacaaacaaggaaaaaaaaaaaaacuaugcuggauaaaaggaucucauuccauauucaauuuguaugacuuauuagcaguucuuuuuggauguagcauuauucugggcaggaagacaggagcauaauuagcacaugggggaggucccagugaccaaguuuguguguuuggucguguucccccaaccucacuacuccuaccagugaaccauuuccccagcccucccaacugacuccaccuaaaucuuugauuuauuauaagucagaaaaaauggauagcaaccuugagagcagccagaggcccuugcuguucuuagacacauaaaucacaagguagaaguacgaagaaugaagacagaaugucaguaaccagccuggggguuggggaaggauuuugggacuuuucuggaucucugaaauuacagcgugugaagacaggaggaggccauccacauagccugaggacuguuaacuaacugagaaggagaaaguaaugcuauggguaauucuguggauggaugcaucauaauguugccagauguaauacugcagacucacagaagaagaauguauuuuggaugugccagcaccgccccacggccaccaucugcugcugccccuucuccucuccccucuccacacccagcccuagguugggcuacucuggguucugaguuccugauaagccauggucaugaugacguggcauuuccuacccugaugaguggugaaaagcuguggguuccagggacagcuucucauuuguucccuaacucaagaaagcgaaacaacgaugucccaggguauucuguuuggcaaguuauuauucaaauggcuggauuuucuucugcucuaccuccuucaaaauuuuguauaacuuaguuuauguauuaucuagcaggucaggcaccaucugaucuggugugacagugguuguggggguggggaauggacucuccauccaguagaagagugugaccuccaacaggaaucccuuuaacauggacacucuacagaugaccccuuaaggagaauggcugcuuggagacagcacaaguugaguggcuauaugaauaaucuguuucaaaugcacacucugcagggagugggggcagaaccagucacaauuuauggaucaucaaaggauaauuuuauuaucaacguuuuaauaaggaaagguauggcuuauccagaacccaaauugggggaucaguaguaauccauagaugggaaaaugaaaauccaacuagcagcccccgaccccaucccuguuggcauccaccaccaaugcugagaacugagcuauagagacagaagggaagggcugcagguggacauugaggcuggacccacugguggugaggagcaggguuggagggaauucgguucagagaggaaggaaagucuacggcagggagaagaguguagccaggugggcucaggaauuccagcaaccuguuuccauucccuguuuaaacuuaguauaucccugggccugaaucauauagcuccuaggagacaguguuuuucuuuucuuacaugccugccugccaguucacccaguagaaaaucaacuucuuuuucaucagaguuaauuuugagauugacuuuauagaaauauauacuuaagagcaagggcuguggagcuggaucucccuggguucacaucuuggcuuuacugcuuaccagccuuguggccuugggcugguuauuuaaccucuccauuccucaguuuguuuguuugucaaauaggauaauagcaauaccuaucuuauaggauuguuguguggauuaagugaagugcuugguacaguggcacagaagauagauagagauagauagauacacauguacauacauagauauacacacauguauguguguauauguguguguguguguguguauauauauauauauauauguauaugaauguggaauuuuccacuugauauaaaccaaauuuaacaauucuuugcacugguuguuggagacauuguaagccuuuguaucuucaauagcccagaugugcuuaaagcaaugaacacauaaggacauuauugaaaggcacgggcaggaucuaaaauucucaggaugaaguugcaugcuagcauucucugaauuucuauuuucugaauguaaagaauaaaacaucugcaaacaacagcuggacaaauauugaaagauauaauuccaacuucuugccauguuggcaaaagcaguugagagagagggaaaugcuucgccuuguaucaguaccuuuuuauagcuggaagaaaagaacaucgacgagucauuuugucaagguuucaggagagcagaccaaagaaaacaucgucuggagccuccuggaagcaaucagauaguguacagccauuuacuaagaaggccuaucuuaucagggcagauugauggauugugcuuuguuuaucuggagaagcuuagcugaguuccaaacaucaauuugcauccuugcucuacauuuuaguaauucaguuucaugcaaagugcuggcccgcaauaagggucugcuuagacaagggaaagaacaggaaagguggccugaaaagggagcaagaaaccugagcuucuguuaaaaagugccccugggguuggugggaggcacuggauggauuaaucagcuugccacaggacuagcagagcacacaccauuuguccagcuuauuuagcugugcuuaauagagcuauucucucccuuuaaugagagaauggcucuauugggaugcaggugagaccgggacagagcaggcaaagaggaaacaguugaagaaauaacuacugaggacacaaaaagaaaaugagacacagaagcaauagaaagcccugggucaagugucaggacaacggccaacccuguggcuuucagacuuugcugcaggcaucccagauuucuguuccugguguuuuccuaccuauaaaaugaacggguuggagauaagcgucagguccuuuccagcucuaaccuccuuuguuaguaaauggcucugcaauccuggccaugacuccaacauaguagaagauggaaaaguugugcuuaucauuaggccaguuucaccccuucuuggcagaccccccacacccuuggcuaucugcuccucagugcaugaggcugcaggacauuccugccuucaccuguuguguucuauauaagacugggcugauguccacuugaaaaggauuucacuccuggccuggaaucuggcccuuuuggagcucuauggagauacuucugauuuuuuuugcugcuuugguaggaagcaauaacaucuggaaagcauucucgucuucuaugagacucuguuaaaacuagaaaacaaacaagcaggcguguaucaucaaguuaggcgggagucucuccuggcuaugugcuugauccacggcuuuggucuaggacaugucugucuccugcucuugcuuaugcucccuuugagucauuucuucugacugcccauuaagaugcuccagcgggcuccaggcacaguggcuuaugccagccuggagagcccagcacuucgagaggccgaggcgguuggaucaucugaggucaggaguucgagaccagccuggugaacauggugaaaccccaucucuacaaauaauacagaaauuagcagggcaugcuaauuggugaugugggccuguaaucucagcuacuugggaggaugaggugggagaaucgcuugaaccugggaggcagagguugcagugaagcgagauccagccugggcaagaagagcaaaauucugugucaaaaaaagaaaggaagaaaaagaaaaaaagaaagagagaaacagagaaagagagaaagagaaagggaaaggaaaagaaaugagaaaagagaacugggugccuuuuggggacugggaauugguggugggagugagagccugggaaccacauaauucuauuacuucugaggagaucaaccaauguguagacuuucuugcccuauaaccagaagcacaggaugcugugacaugaaauuagucacguuuucuagcagcuaggugguuuguaggggcagcaaccaugguuugaaaccacucacuucuuucuauaaaacuaaaucggaccuaaugaaaugcuaauuugacccagggaacucaggaggccaagagaacugaagcuguuaucuggcuuggcucuguguucugauuugaagccagcccccauggaacagagccaguccccaauuaugccggauucccagcagcucauauaauuuauuaugcuaagaaauagagccuccugcuucuggcuaguugguuucuguuguuugguuacuagaguugcguaggauagaguauuuaugguaauaaaauaucggauaaucauccagggcucgguugugaagggauauucaauaucuuuucuuccugacuguaauauuagacaaucaauuaugaugucauauuagacagaaugcugaagaauucuaaagccauauucaccuucuccauccuuucccccuucacucuguuuggaagagucauaggauuugggggcagggguuaaggagaauucuuaccaggacugcuugcugcaugguuuuuguguaugacucaauacccaguccagguagcuuuaugaaaaaugauagauuuuggaaaccugcuugcucuaugaguguaaagagcccaagggucuccuucaagugcauuugguuuagagaugucuauauguuaucugaaaguugucuguauggcuugucuuuauaccaggaagcuccguuuucuuuauccuguggcauaaaaaaaugaaccuaccaagagucaucuuucccuccgccuuuugucucaaauucugcuuucacgccucugcuaugcacuaauguuccuagccagaaaagacugcagcuuucaagagggguuuccuucauucucuaggcugcuuuacgccucaggggaaacccaggagcccaggggccuguggcgacuuuagacagcauuucccaagggcuucguuauaaacuuaguugauuuggaaaccuagcagaucacuucuagauguuuagguuuaaauaggaaugagauagaauucuugggauuuauguaagaggaccccaacuacgcugauggaaggacuggcaguacuaaguaugacuucuaggugauuucaguugcuguugugagccagcuuuaagccaugaggauacuuccaguggcaauuaauguauggccugccauuaugaagccauuauacugaaacagaagccaaaaucuguacaaacacauauuuuauagucucuuuaaaauggcaucuagcuuuuggauuaauauuugaaaguuaaacagucuaccuuauuuucuucuuccacccaguuacuaucaacaguagcuuaagcuggaacuguaggacucacaugucaaguauagacaagacugcucugucaucccuaauaauguauugguucuucucugccaaaacgagauacauuuacuuauguccagcuauuucuugcaacaauaucaaccugacaaguuccauuauucuauuaauacacacacauauuuuuaugggcucucaauggauguauccacacauacacaaaaauguaaauacacaccacacacacacacacacacacaaacacaccccuuaguagauuuuuuuuuuuuuuuuuuuuuuuuugagacagagucucgcuuugucgcccagacuggagugcaguggcgcgaucucggcucacugcaagcucugccuccuggguucacgccauucuccugccucagccuccugaguagcugggaccacaggcgcccaccaccacacccagcuaauuuguuuguauuuuuuuuaguagagacgggguuucacuguguuagccaggauggucucgaucuccugaccuugugauccaccugccucugccucccaaagugcuggaacuacaggugugagccaccgcgccuggccaccccuuaguagauuuuuagacaggcugaauucaauaguauauaagaggccccuguuaucucauucucauuacaugugucauugggaauuuuguuuguuugcaggguguguguguguguguguguguguguguaaguucaaaguacugucauauguacugucauuuaaaaacacacagcaugaccuuguguuugguacuuuauguacauuaccuuucuaaacaauuucgauaucccuuugagaugaguaggaucaauauauucacuuacagaugaggaauacagacucugagauucaucugagaacucacuuaguuuacuaacugucagagcuggaauuugaacucagaucucccugacuccagauccugaguucuuaaucacaacugucuccucccuauuuaauucuugugacaauccaaucgcauuuguucgguuuuuacagacaagaaaacugagaccaaggugaaauuacuugucuggagccccccauguuaugauguuuuuggcugugguuaaauucagucuuuuauaucugagauguucugaccagcaauucaaaugccuuauuuuaauguagagaguagaacugggccaccugaccacaaacuagauuauucgggaaaguugcuuuaucuuaaaccauaaagggaagacauugcuccccucagaaauaguaaccgaaauaauuucuuugggaagcguuguuacuagagguuaauuaagaauaauaaugcacaacagguauuaaaugcuuauuaucugcuuuacauauguugguucauuucaucuuuucaaagccccaugaggaugguucuguuuuucccuguuuuacagaugagacacugagagguuaaauaacuuggccaagauuacaaagcuaauagguggcagagcugagauucaaacucagguagucugggcugguguccuuggucuuaaccacccugcaaugugaccacauucguuuccuauucacuuucacugauuuuguagguuugguggugaagagacccuuuauuuucccuccaguaguuugcugauaaugagagcaagccaucuguauuagucuguuauuauaaugcuguaaagaaaugccugagacuggguaauuuauaaagggaagagguuuaauugacucacaguucugcauggcuggggaagccuugggaaacuuacaaucaugguggaagggaaagcagcacagaccuucuucacguggcagcaggaaagagaagggugaaugagcaaagcaggaggagccccuuauaaaaccaccagaucucugagaacucacucacuaucaugagaacagcaugggggaaacugcccccaugacccagucaccucccaccaggucccgugcuugacauguggggauuaugggaauuacaauucgugaugagauuuggguggggacacagagccaaacuaucucaccaucccaggcaaguggcacugcuuccauucuuaugcuccuggucucaguaucuggauuucccacagguauagccaaaugaaagagaccuuagcauucaguuauacuuugaaaaauacaaaaacaauucuccauuacagugguuauguuuagcaauacuuaaggcucauuucuagaaugauagccaacaagacaaacauauagcuguaauuuaaugccuuuuucaaaaguccauggucauuauuaaauagauuauagaaaacucccuuaucucaucauagucacugaugauauuuauccuguuuguuucacccguccuuuaaauuggugaucagagcaucuugcuugggugugucuacauuggccuugggcccugaacaucuguaaugucuuccucagccuccagugacuuuauaacaucuugacaaggaaguauuuucaauuagccacgggagagacuuugguucccugucugcugucagcuccucccuccucaagcccauuggaaucugaaaagaaaaccgauaaaauaaaacuacugcaagaaguugcugauucaugugaacucuuuuuugaaaucagaacaaauuauucucuguugcuuugcccaccucuucugauaagcaccugagcaucuuuuaggaacugaaauuuuaauucacuuuucuucagcagcuaagacuuuauagccuacuucugcuagggaguugggaguuacaaaacaucuaucuacaccugaagccauuugcuaaaagaguuggcauuccuuucagaacauaucaucaguuuaaaaaaaaagacauuuaaacagaaaacacauuucaaaaucuaucagucucccauggggcuauuuuacucaacugagguggggagagggagauuguuugguucucaaaagacagaacuuuuuuucugucugugaacaagggauagaauagugugggagaaauggcuggacuuggaacugcaacccagucuugaaucuugacccuaucauuaucaucacuuauggcucugagcgucccuuacccauauguaaaauagaggcuauaaugcugugauuaucuaugagcaaagaggccaguuauaguuaaccaggagagaaaugauggcagcaacuugauauuagaauuuuuuuuuuuuuuuugagauggagucuugcucugucgcccaggcuggagugcaguggcaugaucucggcucacugcaaccuccaccucccggguucaagcaauucuccugccucagucucccgaguagcugggacuacaggugugugccaccacauccagcuaauuuuuuguacuuuuaguagagacgggucuccugaccuugugauccgccugcuucagccucccaaagugcuaggauuacaggcgugagccacugcgcccggcugauguuagaucuuuguacaaagacugugcucuuucuagccuaugauuuggaaagaguguaaaugguaacuaauagguuauaauaaaccuauuuggagauggacagaagguuauaguaguugagggguuuaggggaagaguucaagccuuagaaguagaugauuuuuaaucuugguuuuagugcucauuaacuaagggacccugagcaaguuauuuuauuucucugagccccaauuuccacguucauacaguggagacaauaauauuggccuuuuuaucacucagaacuguuugaugaaauaaugaaguguguuuuguaaacuggaaagugugaacuguccacaaaagagggcuugggggaugagugcuucuuggaggcgugggaagcacuguuggaagcgccucuugucccugccccuggguccugcccagcccaauaccuagguucauaagcacgugucuuugaauccagcuaagaugaugcaguauuuacgcaaggaguguuuauggaaagcaagagaugggauacuucgucugugagaaauguuuacauaagugccuuuuaaggugggaguuaugcccagugacgaaauuccacuuacauaugcaacugaaaaaaaggugaaaguugagguaggaauuuguauugggaacaaugaaaauaguaacagaguaggaaaggaccaggcagcaagcaauggagggaaggaguuuugagaucaaagcaggauuuccacuuacuaucauuaaaccuaguauuucagugcuucguguuuggggaagaauaaucagccauugugcugcaguggaaaacauccaagcauugauuuccagagaaccugggguuccucugggccagcuuugucucugguguuuugagggaggaaucacuagcuuuuccaucugugcaaaaggccaggcgucuaaauggauaacucuuccuuuaaaaacuucugugaugggaaggggaacaucacgcucuggggacuguugugggguggggggacgggggagggauagcauuaggagauauaccuaaugcuaaaugacgaguuaauggguguagcacaccagcauggcacauuuauacauauguaacuaaccugcacauugugcacauguacccuaaaacuuaaaguauaauaauaaaaaaaagaauauuuugcaaauaaaguaaaagaaacacccuuaaaaaaaaaaaaaaaaaaaacuucugugaugauaaaugugugcgugggauccuguuaagcagggaauuccuuugaaagccuuguuucccuuuucucuccauggcccagagauagauccuggccgcauuuggauaugaaaacuccucagccuugccguguucuccugccccuugagaguuguguucuguuugaaaagagcugaacaaaugaaggcuguuuuuucacuugggauaagaauauccuucucaaagcaguaagggcugaacgaggguaacaggauccauauguugaagcuggcugcuaauacucagcauaugguccagcaaacuuucuuggggggacucagcuucucauucuuuaaggaaugcuccagugaacuccagaaaagaucaggacuuaggugaccguggcauagacacagcuucugggcuucauaagccuguaguucccagagaaugagagccacgggaagugacagggaagguccuggcuggccuuagcauggauagcacuggccugcagcucucuuuguaaggcuccaugcuccccaagauacgaugggcccuuaucaauucaugggcucucuguguucuguuaagggauagugaauccaaggguuguuacuugggguucccagaugguguguucuagugaauggaaacguuuugcccucugugcaggggcagcauugcaucauggaaagaucaccuacccggagccaggaggccugggcucuggggccacgcuagcccuaacuagaagugaccauaggaaagucacuccaccuuuuccucaucuggaaaaugaggaggcaggauguggugaugucugagaccccuuugggcucucacaguguagaaucaaguggcaccugaacuccauccugaggagaaugacaggagaaagcacccacagauaaucacacuugcacugcgggcagugaccccgcggcauaguauuccagcacagcucugugugcugcgaccacauucaggagaggcaggggaagacuuuuuauugcucucaggcaagaauucaguccugagccucagggagccggcagugguggucugagcaggggagaaacuagcugcccuagauuacucuauuucuuccaaaccaguuuuuggaagucuggguuuuccccucugauuuucacagaugacagcgucagcaucuucccccugccucugcccagggccccauuucuccccuuaugcccuccuccuucccuuuuccaucccugucuccaccacaucaccucuuucucucugaagccucugcuggcuuucuccgugaccugccuugucuguugcuggcaugguuaggaaggccgcacccccuucccagccccaagcaggcccucuaaucccugcagucggcugaggacaacuguagucucuccaucaaauaagcauagaccaagaccugcagcagcucugccugcgagccggucaccauggcaacgagcaucaccuccauucuacugugaaaagaaaauggcuguuggaaggaagggcucacugaaucuccauuccccaggcuguuuuguucaagccugucccuccuguuggccagaagaagccccaugcacugaaccaaauaccuguuugccuuuagauuugggguuuacuuaagagaaggaaaggcagaaagaaguugaauucaaaggaauaaagcauuuuuccaccucgaaacucuauuuucaugaggaaugguugucugcucccagcagauaaacgaggagcagaugaacacagggaucugugagaucuggcgcaguguauuuugucuuaucggugcaguggaaugacagagcauauggauguucaaauaaauauucagggaaaguagccaagggacccagggaauuccacagggcacgggcuacagaauuuccaaagggugucugacuaauugggguggugauaugugauguuggcuccuguuauggaaaaagguguguugguccuguagucgugagggaaggugaggguuuacccuuaccauccccacuucaaaaucagugugagcccuccuagugauuguguccggacagccuggggaacuggcaggagaccccugagcuugauucuggagugcagccuuacugcacuugacacagcuguggagacacuucagaugacauccagaaggaacugguugggucaccauuucugugaaucccaggauguugcuguuuuggagcaggaucauaagucuucucaagggguuggaaacauuuagugcagagaucacccagaaucucccagggcaccuugcacucucugaggggaaauagcuauuccauaggagaauggucugggccgugucucucucuggcugcacauggcccuggcuguugguggcacaaguucucaaacuccacacaaccuccucccuucacucuuucuuaaagucaguugggaagccuauuuuugaauggaagaucuggguuucauucuugaacauuggaauguacguuugaacugaacuuuguggguuuuuuuuuguuuuuuguuuuguuuuguuuuguuuuguuuuuucaguuucucugcagguggauauuguucccagccagggggagaucagcguuggagaguccaaauucuucuuaugccaaggcaagugccuagugcucagcugcauuuuagaacuugcuucagaaacucacuggguagagcaggagcccucaggccaugugagcuggcuggucaagccacaccuagaauucuuggcauugcucuauuacagggucaauaguauggccauuuaagagccagggccucuuccuuccuuuugcaaaaaucugccucaacauagcaaaucugucaucuagacuucaccuugacuacagaggaagucuaggaguuuucuuagaaaaaucagcacaacuuccagaauagugaaucaucccccaucuccuauucuguauacauucagaguucuguaaaugacaauggagaacagcacuggcucagaaacaauacuucgguggaucuguuuaaggcuuauuucuuagaauuccccagagcuugaaaaucuaagucuaaaacuugccuguagguaaauagaauacugguauggcuuuuguugugaggacauauauccuggguuuaccaggucuauugugaauaucgauauucugugccaugguccccaccagagcucugagauaugccagaccuggugaccuuguuuuacauuuagaaaacaugccccauuuccacagcccagauaauugccagaaaauguccuguggaggaaaagguuucaaauuaagccucagauucucuguauaugacaugacugggauucagaacauggaagaaccaggaaagagcugagcuagguguaaauggugacauuuagcaagcagcuuuuggcagggaggggccuuuaaaugcugucaugauuugcguggacgagguggcuuguggccgucggauguguucacuccagcuuugccuucauuacagcaauuucaaugaucuggagacgcagccguggagcccacagcacaucuugcaaauagcgauauuuauugaaaacaugaugggcccugaaaggaagacugcuucauuuccauacuaagcaucugugcagggcuggguggugcaggcugagaagggcgccacgcgaagaggcaggggcccaugcaaacaggcagggcgccgccacauccgccggaucugagcgcccuuccagcucaguguccugggcaguuucagugucagagcccuguuccagcucagugccgggggcagcucagccaccacagucuguuccuccucauugcugccuggggaaaggaagaaugggugguucuggcuaccuucuuugcagcaugcaaggaaaugaauuugucugagcagggagugacgaaaugacagucaugccaguuugugcaggcagaugcuagaauaaauguggcuggaaaaaaugaaauaaaaagugguuggaaucugcacuccuauacuagccaguauuucucgccuucaucucaggagacccauuauccaaggcuucaaaaacaagcugaucaguagacucagaccaguuaggcucuggcgcccgaauccuaaauacacuaauucccuugguuacccguugugugaggcauguguguuccuagcuuagugcccagcacacaguauguucucaacaaguaucucuucucuuccaucauuagggauaggaccaugauaacaacuaguacaagugguuguugaguucuuuccaaauauuguaagagguguuaaguauauaauaguuaaaugcagaggccaaagaagggcugcaugucauuccagcagccauacucaccccucccugauguucaagccuugacugaucuguuguucaguaacucuuacugaucagccacugucagucuggaggggacuuauuagucuuuucgacuucaguagcuuaaaaauaaucucuuccucuuuaguggcaggagaugccaaagauaaagacaucuccugguucucccccaauggagaaaagcucaccccaaaccagcagcggaucucagugguguggaaugaugauuccuccuccacccucaccaucuauaacgccaacaucgacgacgccggcauuuacaagugugugguuacaggcgaggauggcagugagucagaggccaccgucaacgugaagaucuuucguaagagccuccuucuucuucugcauucucuggccucuccuugccaaggagacauguggguaguggaaagguggaaaugaugacagaaggaccagcugagggccuaaccagucccauucucucucccuaagucuuuucugaccuuggccaacccagaacucacaacccugguucacacuggucacagcuacucccccacaggcguucauucucaaaauucaaauuacauaguucccagagggcuauuacggguuucucuaucccuuccccaaauguuggcugacuguucugcaauuugggcuccucucccuucuuauuucccucuccccugcugguaauggagcccagggcucaguggggugggggaucauuaucugaacacucucugccacucagagcaggcaguuccuauugccucugaaaccccaucuguagguggcaucucguuaccuuguuauuuauaucaugcauccaucccagugguuggaguaauggugggugacagcuaauggaacaguauugauugcacgguauuuauugccauuaaaugugcuuuuuuccuguucuuuucaucagcauucugucugccguaggaaaguuggggugggacugggaguagcaguucgagugggagacaagaaaaggacugaugauucuuacuauucguuguggaauggauguuccaccaguucauucuaccuauaaccugugcuucacuggcaucauccugcaugacaaggaacccuuggugaagauauuccuuucauucuguagacccuuuucugcacaaaaugugauaaauuuagcacucaaugagcagauauugguugccaagcauugguaaccuaugcuugggccagcugcucugccugacgucucugagggugccccucuuauacaacuguacaucaggaucgagacuugcccaggacucaaguccagguaccauggcucuagugaaagggguucuuugugagagaagcagcuguuuucccucacucuucuguucaucuuccagagaagcucauguucaagaaugcgccaaccccacaggaguuccgggagggggaagaugccgugauugugugugauguggucagcucccucccaccaaccaucaucuggaaacacaaaggccgagaugucauccugaaaaaagauggugagaccugaauuuccuggcaucugccuuuuccccaggccaccaaguucccuagcuuuuucaccuguacugaggcauuccaguccaaacuccaauucaugugugcccgaacccucaugugguuucuggguccugaauagaugcauaucugaaguugguauacuuagguaccugauuuucucuccaguacgaaagacaaauuucuaauagacauuuacucuuggcuguauuucaaagccagggacgcauuuucuuauuugggcuuaaaaccccacccuaugauacugaaguuaggaaaaaggaaagagacucagccaccugccugcagaugcucucugacugauucuuggaugaaccugccucuuaucucuucuaguccgauucauaguccuguccaacaacuaccugcagauccggggcaucaagaaaacagaugagggcacuuaucgcugugagggcagaauccuggcacggggggagaucaacuucaaggacauucaggucauugugaauggugaggagaguccguucuuccugaucucugcauugcuacaaccuugguucuccaaaaucauucucuuuaacuuccucuugggucuguaaauuaaauccuguccugacucaaucauccgucugagcuaaauccccuccccaccguaacaucuagauuucuuuuuuuuuuuuuuuuuaauauacuugccuguuggaucuuccuucaacuacgagggauuuuagugcagcaacugaauguccuucaccguucugcagcacuaaaaacuuucccccugcuuaccuauuaauccucauuguccuugauguuaccauaauugugaaguuauuccgcugcuuaaauguucaaagaaaguauuaagucaacucaggccucagaauagucagaaucaugguccauaggcuuguuaaucuuaacuugcagugucaaauaaacacacccauggaauugaucugacauuuacaagauguuuacaggaaauuauaaugucaguacuaagaaaauaaguaaaucaggguugaauuguuuugacuauugacacauauuuuuuuugccaaacucuccccaucucauuccuuugguaaaaaacaguuuuguacaagguuguuuaucacagucccagagaaauggcacucuuuguuauagcugaugcauucgaauugguguuaaccauuuaaccacugggagcaguaauguccaacuuuuuccaguacaaagagcuccuuuuuaacaucaaguuucacugaaccugguaguuauuaaguuuaguaugcauugacugagaaaauacauaaugaagaauagugacuauaaauugaauaccaucuuaacaugcauaaaauguauuacuauagcuucucaauuaaugaaaaacaaaaaugcauguuuguagaacugucuauucaguuugcagaaguuauuuaguacauacaugaauuucaauuccugacacuaacucuguagcugcacacgacguuugucccacaggcugagaacuccugaccuggaguggugucucuucuccaggccauuggguucuuccaaauuuucacaaccaccccaugacacccuuuuuuccuucagugccaccuaccauccaggccaggcagaauauugugaaugccaccgccaaccucggccaguccgucacccuggugugcgaugccgaaggcuucccagagcccaccaugagcuggacaaaguaagaaacuggcucauaccuuuuaucauggacuagaggagaauggggcaucacaaagucugcuccauguuagugucugcguggaauggaugugggcuucuuaggaauauuaaccccaggagaagaauggacucuuuucuauaagauucucuugcuugugcauugauuauuccuucaauuucagccuugugggggcagagucagagccagaggguguggucuugggagcccacuuugaaacauuuguggguacaguugcagcccuuggauagucagaggauggaauagaggaauaagagguguauguggacguucaacuuggugccuuaacuuuuugugaagacugaggagucuuucccauugacucagucugcauucuauggaaccuaauuaaaaauaaacgucuuauuucuguggucgaaaucaugcuacuuugcauuucuacaugcucuagggauggggaacagauagagcaagaggaagacgaugagaaguacaucuucagcgacgauaguucccagcugaccaucaaaaagguggauaagaacgacgaggcugaguacaucugcauugcugagaacaaggcuggcgagcaggaugcgaccauccaccucaaagucuuugguaggggcagugggggcccaggucacugcucugccacaauuccccuuccucugcacauucaguccaucaguaagacccuggccacugucccucagaacauaacccaaugcaaccauuucuugccaguuccaccaccuaguccaagcccuaguccaagccaccaucauccucaccugagcagugggacggucucauagcuggccuccccgacucucccuauugguccacuucauucacuucugcucacaguagucagaaugaccuaaguaccacucaucuguuugaaagccuccaguggcucccuauggcaaccagaauaaaauucagacucccugcaauggccuacaagaccagagaugaacuagcuccugccuucuucuccagccucaucuuucuuucgcuuugcugcacaugcaaaguucuccaaccacacaggccuucuucaugucccucagacauaccaagcuuguucuucaucucaggaucacugcccuagguuucucuucugcuuggaauaucuuucccucugauccacucugagcugccuucuucugauccaccauucagaucuuaacucaaacucaccuucucagcggcgccuuccuucacugcccuggcuaauucaacucccucugcacugcgaccacccccacccaccuccacucaucucucucucgugacucuuacuguaucuucuuugcuguacuuaacaguaccugaacagaugucauuugcauauuuguuuuggggauugucugucuccuaccucuacuaguguguaaacuucaagauagcauaacccuggcugucauacacggcguuaucccugugacuccaaacagugccagacuuggcauaggcccuugguaacuuuaguggucgaugggcuggcugcuuugccuuguuugccuccuucccugaccugugcaaaacagugucauggaagagcccccacaucccugcucacuucaucuucauaaacucaggaaacuuccauucauuucagaacugaaaagcauuuugaccugaucuugaaaaaagaauugguugcagagaaacguuuaaccuaauggcccucaagucucuccgcgugucuguuuagaaaacacagauaaacuggucuacuguagacagcacuggggaagugccagucugaggcgcagcucuggugcauggagcccccaggucauuaaaaugugcaccugggaaucaggguugggaccugcuuauccagccugauaaggagaacuguucauaaacacagaccuuugaaaaucaagacuuuauaugcaaauguccugcuaguuauucaguaguaaacagcuggguuuagaaacaggcuaucaguuagguucaaguuaaccguacguauuugagagagaaagcuaaacuucaugaaaaauauucuugaaagucuuuucuugaauucagacugaucuuccccaaucacuaugguuuuaguaaguuuuuccauauuguagaaaaagauagaugcauuuguuaauuaaucccuucauuuaauaaauacguauggaucaccauuguugcuggacagaggggcuacagagaugaauaggauaugaucccuugacccugggaagcacaaagagggagauaaauggauaaacauaaauguuauaauagugucagucagcaacauuugagugacugcuguggacucagucauugccaaguuuacaagaugaauaacauggacucuguucucaucaguagauucacaagcuaauguagauagucaacgcuggaauuugaaaugacaacacauuauuauggcugcaaaauagcaauaugcacaguguuuuauaggaaacaaguucucugguccugugugauguaaguuagagaagucauuaaaauguacuauuucauaaguaggaauuacccagcugaaggaguggaugagaauuuuaggcagccugggcacaggcacagaggcaggaaaagcacaggcuaugcugaaugggagcuucuuguggacaggggcugugucuguuuuacucacagauagauccccagcacccacaugcauuaggcacuagauugaauaaaugaaggaacugucauuaguucuauaugaugaagcaaacauacauauguggcagggagauaagccuggaaacacgaucaucaccugucucuaggaaauuauuuuagacuuuaacuccauaaaguaguaauaauaauaauaucaaacacaagcagaacaccuauaaugugccaagcauucugugaagugcuaucuguaaguuaacucuuuuaauccucaucacgccccuaugauguagauuuuauuauuauccccauuuuacaaaggaggaaccugaucacagagggaugaggugccucuggauucaaaccgaggcagguggcuccuaagucccuucucuaaucuaacaaugaugguuguuaauuccaggaaacccaacaggacacaaauuguaucugaauuaugugggagugucuggcaauacuagaaucagugcacucugccugcaucaccagguagcucaugguuucucugaaaagcaacucagcccugacuuggcugggcaugaacagaucucggcuucucuuccagaccucucugguggugauggcugccccggaguagugagugcagggccaugugggaccgugguagagggaagagagugggucaggucgacgggaggaggucaaaaggcagaaacugccaagacaagauuugucuucccacccacaccuuggacacauacaccccucuucaucacaaacacacacacacacacacacacacacacacacacacacacacacacauauuucacaauuucuuucccgaaacugcagcuggaagaauagggagcauaguggggcaaacagagaagagguggccaggcuccugaagagacagggcaggaaucauagauuuguagagacugaguccacacagaaugggaauccuccccugucauagucugcggagcguucaugcagccucccugaaggaaccuggugccucuucuccaccaccuuuucccauccaucuucccuucucauccuccuuucucuccuccuccacuggccuucccauugguugaggaaacugauauaggguuagggagccaccuggggagggaccagcugauuagggcuccuucuccuuccacucuuuuauuuccuuuccagccccuuccaacuugccauuguggcccaucacugggggagaaaugggacagguucugcaagugggaguagagucuacagcagugagguagaaaagggaggaaaccuguagcuuagauaguaaagaaaagcccagaaguccuguggccucaagaaggaauguccaucaguauguaugggacauaucucaauuagagacuuuaugacaucauuuguaucuaaguggcaucauucuuuccucagaaaaagacauguucuagcacauguugccuuaguuauuagcuagaugcuccuuuuacuaaguagaugcauccuaucauccuuuaaauuuggcagugaauucucauuacuguugucccuacacgugccccugaagaaguuuugucucuauugauucuugugaugcucauguacaugcucuugaggucucaugcugcuguggcugaggaaaguucuccaguggccaggagcccugugucucaagcagccccugaggguuacagcuaaggacaagcaguggccugaaagaaggugcaucuggucaugccccauagcauaguguccaaccucuuuguucagggaugcaggggccucggggcucuucuuuggcuaggguuguaggagcauggacuggaguuggaguagacaaggcugccucuuaguggcaagcauucuuggaaaacucacaggaggaaauauggggaaaggugcaguggaacagucugaggcacuaaggcccauggaggcagguggagaauagaacagggauccaaaagccaagaacucauaagagagguuaauuaauagagggcaggggguguaggaagaugaaacccagagagaucccucuagaugcuggaaggcagagggagggaaucuuuucaguagggugacccagcaucugucccuguuugccuacuaaugcccuuuguccugguguaauuauuuagagccucucaugucacucucaagagagucccaauuuagacaauaaauuaugcauaucacugucuuguucuaagguggcaucugagcuuucugaguuaguucugaccguacugcuucuagaguaauagagaauuaaauuaucagugggaagcuucccuuccuucccacagcacucuguagacuauacaaaauuagccauaaucauguuuuaauaagaauaugguuugccuuuuuucuaaggagucacacaaugcaccuucuguagccaucugggaaauggagccuccaaggccaaauauuaauagauggcaacugacccuugccugucuucuguuaaccuucggcugccaugacaaaguaccgcaggucaggagaaggucagcaaaacgcuguccagaucucagagucugacaagauuuuaaggggccccaaauucagccuuccugggauugucuccagaccucaaaacaacuguugaguuuagcgaauucaguuguauggccacauuuuuuuuaaauuuuuuauucugugacuuuuacaauauagagauucagcucuuacuuuaccuuucuuuuauuuuauuaaccuuuuuguuuuucauguuuauuuuaccuuuauuuuacuuugcccucuaaaacuucccuuucaauggcacuuggcacauauuccuuccaauacgaguuguaauauucucaaaaaucguacuuauuaaggaaaacacaauagggaaaccuaugagguuuaaccucauucauguggacuccaucaacugaaaucuaugaacauuuggccagauuggauugagaugugccuaugugcuauccaucaaaaaaggauuugcuaaacaggcugucaguaugcauuaccuuuaggcaaauauuugaacuauauggaugauuuuauguagaagcaggcauuuguaacaaaaguauauaguucuauuauuguuuucuguuuauuaaaacagcaucaaagaccucaacauggagaagauauauaggcaguuguuuauuugccuacuuaggguuacuguaugaauuugaauauaaagcacauguagucuuucaaaaacuagcuaucauucucuugggguuuuuugguucauuuguuuguuucccuagccugaccuuuuccuauauucaugaaauaagucacauuugugcaguguuaucuuuucucuuccacacaaaguucagcaauuucagagcauaauuguuuuaaauugggaaaauucaauuuucucuaauguuuuaacauuuaacuuagcuuuggaaugcuuguguuuucuugcauuacccaaaacauuuggaaaaugaacucaucucaacucaucuccuucccauccugagcccaccccagagcccccauccaguuccuugccugauuucuucauuugaguuaaugcuaacacccuucucccagucguugagacuccaagucaccuggacuccuucuuauugcuucuuuugguucuucucaccccuccuugcccucuguucaguugccacuuauugaaccuuccuccagcaucugucucaaagcuucucuuugcuguuuccccucaaacaaccuuguucagaauccaacauuaccgcacaucugggucauugccagggcuuccaaacugguuuucccacuucaaaguguucucuaguccaaugcuuccugaaaugucccuagauuaaccuucuugaaauacaaaugcuuuugugccccugacuaaaugcugucugugggccuccaccaggcaccagguaaaauuccagccauccagccucaccuuccugugccucaugccacacuguucucuucccagccaucucuucauauguuuuugcuucuuugcuuuuauucagucaguuuccuacacuucaaaugacuccaucuccacccuagaguuccaccuccugaaaaucucaugguccagccccaaagccguuuccucucgaaggcuccauccagggagcgaucuuccgccauguccugccuccugcauuccuugcccuuaucacuuuuacucuauaggauauuucugauuauuaugguuuccguguugucacaugccuacaucauuguaagccuuggagagucaggucugcaucuccuaaaacaccuagacuagggucuuguacuuagcagacagcuaaccuuuguuggauaggugcaugccaucauuuaaacccagaaagcucaauaauuagauaaacucagagaaauguuuugucuuuucagcaaaacccaaaaucacauauguagagaaccagacugccauggaauuagaggagcaggucacucuuaccugugaagccuccggagaccccauucccuccaucaccuggaggacuucuacccggaacaucagcagcgaagaaaagguaucaugcuccccaggaguuucagggccuuggaaugcagacucaaagcagauugagucugcucaugcccaguucucuuuggggagcugggagauggguuauggucaccagaggccacagccagaucccggggccucccuccccaacccugcaggacauggccugcucaucauccccuuguaauggaauaggcacaauuccuuggauagguuggugggggcgugauguaugggcaugcucaaguuagauguucuggggaggaggcaauggugauugucaaucccagaguuauggagcugugagggaacaaagagaaggcaauauccugguccaccaggugacauugucaucauaucaagggcacccuaggaaagaucucccagaaauaaccaggcucaaaaugaaccuauuaauucuuuuucuuguguuuguauacucaugcuauauaugcacuuaugcacaaaugccugguugccauugugucugccuguauucuuggucacauuuggauaccauuuuguucuaaaggcaaaaauauuuagcaguuucuaaaugaggauuacauccugguuuuucaauauauucauggaggguuuaagaacauuguagcaaccuuccuggcaaauuaaaauggcgggaaagauugagcuuuaaaguccguggauuuguaggccaccagaaagcuaucuuuauuguugacaauauauaaaaacugaggugaccccacaucauacagcccuugauuauugagugggccaaaaguaggaggaaaaagcuucauuuuaaugcaacuuaaaccgucuuaugguacuucuccaaucucaucucguauauccuguaguaaugggcuuuguuuuaguuagcccaaguuuugucaccuagucaggaauaauggccuuagccuuauggaacauuuguaauggauugcuuauugaucagaaugucaaaaaugauagauuuucacucuucugccugccuaaaggaaaucucuagagagaguaaacucaaauaaagcccgaaaggauagugugaaauuccagaguuaaauuugggauuugcauuugaggagcugauuucugucccacuaauagaaaacaaaacugcaucaaauggaacagaaauugcucuuccaaauaaccuauuauuuuuugcaacuuuuaccugcagaguuaaauucaccuuaacaaaaagucaacugaggaacugcuaaauauuuuugaaacccacauaugcuguuugaaacugugaaaaccagcuagauuaagagaugugguguuuacuuggauacuuucuuuaucaacauuagaauuaaacccuuagcuaagauuucagccccacucauguguguuauguggauuuaauguacauuucagggcuuaaaccacaaggcugcugcuuggcagaucuuucuacaucagcuuaaaaguagauuuuuguccagagugacccaguguauaucuuugaccuacagugaaggacagaaauaauaucuaucucagaugaaugaugcuuuugaauucuauaucuuuucuaggaauagcucaacagccaagcuagaccagaaagguuauuaagauuugugccuacugagguucuuuaauagguuggcacuucuggcuuguagcuaugauuucauuuuuuuuuuuuuuuuuuuuuugagacggagucucgcugucgcccaggcuggagugcaguggcgcgaucucggcucacugcaggcuccgcccccugggguucccgccauucuccugccucagccucccgaguagcugggacuacaggcgcccgccaccucgcccggcuaauuuuuuuuuguauuuuuaguagagacgggguuucaccguguuagccaggauggucucgaucuccugaccucgugauccgcccgccucggccucccaaagugcugggauuacaggcgugagccaccgcgcccggccgauuucauuuuuauagaaugagaauaauagccaggaacuaaaacacauucauacuugcuaaauauggagacagguguccagcagagacugucucaagccuaguagugacuacuuuuuauauaauucugcuaucacuauagaucauuugucuuaaucuuagaucauuauuucagcccagcuacauugguuguauuguauuucuuuuacuugccuucaaguucacuuuauuggaacaugagugaaucgguauuaaaacaaguccuccaaaucagcuggugaugugacaccagacugacauauuugccuaagugaaacccuauauaagaaaauuugccauuucuguuaauuauauauugacgucaaagaggcguauuguccaucuuacacuguggauagcuaauaauuaagaaaacaaauauaggcuguucaugaacugguuggaguacagaaaauaaauuucacuuuuacuuuggcagccucuccucauguucuccuccauccgaaguugcuucuauauaauuaggaaucaagauuacuagcaucacuguaauuguaggaguggaaaacaaccauuuucuuuuuaaaaucagggugauaugcuaagcaaacaagaauagaugauuguaucuaauuggucagguaaagaauccuccugagauuuagaucacauaaaaugcuaaaaucauagauguucggaaggcaccuuuugaggucauccagucucaccuggcacccuggccuagcauccuugccaggaagccaguccgucccugucugaagcaugauggugucaguccucugcaggggaguuggccaaugcugaagagcagaaagagcuacuuccuugccccuuccucuacucaguccuccuagccucugccacucaguccuuugcaugagagacauuaaaaacucuccgacuuuccuccaguccacuccucuuaccuugaacauaccaguuauuuucacuauuucucauauggcauaguuuccauaccuuuuaucuuucugguugucuuauacgagauaguuucaguucacuagugcuccccuaaaauuuugcugugcucaguguaauuaaugcagacuucaggagggcuacugccucuuugaucuggaugccaucaugcagaaaaaggcacauuagcucuuagcagucuccuuauucuguugccucauauugagcuuguggucaacuaaaaugcucaggucuuuuuuacaugauccccauuuaagccacauauccccuauccuguucuuaugcaauugauugguuaaccgauauugcagaauuuuauauuuauuuauguuaaaaauugcauuuuguuuguugcagcucagugcuucucaacagggucaugguggcaauuugggaagaggcuuccuucacugggacuguacuaugcauugcaagaaacuuaucaucucuaguccccuuccuguuaaaugccaguagccaccucuaauuguuacuaaaaauaugacacauacaaacacccuguggcuugagaaugacuguuugaguccaucuuucuaaccagucaggacugacuuucauuagaaauucaccuuagaagucuauguguccagggcacuucaacccauguguauauuaaaaguaaaguaguagaguagucaguggagaucccagccuaagcauagagcccaagagcaggcaguccaguagccuucccaaugcagucgucaucuaacauuuguauuagcuguugcuuccaaccuuguaugaacacuuauuugcaauaucuuuguccaagucacugauagaaauguugacuagaacaaggucaaguacaaagcccuuagacugccacaauggcuuccuucuggcucgguggcucagaagguaggccacuugaugccacggugccacagugcucucucaugguuuguaugacuuuaguggaagguucaaugauuccuuuaacaaaguuaguuacaauauuagcaaguuaaagcaguuuuguguuuugcuucacugcugaguuuagucuaguauuagucuucuuaagggaagagguggaaaaaaggcauucaaccauagacauauaguuacuaacuuucuaauggaauaccaauguucuuguucauuauaaaagaaggggggagauaagcaaaaacaaguacaaugagcgugaaugucacacucuaccuuugaucaugucucuguauugagucuaguuacucauuugagaaugaccauuaccaaucuguuaagcuucagcuaguugaguugguuuagcucgacaacugauaauagcuaggguaccuaauuguuuggaucaucgagaucauuaagguagaucagcuguccaaaaguugaugcauuuccuaguaguuacuauuacauugaccaaaaaaauugaccaucauaaugggucaauuugaucaucuguaugaaagucauugugauaccucagaaagcuucugcuuccauguuauuucacuacucauccugcccagauuccuuuuaaauauugccagguguuugagugaguggugcuaaauuccagguuucauuuacuuacugacugagacccguggaugaugauuuacguacucuaucccuggcagaaaaaauccaucauaugccucuuugaacaucucuaugccuuugaaaugacugacaaaggccuaugaagccuuauuaaggaaaggagagcagugaagaauugagaucagaagagauaggaaaaaugaaaagcauucugugaaccuugaaucuuaggcugacagaauaucccacaaguaagagagaacuuuugaaguucuggauucuuuggaagcuggaguuuccuuuucacgagaaaaaaauuccucauucaguacaaacccagggcccgcuuuuaaacacuggaaaagaugacugcauuaagcaaucagucugguuuauccagcgugugggcacaugaauaauggaauaccuaagaaaacuauagaaaugcuucacuuuauuuuauauauguguuccugcagacuuguguguaagacaauaaaauaugaauaucaaaacaaccuagaacaauuuuuggaggauuacuaaucacacucugauuuauuucauaaguguguacauuugcauaucagguuguccuaaugugggucacacauucaccaaauuguuagggccgagauauuuccuaucuuuccaccaggcacaaaaguagaagguuauguuacuggaagcuuuguguuacuagcaacuacuuauucuaaaagccacagaaccauagugauuugggagagacacaaggauaaucagauuugaaaaaacauacaacucaaugugauagagucucucaaaagaaagaucuugauuccugcagcccuggcauguaaccgacaagcuucuaagugauguggaauuggcaagcacauuugacguguuggcccaccguuacuuuggucucugcauguuccucuguucucaccuucuucuucauucccacaucaugugacauaacucgauauuuccaucucauuucucacaaaaguuccuugcauuuaguggacucuuacuaaauguuugcuaacuuauuugcauucccuggguugcguugcuaugauucuggcaucuuuucuauccuuuuuccaucugaacaucagagacaaucgggcagucuugccagguaauaaaaagaacaaugcagcuaucaugucuuugaauccuaguaugaaaaacagauaaacuguaaggagaauagauucccaagugcuggagaaauaaaaaaaucuagauguggguggaaaaucccucuaaccucugugucccuggguuggcuugcaaaugccaacuugugaauggaaugccauguuugauggagaugguacaugcuggaguccacauaccaucugugcauucucugcuguuaaggacuggagcccucccucaaccacuuccauuugguauccucaaagcuuccugacuccuggucucaaggacuucauacuucucauuccuaguguaccucucugcuccuugcuuuguuccuuuuuggcaauaaaaauuugauuuuaacagaaugcaugcaaagaguuguaaaaugcaugagcauuaaauggcauuaguauaucuaugauaagcugccuuauaaaauccaaagaaggagaccuauucucucucucucucucucuuuuuuuuuuuuuuuuuuuuuuugagacagagucucacucuguugcccaggcuggagugcaguggugcgaucucgcucacugcaagcucugccuuccggguucacgccauucuccugccccagccucccgaauagcugggacuacaggcgccugccaccacgcccagcuaauuuuguguauuuuuuuuaguagagaugggguuucaccguguuggccagcauggucucaaucuccugaccucgugaucugccugccucggccucccaaagugcugggauuacaggcaugagcaaccgcacccggccagaggagaccuacucucuuaagugucucuagauaaugugguuagaacuagucaugucaccaaauacuaugagcaauauuuaagguauuuuggaacaagagcagucugguccuacugguauucauaucuagguauaccaaagauuaggaaaaccugaaccuuuugaauuauacauuuuaaugugccuaagggggaaaaaaagcuggacauaagcuaaauccuaaauuaaauuguguaauaaacacaccauugaaagugggccuuggaaaaaguucugaauuaaagaaaagcugcaugugcacggaaugcagugugauacauucucuaaagcaacauguuguaaaauuuuacugcuuucuuguuguguuuuauaucuuguuuucuccaggcuucguggacucgaccagagaagcaagagguauagcuuaccugaccacuagccagucuuuaguuuugaaagcauuacaguuuaacucaccauugcaguuuaauaaccagacaugcuaaacuaauuaguaauuuagcuaaagaauaggucgauagugguagacauuacuuagcaauaguaucauuuuaggaugagcaagcaagcuguguugggaguggaugaacaaauccauauuauuuccuaaaacuggaucuuauucucuugcuggugcugguaaaaucacauccagguaauuacaccaauagaaauaaauugcccccaauucccaggccaggcauuuugaaauggugaaaguuuuuugacucacaugguugauguggcucuggaccauaaagucacagaguuagugaucuaaaaacccacuccucccuuuccuuuccagcucaacucaucuuguugcucacuuauuuuauaaugaucagucuugguaaauuaucacaucacguuucaucucaaaagcaaugcaaaugacaucucucguugguuuucccaaauugcuaaacguaucucuguuacuuuuauagagcauuaaauuuaugagauuagaaugaugugguacaaaugguuuuauguuuuuuaaagucaguagcauuuaaccuuugaaauuucucugacucauugcuucaguuuggauaaugugggacuuaguuugaaaacugaaguuaaguauuaaucuuuaggcuuugauugccacaucucaagacccuacuuaugaucaugacuauaauuuuuuacccgauuuauaugaaguaacauauagugaaaaugaaaccaguggacuucagaugagauucaaggaucuaaucucuaaggacuuuuuuaaaguugccuuugccuuuuauccagauggggcuuugaucguguaaugcuauaaaugcagaacaucaugauccuauagauucuguauuuuaauuugguaaaucuaucccuuagucuuucagaaaugauaauuauucagaacguauaacucaaguguucaggucaaggcuauacauauuuauaugcuguuuaauauuuaaaaguugacugccuguccccaggcacugaucuuaguuucugcacaugaacaggcugccauugucaaauucaguucauuauaaacuuccuguguauaagacuguccucccugucauugggaugacuguuaagugcacagccucacugagaggcuucccgccuguggcacaggaaucacuuagugcugucacagguugggugcuuuauuguccaaaagucauggacccacugggauuagggaagagagagaaggguuaauuaucagccacucuuaagcagcuacagaucucauucugcuuggccucauacaacuuuccuugucauucucauuuagagcugguugaggaggagcugagauuuaucagggagcauuaaggagauguuaagagaauuauuauuguaaguggaaguaauagguuuacucccaugaaagcagacaccucacucuguuuuucagaaguguccuuaucaugagugucuuacuuuggacguaauugacuuucaagugaaugcugccccuagggcucagaaguuccauucucuccuguuugucucauuuggagaugaagaccauaaguccagaugagugcaaaagaaggcucagguuauggccaguuucauuuuguaaguucuaaaagcauuagcacuuuuaccuggaaggagggagacaaaaacauuuugaugagaagaauaauuaucauuaaccuucauauuuuuggggaaaaaaggaguuuucuugccaucaauaucuuuucauacuugcccagagcucaucuccuccuucugcugcagccuggguggucagcaugacuuuuugucuggauggcugguagguggcacacccugaaguugugcaggagccauaguaaaagcauuucaggggaagauagucuaaugacacuggagucuaucuguguauccucaaagggagaacugggcaucuggcagauaauuccaucaucaaaucuguagugagccuacugcaaaauaagaauucucuuuagaaggcuggucuguggacaucauuaaacaggagaaauuuccacauggagaaauuuccugaaagaaacuagauaggaauuaaaaaaaaaaaguauggcuguucacgcaacuguuuucuaagcuucccuucaaccauuucuagacuauucugaguaaagacuuggaauauccccugcuuuguugucguuaagguccuguucuugcguacauucauuucucugccucuuuuguuacaacaucucuuccuuauggaaauguucucuugacuuccagaagaguauuguucaauuuccaaguuugugugugguggccccaggacaagucuggucugugucacaaagaauuuuaguucaguugcugguugauaucacagagaucaccagaaaggccagggguuguccuuaaguucccucugccugcaguccugcuuuguuuuggacaaguaggagugacaagcaggucagcacagcccuuuagagauaccugcagggauggccccaugcucuugaggccacuagucuagacucacggguaaagacuuguguaugauguaugaaaauagcccuggagguaggggcgguuccaagauggccgaauaagaacagcuccaguccacagcucccagcaugagcgacgcagaagacggaugauuucugcauuuccaacugagguaccggguucaucucacuggggacugucggacaguggguucaggacagugggugcagcgcaccgagcgugagccgaagcagggcgaggcaucaccucaccugggaagcacaaggggucagggaauucccuuuucuagccaaggaaaggggugacagacagcaucugaaaaauugggucauucccacccuaauacuacacuuuuccgauggucuuagcaaacggcacaccaggagauuauaucccgcgcauggcucagaggguccuacgcccacggagccucgcucauugcuagcacagcagucugagaucaaacugcaaggcggcagcaaggcugggggaggggcgcccgccauugcugagacuucaguagguaaacaaagcagccaggaagcucgaacuggguggagcccaccacagcucaaggaggccugccugccucuuguagacuccaccucuggcagcagggcauagccaaacaaaaggcagcagaaaccucugcagacuuaaaugucccugucugacagauuggaagacagcagugguucucccagcaugcagcuugagauccgagaacggacagacugccuccucaagugggucccugacccccgaguagccuaacugggaggcaccccccaguaggggcagacugacaccucacacggccagguaccccucugagacaaaauuuccagaggaacgaucagacagcagcauuugcuguucaccaauauucgcuguucugcagccuccgcugcugauacccaggcaaacagggucuggaguugagcucuggcaaacuccgacagaccugcagcugaggguccugacuguuagaaggaaaacuaacaaacagaaagaacauccacaccaaaaccccaucugcaugucaccaucaucaaagaccaaagguagauaaaaccacaaagauggggaaaaaacagaacagaaaaacugaaaauucuaaaaaucagagaaccucuucuucuccaaaggaacgcagcuccucaccagcagcggaacaaagcuggauggagaaugacuuugaugaguugagagaagaaggcuucagacgaucaaacuucuccgagcuaaaggaggaaguucgaacccauggcaaagaagucaaaaaccuugaaaaaagauuagacaaauggcuaacuagaauaacuaauacacagaaguccuuaaaggaccugauggagcugaaaaccacggcacgagaacuacaugaugaaugcacaagccucacuaaccaauucgaucaacuggaagaaaggguaucuugauggaagaucaaaugaaugaaaugaagugagaagagaaguuuagagaaaaaagaauaaaaagaaacaaacaaacccuccaagaaauaugggacuaugugaaaagaccaaaucuacaucugauugguguaccugaaagugacggggagaauggaaccaaguuggaaaacacucugcaggaaauuaugcaggagaacuuccccaauccagcaaggcaggcuaacauucaaauucaggaaauacagagaaguccacaaagauacuccuugagaaggacaacuccaagacacuuaauugucagauucaccaaaguggaaaugaaggaaaaaauguuaagggcagccagagacaaaggucggguuacccacaaagggaagcccaucagacuaauagcugaucgcucggcagaaauucuacaagccagaagagagugggggccaauauucaacauucuuaaagaaaagaauuuucaacacagaauuucauauccagccaaacuaagccucauaagugaaggagaaauaaaauccuuuacagacaagcaaaugcugagagauuuugucaccaccaggccugcccuacaagagcuccugaaggaagcacuaaacauggaaaggaacaacugguaccagccacugcaaaaacaugccaaaucguaaagaccaucaagguuaggaagaaacugcaucaacuaacgagcaaaauaaccagcuaacaucucaaugacaggaucaaauucacacauaacaauauaaaccuuaaauguaaaugggcuaaauacuccaauuaaaagacacagacuggcaaguuggauaaagagucaagacccaucagugugcuguauucaggaaacccuucucacgugcagagacacacaggcucaaaauaaagggauggaggaagaucuaccaagcaaauggaaaacaaaacaaggcagggguugcaacccuagucucugauaaaacagacuuuaaaccaacaaagaucaaaagagacaaagaaggccauuacauaaugguaaagggaucaauucaacaagaagagcuaacuaaccuaaauauauaugcacccaguacaggagcacccggauucauaaaggaaguccuuagaggccuacgaagaggcuuagacucccacacaauaauaaugggagacuuuaacacccacugucaacauuagacagauccacaagacagaaaguuaacaaagauaucuaggaauugaacucagcccugcaccaaguggagcuaauagacaucuacagaacucuccaccccaauucaacaaaauauacauucuucucagcaccacaccgcacuuguuccaaaauugaccacauaguuggaaguaaagcacuccucagcaaauguaaaagaacagaaaugauaacaaacugucucucagaccacagugcgaucaaacuagaacucaagauuaagaaacucacucaaaaccgcucaacuacauggaaacugaacaaccugcuccugaaugacuacuggguacauaacgaaaugaaggcagaaauaaagaaguucuuugaaaccaaugagaacaaagauacaacauaccagaaucucugggagacauuuaaagcaguguguagagggaaauuuauagcacuaaaugcccacaagagaaagcaggaaagaucuaaaauugacacccuaacaccacaauuaaaagaacuagagaagcaagagcaaacacauucaaaagcuagcagaaggcaagaaauaacuaagaucagagcagaacugaaggagacagagacacaaaaaacccuucaaaaaaucaaugaauccaggagcugguuuuuuuuaaaagaucaacaacauugacagaccacuagcaagacuaauaaagaagaaaagagagaagaaucaaauagaugcaauaaaaaaugauaaaggggauaucaccacugaucccacagaaauacaaacuaccaucagagaauacuauaaacaccucuaugcaaauaaacuagaaaaucuagaagaaauggauaaauuccuggacacauacacccucccaagacuaaaccaggaagaaguugaaucucugaauagaccaauaacaggcucugaaauugaggcaauaauuaauagcuuaccaaccaaaaaaaguccaggaccagacagauucacagccaaauucuaccagagguacaaggaggagcugguaccauuccuucugaaacuauuccaaucaauagaaaaagagggaaucuucucuaacucauuuuaugaggccagcaucauccugauaccaaagccuggcagagacacaacagaaaaagagaauuuuagaccaauaucccugaugaacaucgaugcaaaaaucaucaauaaaauacuggcaaaccgaauccagcaaacacaucaaaaagcuuauccaccaugaucaagugggcuucaucccugggaugcaaggcugguucaacauaugcaaaucaauaaacauaauccagcauauaaacagaaccaaagacaaaaaccacaugauuaucucaacagaugcagaaaaggccuuugauaaaauccaacaacccuucaugcuaaaaacucucaauaaauugguacugaugggacauaucucaaaauaaugggagcuauuuaugacaaacccacagccaauaucauacugaaugggcaaaaacuggaagcauucccuuugaaaacuggcauaagacagggaugcccucucucacuacuccuauucaacauaguguuggaaguucuggccagggcaaucaggcaagagaaggaaauaaagguuauucaaguaggaaaagaggaagucaaauugucccuguuugcagaugacaugauuguguaucuagaagaccccaucaucucagccccaaaucuccuuaagcugauaagcaacuucagcaaagucucaggauacaaaaucaaugugcaaaaaucacaagcauucuuauacaccaauaacagacaaacagagagccaaaucaugagugaacucccauucacaauugcuucaaagagaauaaaauaccugggaauccaacuuacaagggaugugaaggaccucuucaaggaaaacuacaaaccacugcucaaggaaauaagaggauacaaacaaauggaagaacauuccaugcucauggguaggaagaaucaauauagugaaaauggccauacugcccaagguaauuuauagauucaaugccauccccaucaagcuaccaaugacuuucuucacagaauuggaaaaaagcuacuuuaaaguucauauggaaccaaaaaagagcccgcaucaccaagucaauccuaagccaaaagaacaaagcuggaggcaucaugcuaccugacuucaaacuauacuacaagacuacaguaaccaaagcagcaugguacugguaccaaaacagagauacagaccaauggaacagaacagagcccucagaaauaaugccacacaucuacaacuaucugaucuuugacaaaccugacaaaaacaagcaauggggaaaggauucccuauuuaauaaauggugcugggaaaacuggcuagccauauguagaaagcugaaacuggaccccuuccuuacaccuuauacaaaaauuaauucaagauggauuaaagacuuaaauguuagaccuaaaaccauaaaaacccuagaagaaaaccuaggcaauaccauucaggacauaggcauggacaaggacuucacgucuaaaacaccaaaagcaauggcaacaaaagccaaaauugacaaaugggauauaauuaaacuaaagagcuucugcacagccaaagaaacuaccaucagagugaacaggcaaccuacagaaugggagaaaauuuuugcaaucuacucaucugacaaagggcuaauauccagaaucuacaaugaacucaaacaaauuuacaagaaaaaaucaaacaaccccaucaaaaagugggcaaaggauaugaacgacacuucucaaaagaagauauuuaugcagccaaaagacacaugaaaaaaggcucaucaucacuggccaucagagaaaugcaaaucaaaaccacaaugccauacuaucucauaccaguuagaauggcgaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggauuacaaaucauucugcuauaaagacacaugcacacguauguuuauuacagcagugcucacaauagcaaagacuuggaaccaacccaaauguccaucaaugacagacuggauuaagaaaauguggcacauauacaccauggaauacuaugcagccauauaaaaggaugaguuuauguccuuuguagggacauggaugaagcuggaaaccaucguucucagcaaaguaucccaaggacaaaaaaccaaacacugcauguucucacucauaggugggaauugaacaaugagaacacuuggacacagaaacgggaacaucacacacuggggccuguugugggguggggggagcggggagggauagcauuagcagauauaccuaauguaaaugacgaguuaaugggugcagcacaccaacauggcacauguauacguauguaacaaaccugcacguugugcacauguacccuaaaacuuaaaguauaauuaaaaaaaaaaagaaaaagaaaagaaaauagcccuggaauguaucagcacugucagcccucaaaaauccaguaucuccaacaaacugggugucacaaggcuuucuagugaaguguuccacaccuguuuguugucaucucucauuaauguguggcaucuccugggaugcaucuuucaaccaaccagcaucccagauuuauaggucaaagcagaggaucagagaacucaucccagggaggaauggcacuugcagaaaugggcagccaugacuuugcuugacucuucugucuucuugcuagaguuguuuuuuagcuuccagacaugaaaugcauuggggcucagaugaccggaauaggcuagaucugucagugaugguccaagggacuuuucauugguaaaucugcugagacugcugaacaaggcuagugaugccuugcuugugagcuuccuaaucuggcugcuguaugacauugcaauucugggcuucagggccccaaaccagcauauccaaagaaccugaagccaauuguucugucauucuuuaaagacccaacgcaugggauggcagaugccaggugcagaauauaaccuccuguccaucccuacagaacaucauauacuggagacaagagggcccagccuacccagaacaagacccuuucuccagaucacuaacuuucuugaggaucugaaguuaagccacaugccuagacucuuccugggccagcaaccauuuuacuuagaaugucaaggggaaauccccuuggaaauacuccaguacccauugccuaaggacuaugugcuuauucucuuuuugaccaaucauuauaauuccagagauuuaggaagcccauugcuguaucaaggacuauaaaauggugguggccaaggugucaaggaucccagaccugccuaggacucucugugccauugucccuggagagagaacccaguuacucucacuuccagugcaguggcuccugaucuuugaguuguuuggcuuguuuuuacaugugauuauuucacuuuuaaacauccaggaaagaggcaucugcagaaauaaggauuucuuuaauaauuucuuauguugggcacuuggaauguccugccacagguacaugcaccauggaacuggcaagugggcagacagaaaggacaggcuggcagugcagguuucccaggaucucaugagguagggcugcugcugcugcugcugcaauaucugcuggccggaggcuuugcuuccauuuuagacaucccaaacaaagucaucuugggggaccuagccccaaaccaaucuugguacuuagaucaggcugccugacauaacugagucucauuuucuguuucggauacucccagguucucaugcugcuucccagugccucccccauuagaugguaccuaaaguaagaaagccauugacacagagaggagagaggaagugagacgggucacagacaagugauggccuagucucccagcccccauccugccauagcacuguugcccuucacccugccuugggcucugacaugcucccuucccccccacccccggcagacucuggaugggcacaugguggugcguagccaugcccgugugucgucgcugacccugaagagcauccaguacacugaugccggagaguacaucugcaccgccagcaacaccaucggccaggacucccaguccauguaccuugaagugcaauguaaggaauaaauggggaaggaccugggggagggaggggcaaggcagggucaggaugagagaggaaaacaucagcaaggaccuaugugcacccuguguguucugcuuacguucccugcagcugacccugggcuauuucagagcucuguucccaagccacccccuacacaccaucuccaggcuucuuacaagccugcugugcccuugagucuucuucccaugcugugcacaggaauucuagaauggcccugaccucuacuauaccaggcgcuggcucugcuuuggagcacaccugccuucccagugccaggagacaggauaugggggcuucauaaucauggcagucauccugacagucauuguuauuuauugcagaugccccaaagcuacagggcccuguggcuguguacacuugggaggggaaccaggugaacaucaccugcgagguauuugccuaucccagugccacgaucucaugguuucgggauggccagcugcugccaagcuccaauuacagcaauaucaagaucuacaacacccccucugccagcuaucuggaggugagucaggaugggggugggacagagcagagaaagcacaguuugacucuaggugggcuccaaaaugcagcucaaguccucucuccugcuucucuggcacauccugagcagggaaggcaugggcuagagaagacacugagccucuuuucagcuccccuucgcccacucuaccaguccccucccugaaugugccucucccaugagccccucugcuauucuuuucucuuguuuaaggcugggcuggagcuaaugauuuauacuuuacuaguucuguuuuuuacuaacuuaauucaguaaauaaagaucugagucugugaccaucccauaggacacuuguaacccaauagcuucuuccuucuaaaggugaccccagacucugagaaugauuuugggaacuacaacuguacugcagugaaccgcauugggcaggaguccuuggaauucauccuuguucaagcaggugagugucccuuacucaccugagagcagcugccacaaccccccaccuaacccugccagcccaauuuguguacuugagugauuccaggauauugggaagaagaaagggccagggucagcaaagccagagaguugggaagcugggagccauuggaucagcgcauggggcauguugggggagaagcaucuggugagaugggccaggaggacaggauacagugacaggauucccaagagugagcagaaaugacagagaugugccuugugacugagaguuaauggucuugggccaaacugggcucaccugagucuccauaugugucuuccccacagacacccccucuucaccauccaucgaccagguggagccauacuccagcacagcccaggugcaguuugaugaaccagaggccacagguggggugcccauccucaaauacaaagcugaguggagagcaguuggugaagaaguauggcauuccaagugguaugaugccaaggaaggugaguugggcgaguugguguuuccauugggaucaugagugccucaguacucagauguccccaccugccauccugggcauguuccuacagaaucaggaacugcaccuccagaauuaggucaaagucauaucugccuguagaguuguugccccuauugccaccccaacccaugcucugugcuucagagccugguucucaugacccuuccaguauggaugaaggcaucuguaccacauuccaggcaggaaccuuguguagguucugagcgcagccagaugaguccagcccauagguucugagcauggccagaugagucuaauccauccuacucugcacguuugaguuaccugugcugcagguucucugccgacacccggccaguccugcuuggauaucuguacucagggacuggcugucuuguaauugugauaguaaccaaauaagcacagccagcaggacaagucugcccuuaaaucaguccugugcuagcuuuccaagcuaaagauuaaaagacugacccuuggauuacugcagugugaagauucugagcccagaucaucugaggauaaugugugcuuauguuggacuccccuuuuuggguuuaauuggaauaacucagugaaguauguuuuguuucuguacaaauuuuuaauccuggucucguaugugguaauucgaguggaauuggaaguaggcugggauaucaguaucacagccauucagagacauaguccagugcaguuucacucagaauuaguucugccagaaaguuuccaucacuucuucagcuucucgggggagccagggggccgagaggagcugcuggguaaucaggauuggagccagaagaaagcaaucacuuugccuuccuaacuucccucugaaaucucauaccaauuuuguggcagguugaucucaugucacuaucuguccacccgacuuuuuuuuuuuuuuaaagaucaauucuaguuauuuuuauuauaaaauauacauaacauacauuuuacguuccaucauuuuuaaguguaaaauucaguggcauuaaguuguaaccaucaccaccauccaucuccagaacuuuuuaucaucccaaacugaaacucuguacccauuaaacacuagcucuucauucacuaccuccucccagccccuggcaaccaccaugcuuucugucucuauguaguuggcuauucuaaguaccucacauaaguggacucauauggcauuuguccuuuuguggcuagcuuauuuuauuucacuuagcauaauaucuucaagguucauccauguuguagcaugugucagaauuuccuuccuguuuaagguggaauaacauuccauuguaugucuaugccacauuucauguauccauucaucagucaguggucauuuggguugccuuucggcuauugugaaugaugcugcugugaacauggguagcccagguaucuguaucuguuuggucugccaucuguaucugucauuugggucugccuuucggcuauugugaaugauacugcugugaacauggacagccagguaucuguaucuguuuggucccgacuuucaauucuaugcauaugcccagaaauagaauugcuggaccaaaugauaaaucuacaguuaauuuuuucaggacccucccuacuguuuuucagagcggcugcaccauuuuaacaauagacucuuuugucauccuucccauauuauaacagccagcauggagggcaucgucaccaucgugggccugaagcccgaaacaacguacgccguaaggcuggcggcgcucaauggcaaagggcugggugagaucagcgcggccuccgaguucaagacgcagccaguccguaaguaaagccagcugccccccuuuucccagcccaccuucuucucccugggggcaguggggaacccugagcuggcccaugucauuguucagaccacagcuuuuugucuuucagaucccucugcuccuggaggccccaccuccuaguucucugguucucagugacagcuaacacacagucccuucauucucucuuucuccaagggguuggggacacuguccuaguagccgguccagcuuguuagaauaacagugaaggggaaggcaccaacacauuauuaaaggaaguggggagaaaaccaggagugaguugucaaaggaucugggaaaguugcuuuucgacaggccacagaagcccuaagcacccugugacuugcaggaagaggguaaagauggugacaguucacauaaugcauugcgggaucuuugaugcagcagagauauuaagucagagacaaauggaaacugcuauagaauaugugagcagcagcagaaacccagcaaagccaaggggaagagguagcccuggccuuggccuuuucugcuccucucccucccauagcaagagcauuccucacggccucuuucaagagaauugcuucccccugauuccacucagggauguaucucuagguuuuccucggccauucccucuuucuuuuaacuacgccuaucccacuuugcccucccuucccaccagcagccaggcugugggcaagcccugcuccugucauaccccuuugcagacagagauacuacccugggaagcuccugaguccacccagcuaaagaagauaccguagaacuaaauuucugaguguucacagaguucccugggcucucugaccccuggauuuaaaaugcaccugggagaauccuuugcuuccuucuuuuugaagccaggggccugcaaagggacccacugcccuuaccucuucccagaaauaggaaagccugucucaucuuccuucuacaggaguggcuucuuucucuggauuugaaguaauuugauaauuugaguuuccagcuccaugugcucugcggauucuauucauuucuuuuacaucuuauuuuuuuuuucuugggucugucucuuguuuuuucuuuucgucuguguuccauccaugggaaaugcagauagcccuccuccacguaagugccucuucauaccucauuaccuguuuccauagcguuaacaucugcuaguucuaguucguaauuuaguucuggucccuuuuuuguccccuagaggcugaaguagaugauauugucugggcccuaaccacacugaccuuagucuaguugugcuguuguuaacgucuguagguuacuccaagaggcuaacacucuuccuguuuuagagcaugcaacuucugugucuuuggaaauugugcuuauuuauuaauuuuugugugugaugauuaccccacggcaaagaugguguuugcugagccaagcaugguggaagucugcagaugggcccugaauaacacgcuauagccccgccucaccuucagccaggaugccgggaaagugaccacagccccaccaggccacuauucaaaacaccuugaaaggaaaaagaaccugaaaggauuuucauauuugcuuuuaggagauaaaggaauugagcucaguugcuuccuugcuucuugucugucagcuugguagcuggaggggaauaggaggacuggccagggaggcuccugcagcagcugccauagucaaaacguagcaugaacuuugguuccgagccaugggcaugucccacagguagcuguugcagaguuaaaucucuaguuccggucagcucuguucuuuagcauguaguuacuugcagugugcaucuccucguuuggggaagacuaaccagcuaauguaggaacucuucugccaugcaugcuagggaaggggagauuccccacuggaaggacacccuucaucauguaagcuguacauagaggacacagggaacaaggguaacagagagaugaacugugguuugaccccauuagccugcagaaaugccccuaaacuucccuucuccugagauuugguucuuccuaggcugaaccagaauagcggagggagguguuacccaggcagacacagaaaaaaagguauucaggaagcuguacagucuuuucauaaaaaggcucccagcuccugaaagguacccaaggaagcuuaucuuuuuaacauuauucagaaauauugcagcaacagcaaaaacuaaguagcuacauguagguauucugagauuuugagcaagugccaaauguccuaccucagcagaguuggugccgggaugaaccagcucucgaaggcaucagaguugggggauggagccuucaggccggacugacagguaccugcucugggccugcagcuaugcccuaagcaaguucgagaggagccacucugggcaugagggaaccuuccuucuggaucuuccccugaucuuuaacuugugguucaacugagucuccagguuuccucuggucuggauuugaucaguaaaugaaugcuggcuuaguuacauuaaagagaggaaggcugggaugaggccccccucugaguuucuaaccaguaacuggaguuugaguacugaaucagaguaacugggucuuggacuucaaaggccgcagugguuuucauucauugccagcucaguucuugcaaaggugagaccauauauauagauauauagauauauauagauauauagauauagauauauagauauauauagauauauagauauagauauauagauauauauauagauauauagauagauagauagauauagauauauaucucagaagcuauauuuuuaaagucaauguuaaaaaugaaauuuuuaaugaaauuuuaauuuuaaauuaaaauuuagauuuuuaacuacaaaaaagaggucuccagaccuuguuguuuauugucugauaguaucaaaauggauaaguaaccacgacuccaagaagcccuuuggaaaaggauggugucaucucugcauuccaaguaggucaugaaugguacaacaacaggcauuguuagugguacagaaagucaguuuuucucaaucauuuaauaaaguuaaggucugaagaaucaaaaggcaaacuucuuuuagauaaguagaaccauggcauauucuuagaguugagcacgccuuuugcaagaauuuuagcaggaugaggcggugaacauaugggaacaucauauuaucaccaaagauaacuuauuauggucuuucuuugugcccugauaaccuucccagaguugcugaagugaggacuuagcccacggaguauccugcugccccuagacccauccugaaaacagauaucauugggaggaugcugccagcaguuacaacugcuaugacaaacccacccuuuugcugcuaggaacugaggacgagccuuaggaaggaccuucucugaauucuuacucucauuucuuggaagacacaaagauugucugaacuuagguagacagaaccaaccaccaguuuagcugugugcuugcacugagcccaagaaccaguggcauugguuucugaugccagcuuacggcaccacugacacugcaccccuguccuguaauacuguugggaugcagaugcacagcaggaucuccuaccacuggaguugugcucugguuauaccccaagccccaaggaagagaaggcacagagucagcagaggccagugugcugcacaggcagguguugcugccggacuccugggcugccaggugucaggugagaccagcgcauuuggcacugacucaucgcuugaaguucguugagaugucucaauaaugggguugcuuucuugguucuuuaauagaccuuuccauguuuagggacauggauauaucagagcagggaugagcagggggagcuaguaaaagccacaaacacuuaauggacucuuguuuucaagcugccaguuaguaagcauggcuuaccuguuuggagguuccuuuguguguaguucaugaaugugcaugaagguaaugaggaagcugugaccccagaccaacaaauaaaacucuaaccugugagaaugugccuauuucauguauuuuuuaagccaaaugucugcaugccaucaagacacucaggaggaaagcucaaaaccucuguuugccuugagacgggcugcuugugucagacuccuuacaacuagcuaggaaucuuccccuccaugacugagcuacccaccuucauaauuucauugcccaaacauuaccucuuaauuugcuucuguaccaugaagcaaaauagauuauuucuuuuugaauauagagauuaugaaugagucucuacuuuuuuuuuuuuuuuuuuuuuuuugagacggagucucgcucugucgcccaggcuggagugcaguggcgggaucucggcucacugcaagcuccgccucccggguucacgccauacuccugagucucuacuuuuuaaaagaggcaucuugagauuuuuguuuucauauguugucccccagguggcacauugcaaguauaacuaugcaaacaauucaagcuaaacaaagaaaagagagggaaggagaccugaauuaaccagaccauccaauaaugaugaguuaugauucuuuguugcuuugauuccagugacacuguacucaugguuuaaugagaugcccucauguggaagguaaaggaagacaaaaccaugaguauuagauauuaaggcaguggcggagauacacugagguuuuuccaaauuuucaucuagcucucgaaggagacuuuguuuugugacugcugaugggacuacuuccaaauauuugccaaugaaaaaccaaagauccauucagugucccaguaucucagaugcacaacuaaccauccucuacacagaagaauggcuagaauuucagucccagucucuucaucauuucuauucccuggaggagugagaauaauccugaacauuauuugcauggcucuuacguagcagccuccaaauaaccacauucuguaggggaguuuuggaaggcagcagugguugcagcaucaucuguaugauacaggaucaugaacuucauacacuaguacacauuagguaggagagccauuucugucucauucauucagauguugaaaugagugaggcauauagguuuugcuauaaauaaagucauauguggaaauauauaccuauauagaaacacauauauagauguguaacaugaaaagccaaugucuauuuucuccuucacugguucaccuuaaacugagguccagauuccuuuuccuccuauaccucucguccuauggagacagcugguccugcugaacuggauauuuguuuucagucaagguuugaggcuugugcagcuguuccuggcccagacuuuaccugaacugcaggguuuggcaggugcacagucucaagguuugacguuagagagagcccugcuccucgcuagugcccuggccagcuguucacacacgguguuguucuucccacuuuaacucacuucagcuccucauacugaugccccaggguuguugcuuccauuuuuuuuucauucaguaucugugugccucaaugaucuuuuuuccccaccuucauuuuucuuucuucagcggcaucugcuagcucgucuaccccuguuccauugucuccaccagauagugaguaucauuuucuucauccaucucucugcaggucacuuuccaccagccacaguuuguuuugccuaauguuaucuccuucaccaggugauaauucaacucaguugguggaaagcagcgucggguuuuagaggagcaguugagaagagaaacaggcauagggcuucucagauccaugaggggcagccuucccugaaggagaggcgagggaaaagcauuguucuggauagaaaacccugcaggcaggauccccaaggcugccgcccuggggccagcccuguccucaggauucugagugggcuggaucaaagcucguauuuggagaagccaaaggaauugaccaagaaaaaugucuccucugcagggucauagaaaauguguuggaguguuuuguuuuuacccuucauuuuaauuggcacaguuggauacagacauugaaauuagauagggaggccuguagcuuucgcuuuauccauaaaugcauacuuuucuuguaaauauuugugggaaaauaaacagugucuggcagugucuggcagaugugccuggcaguaggcgcuuaggcaaaucguuuaacccuucacaagugagccuuguuuaucuccucuguaaaauaggaugaguagucacccacgucccgccacccuaaagaaaaucacaaacauuuucauguuuaucaugcucugcuuuacccacaugggaucauuaccaccaagccagcaguaaugucagcuggucgcucucagauuucaucauccuggcuaagccuugcucauuucugaucuaauuaauguugcuauccuguccuuuugugugccugaaugugcaggaguagaaggggcuccaggccugccacuguuuggaguuuugaaccuagcuuuccagggaggaauagcaaaguaagaccacagcucaguaagacacaggauguaaugccagcaucugcccagaguggcagacagcagcaaaugggcaggcaggguggugccgccuggcuggcuuuauucuccuugauauaucagaagccccugugguuuggacucagacucaggaggugacucaagccucaagcucagaagcccucugucaccaucuguugacucagaagcaugcccaccaucccaugcagugcuuuuccaggcacuguccuguagcagacggaguucaggcuuuggaaguagacagaccuggguucaaaucacagcuccgcuucuuccgccugaagcuccauaaccuaggauaagucgcuaagccuccccaagucucagauuucuuaccucuaaggugaaggauggauuccacuuaccuuuucaguguuugugaaaauuaaagauuaaaugugaagaacacaaaacauacugcucagcauuuagcagcuggaauuaauaguaagaauaaaugagaguuauguuaucucuugcugcaugaaagucauuugucagcaaaaucucugaucaucucuuuuaaauauguauauuaagagucuuuuaaauauguauauuaaggcccagcaugguggcucaggccuguaaucccagcacuuugagagggccaggcggguggauugcuugaggccaggaguucaagaccggucugggcaaccuugucucuacuaaaaauacaaaaauuagccaggcgugguggcaugugccuguaaucccaguuacuugggaggcugaggcaggagaauuguuugaacccaggagauggagguuguaaugagacaagaucgcaccauugcacucuagccugagugacagagcaagacuccaucucaaaauaauaaauaauauguauauuaauauugauagagaagagagagaauaccuccuucaccaucuuuauaaugaugccuacauauguauaauauauacucacccauguauguauacauauauagcuaugaguuuaauuuaucuccauucucuccuucaccuuucuuugccuuuucugucugucguguuuccauagcaacuuggccucuuccugcccuugcaaccacagaaccagcuagugaguacagggcugaguugcucucggccagaccucugaucgcuuguuguagagccgacuucuagauuacagcgcugccuguuguuuucccuuuuauuaaaagcaacaguugugaaugcaugaaggcuccuagccuggugugguuuccuaagcaugccgucugcuuggccaagagagcaaaccaagcaucagcaaaagaacgggguugauuauuggaagaauacuccgugcaugaggaggcuuuuccaaaucgacucucuaguuaaaaauagccaaggauuaggcaaacccugaggacacaaaagaacagcaucuccuucccggcuuucgcuuugcugucccuccuucugaaauacacacgcucaugcgcguguuaauuuagcaguagcaaaaagacugagagcgagggaaggaauaggagaaaauggcugcuugaggaaagggagagggugaugccgagaaggaaggagccgcugcuuccugacagcaugcccggcuuugucuccgcguacgcagagcacaggggaaggagagagcuccuuccugcugucuccuuucaggcucccgccucagugcuagaaaaaugaugggcagaaaaagccuaauccaggcuccccuuggguugagaguccagaugaaagugcuggaauuuaucucuugacaauagagucaagagccagauuguauccucuuuuuucaucguagaaaacauugcacagaaucacugcuguaacauguuccaagcuggucuucauaaugcucuaaugaaguaagauguguguggaggaccugaaucuccugaagaauccauaugaguaugcgugcauguucauaguguucaagcaucaaagcugugugggaguuuuagauuuuauaauauuucugcuugcacagaaaaaaaauggcauacaucccaucaagcagaacaagaaggcagaaagcagguaugcaaaguauaacuccagcuccccgggccaagcuuuccaauacauaauugaacagagaagaaaagaguuuccugguucuguguguugcaugaaaugguucuuuuuuuucuacugcagaacacagcuaagggucugcuuucuugguguucccuccgugugugugcugcgaugaauuuuaauuccugaugcuuuugagguuucauuuugucagcagagcagagccggugacaacaggcugugcucgcauggguuuaauucagauuaugagggguuuuuuuuuacauuuggaaaaggaaugcagcugacagccccuuuucuuauucuacagugucacuccuguccuuuuucaaccuggugcaauguguguccaggcacaguaggagaaagcuacauaauguauuuguacaacugugucauauuucagguggcucacuguagguuggucuucucuguuagugaaacacaaucuugguuccagauuuugccugaagaaggaauuaggugucucuccccugacaugucuuuaauuuuuaaacaucagacauuucugcccacagacaaaaugcuuaguugugacauccaaagggaagaaaguuugagucauuuuauuuugaaccacuugacuacugacccaaauuguaggucccaguggauacugagauaaaggaaagaugcucacaauugggcagcagccugaguuuagcaugaacauauuucucacuaguaagaugaaauguggcacaugugaauugcaguggaacuaauagcagaguagcuaucagcaugugaauauccaucgaucaucaauccaucagugggguugaaaauacauaucucccaguuuugcuucugugugugugcguguguguguguguguguguguguguguguguggacccauuuauaauuaugagggaauaaagguauucuaaauaaaaccaaaggagcaauugcuuaguuguauauaaucccugcaaggccccuuugguaggaaggugccugaaucuguguaaugccagacaauaagaaagaagcacacauucugucagcucacgguggcaagggaagagguagccugguuaaagcauuucucucagguuauuuuuaaccagcgguguucuuuacacagaaaggugucuucaucucccuucuuugcccuucucccucagccucaauuggcaauggccaaaacuuucccuggccucuuaaauuuaaggucagaaacccaaaauaccuuuuaacaagucgagaucacucagucacaacauaggaccaaaaggaaugcuuaagaaaaguguuuuuuuuuuuucauuguaaaucucaaauuuaugacuuaucagugcaaccacgauucuaaagauauaacuuuaaccacaacagguugggugccguggcucaagccuauaaucccagcacuuugggaggcugagguggaaggaucacuugagcccagcggggccaacagggcgaaacccccaucucuacaaaaaauagaaaaauuagcuggguauaguagcagacgccugcagucccagccauucaggaggcugaggcagaaagauugcuugagcccgggaggucaaggcuggagugagcuaucuucaugccacugcacugcagccugggugaugaaacgagaccguuucaaaacaaaaaacuuuaaccacaaauggcccaaacauuugcuuaaugucaaacucucagcacguugggccaaagguacaguuucugcuguuuagugucaacacagccauugucucaaccaucagaaggaaacccauucccuagucugcacuggccucuuccuuuauaugggucuugacuucagggaggcucaccgaggucucaggaauaacauggguuuguggagaaagaagugagauaagauccucaaagccaccaucucuggcaugcauccacccagccucauucagcccauacuccccuccuccuuaugccauaggaaacaugaaaugacucuucuuaauuuaauacaaucuuuuguucuucuagggcacacagucuucaccuuaagacucucgggacuuuuccuugaugacccauauucuguuucauugcccuuguuucccaaggaugcugagacauuucuggaaucuguggauaauaacuugcuuuuuucuuuuccuuuaacagucuccuggauugacuuugacaucuggguccugacagcaacaccuccccauuucaaaacaaguuuacaugcuccugaugugguauuaauauguaguguugcagccguagcuaaugcuuauugguguuguuaaccaaaugcucuuuaugauuuauuauucuucuauuucugggcaguuucacugcccucccaauguuuccuauauaugcugcuaauuuaauuugauuucuccuuuuauuuagucugugauuuuguuguugauuuuucucccugcccauuguuuacaucaguuuuuaauuuuuuuguauuuuccaugugaccuccuccacuuuccuuucaaccaauaucaugugcgugcguaucaugugacuuugucauguggcuugcauggugcugaugaugucguccacgcuggugaacagaagguaaaacucuuuguucugauuagugaaauaaaucugggaccacagccuggcacauagggcacacucauuucuuccugucucagauuuccuaagcaaagccauuugagagauuuccucuuguucucaauucacauccagaauucaucauuccuugcaaacuugacaugacgauuugguaucaugacaaccuuugguuugguauuuugcuucaagaaauuuggucacacaaacuguucucuacagucaacccacauuagccacagcacaguuugcaaacuugaauuuuuaccagaugguucauaaaaauuauuuccuagaaagguguuuggcaaauuagcuugauagcauuguuauuuaacuucauccaguaguucuaaacaccauaguuguucuaaaaugagucacauuccugugaaaauguuuacaaccuugaaaugcuacagagugaaauauaucaauugcaaagguuguauuuguucaaaacccagugagagugcuucauaaaauucaugcacauugaggacuuucugaaauaagagauuuaagaauuuggauuagagcaguuuggcugugauuacugaggugucacuuuuuaagaguggcccucccccagggagggggagaaaaucaaagcaaaagucacuuggcaauuaccaugaauggagaucuccguguaaucaagaaacacaugauugacccuugcagcaaaggaaauaaaauuauagccuaauuaagugcauagcggugacaaaauaauuaguuaauauugugacugucacaaccuuguuaaaacauuucucgcuuaccagaaggagagaaggaagccucugcucacagcuucccucacucaaaucaaacaccuauucagaaccugcccuuugagucauaugcauucaguuuucuccuaacuggaauguuuugcuuccaaucacagccugagacauuggcuacauggaucacgaaagcaaaacuaacuccaauaacccccuggugugcccgugcaugcaaggggucccuguuugaccucacuucucugagaacugauugggcgacauccacacagacaaaccgucaacagcuggucucgcauguccuuuguucccggucugcucuuguguuucguucuccuccuguguguuagcccuguguaccuucccucucguucacccuccacauuucccaucucugagccccucagcuuuauagggaugucagcuuggccccaauguagucccauuuacagccagacuccuggacuugccuaugagccaucuucauuuccaaaaaggcgauauuggguauguacauugcaugaaauaaagugggaaugucccagaagcagaaggacaucugaugcaguccacgccaauaaauugggcuuaccuuuaaaaaucaucugaauaugcaggucuuagggcagagaauauagacagcuuaagauuuucuaaacuacaagucccacccaaaauacgguauuuucaugauuucccaaagguugaccaucagcaagacuggauauuuuucagacuuaagaugacuguucaguagcugauguucuggaaaaagaucugggccuucaccaugaaaucuuaaaugugagcaguuacuggauguugaauuugaaaccuauucauuucuuuuuuuaaaacaagcuuggucauuucugugcaaugcuauaauucggaacgaaacaaagcacaauguuaauaagguagacacuaauucauuccucugaagagagaucucuuccagacauuuuaagccagggcaagaaauguuuaaagauguuuucugcaguugccguagaaacacuccuuagcagucaucuuggcuguugguaaaaaauguggccgguaccaaaaaaaaaaaaaaaaaaucgcugacagccuuagagaauuacaaagcuaugauuacgcccuccuggaaccauguccucauccaugacagacccucuccugccaucugcaagggggcaagcugaagacuuauucaggugagccccgcacgcagcaggaauuguccuuuaacaauaaaauuuaagagaaugaagaggucagggccaauaaaauccauggaggagagcaacaaagcuuaguuaaggacaguuaucaccuccucucccuggguauuagcaaagauuuaagcugaauugggccucaaugagaaaagugagaguaagcuggggggugaggggggagcuuucugcugucaguggguuguacacccaacaacuggugacaucugauguucccuguccaccuuguacccccucaaaaaaagaaaacugccugggauaugcauaaccuaagcuggaugcuccaucuacccugaguucagugggacagcguuuacagaauccagcagcacugcgugaaguguggcgacucagaaggagaagggagguuauaacagggauugagcccuauccuuuaugguuacuuggcuccugagccuacagggcuuggccuguagaggauugugacagauaagcuuagacaccugucccagaaaagaagaagugaggaugcaaacuuugauucuaaggucauggcaucaugucacugcagggcuuccuccaaugacuccacggagccguggcuuuguccaccagcuacugaggacucuguguaaaugggacuccccaccagcagcaugugugagaugagaagcccccugcaccccucuguccaugugcugcaugucugagcauggcgcccuccccagccauucauaaugauauuuuuuuucuuuagcuacugacacugacucguacuaggaaacgcugauucugaugagcuaagcucuuuaacacccacucuuccuucuuagauugaaaacaucacuaaccaccccuuccacucccuccuuuauuuuuucacagcugugugucuggauugccacgaucucuggcaggucgacacagacuuuucaccaggguuucugcucuaauugccuuuaucucuaaggauucccugcacuggagguuccuaggguagagagucagugggaaggggcugaagaaaaaggcagugaggugugucagcccgaauccugugggcagggacugugggcagggacugugggcugcugcuggccuuggaaacugccaguucccuuagggucaccaguaugggggcugaaacuccccaggagccacauucuucuucauaaccaaucuaauguccaugaaauagaguugaagaugggcacgagcccccuuguggccuuggaggcaggagccgaguuaacuguugaugauagcaguuauuucugucauaacuuccucagccuggaucagccccauaaccacaagccauaccuuccuggucauauuuucuuuuuaggaugaugaaacaaagauaauugaucaauuaaucuguugguguuuucaugacaccugcgagaagggaacugguauuuuugugguucagucugucagagcucguugguugcuguuuaauuuguaccuugugcugccauuugccaccguaccccaacacauacucucacauucauaaauuccucaggaaacuggugcuggaaaggauuuacagaccagaugccuuagugaguguggcugcggggagcucagcauccuugcucugcaagcugggaaccggccgugcccacacucacucauuguguaucccgaggcucccuggagcuaggaacuaggauggcaaagauucuggucacucaggcacaagcaaggccuuaaagcugaagagaaaaggguucagggaaaaacaaacaaaacuuuaccccaaaagcuugauccagcaggaacaaugccuaagacaaauuaauacccacucuuacacugcccggcuguucuucgggacuguccgaaagucacucggcaucccuagaauagccagguagguuaccaaaagaggcgccagggagagacaugaggauccaagaauguaugcaacauagaucacauccgauucuuuuguuugucgucgagggcuaagcgcuuuguuucaggaaagagaaucaguggucuaauaacgcuaaauccugauucccucagauaauuugcugauccccuaaggaccagccacauuucuaaccucuggauguaauuguaauguuucugacuuggaaaaaguaaauaggcuucauauuugaauagcuaaaucauacauuuuggacuuuucaaaaacuaaguguaaaaagguauauauaacacaaguuucaaauugcuuggaagaaauaaucaaccaaaggagacaggaguuaugauaaacaaaaugaacaguauuuuuaaaacuagacagucuuauuugauaggaaaaguaaaagauuguaaugcaagccccacauuuaucacagguuuacgcucagacaccugaaacuuugugcagaucucuaugagggagaaaacaaaguagaugaauagagaacacagauggagggcuuuuuguuuuguuuuguuucuuuugaggcugagucucgcugucacccaggcuggagugcaguggugcgaucucugcucacugcaaccuccaccucccaugcucaagcaauucuccugccucagccuccugcguagcugggauuacagacgcaugccaccaugcccagauaauuuuuuuuauuuuuuuaguagagaugggguuucaccauguaggccaggcuggucuugaacuccugaccucaggugauccacccaccucagccucccaaagugcugggauuacaggcgugagccauugugcccagccccagauagaggcuuucuugaggaugccuguuuggcaccccagccuuucauucagaagacacagcuaacucuuggugcucgggcuccuuugagugagaaauagaauauuguuuuccugcuaaaauucaccaaugcuguccaaguacccuggauuugcuauaauuuuuguuguggaauucagauauccaguggaguuuucuaacuccuggggcuucugcugaugagaggaagggcaugaagcugauucagauuuaaggguacaguagcagaguaauuacaaacagagaaccugcaaucggcauggccagaaauauacauuucaauuaugguuucuaagggagaauuucauaggaccugccuaugauauaucugacuauauguggccucuaugguacguucuuucuuucuuggguucaugauucacauccugcuagaaaauaccagaacugcacaauacuuuauauuuguuauuggcaaaguuucuuuuuaauguuccguugguguagucuuuacauaauacauuuuggggggaacauuugacucauggcuaaagcgaaacuccaaggguauaauuaaccccaggggucuucugggagcaaccugccgauugcugcugaaucgcaaaccaacauuuacaaauaauuacaauaaugguuuuacugaacuuacucauaaugauuucaaucagggcagccaucucagaacacagugcacaucaggacucucucaggcauuucuucugcuaaugugcucgauaaagcagucagccuccugaauggcaaggucccuuuucucccaccacagccccucccucaucaggcuuuguguagaaagccuaagaaaguuucucuaaccccauuucuaaucuuuaagagaauuugcugacagugaacacuggaagauaagacacuugaugaaacaauugcucuuuccauauuuucauguacucacagcaaguuacagagccaccaagucggucaaaaucucugugauauuaguugaauaugagcuuccuguagaaauacugucauaggcugggugcaggggcucacaccuguaaucccaguacuuugggaggccaaggugagaggauagcuugagccuagaaguucaagaccagccucaguaacacagugagaccccaucucuacaaaaaauuagccgagugugguggcaugugccugugguccuagcuacuccggaggcuguggugagugaaucgcuugagucauggagauuaagacugcagugagcuaugauugugccacugcacuucagcuugggugacagagcaagacccugucucaaaaaaaaaaaaaaaaaaagucauaggaagcauuauguauccguccaagaaccucaucaucuuuuaaaagaauuaaucauaacuuaguuuuuucauuuggcaaacaaaauggugucuuauuuaccuuugagacuucagugccuaauagacuaccugggaccuaguagauacucaguacacaucuguugaauaaaucguagguaaagcacucuaaauaauaaaccuaaauauuauuucauuuuauuuuugagacaaggucucacucugucacccaggcuggagugcaguggcaugaucuuggcucacugcaaccucugccuccgggguucaagugguucucgugccucagccucuucaguagcugggauuacaggcacaugccacuaugcccagcuuuuuuuuuuuuuuuuuuuuuuuuuuuuuuugguagagacagaguuucacuauguuggccaggcuggucacaaaauccuaaccacaagugauccaccugccucagccucccgaaguccuaggguuacaggugugagccacugugaccagccaauauuauuauuuaauauaaaaugcucuaaauucuaagagaaaauaauacacacauaucagaguacugugauagacucagauaaaaugauacaaauuauaguguucuaacuaugucaaauguguucuaacuaugguauagauuuugauggcuuuucuccgauucaaauuacauuuuuucugaaacaaaucuaaagauaagagaguacuuucaucagggaaguugguuucugcaggauucccuagagagauuuuuauucuuaggucuuugaagagacuugggggucucuuuucaaagacaaaacuuuugagauaacuuuuucaacauuuuaaagcaaaaaguugacaacuuucugccuuagagaugugaaauuguugaccuuggagugcaucucccuaaaauuggcugaaagucgugaauuuuguguucuguuucccacaaugucaugagaaacagcccagguguaguugguaguccgugcuagugcaguggcugucacuguuucacaugacaacagagcuggaaggagcccuaaauagcauccaauucagggcccauauuuuguaaauguggaaugaaacuugaucgaggcaacagaccccccaugaugcggaguucagagacaguguuuugcaggauugauucagccuugaaaacucacacagcucaauuucaagaggaacuaauuaggaacgugcagccagggaggccccaguggacugaucccuaaaagggggccuugggagaaggacacaguccucgacuagugggcauguuggaagggccacugaugcugccuauaaaaauccccuccaggcuagggcagguagaccauucagcacagagucagugucaugauucuaagugaacaaaguuaaaauaauuuguucauuugcaguaggucuagggucaucaaccauuccaguuugccugggacugaaggguuucccaggauguugaacuugcagugcuaaaaccuggaaucuuccagacuaaccgggaugaguuggucaccccaauuuaaucagagaauacaauuuguaaaguucuccugugucuccuucuauuuguucagcauuucugaaucuacacagagcuccugccuugaucuaaaaucuaugccacuuugagucacuuuuuagcacuggauaucuauaaugacauagccauaacugauguauuaucuaggacuugggacaguccgaaggaauuuggaaagccuaaauaccuugacgugucuaaaccaaauuucuaccuauuuuccacugaauaguuguggccuggggcuagauaguggcuuuaaaacaggacaggucuuugccugaaguccauucaucuuuuuauuccuguuuuuauuuguccuuaauuauugaucuaagaaaacaaauaauaagcacaacuuuuccuaaauauccuccagacauugugcauccuccuuguugcagcuuuuaaucuaugccuguuacugcuacuucucuaaccuaaaugugcacagagaucacuggaaggaucuuguuacaggucuaaaaagcgcccaggugaucagcaugcugcuggcccuaugaugauaaguagugggcucuuccuuagccuucucucugguuccuccucguaucaaaggaaggugguucccagaguagcugaaugagaagugaggcgugacucucgcugugccugcagccgucucauaaauggccaaugguguaguuuuaggugcuuagauccaaucccuggugacaagccauuuuguggcucuucugucacacgucugugauucuguuuuccagagagcaagccagagugacccacccagaagguaacuguuuuguagccucuccaaguuuucucucugagguuaugaaauagaugcagagauagcuccucacagaagugcaggauuccccaguguguuaaaucuuaauuuuaacuuuguauaugagacguccucucaccuuauuacuuucagcauauauuaaugcaauuguuucuuuuaaaguaaaugagugccuuacucacuggagaaccauccuagcccuagcaguuugucacaugcaaguucaucuuccuucucgaccuuggauucacagugcuacaagcugaguguauacugcaaaucaagaaacaacuguuuuucuguugagaaaugcuaaagacauuuuucucucucuccucucacaaagaaaaagacugcacugauuguuacuuuaacacauuaaagucuugagaauuagcacucacucauuugaaccauuaguggauacuuacaggaaacuugcauaagagccauaaggauacuuacaaaaaacuugccuggggcaaguugugauuuauuuaaucacaaccggaaacuucuuauuuuuuaaacgaaucuaaguaauaaaaugucguucaugaaaagccagucccaagaaugcagcauuauuuacucccacuagagaucaggccucccagucccaggggugagugaugugucccggcaagaaacugggcuguuuuacaaaauaauuuuauaggugggaguuuccuacucaaacacuucuauuuucuccuauuucaggcuguuccucaagaugugucaggcuuauaaaaauuaaaucuucaguuguaagaccagcuaaaaggaaacauaaguaccagugagacaggggaaaaaaaaaaaaaaaaaaaagccuauuccuaaaauggugaaaggacccugcucacaggaaggcuauuuaccagaacauucccaagaggcacucucaguuugggcucagucugaggcaucuaccuggaauucaguuuuauauuuauugcuuuuuaaccauuugaauuucugagaaagcaagaaaaguguccagccccacccugucacuccaucccauucagauggguuggauuuucauucuguggaugagaauuucaugugaauuaacuggcuguuucaggggaacccagugcaccuaagcucgaagggcagaugggagaggauggaaacucuauuaaagugaaccugaucaagcaggaugacggcggcucccccaucagacacuaucuggucagguaccgagcggugaguggccuccuucucagacuucaccagaacccugcaacccuggcacccagcuugcuagggaaacaacaggggcagcccacggggcaggggugggauggggucuuauucugugucuggcagguggcccaugggcccuggccauggcuuaaaaucccaagacagcccuacagcuauuaggucauguucacacuggguccauuuggaaaccucauagaugacugugguggugacaaacccauaccaugguugauuuuucugugucuugaacuuuucuacaaaguuauuuugccauuaucuaguacuucuuguaaaugccauacuaauauauaagaaucccuaccuuggauaacauguguauuguaggccaggcaccugcaccucacugugaucacaugcauuuucucugcacaagaacccuguacaguaggucuuaccauuauccccucuuuacagaugaaguaaguggguguacagcagucaauaacugcuggaucucacgcagcugggugaggcaguuugaauccaagccugacugagaggcugggcucuccccacugcccaaggcugccuaagguccucaaacaaugccaguucccucaccagcccuucacuuggccaccugagcuguccuaauccugcuaacagcaaguuggcucuaagccaccuucuccugguuugcucaccacccacuuaagauuccccucauuccaccuuuuaucacaacccccacacugaaaaucacccuuuccauuuugguuuuagaaugacacuuggucaucuucaacuauaaccaauggcugagagauuuagaggccacaucugagcacugagaauaaccucuugcugggguuucguaguagagaaaagaaugaaccagggagcaguuuccuuucuucacauagccccaaggaagacuuuuucugggaagcugaguuacuuccucucugccuugugaucagcuccuguggaagugauaggucuuuaacuagcuagucuucuggcaagucaguucagcacagagccccgcaggcauacuucucagcugcagaggccuuguucccacuuaauuuguaagcagaugugagcugaaauaguaggaaaggccugucacugcccugaggcccaguccagagaucccagugaaugagagguccccauggcuuccucacugccaaguagggugcaaggauugggcagguggcccccaauauaccccuggaagcagagaugugguaggcugggaugccuuuccaaugguuauccugauguggccccauggacagaacauagguuuuagagccagacagacauggcauccaauucuagcuuuacuacuuauucuggaagaauaggucaccuaaucuuucagaacuucaauuucuccaucuguaaaauggggauaaaauagcuuauugaguuguuauaaagaugcauuauaauauaugcaaagaaccugaaaugcaccugacacuuggaaaccuuuauaaauggucacuaugguuacugcuaagaggcaggcucaggcuggaaccaucucccguaugacaucuccaaccaugucggaugucaguuugucugaggagccacuguggcugcagcaggcagcucugcauuagaaagacacagcugggcacaacgcugaaauauguuagauuucaacaaccguaaccacccucucucacuucaaaaccucauucauguuugcuaaauauuauaauuuuauauuaugaauaaguauaauauaacauuuucucuagauucugguugucucuuguauaaugauguuugccaaggaagacagagaaaugaagaggaaagauaccggaauugcuuucuuuuaaaugaaaguggggccacauagugauauauacacauccuagcuuacagcauagccagacugguuagacucuaaggaaacuagaauuccccuuccagcaccacuggcauuugcccaugcagcaugagcacugucacauuccuaaaggcaucucuuuggcuagugcaaacccuuuugccugggaggacugcuuugcuguaagauaacuccucauccagccuuagccaugggccuacaacaguuacuagaccacuguccaggugacagugcuauuguguucugcccuuccaaggagcagccugucaugcaauaaacaucuaucaagacuucuugugugcccagcagauaucccagggcaccugccuugugaaaaggccaaagauugcaaagagaugggcugugcaauggugaaaccaucugaagacuucucaggccuucuuccacaaacuguuuggugagggaggugguuaccuaauuauuguucuuugugggcccuuugagcagcccacuguuggacuugacagcagaacuuagucccgagguaccuccaucuauuugcugccguuguagagaccaggucacacugcauggaauagaaaaaccuuauucaguccaacagauguuugcugagcucccuacuauagaagggaaagaucaugagaggaggagaagacaaagagagauugauugauggaaacaaauacaguuugauaggagaaauacggccaaguguuugauagaucaguagggugacuguaguucacaauuaccuauuguauauuucaaacuagcuagaagaaaauaacucaaauguuucuagcccagagaaaaauauuuaaggugauggauauuucaauuauacugacuugaucuuuacaaauuaagugaauguauuaaauuaucacauguacccugaaaaucuguauagcuauuuuguaucaauuaaaacuguuauuuucaagaacacaauuaagaaaaacaaaaaaaaggaaagaucauaguuuugggcccaaacgaacuuagcuccagccuugacugcaggugugauuuuacguuagucaccuuacuucucucucacuuccccaucacuggguuuaguaagagccugacaaaaccccacaggcauguuguaggaauacaacaagaaaauguguguaaagcuuuuguagugccuagcucuuaguaagggcucaacaaaaauaguuuucauuuuuuuuuuuuuuuuuuugagacggagucucgcucugucgcccaggcuggagugcaguggcgggaucucggcucgcugcaagcucugccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccauaguuuucauuuuuaacgaaacuggaaucuacacaguauucacacaucaggaaggugagucagccacuuuaacuuaagcagcauccugaaauaugacaagaaauguacuuguuuuauuacucuucuaggacauccuuaugcauauguccccagcaccagaguguagccugggagacaggaguggugcuugagucucugcaugcccugaaggugaugggaccuugacgguguuggcccaaugccacacuggcaucugcuguugcuuguguuugccagcaugcaaaguugaccuccugaccugugcaauuuuucaggcugguaaagaauaaagaccaugucccaucauugcuuuuuuuuuuuuuuuuuuuuggagacagagucuugcucugucacccaggcuggagugcaguggcauuaucucggcucacugcaaccuccaccuccuggguucaagccauucucuugccucagccuccagaguagcugggacuacagguguguggcaccacgcccagcuaauuuuuguauuuuuaguacagacggguuuucacuaugguggccaggcuggucuugaacuccugaccucaagugauccacccgccucggccucccaagguggcuaggauuauaggcaugagccaccgcgcccacccccaucauugcuucuuauuuucaugauuucaugccaaaaguuauugagucccguaaguuuugccuauugucuggucuuaccaguacuuuuaucuaaagcuuuuuuggucucuuguauccuucuugccgguuucucccagaagcucuccuccgaguggaaaccagagaucaggcucccgucuggcagugaccacgucaugcugaagucccuggacuggaaugcugaguaugaggucuacgugguggcugagaaccagcaaggaaaauccaaggcggcucauuuuguguucaggaccucggcccagcccacagccaucccagguauggcugccucugcuuucuguuuguuuccgcuuugaauuaaugcacaagugcugcaccuccuaaugcgccugaacaacccugacaacuugcuugcuuacagccauccucaugauugguugcccaugcaaagcuuaguuuugccuuguaccuaucugugcaguggggugagauguacuggacccccaggaaggcuuggccaagcauccuggagaaaagguccugucccauuuggccuugaaggacugaugccaaucaguccauuggaccccucagaugggaaaugccccagcuccagccuagccuuggaaguugguugaguaaggauccuuuuuugagaccuuaucugccaucugccacaucauacuuggaccacauaacuguuucuaagcacuuccuaucugaugcuugcuuuaugagcacagccaugguccaaaucucuucucuguggugacccuaagagaaggaagagaugaugcccauuuacuuacaaacccuaucuaccaaaggccucucaauggaaacagauuaaauugaaccacuuguaauagaacaaguggagaaaauagaugcuggaaagcaccaucaaugaaagcaauccggucugcuagagacugugauggcagcaguucuccuaggagauacagaucugucuccagggauccaagaccuaaccuugcuggucuccuuuuuggccaaaucccucagagaagaaggagcucuucaacugaucacucugcuuuuccagaccagccaaaugccaaccccaggcaggagaggugggcauagaacauacagcugcagccuguuggggggccccauagacccugccauguucaaguguggugggaagacggccuugggcagccccccucaugccugcccugucuucagugcuugcccggcucuuggcucgguggucaugauuccuccucccaggaggagacaggccagagggcuguggccugccuaugaugcagggauguaugugcaaaaaugggcuaggagagcagcaacaaaacgggaucagugugugguucccagugguuguuuguacauggaugugugugucugggagacgugugcuggaccuccagugaguuggcaggugaguuuuacacuguaggucagaagcaucaauugguccacccugcauugacaggaaggcuccccagugcuugcugggguggguguuucuccacagucgcuggucagauggucggugcagaaggcaaggcacgugggcaaggcugcaggaaauguccucauuauaccuuaacaggauguucaaauggagguucuccuugcuuuuccucugccccuucuuucucuccauucuuugguccauuccuuuacaaucgacagcuuggagugaauguccagaucugucuggccuucaugggacacuuaggaggugagaucaggugaggcuugaguaagcccuuugcagcaagacagauuccuuauggcaauugcucccuggggugagacucacuggguaggcuguuuggaccugcuguguucacaugcuggguacuccuagcagcacuggcuucugugguuuuugugucagagaccgaaauucuggguagaccuuguccuccagaguugugccugcuggagauaucagaauccuucuugugaaucgcccaggugcccacuuaagccagagagggcugggggauugcucaccucaccggugacggcucuguggcucuccugcacagaucugagaaggugguggcuguguucucgguuagacuuuccuggccauugaauugggauccgagaauaaaaccucucugaauuacaaguuggacauuugugguugaauucuguggucagcaagcaggguagaaggugaagcgggguacagaaugagacuuccuuuaacagcacuguggugugggacuugugccauaggaagaaaagccugcuucaucucugacaaggccauccccaaucccuaagcacagugugcugacucauagugcagcgauccaaugcaucuccaccacuauggguaaaacacgcuagacacuagaagacaauacacuugcuggcuguaucuaagaggcuucaccuuagugaaagguaacacucuccuaaucaaacucuuguauuuuagcguggaggcuucuguucucucacuuuaauuucauuugcucgcugaucccuagcccccaaauuaacccugcugugcugcuucuggcauugcugagcuucugaacuggccuuaugguauugauacugcacugaacccucucuaaccuuugucaauuuaauuuacuaaguugaauuaaccuuugauucuguguuuucuauaguugaccuaauuuuuuuucuuuuuaucuauuuuuuucucuguuucugucucuaccuucccuuuccuucugucccccuccccuuccugugucugucgucacacuugucaccuuggacgucacugggacauccccacugccacauuuguuuuuaaacaaccacauuaucucuggggacccauugcuugacaccugcagcaaccuugggaggcaauucugcauccuacaccuuugucucauugcuuuucucugcagugacucuucuuuugcucuguuaggaacuugaacacaaaaauuaaauuugcuuaaaagcccaguuccuaugaaaaagaucagugcccccuuuggaagaaccuggcaggaccaccauggccacagcugcugagcaaccauucuguguggaagagaagguuuugugauuggaaaaagcuuuaccuccagacaugucaccacucacagauacuuuugugccacuucauaaggaguuugcccccuuuuuaauggcaguaaaaagaauuugagagcucuuucuuuaaaugcuauuuuuaaaaaccaucaugcuagauuuacagagaaguuucugcauaucugcuacuuguugcauuuuggguucaaaccuaaauaugauguagcagaggaagaauucuaaguaccuucuaaagcuugugucagauuguuaaaaucaccacacauuccccucauucuaacucugugcuccuuguccucccuucaauaauaauuggcuuugcuugcaauuaagcauuuaagugcccauguuaaaagagccagaccgcacugauucacaugagcguuuugcugacaugaugggcaacugaagucaccccuguugcccaugcacuggaaaaaaaguugaauuuguuggauauuuucuggggcugaugaacguucugggaugugcuuucaguccucguauuacggccagcaccuuacacugucucugugaacggggccaagccaugaugugccaacaagugucagcuuugaaagguguuugucucccaaucggggugacuccccugcugccuggcagcaugucgcagaucagcacagaguggggccgugguucagcagugacccacagaauggcuuugagcaucagucuacaggacagguuggaagcauccacugugaaccaggcauuaguccccuaccuggccugugugugcucaguagagaaggagagggacaggccacucccagacugcccagcccaggaggguuaauaaauuggggccgagccaaccugucagugcuuccugaaugccccagccucuguauuggugcguugguucagugacauuuucuaaacucuccugaaaauccagcugcuccucccugcugcuugggaguucacccaggagaggaaauggguguguuuuguuaaggucccuuguggagacucagggcugaauccugcuugguaauaucagugugugugcuuggggauggaccuucuacugaauaaaaacucccucccuccccccauuguggucacauaucauucuacauaucucaucucugagcaucuccauggaagcuugauuuuuguucuuuuugguuucuuuauguauuuuuuucuguuguuauuauuuuuuaauguucaaagacuagccuuucccuuugggauuccaaaugaucccaugcuguggucugaggggcaaagccaccuauguuggcgcucgccauuaauccccagcgcucaguuuagaggcucacgugcagacaucagaggcuccaugcugcacaguagcucaggcaggguagugccucucaacccagccacaaaacucuccccgcuggagucccagauggcgcuucacaccagggcaguggaggcaggcaugguuuuugggcacagggcagagcauaaggaucccaggucagugugggagagcuacuggcucuuaggaucaccuugggcagaagucacacggcuucauccuaggagggcccagcuugggagucugccucccccugaucccaggaccacccacaggagaggggcaguguccaucuuucugaagggacccuuuggagaucucguccuaaguguggagaggacugacguggcccugucaucucaacacaucccagggucaggcaggccucagcugaaacaaugucaggguccucaagggucccauuuagacagacccacggcuuguaacagugcgcuccucaggaggcagcacuagcgcauacccacuccccacggacacugaguuccuggugacagcugcagccccagccccgccaggaguccuggagacagcagcccucagagacccugcaggagugagugcaccccaccuugcucagccacaccccacuccccugugcccuguaguugugcugcccaugcuccacacaccauggggccccuuugcucauuuuuggacuauuuauacagcagguuuggaucauguuuuucuacuaauaagaaugcuaacauuguuguguagauaaucagugagggcuuuaugaaguuuacaccuuugcauuauuaaaggaaauaacaguucaugugaacucaccagcguggcuugauuuuauucaauaguugugucugacaaagcagcaaagacccuuucccuccgccucucauguaccuggauagacuauuaccuagagaaauaguagccuggugaaugaaauacuuuuucuuccuaacggggagcaaucucuuuuucccaggcauccuaagagcuguuaagaggcauugcugccuuggaguccccagcaggcagugggaggggaaaaugccuuugcagaacuggggagguggucacuauggggauggggccacacucugagccaacagaugcacaacucuguggcaaggucaccugaugacacagcagccuuuauacuaucccuaacagaggcugcacagagugagcuuguggagagggaaucugagagaagauucucuuugcaaacuguauucuauucauaaucacacuuaacucagacgcauccugcaagccccugagaccagccaucuguuuagcugauucgaaggagcaagcagacauguaaagggcuuaugagugaaccagaaccccagcucaacaguuccaagagucugaccaucuucugggagucuugggggugaaaagggcauuucugcugcaccagggucucauggcacaaggacucaggcccaucuggauauuuauaaaaugugagacccauguuccuauauuaaggcauacaaaaauaggcaucugugggucucauucuuggagcaagccaguucccucuuuagugccaaccccucccaagccaggaaucacagaagauggacagcuccaccuucauaaucucccuguccugggcagcucugaccucgagguuauggggaaacucuuccccagaagccuucuuugcauccaaggugcacaggugaguuagucaagggagggcugagggaagaccauagcaaagacagacccauggagguuuauauuuuuccuuuuaugaaauauuacacaagaggcaggagauggccuuuguucuucuaguuaucuuggacuaaacaauucugugauagccacugagagggaauggguguuggcuuucgccuucaauacccugcugcccauuucacagccugucccuucuucacagccucuuuuuuguaaaagccacaaacauucucuuccuagcuuaaagagcaucucaccugcuugaggaguuuagacucaguguuggcauacaguauggucgcuuuuccuuuggggcauacucuuuguuuucucuugauccacucaauaccuuaggucaaguuuguuuucagggucacugggugagacagcacagugcacccugggguggcaaaucaugggaucacgugcuccucuuuguaaugcaggggagggaagaccuaggagcgugguccucauaagaaucaccugggcugcuuguucaacuccuguuuccugagccucauacccagugauucagaucccauaaaaguggggagccccagauucugaauuguuaacaaacacccuaggaauuugcuacagguggagauauauugaguuuaaagguauuugucaugcaaaaauaaaaucacaaggaucagugauuaaauaugggaccuaccgagcauuuuggucuuccaggaaaaagucuuucucaguccacacucuggagacuggcauuagggaaccuguaccgugugccaggcaguguagaauguaugacuuggaaugacaggcucuugugguugaagagacacucuccacccaugcuccugcccagugugggagccucauccacagccuuacagcgucccugccaaggggucuucuggccucugcucgagugccuucagcaucaaggaacucaccucucagagcagcccacacuauguuggauucgcccuguuuauuaguccuuucucagauggagcuaaaaucugccaccaccauaauuuccacacauuggugccauauacaguaagacuacuucuuccuucugguuauaacaccuuuaaauauuuggaaauaguauucucgucuccagacuaaacacucauccauuugugcaacaaguauucuuugaacauuuucugugaaucaggauuguccuagaugcuggggagauacaagagagacaggcaggguaccugcugggauguccuaggggggauggcuagaucauaagcauguaaaugaacagaaaguggcagauaguaguuagaagagaauaaaacaggcuagcagcaugguagguauuggcuggaggugccacacuagauaagagaucagauaaggcuucucugagaaggugacacugggacugaggccugcaggacaacagagagccacccuggagggaguguuccaggcacagaaucaucaaggcccuaaagcggguugagcuggauguguucagcaggcagaagggaggcugccgguucacgccaugaggcccaacagaggagugggcagagucugcagcagauggugggccuuuuaggccgggagaaagacuuugaauuuuauauucaaaugaaaggggaggccgcugcccuacuuguuuaugccacaguucagaagccuuuucccugccuggcccuccccuggaugugcgcagugccagugccgcccuccagcugggucugaugagcacagagcaguugucccagcugcuguccucucaagcacauagagcagcuuugcaggaguuuauuuuuccucuuuagagauaugauuaguuucacaaaaucauauuuacacauaaaccucagaagauauaauuagugccauugaguccaaaaauccagacauauuccccacugucaucaaaaaaauacuuucagaucuuucuucagggaguaggcacuuuacaccuaucggguacugauguccggaagcugcaguggccuggagcccugugucauggaauggagagaaaacccaaggcuaaaguuucuucccuguucagggaaacagcuaugggauccugaagaccaagaaggccugugucuccuuugcuuuuuggguggaaugugugaggacucuggggaaguggaugguuuuguucuuaugagacuaaccagaaauaccucugcauucauggcugcuaagaaaaugacccauucuagcugacggcuaaggccaguggccagcuuccugcugccaaagcccagagacagguguccagagcuggguucuccaagcagaguucuucgccaucucaagccuuccugggggaaugcgcuaggaucuucagugcgaggucagcagggaccagccagagagccugaggaggaagggcugggaggcaagccaaggucccaaagggacuaaaaacauguacgagcugcacccaggggucucaggagucauuugugagggauccucucuggcaugcuaggcugauggcccauuccccaaacugaaguuugaaauauggaccaguggagagggacagccaccagagaagcacuagagugccuggacagagaccccuggggcacacagagccaucaauaccaccacccucccgcaaauacaggcugcaugaaaaacaaaaaauguguggcccagcucuggugcugguuacucaguuacauguucccuccacuaucuaucuggcauguuacauggcucgcaagcugcugagccuggccuggugcuuggcaaagccuagcgagcuggguugggagugggguggcugguggggugagccccagguagugcuggcuacaguucccaucuucagucugcaguccuggguggcuucaguuggcccugagagcacaggaagcuuuagacauagucuacugguggggcagggcugccaguuauggaagcagguuguucuggaggaaagaugaauuagaagugcccauauuucagucgagggugauuguucccacaucgacuuaauggcagagcuccacauggguccuugcuuccugcaucaugaccacugucucccagacacugaugggaaccaccaagaggucaauugguccaucccaggcaacuagugucaaucguaaccauggguugaucucccaggggccccagagagcugaguccaggucucucugugaaaccaucaauagccaaagacccuggggggauugcagaugggcaccagggaaguaagacacaggcugagucuuucacagugaguccagccagaaccagggugccaggugcuagaaugugagagugcaugccugucugcaugggcauuuauccugcgugugagugugccugugugugugugcaccucugagugagucugcacucacuucagguuuuccugaagucugguccaagcaggccugagcuccuagauggugaguauucccagaccuuucaccuugcccauggccuggggaggccuccaugucucuggagucacccaggcuucacuugucuuccuggggugcagugaggaggguaaacuaugaacccagugugcucuaaugcagggcuccuuuggggucauuccuaaagagggaaagaggaaguggagaaguauaauggggaugcuauugugauggacaacccaacaagccccaagaaagccccaggaacccuccaccaccccauuuugggccccuaucccugagcacuugaggagccacagccccgccugaaaucagugaucacugccugccugugcugcaaagccuuuugcccugguccaggggaaacacagcagcgcccuccaacugccucauuauccgguguucucagacaggcggggcucagucugcucccaggacucacgggaggccagcugaccaggcucaccccuguuccccaaucugugagaugauguugucaucccucccucuggaagguauagaaagacccuguuuucucaauucuggggcauagaagguccccaggaaggugucacucugggcaugaaugccaugacucuguccucugggcccuccccacccgcaggggcuuuugcuggcagggucuggaggucucgcaucucagucuguuaaccaccagccaucucucucccacucaagccaacggcagccccaccucaggccugagcaccggggccaucgugggcauccucaucgucaucuucguccugcuccuggugguuguggacaucaccugcuacuuccugaacaaguguggccuguucaugugcauugcggucaaccuguguggaaaagccgggcccggggccaagggcaaggacauggaggagggcaaggccgccuucucgugagugcagaccuguccaccuugcugagguuugggcucugcuccagcccagggacccagcagcugcaccacccugcgccaucagcuggugccuuuccuuucauugcacguucuccauuuggaacccugaugggggaaaaacauuagagaaaaguuucucaaagcauggucuuuggggguuaccuguuugaaauguagacucuugagcccaaucccagaucucuuguauuagaaucuccccagagugugaaaaucccuguguaggucaaaaugagggaaauugucagaacuaaaccuggggaggagcugccaugggguagggcagcauuagagggacacacuuaccuugcuuucguacauuguuuauucauucauucauccaucacucaacaaauauuuaucaagcagcugcugcaggcaaggcacuguucccaggcacauagguacaacagggaacaaacagauagaaauucuuguccuuauggagcugaugauccagauacugucccuccaacagcaucuuggagaaacagauccuaagccaguuagcaagagccuucgaagacugucacuggguggagcagagcuggagcaagccagaaagggacugagcaaggaaauaaguuguuuagcaccaccacaugccaggcacuguauaugcauauacauguaugugcauguacuuagaaauguauguauaggggugacucacgccuguaaucccagcacuuugggaggccgagauggauggaucauuugaggucaggaguuggagaccagccuggcuaacauggcgaagccccgccucuacuaaaaauacaaaaauuagccaggcgugguggcaugcuccuguaaucccagcuauucaggaggcugaggcuggagaaucgcuugaacccaggaggcggagguugcaacgaaccaagaucacgccacugcacuccagccugggcgacauagagagacucugucucaaaaaaaaaaaaaaaaaaaaaaaaaaagaaaaggaaaggaaaagaaauguauguauaccuguguacagagacagauguauguauuugagcaaugaucugugucaggcacuguguuuagcacuucccaugcauccuuucauugaauucucauaacuaggcaaaguaacaguguuuuugccucauuuuacagaugaagggacugaggcagggugauuaaaucugaagcucaaggucacacagcuagcaaggguugggcugagacuuauacauuugaaucuguuggcucuggaugcccaccgugccagccuuggguugagucauagcugcucuuccgugggagccccucccugcagcugcccuagggucuaaccagcaguacugucuccacaggaaagaugaguccaaggagcccaucguggagguucgaacggaggaggagaggaccccaaaccaugauggagggaaacacacagagcccaacgagaccacgccacugacggagcccgaguacgugggcugggaggggcuggcaccugcuccguagagacccccacacccaccuccccacccuacccccaccucccgugccccuacccacagcucccggccaaacaguucaggccaggauuccaaacccuuggccacaagaccugcuuggcugagaaaugccugaccucaggcauuucugguucuauuucgguggcuguggguacccuuagaaggcuccuguauaaguagggaucccuggaucccuagccccuguucucaaguuauacacauauucuggaaauggcuuaagguggcaaaaucucacugaaaggcuuagcagagucugcuuaggauuucuugaaauucuaggguuuuguguuuucccccugaaaggauaagggaagcuggggaccugguaaaguucucugccccuccucuguucagaaaccucggggacccacggagccccagaccaguugugguuguaaugccugccuagcugucaaggaucuuaugggcuuaaagggaauggaguuucagggaaccacaaaaucugugacuggaagaacccacagcuccuaugagccauucugaguacucgugaucugccuuauucgugacuuuucccaucggugcccuggggagcccugcaggacagcugggcccaguuccucugggaccugggaagccuagagcagguggaugcugaacagaagccugccccuccuugaauggagauccagggcagggaucaggaagcccuaggcaggucugcaaggacuucagggaaagggagcucuaugcagagagcuggagagacaucagcagggaagggcuagcaggucccuuuugagaccgccacguucucugucgucuccuguguccucuucugcccaccugggcgugugcuuccucucagcauccuucucucucugugggccuguguccgugccugugccuaacugcaugcccccacccccauggucccuguccugggcuucagcccuccuccucgcuucucugucacgucucagcuucauugucuauucucuucuacuuccuguccucccacaggcugccugccgacacuacggccacugucgaggacaugcugccuucugucaccaccgucaccacuaacucugacacuaucaccgaaaccuuugccacugcucagaacagccccaccagugagaccaccacccugaccuccaguauugccccgccggccacggccacgccugacucaaacucuguaccggcuggccaggccaccccuuccaaggggcccagcgccucugcccccuccccggccccagcuucagcccccaaggucgccccccucguugaccugagcgacaccccgaccucaaccccugccgcuagcaauuugucuucuaguguccuggcuaaccaaggggcuguccucagcccaagcgccccugcuggugucggggaggccucuaaggcuccuccggccagcaagcccaccccugcaccaguccccaccccgacuggggcagccaguccucuagcagcagcggcugccccugccacagaagccccucaggccaagcaggaggcucccagcaccaaaggcccggacccggagcccacccagcccggagccgcgaagagcccggccgaggcagccacagcccuugcuagcccgaagagcgaggcugccuccgucagcaccacaaacccuucccagggcgaggacuuuaaaauggacgaagggaacuucaagaccccagauauugaccuugcaaaggauguuuuugcagcccugggcucuccugcucccgccgcuggggccaguggacaagccccugagcuugcuccuuccacugcagacagcucuguuucgccugcgccagcaaagaccgaguacggccucucuuugucugcugucaucggguuguguccugugguggugugcauuugugcugugcuguguccuccuuguuagaugugucuucagccucauccagggcuucucugaggcgaccgucaaccaaggggcugggauaaggcagagagagcaggacaggcagcugggccccaggagcagccgccugcuggcuaauuaggccauguuaauuauguuuuauccuuaucauccuagcagcggcuucuguuuucccugggggagcccuugcagucaggccacugaugagaauagcuugggaagcaggcuaagaaggccaaggugcccuuaucagccacccuggggcccccagucgguguguuauucagugccaggcugagucccuaccagaaaggcacugaugugcaggaagaaaagagguaggccccaggcccguggcaggggagggugcaguucagagguccccucacacuguggcucagaugcucacccuccccucccaaccccggcccccagcccacucuugcuucuccugcucuuagaguggcugggaagacucggggcuccccagcaucaaauggcugcugggucucaaaguucaagagaaaggccuuaaccuuucagguuuguaagugucuugccaaaauucaguggcaccagcugaggcuggggucugugccuguccccaugcauccucagacccgacucccuuuccuggaacugauggaggcagagucagaccuagauuuuuauagaggcuccuauggcugcuccccagauaagcugccaugcugccaccaugggcugcaaggggcucucgccaggagcccugaaucucagcaucgggagggaaaaggacucugauagcccugcccacucagcugcccucaacucucgcauagccaccaggcccacucuaguaccccaccaggcugccaugaaaagcugccuccaucaguguuuucucacccuacccaggcaggcccuagaggcaucauccugcaacagcacagggugggguggggaagggacaggcaagaguggguugcaaaggggccccugaaaucagugcugggagcccagcccagcccagcaggcugcauuuacauccagcugagcuguugccacugcagcuggucagggugaggaggagcugccucugcugcccccuuccaccaccccagguaaaaacacagccucuggcaucaacuuagggcuggaagaggaaaggacucguucuucugacucagugcuucucaacuauggcugcacauuagagucacuugggugcuuuuaaaagucacuguguccggaccaauuaaaucaggauuuccgcgaacacagcucgggcuugggugauuuuuagugcucccaggugauuugacgggcagagguuggagccgggugcugucacuggagaaccccuccuccucccugcuguccccaaggccuggaugcaggggcgagaugucugcagaccguggucucagugguucuguuuuccugauucucugcaggaagggccccguagaagcaaagccagagugccaggagacagaaacgaagccagcgccagccgaagucaagacgguccccaaugacgccacacagacaaaggagaacgagagcaaagcaugaugggugaagagaaccgagcaaagaucaaaauaaaaagugacacagcagcuucaccagagcauuuccaacaccacagacacacacacgcacgcacacacacaaacacacaugcacacacacacaucucauuucucuagugucuuuugccuuuaaaaaaaacuaaacagauaaaacaugggaaucuccuuuuuguagguuuauagaaagggucccuuuguugcacacucacuuguaagaaaaugagacaaaaagguuaaacccacagccaaacuaggacacuccguucccugaaaccguuaaaaaaucaaacaaaaggaccccaaauuaagaaucuaggaagcucagaaacgaaaucuagguucaggaagaccacacuugguguuacccgauuggcacagaccaguuucagagaaauacuuucaggcacuaagacuaaucgaaugaacaaaguccacaguuuauuuuuauacuuucagucaaguuugaacucuguaaaaccucauaaauaaguuauaauuucuguucacuuuguauuuguucaguaugcaaagugugucacccuuucuagcugaauucaauucccacguagacucuuauuuuauaggacgaaugccaaauugcagcuucuggggguagaucucaauuugcaguauucagacuucuuuuucuuucuuuuacauucuuuuuucuuucuuucuuucugccaacuuuguuuuccaguguuuacaaggugacaaauguuugacuuugguuguguuuaaauguccguguaaaauagcugccuuuuauuuuuuaagguaacaaauaccaccuagagguagguaggaucaucccacgcuugcuuuagcacaggacaacuuuacaaaacaugauuguuuacagcugcucuuccccucuuuucugaucugcaguuuuugccugggucccacucaggugaaaauccaucucauucuggaaugguuuugcuuuugaauuuuugguuauuuuuguguuucuuuggggguuagaccacuuucugauuagccgccaccugccugcaucugugaaaagggaucugcucccaggcguucucacccuucuuuugaaggacuccuuaggcuuuguugaaugaagcagagaagauuguauaguuggggcuggucuuggugaacacacauuauuaccccacacauccccuuuguguagaaagccaaauaaaaucuauacauaccauuuccuuuugagcccagaaucuagauuugagcggaagagcaugugugcuucagggaauuagugucuuuuuuuggaaaucuguugaaguaaaguaacaucggccuucuguucacuuaggcagcauuuauagaaacaaaagaagaaagaaacaaccuacugucuggagucauaacacaacuuuccuggauuggaaaccaagugggggaaaaaauacagaaacuuuaagggggaugggaggggggggagaagggaaaagccagcccuuuguauagaaauuuugcuuuuuuuucccucauucuacuuuagaacugcaagcuugugcacuguggaugcgugaauauuuuagugugaaacguguuuuugucauaguauugaaauaaaacuucaacauaguuugguuguggaagguauagcagauaguucagaaaaaauauucaggaaacaaaaaucacucaaacggaaucgaagccuuuuaacaaagaaaaugaaauacagaugaugaugaugaugaugaagaugaugcuaaguaaacagaaaucaguacuccgcaugcgcuccucuccuaagguacaaagcagcaagagguuaggguggcaaggcugccucuggguccauucugugggccacucuccccaacguucugacacuucugcagucugaucaguggcgaugcuagauuauaauuucaaacugugaagaauaauggucuugucauuugcucaaugugggguuauguugcauuuucucagcuccuggggauggaaauggaggaucccagaacacacagcccuggccccuuugauucuagggccugcacagaucucugguucaaaugcacaggcccucagaauagaggaacaugaagagagaucuuagagcacacaguagaaugugagagccugggugucugagaccgggagggcccagcagugaggggcaggcucuucuggucaccaggcuguucaguggacucaguucuucaucuuguaaugucgauggcuuugccacaccaggccaagcccaugccauaccuugucaagacugucaaagugguugugguuaggucaaacugguuuugguucugaugguuaggaagaaacaggucagcccucagaucaccuggcccgggacagcugacccccuagaacccuggcucugccauuagcuaggaccuaagacucugcccacauuuuggucuguucucucccauuacacauagguuugucucagcaugcaagaguuuuuccuuuaaaaaaaaaaaaaaaaaaaaaaaaaaagcaaugcuuucucuaaaaucaaagagggagucauuuuauuccaagauguuuuaucuuuuauguuaagagaucaaagcuuauaauuuucuuuuuuaauuuuugaaggagggaucaacuccaguuuccaaugucuaugugucuauguguguaugugccauacauauguauucacaugaagaccggcauggccaaguucugcuggaggagcacucaagugugacgagcagggccacuggacccugcagggcugugguguauauagugcagcuuuggagguggaacucuauuuucacacuuuucuauggagccuuccgagucccagguuuucacuugaggcugucugucuggauggcgguuuucagaccuccauuaacaucccuacccagcauucuguacuucgggggccuucucucuuguuauaaaacuuuuuaccaagugaaacaucgauaccaccuuuguuuccauucucacugguguaaauacugaguacuaacugagaauuuugacuuugcauucugucggaauacuuguguucaauaaaaauugaaagaaaaaagcuauuauga

SEQ ID NO: 15981 - RNA, 7514 nt, Homo sapiens
cgcacugcgcagccgcggugggaggaggcaccggccgcgcggcgggaggaggugccggccgagcaccgcagacagcgccgggaagaugagcacggaaggugguggccgucgcugccaggcacaagugucccgccgcaucuccuucagcgcgagccaccgauuguacagguagggugugcacacagguacagcggcgggcggugggcgccgggccccggaacgucaccggggcggggccggcgggcgugcugacgucgggcccgggaggggcgcgggggcugcuggggcgacgcgcgcuggucggcuucguggggcuucggacggccuccagcauccugaugggggcuggaguguccccagcccuggaggggugggggagcuugaugguuaacggagccgacugcggagggcgauggcccacgucugggugcggggcccacacccgguucugcgacucgaagaaacgucucugccccuaggagucccuugguguagaccacaggguugcugugaaacucagcaguguuaaacucgccuauguuacacaguaccuggcgcggcguagacacucaguaaauguuagcuaaucuuguaugccaggagcauuggccaccauaucuaauguaauuacaaggcaaauuuuagccccuuuuuuaccaaagacuggaugaacccagucccugguggucuaguggcuaggagaaaaaaaaaaaaaaaugagcccagacguucaguuuccgaagcagcauaguugggauuugaaucccgaucauacauacugcuugcaugcacugacgaguugauuuugaggaauuuuaccacgcacuaaccagcuccacccucuggcccuccguaucgucgucugugaaaugaggaugaccaucgcuaucuaacaggauucaucccuccauucgcuaaaccagguuuuguuucgugcuugucagggcuugugcuagguaacggaugcaucagggaucuuguaugggguuuccaaucuggccuauuuuguggaggguacacugagaaaauuuugugcaaaagacuuuagcacucuaaauacaagaaguggcugagcaggagaaaguggggguguguuauuccauuuugcauugccacaaaggaauacugagacugguauuuuauaaagaaaagagguuuauuugguucugcaggcuguacaagaagcauggcaccagcaucugcuucuguugaggccucagggaccuuccacucaugguggaaggcgaagggcgagcaagcaggcaacucacagggcaagugagggagcaagagagaggagaggaggugccaggcuuuuuuuaacaaccagcucgcccauugacuaauagagcgagaacucacucauugcuucagggagggcaccaagccauucauaagggauccacuuccaugagccaaacaucucccacuaggccccaucuccaacacuggggaucacauuucaacaugacaauuggaggggacaaacauccaaacuacauuggggggaauaauaaagaggaucucaaaaaaaagggguuguauaauaagcuuaaacaccugagggugguaaggucucauagacgaugcgaaauugaauggauggguauaaguauaaacauuaagcaauuuguuuucugucugagacgacagccaaagauuguaauuuuaaaaauucaccugcuuggaauauuccucaacagauugguaaaguucucaugaggcaguaguugagacauaguauaaagcaagauugcuaaauaggagacuuaccaggucauguaauuuuuuuaaauuauuuuuucuggaugaguaguuuagcuucugagagaaaugagauaguaagccacuuugcggaucaccaucuauguuuaucauuauaugcuguuauuucauucagcacuugccuguuacauuguaggcacucaguaauguugaauugaaaaguggaaggcccaugagcagaucaguugcuguggaacaaggggguugaaguuaagguuuguuugugcuaauuuguaugguacaaucuucuaauuagggaauaugccaugguuugugacguauacguaaguaauaaaaucaacaugauuucugacucucccuuuggugagcuaaaguaauaaauugggaaacuuuucaaagaucaguacaaauaauaaauauaaggaacagagaaggggguuugaaugugauacuugugucaugcugacuuuuuuuuuuuuuuuuggucaguaaauuucuaagugaugaagaaaacuugaaacuguuugggaaaugcaacaauccaaauggccaugggcacaauuauaaaggugagagaaaaacugaugacauuucagcccuucaauaaggaugaaagaguauucagcaaauguagacauaaagaaugggaaaacuuacggacacagugugaaugcuuugagccuugaaugagaaauuaaaugggaguucagaaugaaaggaucuguugucuugguuggguguguguuaaguuuuaccuugcaaugucaacucuuacaaacaguccaaaacaaugaaugguuuaaagcauuuuucuuuguccuagaguacacaacaaguuucuuucugauuagguauggccaaggcuaauguuaaaauuagauuuuauucuuugaguaaauaaugacugacaaaaggggaauguugccuaggaauguaauguauggcagaaaaauagguuuggucuaaagcuuugccagcaguguucgaagaaaguagguaauuuguucaaggauaagagacuugauucuuugagguacagccugccuuaaaaaacagguacauaagucguagaguauaaaacaguauguggugugguggcauaaaaaaaaacagacaaggugucaggagauuaggauuacugguuuagcuacagccucuuccuuaaucuaugguaucucagucucaguguacucacuuacauguaauaucuaaugguauuuguacagaacuaaaauacauaaauucauaaaaguuauuaauguguaaagcacugauaaaguuuuuuuuuguuguuguuguuuuuuuuuuugagauggaguuccacucuuuuugcccaggcuggaauggugugaucucccgucacuacaaccuccaccucccagguucgagcgauucuccagccucagccucccgaguagcugagauuacaggcgcccgccacuaugccuggcuaauuuuuguauuuuuaguagagaugggguuucaccauguuggccaggcugcucucaaacuccagaccucaggugaucugcccgccucggccucccgaagugcugggauuacaggcuugagccaccacgccuggccaagauuuuucaaaugcuucucacaagcacuuuuuaauuuacaaagcauuacuuuagacuuuguauacauucaugugaguaaggggacaagaauuuaaggcccaguaguauugcuuguucagaaagguacugcucaguauuggaccagcuugcuguguagcuggacaccugaaagacauuuucuacuucuacaggcagagacugagcagcaucuugaugcucccuagugcauuaacauaagcagaauuuacacccuuuucagccuuggccgagugccucugcuuagccaacauuccuacuaagcuccuuugucucgauugugucuugcuuugguugcuaaaaaaaaaaucuuaacuaaaauaacagauguuuugggguaaauauuuaaguauagcuuuuggggacagaucuaauaauuuauguugccaacuugugcuuguauguugcuaacuugugcuuggauguugaucuguugaaagucaugcuguuuuuuuuguauuuuguuuucuuuccauaguuguggugacaguacauggagagguaugugcagaaaauauuugugugguuuuugcagauugcugggcucucuuucagccagugugguggauucuguguugaaaacuguuccagucaguauugcuucauuguuggcccuuguauauguguguguggugagcugccgccauuccaggccucuccucuaccaaaguguugucuuuaauaugcuguauguggacagguagaagggcuauacaaugaaaaggaugcuugaaguacauggugcuuccaugcugaggucaaugauuaucucugggaugaaggcaaaugugcaaaugugggcacagucucugcacauuguacugccuuuaauaauuugccagccguuuaauauggagagccuaucacaguaauauucaccuuuguuuauucuuuagauugacccugcuacgggaaugguuaugaaucuggcugaucucaaaaaauauauggagguaauggcauguugggugcuuauuaugugcuauucccuaacuguaauauuugguggcccccuaucuaccuccccaaccaguuaucuccuaagguuccaugacuuugugaauagaacuggauguggguguuggggaauaguuggaagaacugcucgcauggccucuaaagguguuuuggugacuuaacggaaauuagucacaguuguguuacagcgaugggaggaaauauaacaugcucaccuuguauuccuuguuggaauauccugauuuccuucaguuaacaaauucuccauuucuuuuaagacauagcuuucuccuugagacuuacugucuuucuuuuuuuuuuuuuuuuuaaauaggcacagaaccaaugcaaacuuuucuuuuugguagagguaggggucucacuauguuguucaggcuggucucagacaccuccugccuugaccucccaaagugcuggaauuacaggcaugagcuacugcuccuggccuucuccuuggagcuuucucuucccucucugaauauuccuuguaccuuugaucauagauuuagacaccacacuguguuguucauucuagcuuuauuauaaacucaccagagcaguaccucauagagauaacacacaagguguucaaugaagaacuuaacugauugugucauuauagaauucuugcacuguaagagacuuuggagauuauucagaccaacuucuucaacccauagauuaagauugagagaugcugaacaguuaacugacuugccccaggucauauggcuagucauuugcaaagcugggaguagauuucuuuccuuccagcuguuuuauuaugcugucauuucacuugcagcuuagguuuguucugagauuugacauuugcuugauuaaaaugauguuauuaguaaugauuacuucuuucacauuacuuauucauauauucaacaaauuucucuacuucgcaucaguuuuugagcuaaguguacaaagaugaaugagauguagcccacagaguguauacauuacuuuuucuaggaggugaagaauauuauuaaauaacuguugauuuaauaaaugaguagaagaaugagugaaugaagaaacagcacuaugcucaaaauacuuuaggaaaguuauacagauagggccagcaugcauuuauggggcagggguuggggggcaggcggagagagagagagagggagacagagacaggagaagaggagggggaggggaggacaggggaggagaggggaggggaaagaaagaaaaagaaaaagagaaaagaaaagaaaagaaagaaaagagacaagacagcaacauaaaaggccucaacauaugacuaaauacuggaggagggcuucucuaugcuguuuucugcuuuuguaugccugaaggacaccacacacuuucaucaguaaaaguggcuuaucauggcauguagaguaaaguuagagcucuaccguggggggaggauugcuugaguccaggaguucaaggcugcagugagcuaugauuaugccacuugcacuccagccuggaugacagagacccugucucuaaaaacaaaacaaaagaaaacaaaaagcccugcauaagaggcuuuaauggagaaauugggacuggaacugggauugaagaugaagcaaggaugcccguuuucuuguuauucauguggaacaucccuucauuggauauauuucaauaacuguuugaucuaggacuuacucuuuuuguaugauucuaguuuuucucaagaaaugauugcuguuacuguuauuaauguacccuucuucaaacuacguccuauggaaaauuacauuuuuuuuucacagaugcuuagauuuuuugcaauagcuaaaagcaaaaaccuagaaagaaugaggcaauuuaauccuugcugaugaugaggaaaaacauuauguuaauauacacgagcauuagggaguaauagucuuuacauauauauauuuuuccuucuaugagcccaagaucauucuuaaauuauuccucauagcaaaaauuuagaacuacuuacauaauuucagucuaggucugcuuuauaaaauguaguagucacuggaucuuuguccuuaugauauuguggcauuguuccguaggugugacaguguuauggaaaaauauuugugcuaacuguuuggacaggauucacaaaguguuaaacugaauucugaauuacaauggcuuguguugcgagaaagcuccaggaauucucugcuuuuugguuucucaccucuuuuuauucaguaacaaggauuccuaaucauuaccgacagcugggccugacuuuauuuuacaacuugaaauuuuguaaaguugccuuguaagacucaaaucuaguacuuacaaauauuuaguuaguggcuaagugauaaggugagguuuagaggcauaaguggaacaauuuggaauuugagucguaaauggagucaaugauauuuucccuugguuuugucucuaggaggcgauuaugcagccccuugaucauaagaaucuggauauggaugugccauacuuugcagauguggugagguggguggcacuguaucuugccuuauguggauuguaaaacaagaauugauuugaauacuuugauuguugugugauuucugaaguuuuaauuuaaugaaaucuuucgaaacuagaauuucuauuuucuguaaauauuaaacaugaaauuuuauuguuugcauuuugaauuuuuuuuguuuuuguuuuuuuuucuuauagcacgacugaaaauguagcuguuuauaucugggacaaccuccagaaaguucuuccuguaggaguucuuuauaaaguaaaaguauacgaaacugacaauaauauugugguuuauaaaggagaauagcuauugggguuagcauugcacaaagcccaguuucuuucuguguuugaaaaagauuuugauccccuuggaauauuaagaggucaacacgugauuguuguacguacacauugugcucuggagugccuauuuauugaaaucauuguaagaccuguuauaaauuuaagucuauuuaaaacuaaacuuguaauauacauccugaaaaucauuuagagagucuuuuauuuauaaauuaaaaaucacuucauuuucacaaaauguuuuggugugggauuauuugaaagcaaaagaaaucuaauuuuguuuucuccauuaccuca

SEQ ID NO: 15982 - RNA, 9424 nt, Homo sapiens
uauuuuugacaaaaauuauaauauuaccagaagagauuuagcuuagggaguuuaaagaccuguccuuacuaguuuuuugacuuuguuaaaaucucugagcuuuuguuucuuuacaguaaaauguaauaaugguagcugcuauauuuuccucaugagauugcuuaagguucaauugagaugauauaauuaaaaucauauugcauuuuggaaauguggcauuaucauuugcuaaucgcagcauaauugcaagauugauaaggugauguuugucugugcagcgguuuaaaaauucuauuggggaagauuuccacauauuugagauuuacuggauuggacuguucagccacuuucuagagaaaccaauuuguuuuccagguuccugaucauagcccagucuguagcccaauaauuagucagauuguauuuucaguuaguugcuuuuuuuuuuuuuucuuuuuuuguugauacagagucucacuccaucgcccaggcuggagugcaguggugcaaucucggcucacugcaaccucugccuccaggguucaagcgauucuccugccucagccuccugaguagcugggauuacaggugcaugcuaccacgcccggcuaauuuuuguauuuuuauuagagacgggguuucaccauguuggucaggcuggugucaaacucuugaccucaugaucugccugcuuuggccucccaaagugcugggauuacaggugugagccacugugcccggccaguuaguuacuuuucuguaauguaaaguuauuuuuaguaacuuauuuuuauuuccuuuuuaaaaauucuagauucaggaggaaucagauauguggaaaauaagagaacuggaaaaacagauggaagaugcuuaccgggggaccaaaaggaaaaugcuacccagcaguucaaggugaaguugcagcucugagaacuaaaauaauucucaucuuuuucagaaucaucaacuuuuguuuaaaaauacuuugguauauuaaggauaaauucaguucugugaguccuuaagccuuccuucuuucguaaaucuagacccaggcauaaagauaauggcugugacgcauauggcccugcucuuuguacuuauuuacaauggagaguuaaaaaauucuaccugaacaauuaugaauguguaggguucuguggauucuaaccuuaccugauagcuuuuaacugaagauuuuauacuggaaucuuguggucacuaagcugaucagucauucuauucucuauuaaucuuucauucuuucaggcuuuucuuuuuguagcuggaacugcaggugcaugccacuaugccuagcuacuuuuuuuuuguagagguggugucuugcuguguuccccaggcugguauagaauccugggcucacgcaguccucccaccucaaccucccaguguugggauuauaagcaugagccacuugccuggccucagacuuuucuucacccugucuauucacccucuucaccagaucaacagccuuuucacauuaccuuaauagcuugaguguaaauaugaaggauuaugcaggcuuaguuaucuuccuuguggagaggccuaggaaugcuugaauaauugggaagauccuuacacgcuuguaaguguaagagcuacauauauaagaaauacuuaaacucuuuaggagcagggcuugugauuuucucauuugcugcuauauuccugccagcuagaccaguaccugguacauaggaggcccuuacaauuuuuuuuuuuuuuuuuuuuugagauggaguuucgcuuuuguuacccaggcuggagugcaaugguguggucuuggcucacugcaaccuccgccuccuggauucagccaauucuucugccucagccucccaaucagcugggauuacaggcaccugccaccacgccuggcuaauuuuuguauuuuuaguagagacaggguuucaccauguuggccaggcuggucuugaacuccugagcucaaagugauccacccaccucggccucccaaagugcugggauuacaggcgugagccacuggaccuggccccuuaaaaauuuuugauaaccgauuagcagcuuacuggcuaguuaguagaaaugguaaacagaagcuggaucagugguucucaacuuuuuuccuacuccaguauucccauggguuagaccuuguucccacuguuauugggaccucucuauaguaaguugcugguuugcacagagggaaguguauuucagaaucucuaggguaguuugaagugucccuugcuaugauuauguucugcuucccucuuugcaugcccuccuaguugagaaucagcgagugaacuaucacaugacauaguccagaguugauuucaucucucuaugcuuugcaauaggauggguacuaauggucagauuuuuuucuuuuuuucuuuuuuuuuuuuccugagacggagucucacucuguugcccaggcuggaguacaauggcaugaucugggcucacugcaaccucugccuccccggguucaggcaauuuuccugccucagccuuccaaguagcugggacuauaggcgugugccaccacaccuaacuacuuuuuuuguauuuuuagcagagacaggguuucaccaugucccccaggcuggucuugaacuccugaccccaagugauccacucgccccggccucccaaagugcugggauuacaggcaugagccacugcaccuggccuggucagauuuuuuuccacuggacuuuacaaauguacagaggaacagauaaucaaagugcugggauuacaggcaugagcuacugcacuaggccuggucagauuucuuccacuggacuucacaaauguauagagaggagcagauaaugucuuugccuuuuuuuuuuuuuuuuuuaaacaguaucauguuguuuccuucccccucagcuuguuccaugaguuuugugcaugauguuccauaaaguaaacucacagauugcuuuuacaucuaaaaguucuucugcuuucucuuuuagccggaugcgcagugaugguuuugaugaagaaagucaaagauacuauuggaggccaaagaaugaaauuucugggacacuggaagaugauuuucuuaaggcuaaauccuggaauaaaaaguucuaugauuaugaagcaaacaugccagacagguuugugauuaauuccugugagcauuaauauuuggccugagaacguguacuuaucaaaauuaauuguccccacaaaaaacuuguguacaaaaguucauaccagcauuauuaauaauggccccaaaaaauaauggccaaguaauccaaaugucugucaacugaugaauggguaaacaaaaugcgauauauccauacaauggaauauuauuuggcaguaaaagaaaugaaguacagauacauguuacaacguggccuugaaaacaucaugcuaagugagaaggaagaagccaagucacgaaagaccgcauauuguaugauucuauuuauguacuauguccauacauaacuguaugauuccauuuaugugguaggcaauuccauagagacagaaggcagauuagugauugcccugggcuggaggcacuacacuuugaaugccaugauaugugaauuauacuucaauaaaguuguuauuuaaaaaaaauaggccaggugcuguggcucaugccuguaaucccaguacuuugggaggccgaggcgggcggaucacgaggucaagagauugagaccauccuagccaacauggugaaaccccagcucuacuaaaaauacaaaaauuagccgggcgugguggcaugcgccuguagucccagcuacucgggaggcugaggcaggagaaucacuugaacccaggagguggagguugcaguugagccgagauugcaccacugcacuccagccuggcaacugagugagacucugucucaagaaaaaaagaaaaaaauaauaauaaggcugggcgcgguggcucaugcuuguaaucccagcacuuugggaggccaaagcgggcagauccaugaggucaggaguuugagaccagccuggccaacauaaugaaaccccaucucuacuaaaaauacaaaaauuagccaggcaugguagcaugugccuguagucccagcuacucgggaggcuaaggcaggagaaucacuugaaaucgggaggcggagguugcagugagcugagaucacgccacugcacuccagccugggcaagagugagacuccaucucaaaaaaaaaaaaaaaaauuguccccauguagacagcaugauauuaugaaguguuuuuggaaaagugcuucauagcuaaagagcagaguguaagaguucguuaguguuucuuaaggaaagcaauggcaaguucucuuacaaauggacaaaauaaucuuguaugucugaagugauaguguacaguacaggaaauguagcuguuacugagcuauaaugggggcuugguucuaccauaucucuacuuuguguuuauguuuguguaugcauguacuccaaagucuuucuaauguugcuuuaauuuccaaaaauguaugcauugcuuuaacaauacaugugaugugucauauuacagauggggucacagugguuauaaagaguuauacccugaagaauuugaaacagacagguaaggaaaauaggcuuacugaaagaaacuaagaugguacaaaaucuguauuauaaauugauuucuuaacuuuuacgaagaauauacuugccaucaaaaauguagcuagagaaacaauaggugauuuaguuaggaggugaucccuguuuucccauucucugguugauguuuggcaugucuguaagcauuuugguuuuuauauauaguauuccauacaguaacucaguauggcagcuuagaauuuuuaccuucauuuuaaagaugaggaaacaaaaacucaaugagaauauuaaaguguuaaaguauacauuaaagugcuuauuuaaaauucagauguuaaccucaauuuuuuaaucuagaaugcaaaauauuaaaauaauacgcuuuuuuuuuacauaaaagcuucuauuuuuuaacuuuucuuauuaguagugaucagcaagauauuaccaacgggaagaaaacaucuccccagguaaagucaucuacccaugaaucccgcaaacacaagaagucaaagaaaucccacaaaaaaaagcagaaaaaaaggucacacaaaaaacagaagaaaagcaaaaaggaagccacagauauaacagcagauuccucgagugaguucucagaagaaacuggggcuucugguacaaggaaagggaaacaaccacauaaacgcaagaaaaaauccaggaaaaagucucucaaaaaaccugcuuuauucuuagaggcagaaaguaacacuucacauucagaugauucagcauccagcaguucugaggaaagugaggaaagagacacuaagaaaaccaaaaggaaaaagagagagaaaaaagcccauaccucuguagccaacaaugaaauacaggagaggacaaacaaacgcacaaauuggaaaguagcuacagaugaaaggucugcugagagcucagaggaugacuaaaugggaaacacuuuuguuuuccacaugacuguggauauuuacaguucuuacuccuugugguuuugccagugacucuuguucagcacggggccugaggucagagcugucuugugccaucuguauguucugacagacgucuugucuucuauuuuggcguuaagcuugauccccuuuucuuguuaaaagggaaucugguauuuuguuaugaagguuucuugaagagauuauuuuuuuuugcaauuaauuacguuuaguguagagugcauauacagcaaauuaaaggacccagaaagcuggauccaauagugaccuggguacaccaaucggaauauugaauuuggggaagucaagggcugggaucaagagguggauuggaacuaaugccauguaggaugguaugacaaggcaacacuguauugcucucuguuuauauagcaggugucacaacuaacuugucuuuagccuuggugcuuugauccuucuauauuuugaccccacaggugugguccgguuuacuuaaucaggacaugggccuaagaacaaaccuuuucccuucaugauaacauccauagacaacuuauuagaagggacuagaguuuuugcaaauuucccugcuggauggggccuauagcuauacuuaguauaugccuaaacaugguaauuggauaguaaaugguuuucuaguuccauugcuguauauuugccuaaauggacuuguguucaaauuauuucuucaauugucauagauaauccuguaccaaauggggaagaauuaggaaauaaucauguugucuaaugguacucuggauucagggcagcaacugccauuuaaauguugucuuguucauuucuaaaucuguucaugaaguuuagguuuucccugaaacuaaguugaauuauuuccaaaaugaaacaggcuucucagggacauauccacuucuucccagucugccuuuggauuaaagcaccaagcagagaccacauuaauucccuuugcuauacugugauccuuaguauguuaauucuuaagaaaccaacauaucacugaaagaaggcuggcagaacgcaagugcauuuuuucacugugggaagaaagaucaagugacguauuauuuuuuccugguugucacuuaaugggcugaguaaaaagcuugaaaacucagacuuucggucuugguucugccacucauugguuaugaggaggcccagagcagguaaguucaccuuccuggccuuacuuuccugauguguaauacggaauuacuucacaguagcaugacaguauaagacaccagcaguagauacaacuaugaugacauuccaugaguugguauuuuuaguucuaacugcuaaauuuguucucuuuacgggacagauuucuaauaaagugcuuggucuuaaaauacaugguuggacagaggugcccuaucccuuaacuaugagcaggugcuaccuuuugggauauuuauuuuaaauuuuaauacuuugguacucaauugucaguguuccaugguguguauuuuuauuuuugggauuagugggggucuaaagggagaagaauagucucuaauuacuaccucuuaaccuaaagcaauuauuuuguuccuggagcaaguuaaaucuuuguuggaaggagcuuuggccauauauuuuuuagcaugcauuguuucugugcccugaaaguaccugaaagguuuuaagcacagacucaggaaaaugugccaguagaacaggccaucuccaggaaauuggcucuauuuggguccugaccuucccuuccucccaaguuagcaggcuuguucuuucgcaaggaauacacaucuugccuuuuuuuuuuuuuuuuugccauguuuuccuuuucuuggucauguauaagcaauaaagcuguuuuuuguucuucaucuuucuuaaccccaaauuuucuucuaugccuuaggcuucgaugguucuuccaacccccuuaauauggcuuagggugguuuuucaaaaccuacaaucccccauuugcacuacuggccauggaacauuuauuucuaguguuccugccaaucagagaucucuauauuaaauucuaaaaugggauuaaaagaagaguuggagaauucacacuuauugaguaacugaugucauacaaccuggaauuucugaauuccaaauaaauaaauuucacucuuugaacauuucaucuuuuacuuuuuagcaccaacagacuugauaacagccugaugcugaucugacaauggguugauagccuucccccacugacccuuaaaucugcuuaguaacaaguccuuugcuucugucauucuccugggggauggccuacugcccuccuuucuguacaaucugggcaaaccgacuggugauggcaagaguggugucaaugaagcggucuacacagcuggagagacaauuuucagugcgagagucuaggcgauucccuggcuucuccacacauuuaucccaacauaacuccaugaagugaugcaccuaaaaggaaagaaaaauaguaaccauuggggucugcagauaggccuaacucuuguuuauuaacuucucacuuuuugacaccugacaaaaccauucuuuaaaucaaccacggagucacuuugggcucuucucuuucuucauuuccuaauuagucaccaauauugauccagauccucgucccuacagauuguacauucucagguaggacuaauaaccuuuuauauuccccaaaguagcuagcaccauugugaaccaacuagggaaccaauuaauuuucccaaacuauugcacucauuuuauuccaaaccuauccccuagacaagguaauucuuccauuaaccuuuuggggguuauggauccacuccccagaaaaaugcacauacaggcacagaaauuaugugcacugucauuagaauguucagggcccaaagauuucuagccaggguucuugcuggucauccgagcacccucuuccucccacccaaaaggaaaaaaccauuuuaccaagagcuuacuauuugugaggcuggguacuaagaaaucaguucucucuaagguccucaaggauagcugucaucaccucccauuuaagaggcgugauuauguaguccaaggucauguagccagcaagaagucaggccgcguuagaaccauguccgaagggcuccaaacccuuguucuacauccauagucuacagcgacuacuucagaguccaccuuccuccgauaauguucuagucguuuucaaauacauugucgcauaugauccucacaauccagugaggcaguggggugacggcgacaccaaaacccacaguggaugaguaucuuuucuacgggcacguggccugcaaggagcagagggaggaugagaacccagaucuuucgaaugccagcccagucaugucgccggcuaacuagucucccguacccuugcgucgcccaaaucuucccuguuuuacaccuuuucuuuucuccacgcuacgcuuauauaccuggcaccugagcacuaccggucaccagggacaggagagccauaacuuugucuuucgugaggggaaugggaugcagccgggaucgagcaccagugagccgccaguguacagaccuccgagcgugcccaggaccaccaaggaaggugaaacuuccuuucccuucacccuccccguccccgcaccugugcaguaaacugcgccuucugcugcucggcggccaccaggcgcugcaacuccgcuucaucggcuucgcccagcuccgccauuguucgccucaggcucgccaccuuccgacagcuguguuugcgcaugcgcgacgggugugcaccgccucucgacuuccgguucacccagcauuuccucuucc

SEQ ID NO: 15983 - RNA, 11381 nt, Homo sapiens
cauaucuaguuccggaaugucccccuucuggugccaggcuugcuuuucaguugggccugacccacuucucuuccaggaaagcgcccgccuuccuucugcacccgucaaccucuggaguguccugaaaacccucccuugugggagucucugggcugccuguuggugggacgauuucucaggagcacgacuuccggccugaaaaggaagucuccuccuuuuucucccaaaccacuucuuccccccuaccccccgccacgcgaggcugcggcgcacgguauggguguguuuguguguauuuguguggggagggcguuuggagggaagguuaccgggagcuccgaggccgcuggggaacagggaucccggugacaaagauggggauauuuccucugucuuccacuuggaaaccucaacccccgcuucaggcucccuagauacuuucuggggcccaaccgaaggccguagccauccaaagcguucccagccuuucuggggagugaaacuuacccccgggguucguccuagaggagcgugagcggggaaugcccaggucaaccgggcuguccgaauuccgccccggcucagccuccggccucaguccgggagagagaucugccugucggucugggcugggggaaacgcggcaguggccugggccacaggugagggcagaguaaccagugggaaggcugcguuuucacgaaggacucgggugaagcugcagagcugccuuugagcccugacuccuuggcuuccugggucggaggagaucuuguaauggagugguucuucgucucacuagcaagaugccugauuuccucaggaucaaggggugagugagcguuggggugguugcacaaagcuccugcuagcuacacacgaaaauauucuugucaucuaguuuuuggaagcuuccguagcaaguaggaaauaaaaugcccccaaauggagaaauuuaggacaucuuugcauuugauguuuugaguaaucaguuucuguuacuguugacacccgugguuccugacacucucaaaucuacguauuugcuucagugcaaacuauauugggauuggagguuugauuuuuaauuuagacagugacauacaucauuugccugggacuauguggcuugggacguuacagcuuuaagggaacuucaucuacaaaauagggauggagauacuugccucauauaaaaaguaguuaugaggauuaaauaaaauggugcucaugaaagcacuuaauuuuauguagucuugugcauuuucaaagaacuuuaauguacauuaucuccuuucaucucacauuaguguguuuaggcauuucccucuuuuaaugguaaagggaaaacuauucuuuagaaucucugacuucuaguucagugaucuuuccuguaccucauaugcuucuuuauaaaacuucaagaaaagauaaaguaauaacagaaauuauuacuaaacguuauuuguugauucauuucagauugaagaaugucccggauuccacuggggaagguccuccugaggaaugucauccggcacacagaugcucacaauaaggugggagguacaaccuaguuacuccucaacgcuuacugaaggcaagcagugugccaagcauuauuuuggaacaacugggagauacaaagaauauucuugucaucuaguuuuuggaagcuuccguacacaguaggaaauaaaaugaugaauaaaauagauaauuauaauacaguuugauaaguacuguauaacagagauauuugcaaagugcuuuggagcacuaaggaggaaauaauaaaaucuacacuggggaauuagaaaagauuuuacagaauuagugguauuucagcugcugaucuuugaacugguucuugaauagguauacguuuaccagguaugaaauaucauucuggauagacagcaucaugcauuaauauggcaacgagaaagagcauuaaucacuuggggcauggcaagaaauuuauccagaaagcagggaagguaggggauaguggcagaagauaaggccucagugguaauuagaguuggauugugauguuuggagcugagacuucuuccucuaggcaauaaagaagccaucaaauguuuuuaaacaggguguggcaugaucauaguuauauuuuagaaagaugguuugucagcuggguagggaaugaaucagauggggagauacagaagggagaguaauuaggaggcaauugcaguauuacaggugagagaugaugaggguucgcaugaaauuagugacagcagggaugaagaagaggaauuuaggagauagaauccaaagaaguugguggcuaauuagauuauaaugauaagaauggaaucuaauucaguugacccuugaacaaugcaggggcuaggggcaucaacccccugcauagucgaaaauccauguauaacuuuuuacucccucaaaauguaagugccaauagccuacuacugacugaaagccauagcgauaccauaaacaguggauuaacacauauuuuuuauguuacauguauuauauacuguauucuuauaguaaaguagcuagagaaaacaacauuucauuaagaaaaucacauugaguaggcugaggaggaagaagagggacuuguuuugcuaucuuacagguggcagagguggaagaaaaucugaggauaaguggaccugcacaguugagauuccuguuguucaaggucaacuguguaaccaccuaugugacuggguagaugaugacaauucuguuaauugagauaaagaacaaaaaaugggacaauuaugauaggaaagguaauuaguuugguuuucaacauguugauggugaggugcuuauaggauguccaagcaguugaaaauucagacuuggaguagaggagaaaaguuggggcuggacauaaagguuucgggauuauugauguauagguugaugauaagaggucaugagaguagaugaggucaccuaggagagcacauauaaugaaaagagggccaaggccccugguuuaguuuucuucaguaaacuguacuacuuuugguuugaucauauuauuauuaucauaucaccugauuuuuaaaauuaugggcgaggguaaaacuguuacccgagcugccuaugcaauuauguuaaccugccccuaguuauauaguaagcuuagauuuaaaaugguagcuagaaaaagauaaaucuagcacagaucuaaugaaauuaugcaggaagacuuagaaauaaaauguguucuuuggguaaucacauucugcuuuucaagaaauucccuagcagccauacugauuauuuuauuuuauuuuauuuuugacaaaaauuauaauauuaccagaagagauuuagcuuagggaguuuaaagaccuguccuuacuaguuuuuugacuuuguuaaaaucucugagcuuuuguuucuuuacaguaaaauguaauaaugguagcugcuauauuuuccucaugagauugcuuaagguucaauugagaugauauaauuaaaaucauauugcauuuuggaaauguggcauuaucauuugcuaaucgcagcauaauugcaagauugauaaggugauguuugucugugcagcgguuuaaaaauucuauuggggaagauuuccacauauuugagauuuacuggauuggacuguucagccacuuucuagagaaaccaauuuguuuuccagguuccugaucauagcccagucuguagcccaauaauuagucagauuguauuuucaguuaguugcuuuuuuuuuuuuuucuuuuuuuguugauacagagucucacuccaucgcccaggcuggagugcaguggugcaaucucggcucacugcaaccucugccuccaggguucaagcgauucuccugccucagccuccugaguagcugggauuacaggugcaugcuaccacgcccggcuaauuuuuguauuuuuauuagagacgggguuucaccauguuggucaggcuggugucaaacucuugaccucaugaucugccugcuuuggccucccaaagugcugggauuacaggugugagccacugugcccggccaguuaguuacuuuucuguaauguaaaguuauuuuuaguaacuuauuuuuauuuccuuuuuaaaaauucuagauucaggaggaaucagauauguggaaaauaagagaacuggaaaaacagauggaagaugcuuaccgggggaccaaaaggaaaaugcuacccagcaguucaaggugaaguugcagcucugagaacuaaaauaauucucaucuuuuucagaaucaucaacuuuuguuuaaaaauacuuugguauauuaaggauaaauucaguucugugaguccuuaagccuuccuucuuucguaaaucuagacccaggcauaaagauaauggcugugacgcauauggcccugcucuuuguacuuauuuacaauggagaguuaaaaaauucuaccugaacaauuaugaauguguaggguucuguggauucuaaccuuaccugauagcuuuuaacugaagauuuuauacuggaaucuuguggucacuaagcugaucagucauucuauucucuauuaaucuuucauucuuucaggcuuuucuuuuuguagcuggaacugcaggugcaugccacuaugccuagcuacuuuuuuuuuguagagguggugucuugcuguguuccccaggcugguauagaauccugggcucacgcaguccucccaccucaaccucccaguguugggauuauaagcaugagccacuugccuggccucagacuuuucuucacccugucuauucacccucuucaccagaucaacagccuuuucacauuaccuuaauagcuugaguguaaauaugaaggauuaugcaggcuuaguuaucuuccuuguggagaggccuaggaaugcuugaauaauugggaagauccuuacacgcuuguaaguguaagagcuacauauauaagaaauacuuaaacucuuuaggagcagggcuugugauuuucucauuugcugcuauauuccugccagcuagaccaguaccugguacauaggaggcccuuacaauuuuuuuuuuuuuuuuuuuuugagauggaguuucgcuuuuguuacccaggcuggagugcaaugguguggucuuggcucacugcaaccuccgccuccuggauucagccaauucuucugccucagccucccaaucagcugggauuacaggcaccugccaccacgccuggcuaauuuuuguauuuuuaguagagacaggguuucaccauguuggccaggcuggucuugaacuccugagcucaaagugauccacccaccucggccucccaaagugcugggauuacaggcgugagccacuggaccuggccccuuaaaaauuuuugauaaccgauuagcagcuuacuggcuaguuaguagaaaugguaaacagaagcuggaucagugguucucaacuuuuuuccuacuccaguauucccauggguuagaccuuguucccacuguuauugggaccucucuauaguaaguugcugguuugcacagagggaaguguauuucagaaucucuaggguaguuugaagugucccuugcuaugauuauguucugcuucccucuuugcaugcccuccuaguugagaaucagcgagugaacuaucacaugacauaguccagaguugauuucaucucucuaugcuuugcaauaggauggguacuaauggucagauuuuuuucuuuuuuucuuuuuuuuuuuuccugagacggagucucacucuguugcccaggcuggaguacaauggcaugaucugggcucacugcaaccucugccuccccggguucaggcaauuuuccugccucagccuuccaaguagcugggacuauaggcgugugccaccacaccuaacuacuuuuuuuguauuuuuagcagagacaggguuucaccaugucccccaggcuggucuugaacuccugaccccaagugauccacucgccccggccucccaaagugcugggauuacaggcaugagccacugcaccuggccuggucagauuuuuuuccacuggacuuuacaaauguacagaggaacagauaaucaaagugcugggauuacaggcaugagcuacugcacuaggccuggucagauuucuuccacuggacuucacaaauguauagagaggagcagauaaugucuuugccuuuuuuuuuuuuuuuuuuaaacaguaucauguuguuuccuucccccucagcuuguuccaugaguuuugugcaugauguuccauaaaguaaacucacagauugcuuuuacaucuaaaaguucuucugcuuucucuuuuagccggaugcgcagugaugguuuugaugaagaaagucaaagauacuauuggaggccaaagaaugaaauuucugggacacuggaagaugauuuucuuaaggcuaaauccuggaauaaaaaguucuaugauuaugaagcaaacaugccagacagguuugugauuaauuccugugagcauuaauauuuggccugagaacguguacuuaucaaaauuaauuguccccacaaaaaacuuguguacaaaaguucauaccagcauuauuaauaauggccccaaaaaauaauggccaaguaauccaaaugucugucaacugaugaauggguaaacaaaaugcgauauauccauacaauggaauauuauuuggcaguaaaagaaaugaaguacagauacauguuacaacguggccuugaaaacaucaugcuaagugagaaggaagaagccaagucacgaaagaccgcauauuguaugauucuauuuauguacuauguccauacauaacuguaugauuccauuuaugugguaggcaauuccauagagacagaaggcagauuagugauugcccugggcuggaggcacuacacuuugaaugccaugauaugugaauuauacuucaauaaaguuguuauuuaaaaaaaauaggccaggugcuguggcucaugccuguaaucccaguacuuugggaggccgaggcgggcggaucacgaggucaagagauugagaccauccuagccaacauggugaaaccccagcucuacuaaaaauacaaaaauuagccgggcgugguggcaugcgccuguagucccagcuacucgggaggcugaggcaggagaaucacuugaacccaggagguggagguugcaguugagccgagauugcaccacugcacuccagccuggcaacugagugagacucugucucaagaaaaaaagaaaaaaauaauaauaaggcugggcgcgguggcucaugcuuguaaucccagcacuuugggaggccaaagcgggcagauccaugaggucaggaguuugagaccagccuggccaacauaaugaaaccccaucucuacuaaaaauacaaaaauuagccaggcaugguagcaugugccuguagucccagcuacucgggaggcuaaggcaggagaaucacuugaaaucgggaggcggagguugcagugagcugagaucacgccacugcacuccagccugggcaagagugagacuccaucucaaaaaaaaaaaaaaaaauuguccccauguagacagcaugauauuaugaaguguuuuuggaaaagugcuucauagcuaaagagcagaguguaagaguucguuaguguuucuuaaggaaagcaauggcaaguucucuuacaaauggacaaaauaaucuuguaugucugaagugauaguguacaguacaggaaauguagcuguuacugagcuauaaugggggcuugguucuaccauaucucuacuuuguguuuauguuuguguaugcauguacuccaaagucuuucuaauguugcuuuaauuuccaaaaauguaugcauugcuuuaacaauacaugugaugugucauauuacagauggggucacagugguuauaaagaguuauacccugaagaauuugaaacagacagguaaggaaaauaggcuuacugaaagaaacuaagaugguacaaaaucuguauuauaaauugauuucuuaacuuuuacgaagaauauacuugccaucaaaaauguagcuagagaaacaauaggugauuuaguuaggaggugaucccuguuuucccauucucugguugauguuuggcaugucuguaagcauuuugguuuuuauauauaguauuccauacaguaacucaguauggcagcuuagaauuuuuaccuucauuuuaaagaugaggaaacaaaaacucaaugagaauauuaaaguguuaaaguauacauuaaagugcuuauuuaaaauucagauguuaaccucaauuuuuuaaucuagaaugcaaaauauuaaaauaauacgcuuuuuuuuuacauaaaagcuucuauuuuuuaacuuuucuuauuaguagugaucagcaagauauuaccaacgggaagaaaacaucuccccagguaaagucaucuacccaugaaucccgcaaacacaagaagucaaagaaaucccacaaaaaaaagcagaaaaaaaggucacacaaaaaacagaagaaaagcaaaaaggaagccacagauauaacagcagauuccucgagugaguucucagaagaaacuggggcuucugguacaaggaaagggaaacaaccacauaaacgcaagaaaaaauccaggaaaaagucucucaaaaaaccugcuuuauucuuagaggcagaaaguaacacuucacauucagaugauucagcauccagcaguucugaggaaagugaggaaagagacacuaagaaaaccaaaaggaaaaagagagagaaaaaagcccauaccucuguagccaacaaugaaauacaggagaggacaaacaaacgcacaaauuggaaaguagcuacagaugaaaggucugcugagagcucagaggaugacuaaaugggaaacacuuuuguuuuccacaugacuguggauauuuacaguucuuacuccuugugguuuugccagugacucuuguucagcacggggccugaggucagagcugucuugugccaucuguauguucugacagacgucuugucuucuauuuuggcguuaagcuugauccccuuuucuuguuaaaagggaaucugguauuuuguuaugaagguuucuugaagagauuauuuuuuuuugcaauuaauuacguuuaguguagagugcauauacagcaaauuaaaggacccagaaagcuggauccaauagugaccuggguacaccaaucggaauauugaauuuggggaagucaagggcugggaucaagagguggauuggaacuaaugccauguaggaugguaugacaaggcaacacuguauugcucucuguuuauauagcaggugucacaacuaacuugucuuuagccuuggugcuuugauccuucuauauuuugaccccacaggugugguccgguuuacuuaaucaggacaugggccuaagaacaaaccuuuucccuucaugauaacauccauagacaacuuauuagaagggacuagaguuuuugcaaauuucccugcuggauggggccuauagcuauacuuaguauaugccuaaacaugguaauuggauaguaaaugguuuucuaguuccauugcuguauauuugccuaaauggacuuguguucaaauuauuucuucaauugucauagauaauccuguaccaaauggggaagaauuaggaaauaaucauguugucuaaugguacucuggauucagggcagcaacugccauuuaaauguugucuuguucauuucuaaaucuguucaugaaguuuagguuuucccugaaacuaaguugaauuauuuccaaaaugaaacaggcuucucagggacauauccacuucuucccagucugccuuuggauuaaagcaccaagcagagaccacauuaauucccuuugcuauacugugauccuuaguauguuaauucuuaagaaaccaacauaucacugaaagaaggcuggcagaacgcaagugcauuuuuucacugugggaagaaagaucaagugacguauuauuuuuuccugguugucacuuaaugggcugaguaaaaagcuugaaaacucagacuuucggucuugguucugccacucauugguuaugaggaggcccagagcagguaaguucaccuuccuggccuuacuuuccugauguguaauacggaauuacuucacaguagcaugacaguauaagacaccagcaguagauacaacuaugaugacauuccaugaguugguauuuuuaguucuaacugcuaaauuuguucucuuuacgggacagauuucuaauaaagugcuuggucuuaaaauacaugguuggacagaggugcccuaucccuuaacuaugagcaggugcuaccuuuugggauauuuauuuuaaauuuuaauacuuugguacucaauugucaguguuccaugguguguauuuuuauuuuugggauuagugggggucuaaagggagaagaauagucucuaauuacuaccucuuaaccuaaagcaauuauuuuguuccuggagcaaguuaaaucuuuguuggaaggagcuuuggccauauauuuuuuagcaugcauuguuucugugcccugaaaguaccugaaagguuuuaagcacagacucaggaaaaugugccaguagaacaggccaucuccaggaaauuggcucuauuuggguccugaccuucccuuccucccaaguuagcaggcuuguucuuucgcaaggaauacacaucuugccuuuuuuuuuuuuuuuuugccauguuuuccuuuucuuggucauguauaagcaauaaagcuguuuuuuguucuucaucuuucuuaaccccaaauuuucuucuaugccuuaggcuucgaugguucuuccaacccccuuaauauggcuuagggugguuuuucaaaaccuacaaucccccauuugcacuacuggccauggaacauuuauuucuaguguuccugccaaucagagaucucuauauuaaauucuaaaaugggauuaaaagaagaguuggagaauucacacuuauugaguaacugaugucauacaaccuggaauuucugaauuccaaauaaauaaauuucacucuuugaacauuucaucuuuuacuuuuuagcaccaacagacuugauaacagccugaugcugaucugacaauggguugauagccuucccccacugacccuuaaaucugcuuaguaacaaguccuuugcuucugucauucuccugggggauggccuacugcccuccuuucuguacaaucugggcaaaccgacuggugauggcaagaguggugucaaugaagcggucuacacagcuggagagacaauuuucagugcgagagucuaggcgauucccuggcuucuccacacauuuaucccaacauaacuccaugaagugaugcaccua

SEQ ID NO: 15984 - RNA, 1686 nt, Homo sapiens
aaacaaggcccugagauuuggguuuauucagcuccacccaaaacuaaaccaaggcuaugacaugucccaugggaccaaaccauacauuguggaccaugcaccuuucccuucccccaaggaugcugcuaccucuggaguggugggcagcugcccauaucaccuugggagguagagagggauuugcugggugcugggucuguggcaaucagggcucaacuauggcugccuccuccucuuccucuggaucaggaggcgcagggagcagggagauguagaccucauugaccucuguguccaaaugucggccaccccgaggugcuuccagguuuaagaugccaucaugggagagagcagcucggacucgccaggggucgacaucagcaggcaggacauaggugcggcagaacucucgggacacgaagccguggcgguccaggcgcugggggugccgggcagacaccuccagcagguuauccacaguccucacagucaccucgucugggguaaaguggcucacauccagaaaugccuggaacuugcccucacugagccuaagcucggaggccccugcccugcugcccuccccagcuggggcggcccgaggccggacauaguagccaugguagagugugggggucaggaucucuucuggcaggaggccuaaagggcagagagaaggcaagaggcaggaugagggaggaugaggcuggcacaggggcgaaaugggaaaucuggagaggagggauugggaagagcaagaggggagucaggaggaguagggaacgggagggaggccacacuguagcuaggaggagaaggcagcucggaagaggggaaagagaacggaaagguaagggaggaggaggaggagaaggaggaggagggggaggaggaggaggcaccaaacggccuggguggauagaagggggacaaggaggcacacccaggccggcaaagagcagguaucagcacugcaagcaccaagugugucuugaggucagcaggaaugggaaagaucucugcuuggaggggaugagggguagucuggggugggggguggcuggucccaggagaucaguuaagcccagagugggguggaggccagcaacguugggaggucagcccagaauuucaggggguggggguggggggcaaggggguggugucugugccauaccuucuccgaagcgcugcucacccaggcggcucggguuggcaaauucguacucggcgguggccgggugggcauguggcacugagcggcccgacauggcugcagaugcagcagaagcccugguccgaggugcagccccaacaggcgcagcgcgaccccuccagcugcccggagagccagggcucgauaggaggugggggcggggucgacaccacccaaaauagugccgagccucuuggggggggaggggcugggagugggggcccugagugagagcaacgagggugugaccagcgccgcccggaccccuaguccccucccccgcacacucuucagcugucgcagggggccugagaggacagcugaggguccuggcugggaacgagcuggggagggggagcugguggugccuggggcaugaagaggccucgcugagacccucacaaacgguuugcacguuuccacaccucauuuucuccucuucgguggcaggcacugugcacccaauuccu

SEQ ID NO: 15985 - RNA, 5390 nt, Homo sapiens
ggcagcugcccauaucaccuugggagguagagagggauuugcugggugcugggucuguggcaaucagggcucaacuauggcugccuccuccucuuccucuggaucaggaggcgcagggagcagggagauguagaccucauugaccucuguguccaaaugucggccaccccgaggugcuuccagguuuaagaugccaucaugggagagagcagcucggacucgccaggggucgacaucagcaggcaggacauaggugcggcagaacucucgggacacgaagccguggcgguccaggcgcugggggugccgggcagacaccuccagcagguuauccacaguccucacagucaccucgucugggguaaaguggcucacauccagaaaugccuggaacuugcccucacugagccuaagcucggaggccccugcccugcugcccuccccagcuggggcggcccgaggccggacauaguagccaugguagagugugggggucaggaucucuucuggcaggaggccuaaagggcagagagaaggcaagaggcaggaugagggaggaugaggcuggcacaggggcgaaaugggaaaucuggagaggagggauugggaagagcaagaggggagucaggaggaguagggaacgggagggaggccacacuguagcuaggaggagaaggcagcucggaagaggggaaagagaacggaaagguaagggaggaggaggaggagaaggaggaggagggggaggaggaggaggcaccaaacggccuggguggauagaagggggacaaggaggcacacccaggccggcaaagagcagguaucagcacugcaagcaccaagugugucuugaggucagcaggaaugggaaagaucucugcuuggaggggaugagggguagucuggggugggggguggcuggucccaggagaucaguuaagcccagagugggguggaggccagcaacguugggaggucagcccagaauuucaggggguggggguggggggcaaggggguggugucugugccauaccuucuccgaagcgcugcucacccaggcggcucggguuggcaaauucguacucggcgguggccgggugggcauguggcacugagcggcccgacauggcugcagaugcagcagaagcccugguccgaggugcagccccaacaggcgcagcgcgaccccuccagcugcccggagagccagggcucgauaggaggugggggcggggucgacaccacccaaaauagugccgagccucuuggggggggaggggcugggagugggggcccugagugagagcaacgagggugugaccagcgccgcccggaccccuaguccccucccccgcacacucuucagcugucgcagggggccugagaggacagcugaggguccuggcugggaacgagcuggggagggggagcugguggugccuggggcaugaagaggccucgcugagacccucacaaacgguuugcacguuuccacaccucauuuucuccucuucgguggcaggcacugugcacccaauuccuaaagcacuccuggauuuaauguucugagagccacauagaacgaaagaugcaagaaaucuguuugcucuuuuuucaggggguggggucuuucugcccagaugugggauccucuccuaaacccaggucaacccagggcacgaggcagauggcuggugcugacauguugaccaucacugcucucuuccaaggacucacaaagaguuaaugucccuggggcucagccuaggaagauuccagucccugcccaggcccaagauaguugcuggccugauuccccuggcauucaggacuggaaaggaggaggaggggcacacuacgccggcucccauccuccccccaccccgcgugccugcuugggauuccugacucuguaccagcuucagagaacaggggugggggugggugccauuggguguggacagaaagcuagugaaacaagaccaugacaagucacuggccggcucagacguguuugugucucucuuuucuuagcucagugaguacuggguaugugucacauugccaaaucccggaucacaagucuccaugaacugcuggugagcuaggauaauaaaaccccugacaucaccauuccagaagcuucacaagacugcauauauaaggggcuggcuguagcugcagcugaaggagcugaccagccagcugaccccucacacucaccuagccaccauggacaucgccauccaccaccccuggauccgccgccccuucuuuccuuuccacucccccagccgccucuuugaccaguucuucggagagcaccuguuggagucugaucuuuucccgacgucuacuucccugagucccuucuaccuucggccacccuccuuccugcgggcacccagcugguuugacacuggacucucagaggugagucuccccacagcuaggacgggagaguccuuacuggaaccuccuggaaacuucuccauccauuuuccuuuccuacccugccuaaaccauuuuaggcacauguguguccaaaugugaagaaaaaugaggagguugcuagugccuuccucccccaucaccuguuucuauuugauaguccucuguaucccauuuauuacauuuuuucaugcacugucaaguuuauccuccguccccuaacuucucuacaggauaccccuuucugguuugguucaugacaaucugcagggaaagagcugccuucaaacuccuuugcuuaucucuuccaacaccuuggacucuugaccgauuuuaccaucucagguuucagagccaggagagagcccugccucauccugagcuguucauccccauggguauuuucugccuuucuauucccucuucuaugauuuucuggguuucucagggcuacgacagggcgcuggccuggguccaaucaagcccuacgaggaaacaauauagggacgcccauuuguccuaagaggguggaagaacagggugaacaaauaagguugacagagcugucacagauaacacucugguuuaaaaauauucaagugugaguaaacaggagcugagugggcaagggcuuuggaaggacaagcaggaccagcagaacauuccagauuggguggguggaaaacuggcaaagagaccugagccagaagaagaggccuuugucucacagacaaaccacaaagccaggcauuggagucagagaggcagcagaugccaggcuugcacccauccuugcgacugguccccugggugaucugucuucuucucugucccuguaaauaaaguuugggucugaucaccaugagccuuagguaucacugugguggcucccugaagcagacagcuauguuuauuuaaaaaggagauuuuuuaagcagagaagagaaggaugaauuacccggacagaaagcagcucugcagaauaagacagcaccuguguaaucaguauuuuugcccucuuucucccaucccauucccuuaccuugcuauuucuagaugcgccuggagaaggacagguucucugucaaccuggaugugaagcacuucuccccagaggaacucaaaguuaagguguugggagaugugauugaggugcauggaaaacaugaagagcgccagguauguagcuuguuuuuuuguuuucugcucauucauucagugcauacuguaauaguccagguagugcuaucagcuuuggaggcuggcuacauuccagucccaagccauaacagucgggaucagggguuacaaaucaaugucuagaagacuaaguuaggauagacauauugcuguuguuacuauuauggccagagauguggccuuugauuugaucgccuuagaugggaugaugggaugcugaugccccauuuaagccagugguucugaaucugggccacauuagaaucaccaggggaacuuucaaaaaaccuaaugcucgggcauacuccagaccaauuagcauaugugcugccgaagcgagcacuacuccagaccaauuaaaucagcauuuuuaagggugggacccaggcaucagcaauuuuuaagguaauucuaaucuacagucaagguugagaaccacugauuagguauagggcugucagacaccuaguugcuuugcauaauuacauuaacuacagguacccuaaaagcacuugaguugugacuucucuuuuagcugugcaagaauccgugucucuucuuuagcccaucuuaaugcugaacuacuugguuugucuaaauuucagagcugugcucagucuuuaauccccuacagcccaugugguaaucaguuaacgagagccuguuuggcuacaugcuugagagucagcaggcauacggguuaaggucaucuacucuuugggggaguucugacaaauggaacagcuuguuaugacuuuauaagagggcuuuaaaauugcuucucaccauuuaacgauagcucagaaccugugcgucaaccaguacaguuuguccucaguaauguccucaggcuguuucaauuuugcuuauaugauuuagguuugggucauagucuccuuggauggagucauuuuuuuuuuuuuuuaauuucagcagcaguccuauuguucuggaaccuucugggacauuccugaagagucaggacaauuucagggcuuccucagggacucagauucuaaaugagauuccaaauucuguaggcccagccaacauugaucuaaaccuuugggaaauaccccuaaacauaucuaugccucaggguuugaaaaacaaugaaguguuggacuguuucagacuucucagauucucacugguaggagugacuaccuaggcaauuucaucuuagcugcaacccugaaacgaagcucuauuuauuuuuccuauguugucauggcauuuggucucaccuaaggggaaaucaggaugccugaguucugggcaggugauaauaguuccuguucuuaucucucugccucuuuccucauucuuuuggguuaggaugaacaugguuucaucuccagggaguuccacaggaaauaccggaucccagcugauguagacccucucaccauuacuucaucccugucaucugaugggguccucacugugaauggaccaaggaaacaggucucuggcccugagcgcaccauucccaucacccgugaagagaagccugcugucaccgcagcccccaagaaauagaugcccuuucuugaauugcauuuuuuaaaacaagaaaguuuccccaccagugaaugaaagucuugugacuagugcugaagcuuauuaaugcuaagggcaggcccaaauuaucaagcuaauaaaauaucauucagcaacagauaacugucuuguguuugaauauuccacacacuuuuaaauaaauauacagauacc

SEQ ID NO: 15986 - RNA, 4737 nt, Homo sapiens
uaaaacgagcgccacagagaacgcgagccgggaguccguggaggccauggccccucggcgccuccuguugguuggggaggggaauuucuccuucgccgccgcucugagcgaaacccuggaucagagcacucaacuuaccgccaccugccuccagcgcccggccgaguuggcucgggauccacuggccugggagaaucugcagugccugcgcgagcgagguagcgagcccgccccucugcgaaaccccgcccagcggccggcgcgucccaaaguggaaagggugggggcguggggauguaacccacguggagauuguucuugaucgucccacggauauucacauaaagccggcuuugugcccagacuugggcuggucugcacgguuuaaguuaggaagaguuuuucuguuccaugucuugaggcauccuccugucuauauuuugcgcccccaaacuaucuuugccagguaucgauguacguuucgguguggacugcacccagcuggcagaugucuuugaacugcacgagagagaauuugaucaaauuuauuucaucuucccgcauuguggacgcaaagcuggcguagcuaagaacagggaacugcuugccaaauuuuuccaaaggugaggaaaggagcgcccucacaaggaaaauguuuaagauguccauaacauaguuacuguacccaaacauaaggcacacgugcaagcuacuaugauauguuuagaagagacuauaaagccccaaaggaaccccaaguuuaguuggaaagacagauauauaaacccuaaaugcuaaaugaaaguacaaauaauguacucuuggguguguaaaagaggaucauuuauuuuugacagugcaaaauaaugagagccauauagucuaauggcuaagaacgugcacuuagaagccagacugccuggauucaaaucccagcccaccacuuaacaguuguuauuuuuuuauuuuuauuuauuuuuauuuuuugagacagagucucgcccugucgcccaggcuggagugcagugguguggugcaaucucggcucacugcaagcuccgccuacuggguucacgccauucuccugccucagccucccaaguagcugggaguacaggcgcccgccaccacgcccagcuaauuuuuuguauuuuuaguagagaugggguuucaccguguuagccaggauggugucgaucuccugaccuugugauccgccugccuuggccuccuaaagugcugggauuacaggcaugagccaccacgcccggccaacaguuguuauuuuaagcaagcuuacuuaaucuuuacaugcuuccguuuccucaacuguaaacuagggauauuaauaguaacuaacugggccaggcgugguggcucaugccuguaaucccagcaguuugggaggccgaggugagcagaucaccugaggucaggaguuugagaccagccuggccaaaguggcaaaaccccgccucuacuaaaaauauaaaaauuagcuggccgugcuggcacgugccuguagucccagguacuugggaggcugaggcaggagaaucgcuugaacuugggagguggagguugcagugagcugagaucgugccacugcacuccagccugggcgacagagcaagacuccaucucaaaaaaaaaaaaaaaaaaaaaaguaacuaacagccucauaaaauuauugugaacugaaaacagugcuuuacaugauuauaccacaagacaugauacuauuggagguguccgauggggcauagcugucaauaaaguuuugacagaggugguauuuuaaacuaguauuugaauuucaggagggcagugaaaagaacuuucuaaaugggaagaaacagccuaagcaaugaaucauauauaggaacugugcagauauugaucuuucugugacauaugcaugaaugacacaaaugcaaagcagacccuggucagccaaucuuaucagugaguggguugaacauuuaauuuaugcuucuauuuacuuccagcuacuuucuuugcauuuuuugaggucuaauagauuuuugcacauagguaugauuggauuuuaauuauuucacaggcaaaccauguguauguugccaacuccugugguaauuucugcuuguuuaugauaauuaguuaguguuucuuuucucccuauuagcugugcagacguucuugcagaggaaggagaaguccacguggcauuauguagaggacaagguggaacuccugcggauaagccccagagagaauggcacaacaguuggcaagugguugccauggcagcccugggggggcucauuuuaagcgacguguauccauucagcuguaaggcuguggcaggguacaagugcacuggauauagguagguaauagcauagguuuaagccuucugcguuuucaucucucucacuaaugauaacaaaaucucauagacagacucaauaggcccugccaauuaauugauucggucucuaaaaauacuugcuuauuuuaauaaugacagacuucauauuggugucuauuuugccaggagucaagauaaguccuuucauguagaaggugcuuugaaccauaucuucaccaggagcuuaccuuuugaagguucucaacccagaaucuucaggaucaaacuggguaaccagugguuuuccuuuccagaaccagaagcacuuguaggaaaguugaacagguaaccaguuauuuugcuggaaaucacuuccaucuccaguuguauccugauugucuugauggcaaccauauauugaauggauggugcauaaauuguuagugauguuggugcuauguuuauuugucagccuggccuccuuaagcaucucuagaauuauaaauggucacauuuucugauauauuguagggaugguggcugucagaguucugaaauacacgucuguuucuccuuaugguagaugauuucuuuguuuccuuucaagaucaauuuaaagauaauucuuuucuguccagcuauuuguauuuuuaauucuagcuacauuauaauuauuuacuaucuuaaguuagaaaaguuauuuuuguguguguuuaaacagggguuuccuggaagcaccuucaugucauccuaucaaaaccauaaaugagaaacucauugcugaauuaggcaaaguuuucccgcuaaaaaggcugaaguguuccuacccuuugcugccacaggaagguaccaguguucuuccuuucuggaauugugacuuucugucagcugcuuuuuggauuagucuccaugaagauaacucaaauucugagucccugacuggugggacaucacaagauguggaagacuuucuagugucauuuucagaacuuagccuucucaagaauccuggaagagaugguaaagaagaagcuugugaaggaaccuguggccaggccaagaucugccuuagaccuucucuccuagugcauguucaggaugucaucgaaguaccagacuuccucucagguucucugcacauccucaguggaccugucuuucagaagugccacauuuugccuuucacaaugccagcauuucaugaaacuuuauuuauccuugggguuaaucaaaaucugaaggauggcugucuucaaucacugcuggaucaucugaagggcauucuagauagccugcugacccagacauugccggagagcucuaagcugagcaguuuagucaaauuuguccuucagucaaauggaaaggauuauaugauucgugugaagacucauaauuuuagcccagauuguacugaggaucuaauuauugggucuguuaucacaucugccacuaguguuauacauaaagaccaguguuuuguguuugugucuaugaacuuggacuuauuagccaugcuugucugguguaucucugacuggagaauguuguggacguuugauaaccguuuccugaaaaauuuugucccuggcaaaauagaacccuuuaaaagucauucucuguauccuccauguuaugugcaugauguuaguuuuuggauagaucagaagaaaggauuugaugaacuagaguuucacacuguggcccgagcagugucucaggacacuauuauauccauacaguuucuuagccguuuccagcauccaaagacucaacaggucagucucugcuauagauugaccuaccagaccugugacaaggcccucacccagcagcaaguagcaucaaugcagucccaguuuaggaaggagauucaacaacaccuauauguuauaccucgguaguuugguaaauccuuuucugcagugugauccuucauugcgggggauguggaggaaaauuaccaacuugcaaccaguaguccuuucuggauuuuuguuuuuguaaaaucuuuuacuuugugaccauagcuacuguucguugaucuuuuuuuuuuuuuuuuuuugagacggagucuugcucugccgcccaggcgggagugcaguggcaguggcaugauaucagcucacuauaagcuccaccucccagguucaugccauucuccugccucagccucccgaguagcugggacuacaggcaccugccaccacgccuggcuaauuuuuuuuuuuguauuuuuaguagagacgagguuucaccguguuagccaggauggucucaaucucccggccucgugaucugccugcgucggccucccaaagugcugggauuauagaugugagccaccgcgcccggccuacuguuaguugaucuuaaagauaccu

SEQ ID NO: 15987 - RNA, 1314 nt, Homo sapiens
ugcuucauaaagacccugugucagucauuaaugauuaaauuaaaacuuguuuuuuaaguguugacuuuagccuuugccuuuuacguuugaaauaguuuuauagauaaagauauguuugaggguuacuccggaacaaaguauuucucccauaguguguucucagugccauauauuacauuucauucuuuuucucuacaccugauaauuugcuuuauuugauaagucucucugcccacauaguaauugacaauaagcauuggcacuucucugguuuuuugaugauaugaccauuugguugugaauuucacugcuaacaguuggugaaaugggucaagagacaucuaauuauaaauuucucaaugauuuuggacugacuugugaccucugccucugugcucccugguugagguuuuagcagaaauauuuuuucuucaagagaaauguuuuucacaugauuuuccuggcuuguuuguuucaaguacauuuagcaauauuaucccccuguguuuuucuuauucuccuuguguuucugacaguuggcagcuucaguucauuccaucagaguucagaggucaguuaccaaaaccuuuugcagaaggaccucuggccacccggauuguuccuacugacaugaaugaccagaaucuagaagagccauccagauauguaagggcuacauucucuucuugcuucucugaaaagaauucuaugccuaaaagucuguugguguguauauuagagcauugauaaaaugagaauuucuuagaaagcaauuuuuuuaaggccgggugcuguggcucacaccuguaaucccagcacuuugggagacgggcgggauaauugcuugaauucagaaguucgagaccagccugggcaacauagcaagaucacauuucuacaaaaaauuaaaaaauaagccaggugugguggcuuaugccuguaaucccagccuuucagaaggcugaggcaggaggaucacuugagccucggaguucaaggcugcaguaggccaugauuccgcuacugcacuccagccugggcaacagagugagacccugucucagaaaaaaaccggauauuuuuuaggaugagggguauaacagcuuuuguugaaaaacaguaaacaguaucacuuuuauuuucaaauuaaccucuuuauuuucuauguaaaauguauaauuuaauuuugaagguuuuggguaggcugaaaguuuucuuacgguagaaguuugaaccauuauucugaaacucauaucauuccuuggccuauuaaaauccuuaaugaggaacuuucaaguuaucagguggaccuuu

SEQ ID NO: 15988 - RNA, 1314 nt, Homo sapiens
aaagguccaccugauaacuugaaaguuccucauuaaggauuuuaauaggccaaggaaugauaugaguuucagaauaaugguucaaacuucuaccguaagaaaacuuucagccuacccaaaaccuucaaaauuaaauuauacauuuuacauagaaaauaaagagguuaauuugaaaauaaaagugauacuguuuacuguuuuucaacaaaagcuguuauaccccucauccuaaaaaauauccgguuuuuuucugagacagggucucacucuguugcccaggcuggagugcaguagcggaaucauggccuacugcagccuugaacuccgaggcucaagugauccuccugccucagccuucugaaaggcugggauuacaggcauaagccaccacaccuggcuuauuuuuuaauuuuuuguagaaaugugaucuugcuauguugcccaggcuggucucgaacuucugaauucaagcaauuaucccgcccgucucccaaagugcugggauuacaggugugagccacagcacccggccuuaaaaaaauugcuuucuaagaaauucucauuuuaucaaugcucuaauauacacaccaacagacuuuuaggcauagaauucuuuucagagaagcaagaagagaauguagcccuuacauaucuggauggcucuucuagauucuggucauucaugucaguaggaacaauccggguggccagagguccuucugcaaaagguuuugguaacugaccucugaacucugauggaaugaacugaagcugccaacugucagaaacacaaggagaauaagaaaaacacagggggauaauauugcuaaauguacuugaaacaaacaagccaggaaaaucaugugaaaaacauuucucuugaagaaaaaauauuucugcuaaaaccucaaccagggagcacagaggcagaggucacaagucaguccaaaaucauugagaaauuuauaauuagaugucucuugacccauuucaccaacuguuagcagugaaauucacaaccaaauggucauaucaucaaaaaaccagagaagugccaaugcuuauugucaauuacuaugugggcagagagacuuaucaaauaaagcaaauuaucagguguagagaaaaagaaugaaauguaauauauggcacugagaacacacuaugggagaaauacuuuguuccggaguaacccucaaacauaucuuuaucuauaaaacuauuucaaacguaaaaggcaaaggcuaaagucaacacuuaaaaaacaaguuuuaauuuaaucauuaaugacugacacagggucuuuaugaagca

SEQ ID NO: 15989 - RNA, 57959 nt, Homo sapiens
aguaccauuacugaaccagucugcacgguaggcaucugcuaccaaaauuuaccuccuaccugguaggugucaucugauaagaaagaagacagguuauuuuaauuuuuugagauaaucacagaaaauugcagcccauacucuuuauuaccgaauucaaguuuggaaauagacccuuuguuuuaaaucaugaugggucuuuaucccaaucauuuaucugggucauuuuuccaacuuuggaguucuaggaaagaaccuugaaaaccugauaugauucugcagcaugaggucuacggugaccauuugggcaaagcuccaguggcaaucauuuauuguguuuugcauuuccugggauuuauugaaauaagaauucacugugauuauguagucuucuggcuaguaucaggcagcucugcuuuuaauuugguuaauuuuauuuucucugaagagggagaagagguacaauuuaaucuuggccuccacaagcauauuaaagcucacguguuaaucagugcauucuuaugcuccuacauuaaaugccuuggguaaauggauaaauggacaugugcccagcuuuaauuuuuuuugcaacagaaagaucagacuuccguauggcaucguuggauuucagaggcuuucugguguaucuguaaaucugaauguugccuucugccagucuguauaaccaggugauucaugcugcaaaugaaaucaggaagcaguaaaguguuaaagcaagaguauuguccaauucacuugucuuccugauccuuguacuuuauuucacgugucgguguuuacauuacauacuuauauuuccugugaaagaaagaguuaaauaaauuguagcaguuugauuuucuuuuucuuaaugugacauuuucucuuuugcuuuuaaaucuuucuuggaaauuggaaacugaaggagcucaaguccuuucucccugacuccagcccuauuccucaguguggagaccugccuucuacaggccaaauaucccagaauguuuauucugaaaacuuuagaagaagacuuugggaaacccagugaggauuaguuuuauuuuaacuauguuaaaaccacgcacaguaggaauuaauauaugggccaggcguaguggcucacgccuguuaucacagcacugugggaugccgagacggguggaucauuugaggucaggaguucgagaccagccugaccaacauggugaaaccacgucucuacuaaaaauacaaaauagcugggcguaguggcgcaugccuguaaucccagcuacuugggaggcugaggcaggagaaucacuugaaccugggagguggagguugcagugagccaagauugcaccauuccacuccagccugggcaacaagagugagacuccaucuaaaaaaaaaauaauaaaaaaugaauaaaaauuaaaaggaauuacucaauacaugaacauuguaccuaaaagagaugaaguccuggauccaucuuaaguuuuuggaaugagaaucacuggacugugagagucuaauuuucuuagaaauccuaauccaguuauaucuaacacuuagguaauuucccccuuuguugggguugucagaaggaauaaauuuuuuuuaauuuuuauauuuuagaaauggcauguguuacauuguucaggcuggccuuaaacaacaaacaguccuccugccucaaccucuuaaguagcuaggacuacaggcaugcaccacugcacccagcuggaauaaauuuuuuuuuguaaaugaauuccuaauguccuuguuaugccauggacuuuauacccuauaacuucuagcagccaucugguguugugccguugguuauuauuauucuuccuauaggaccccagaugcccuuaacuugguuugauuuauuucucccaaauuguuugaagaaaggaugcuuuuauuaguguaauuccaggaaggagaaguccacaacuuuaauuuauuuucccuugucuagaaugucaucuuucucccuauuuguuacuguuacuuuuagggcugagucuccuuuuucuaagaaggcuuucuagacuucagacucuuugauuacauucuuuucugagccuucuugauuacccaguguccuuaauaauggcauagaaccguaacauauaaaccaugcgacccugucucgcaaggccauuguuggcauaugaggggcaaagaccacaucacacugcuauguauucccggugcucagcgugguucccugaacauuuugguacuguauauuuuuauugacaaugaagaaagaaaagcaaaaagagaccugggacuaauguacaaacuguugcucucaacuuggcauggauuagaccauagaaaauauggcaaguuggccggacaugguggcucaugcuuguaauuccaacacuuugggaggcugaggcgggcagaucacuugaggucaagaguucgagaccagccuggccuacacggugaaacccccaucucuacaaaaauacaaaaauuagcugggcaugauggugggugccuguaaucccagcuacuugggaggcugagacaugagaaucgcuugaacccaggagguggagguugcagugagccaagaucacgccacugcacucuaaccugggugacggagcaagacucugucucaaaaaaaacaaaaaacaaaacaaaaaaaaaaacggcaaauuauaaauccugccuguaguacucaaaaagggcaauuuggaagauaugaauguuuauauuucgccaauucuccugaaauacaagugcuucuuuacaaaagcauuuuagaaggguagcuucuaaaaagagagaaaggguaccuuuauugaauauuccuauugugacuugcuuuuagagggucggaccuagcccaggaggccuucugaacaaguuugggucagaaagccucuccuccaggugugaggaggugaucgggcccuaccagcuacauguccugcuaggaaaaggaagucuggcugcaagaugaccguagccauacaucagauugaauaauauuaaguagcaagggauauuuuaaaacugaaagcuguuuuggcucucuucagcuguggauucagcauagaccugacauuuaaacaaaugauaaccaacacgugagaaauauaauguaggaaauuuagauuagggaugugagauuauggaauuguagugacaaggaaagacugggaauuuccaguuguagguugguagaauaaauagucuguuaaaauuaacaauuggguuuaaauaacauuuuaccugaguaugagcuuuuuuuucccuuuuuuucagugaauucucauaaaauacuuuaggugguagggcuuuuuguuuguuuuugguuuugccucugguuucugggcuuguucugucauuacaugccuagagaugaaaguauguaaguuggcuggaugagggggcucacaccuguaaucccaacacuuugggaggcugaggugggaggaucguuugaguccaggaguuugaaaucagccugggcaauaaagcuugaccccaccccgccucuauauguaaaaauauacauauauaauuaaaagaaagaaaaguauauaaaugaggcaacuucuugguggucccaacagccaaaagauugggugauuugugacaaacuuccucugacaaggguuuuuugcagaccuucagccauggauuucaggcauacucgccuuacaagagcucucuugaccuucacucucgcacaaacuguauuugacaaguggugcccuuggccuuugacugaucaucuuaacucgggaauugcaaguugccaaaugagaagggcgugcguuuuugguugauugguuagcugcuucaacagccugguacccacugcugaagaagcugugaccuguaaagcagcaguucuccaauggagcuacacgagacagaaucuggggaucauuaaaaaauuugccacuauuggccggccgcgguggcucacaccuguaaucccaacacuuugggaggcuguggugggcggaucaccugaggucgggaguucgagaccagccugaccaacauggagaaacccugucucuacuaaaaauacaaaauuagucgggcgugguggcgcaugccuguaaucccagcuacucaguaggcugaggcaggagaaucgcuugaaucugggaggcggagguugcggcgaaccaagguagcauccuugcacuccagccugggcaacaagagcgaaacucugucucaaaaaaaaaaaaaaagaaaagaaaagaaaauugccacuaucugguugaccacccaggaauucugaguuuguggucgagggugggcccaggcauccauuauguuuuuuuuuaaacucuccaggugaucuagcuaacagguagcuagaguugaacaccacugcucuggauaaagacugagagacuaacaaucacaccaaaaaaucaaagguaauuaaacaggcaacauauuugguguccuuuucuaauugugacuccugguuacccaggccuucaucuaggccucuuccccaccacagaccuauuucucugucuacuccagcccaucaaaccuuaccugcccucucucccauucccucugggcccugcuuucugggaaacaauuaacuaauaugauacugaaguacgcuaauggauguuaauaauuaacuguaguucucuucccauugauccucucaucucaguacacugaaugacaacucaucuggaaaaaaagaaugaaugacuauaauuuuggcaauugcagaccuauucagugucauuugauugaaugauugaucaggugguagaagaggcuugagcaggccgacuugcccuucaggaauacugccuggccuucagauucaaccuuauugcuugacacuacuuggccugcucagguaaggaccuauggcugccuugaguagaacaauggguguaaaaaaaaaagaaggugugaauauuaagcccuucuacucaacgcacuggggaagccugcuuuguuuggcuuuaaaauauaaguagcucuguuuauuugacagaagcacaguaaagacccuauuuuaccuuuguuagucugcuucuggucuuugcagagagagcuucucuugagcugcugccacugcccucagacacgagagcaaagguuaaucucauuuggggagaaaugacgugaaauguguucacucaaccaacaacaagauaccauguaccauucaggaguuggucucaccucuuucuugucucccuguuacugugucucuaagccucccugguauuuccuauaaugugcucccauuuuuuccuugccagugaaauauuuguggagguauguagaaaagaaggcuguuuuuucagugcuacauguaugaaagaauguuauggauucuuuaaaacucaccccuuuccuugcauuuuuuuuuuauauuuguguucucauagucugugauuacugggaauauucuagaaaacagcaccaaaguguaaauuuauugccaaaguuuucuuguuuuguuuuuguuuuacucccaaguaucacugucucugacagcuuaaggcaaccuugucugccaugcugucauaagucuucccuaauguccagcagagggcauccuauucucacuaaaaucucagcccuccuuucccuccagcaauuuaguucaugucaguuuuugauguaauuccaguguaaguugaaauaucuucauugcauuucuuuagaaucuguauuucugcauugcacucuuguauugcuauaauugcaaaaauuuccuggagaaaauuauguccguaacuaaccaaggggugaauuguccaucacagcagugacucccuacuggucgaggauucuuaagucaauucucagcuaauuucaguucuguuuggcaugacuaugaugguguucauagguaacauaaaauguguuuaguugggaggaggaagcagcuacucuuaguggcaauuaccagccaucugcccauuuucaggguuccaaauaugagcaaaccacaucacauacaaaguccuaacuuuaccucugguaauuuauugauagugccaaaagcaacucaaaagauuuuucaaaguccaagguucuguccuucagaugcuaauucauuauccauggcacaguaacucaagggaaaguagaagcauuuagcagggccugagcccaguaaagugaaaggccuuagaauaccuuuacuccccaugccuaggccauggguugaaaagcacacauuuacagaaggaaguagaauuugcauuuugaaaguguaggguaaccaccuagaccagauuugggccuugaggaacgaacaaggucagcucugccagauauagaaggggauucuauucuucaugauuguuaacuccugauacccuccuuugagcucaaucuuagaaauaugugggacuguacugguuuuagguuuaggaggguauuuuguuuguugguuugguuuuuguuuuguuuuguuuuuguuuuuugagauagagucucgcucuguugcccagguuggagugcgguagcaugaucuggucucacugcaagcuccaccuccuggguucaagcgauucuccugccucagccuccugaguagcugggauuacagguacgccaccacgccuggcuaacuuuuguauuuuuaguggagaugguguuucaccauguuggccaggcuggucucaaacuccugaccucuggugaucugcccgccucagccucccaaagugcugggauuauaggcgugaaccacuauguccagccuugguuuuuguuuuuuuaauacacccucuagauugucagauuugcucuguggaggaaucaugaauaauagcuaacauauuaaacuuuacuauaugucaagauuuuuauuuuuauuuauuuuuuguuauuuauuuauuuauuuugcagugagccucaaacuucugggccaagugauccucccaccuaggcuccuggauggcugggaaaugcaggugucugcaccacgccccacuuacgucaggaaugcuuuaaguugcuuuuuucucacauagucgucacaacaaccuuaugaagucaauaacuauuauuaaccuccuuuuauagauggggaaacugaugcuuggagauauuauuaagugucuugcccaagaucaccuagguagaaaaugguagaccugcaauucaaacccaagcagucugacgccugagccgcucuuuuaaccgugacuuauagucccuauuucauaaccucuuugaagucuacagucuuuuuuggaugauauguugggggaaccuagacggagucaguaggcagagaugagaacaggauguagucaaaguuguuucacuuuaugaaaaauaaguuauuuauuuauuuagagauggggucucacuauguugcccaggcuggccucaaacucccgggcuuaagugauccucccgccucagccuccugaguagcugggacuacaggcacuuguuucaguuuuuuaucaccuucuuaguccacuuccaguaaccacagccuggagaguguccuaguagaacaguaugcagcugguacaugaaguguuuguaggggcuuuucuagaacacugggggccuccagcuaauuuuaaccacauagcuaaaucagagagggaguugauuuccugaaauccuagaaguuaguggaaauuccaguuucugauuacagucccagcuggauuucugccgaaaugugacuuucguguccaggggaucuuggcacuggucccuucuuacuccugugacuuuucuccuaccaguucugcugaguagaucagaaaaggaaguggggaagaauaccaucuucaggggagaccaagggcaaaagcuuucaggggaacaggaauauuuuaaguuggcccugcuguugcuaaaucaaaccucugucuaguuggauccugggggcagugugccuagcugcugaaaucuacuauuuauguuggccaggucuaguacaagacaugaugauaaguggccgggcgugguggcucaugccuguaaucccagcacuuugagaggcugaguggagaggacugccugagcccaggaguucaagaccaaccugggcaacauggugagacccugucucuuuauuuuuuuucuuuuaaaaaacgacauggugauaagaggccuacaaaaaugagagacaauaaagaaaucuggacucuacccuguggauauagcagagauacacagggaauagcugggcaggaguuacuuaucauacacaucuauggaugccacaggaaagacagccagggccaggcagagagcacagucuguaguaugguaaaccaagaacuaaaagguuugcuuguuucaauagguaauaaucuucaugguucaaaauucaaaaagccuaaaugcauugugguauucuggagugaguccugcaauagaaaaaggauauuaguggaaaaaugggugaaauuuaaguaaaaucuggaguuuagacaaaguacaaauggauaugcugcacacugaaaaaauucccuuccaucucuguuccccaggcacccuguuaccuugccauaaacaaccaaacguuauucaucacauguguccuucuagaguuuuuugguacauauacaagcacgugugugcauucuauuuuacacaaaugguaagauacuauguacacuauucuggcccuugccuuuuuguuuguuuuguuuuguuuuuuggagacggaguuucacucuuguugcccaggcuggagugcaauggugcaaucucggcucaccgcaaucugugccuccuggguucaagcaauucuccugccucagccucccaaguagcugggauuacaggcaugcgccaccacgccuggcuaauuucauauuuuuaguagagaugggguuucuucauguuggucaggcuggucucaaacucccgaccuuaggugaucugccugccucggccuccuagagugcuggaaugagccauggcgcccggccuccgugcugcuuuuuuuuuuuuuuuuuuuuuuuuaauaagauauggcuugguaugguggcucaugccuguaaucccagcacuuugggaggccgagaugggcugauugcuugacaagcccaggaguuuaagaccagccugggcaauguggccaaacccugucucuacaaaaaaaauacaaaaauuagccaggcauggugacauacacuugucaucccaacuacuugggaggcuaaggugggaggaucaccugagcccaggagaucgaggcugcagcgagccgugaucaugcuacugcacuccagacuggguaacagaaugagacccugucucaaaaaaaaaaaaaagcaaaaacaaaagaugauuuucguauuagccauuuaggagcuaugcuuuuucacuuaacaccauaacaaaacauuuuuuuccgagugguauauaggccccuggcaagauaauggggguucuggccugagaacacuggagcccuuuaauaggacucaaaggccuaaggcuuuugagaaaggucacugugccuguuuaucuucagguuuuccguagcuuaaaucuacccuugugacgcccauaaucccagcacuuugggaggcgaaggcaggcgaaucaccugaguucaggaguuugagagcagccuggcgaacauggugaaaccccgucucuacuaaaaauacaaaaauuagccaggcaugguggcacaugccuguagucccagcuacuugggaggcugaggcagaagaaucacuuggacccgggagguggaaguugcagugagcugagauugccccauuguacuacagccugggcaacaaagcaagacucagucucaggaaacaaaaaaaaaaucuaccauuguggcuaaaggagauacuaauccugacugcuguucuuagagaacuggggccuguacaccuugaacauagucuccagauguacucucuuguguuuggcaugggcaucagauucagugagcccuuuguaauaaauaauacaacuucuguauuuuuuuuuuuuuaaguagagagggaguuucacuauguuagccaggauggucucgaucuccugaccucgugauccgccugccucggccucccagagugcugagauuacaggcgugagccaccgcacccggccuaaauaacacaacuucuaacaucugcauggugcuuuccacuaacaaagcaccuuucaucaugacucucacuccucacaagucugagagguaaaagcucuauuuuaccgaugaaaaaaaucuucuggaacagguauucugacucuguaagucauguaccucuuucauucuuucauguggguccuuucuguugccaaaguucaauugauugcaauauuuuccuauuugcucccacuuccucaguagauaaaaacuguuaauggauaguauuugagugcuuucucuugccaggcacuaccuaugcacuuuauaugaauuauuuaaucuuuuuaacaaccacaugagguaagcucaacagccccaccguauaaauguagaaaccaagauucagagaggauagguuauuugcccaaagucacacagcuaguaauugguagaggugggauuucaaucuacaucuuccugacuccagaguauacucuccuaaccauuguauguacuauugugaaagguaacugaguguccucuuucuuuuucuuuuuucuugcuauauugcccaggcuggagugcaguggugcaaucauggcuaacugcagccucugccucccaggcucaagcgauucucccaccucacccucccaaauaacugguacuacagucaggcaccucugugcccggcuaauuuuuguauuuuuuguagagaugagguuuuaccauguugccuaggcuggucucaaacuccugagcuccagagaucugcccaccuggacuucccaaagugcugggauuacaggcaugagccaccucaccaccuugcccggcuguccuauuucuuugauuugcucuucccaagaauucaagcaaaguuugccuuggaaauccaauaccuuuguuauauguggugaugagcuguagaacagagguaggagauggaggagggaguagcaauaaucccugauuaugaguucugcaccugcuucugauuuauugggacaucagguaaagucccuuucucuuuguugggguauucccacccauaaaaaugagauuaaaaauuugccaugaagaaaacacagaagaaaaagaaggcuaaaauauugagcugaaauugaagggaaaauauuugaguuccacagaauggugacauacuuugcauaaauacaaauuuaaaauaucauuaaugcuauggugauaaucacuacuuugcgaugaauuaaguacagcccucggaaucaguuuaccagggucaucuugccaaaugaagacaguuggaaaaugcuuccgugugccucagguuucccgccccugucauccaccacucccuugaugucccuuucagggggacaacagucugaaucugcccugagacacuuacaggucuccuacacuuggccuucucacacaguggggugacuguggagcagaucagcauuugaaugagaaccuauuuguaaagcucuuuggcuguaagggagacgcaaguuuaguaaacuugaggcaaggggccagagaagaugacagugaugucacuucgauccucaugacugaugcuuuucuuuuucccaguggcgcuaucucggcucaccacaacaucugccuccuggguucaagcgauucuccugccucagccuccugaguaucugggauuacaggcaugcaccaccacaccuggcuaauuuuugcauuuuuaguagagacaggguuucacuauguuggccaggcuggccucaaacuccugaccucaggugauccacccuccucggccucccacagugcugggauuacaggcaugagccaccacgcccggccaaugacugaugguuuucugaugugacuuugagagcuguuaaugugagcaagaguugauggccgucgaucccaucugccuguacuuccuauauucuugaugcuuugucuuauaggaaccgggcaaaucuaacucagucuuccuuugauccacacuggaugagugaacugcaugugggugucagaacucagugcuuuuguacugaggcugucaccuuguuaccugagggcugccuuaaauccucaaccuaaucucagcuguugccucuggcauucccugguuauuaguuucuuguggggugugugugggaaguggagaggagaccugagggaggaauagagacaggauauggaaauaccucagugccacaguacuguauugguagugcuuggcuaaauuccagaaguccagcaaaagagggacaauccuuuuuauuuuauuuauuuauuuuuuagagacagggucuggcucuauucccaggcuggaauguagugaugugaucauagcucacuguagccucgaacaccugggcucaagugaucaucucaccucagccuccuaagcagcugggccuacaggugugccagcggacucugcuauuuucuuucuuuuucuuuuuuuuuucugguagagacagggucuugcuuuguugcucaggcugugggaccaucuuuugaaucuggcaaaacccacagccuauagauucagaauugcuuauugauaagucauuugauuucuucuggacacggguggccuccaaagacuuucagacucuaccugagcagaugcuuguuuauugacauggaaauuacuuuuccagaugaacuuuuaaaaucaaugguuuucaaguaucaaugcacacuagaaucacccaguggacacuguaaaccaucuggccccauucuuaaggacucuaauucaguaggucuggguuggaggccagaaaucugcauuuuuaacaggcaucuuaagugauucagacggucagccucagaauuuggcucagguuuugaacuagccuuuuuuucugcugcagucuguuuuaaucaccuucauugaaggauuuauuagcaucuccauguuuauuaccuguuucauucucauagcaucacagcaacucaagcaggaacaagaggugguuagcuccauuuuaugggguguuaggggguggaaggugggauugaggcacugggagagguaggucaugaugagucagagacagagaugggaacugaaguccaaaauugaugacucucaaaccaggcaauuuucuggggccuauuuucucagcuugugauuuuauauuuaaucauaguuauuccuugaaucgccaguucauuguacuuggguaagcaaagcauauuuguauuuuaaacaaaguaguuuagcaucaaggugccaguuuuuguuagcauauuaaggcucucuuaagcuugaguuaauaucgaaaacaguacuguggaacugacuuaaucugcuucucucugugcaugcuuccuuuauuauuucugaagacuuuaauuuuuuuuuuuuuugagacagggucucacucugucaccuaggcuggagugcaguggcagucacagcucacugcagccucaaccucccaggcucaagugauccucccaccucagccuccugaguagcugaaacuaggcgugcacuacaggcccagcuaauuuuuguguuuuauuuguaggaauggggaucucacuauguugcuaggacuggucuugaacuccuggacuuaagcaauccuccuaucucggccucccaaagugcugggauuacaggugugagccacugcaccuguccaagacucuuuuuuuuuuuuuuuuuuugagacagggucuugcuuucucacccaggguggagcgcaguggugugaccucagcucacugcagccucaaccucaugugcucaagugauccucccaccucagccuccugaguagcugggacuauaggugcacaccaccacguccugcuaaguuuuuuuuuuuuuuuuuuuagagaugggguuuugcuaugcugcccauggcuggucuugaacccgugagcucaagugauccaucaugugcaccacugccccaggugacuuuuuacauaaaguauaagaaaacagauuccuccucucaaugccuacaggaauccccucugaucuucuaacugguaaaguacuaaguuaaaaaaaccucuuagcccucugucucuccaaguuggguaguauuaaauauaugaauccauuuuuagccugggcagcauggugagacucugucuccauacacacacacacacacacacacacacgcacacacacacacgaagcuggaugugguggcacaugccuauaguccuagcuacucaggaggcugaggcuggaggauugcuugaguccaggaguuuaagguuacagugagcuaugauugugccacugcacuccagccugggaaacgcagcaagacccuguuuguuaaacacacacacacacacacacaacacaauaauuuuuuaaaauccugaaaacucucaguuaagucauuauuauuauuauuuuagagaugggggucuugcuguguugucuaggauggucaugaaccccuaggcucaagugauccucccaccucagccucccaaguaacugggaagacaggcacgcguuaccauguuuagcuaaauuguuuuuauuaugcugugguuauuuaaauuuacgaauauaaaguaggaaaaaugugcuuuuauuucuaguucuuacacagcuaaaaaaaaaccacaacaaauuuacaaauuaaauacaaaugaaaccacaaaaugaauacuauucaauuaaaaauauuauaguaauuuaacgugacaaaugauguauuuugcuaaaacugucauccgucguauuguuacuaugguguugccugcuauagcucagcuucuuuuguguucaacaugccuaugccaccaagugacuccugauaucuuaauuuucucaccauuuuucuguuacaacuaccaaauagugcaaucucaugaugcauuuggcuuucauuuugugcaugaaaguaucauugucauuuuaaaaccaccucuguucuuuucucauuaucccagaacaauaaaagcagcacuaaaacacacauguaaaugugggugcugaaauuguguggcaauacuugguuguaagguggucacccaaauaauucagaauaugcuuauacaaaucuaaaaaauaugaaaaugaaaauaaaauuaaaacccuagagaauacauucgcagacauaauuugagaaaaacuguucaggucugcugguucccaaacuuucauuacuaucaaaggcucuagcuauugugcuuacuuccaagaaccccauuuauuuauuuauuuauuuauuuauuuauuuauuuauuuauucauuauuucauucauucauucaaaggcucuauugugcuuacuuccaagaacgcuauuuauuuauuuauuuauuuuagagacggggucucacucugccgcccagauuggaguacaguggugcgauccuggcucacugcaaccucugccucccgggcucaagcgauucucaugucagccucccgaguagcugggacuacaggcucccgucaccagcccagcuaauuuuuguauuuuuuaguggagacaggguuucaccaaguuggccaggcuggucucgaacuccuggccucaagugauccgcccgccucggccucagaaucccauguuuuaaaaaaguuugucuccuacacugcauuuauaguuuuauuaaucaggcacauagaauuaccauuucggagcuugugaucaccauauguaguuaucacuccaagcugcuuaaauuccagucuaaaacaaacaaaacauucuaauuauucugugcuacccugacagggguaagugaaaacuuuccauucagguuuguaagaacgagcucccagaccuccaccucuuccccuugcugccucugaggacucuuggaggucuagggaggccaguuuggguuuucuugcucaagaaaguagccaccccacccaauuuggaaggauuaaagcuuguccuaguuuugcuucauuguuguacuucuagcaugcuaaagagcuaaaaaaugggaggaagaaaauacaacagaaggcaccauuccaguaccaaacugaaaagaaacacaaaaacaagagagcagcauguuuuuaacagcuugcguggaaaaaauauugacuggggaguuuggacagcacuguucauuuucucucaccgcccgcguuauuugucuuacggagcaggagccagauaccauucuggagaaagagccgcgggaagagguggagggguucuguggaaguuugagucugagcggagaaauuagggcuggagauccaguggcucagggccaggaagaagucaggggaggugcuaaagccuuuuuccuccuggccucgggcacucucuuugguccgccugagucuuaagagggcacagcgcagaucauucagguagguuccuggcuccuucagacuacaacgagcuggaugaaucccugucccuguuucuuucggcuggggaaaggacgcagggguuccauucgcuuucuuagcccacccgucuucuugaguucagaccuacaacuccugcagugggggucagaagggagccuuaaucaucgggacagaaacgcggcuccccaacuucggcuaaaccagcguggcggccuucgucccuacugccugggcgcggggcggggccugggcgcggggcgggaggcggugaccagcagcaggaggagaaagaacauggcgggcgcaucagagcucgggaccggcccaggagcagcggguggagauggagaugauucgcuauacccgaucgcgguuuuaaucgacgagcuccgcaaugaagacgugcagguacuggacugaggccggggacccgaggcgagaccggcuggucgcgugguagagaagggggaaggccugcgucgcgguggggguggccgagguacugaaugagucggacucguagcagaaacuugaaggggaggcggggaaugcuccgcgaggggcuguggugacacgccccgacccucccggguaccucucuaguaaccuugcuucggacccccugaggcguccgcccggagccuugcccuucccgggcgguugucggggaacccgcuucccgccugggcgccccauccgggccgugagguggccgcgucucuugggcgagggagcaggagaagcgcggugccaggccgagacggggcuggagcggcugaggggcgcaggaugcccagaagcccuuugaagugccccuggaucccuucaucucggcuuggaacuggcucggcuuguuggguagaaagcgggggugggauggccgauuaaucuggacgaguaguguauccgcucugugggaacuuuucuuugaaaccacagguguuguauucaaccguuucaccugcuucaccacugccaaagugcucucuuuuuaaaauuaucuuacuuccuagguguuguauugucuuuccuucauuucucuuccggucccuucugaguguuucuccugggaaauccuccgccggcuagugaggccgaguuacacuucuuuuuggaaguccuuaugagcuuccuuaacaguaaaaucuaaaugaaagguuaucuucauucuuaccccugugucauaauuucaccuguuagcaccuuuugucuuuugaucuaaauucagccguuucuuuacauuguucuucuuucuacuuucuuuucugaagcuccgacucaacaguauuaagaaguuaucaacaauugcccuagcacuuggaguagaaaggacccgaagugaauuguugccauuucuuacagguaugugaaucuuuguuuaaagaaagguagggacauuccauuuuccaguagcuuucaacacugacuuuuuuagaguuuauuacccacauuaaaaugagccagguguuuuuugugcaaaagaaacagaacagaguauauuguuaguuguggcuagauauauucaaacaucaaccauuuagcuauugaaaguaauugauacgggaguaugaauuucuaauucguugugcaaagcagauacaggaagacgguugagaagaaagaaaaugcuguuaggauuuugacugggucaccuuccuggucgcauagugaaucuguuccuaguuuugugucaguguccagcugugggagagcuauccauguugaugaguccuguuguugucacuuccagauacaauuuaugaugaagaugagguacuauuagcucuugcugagcagcugggaaauuucacuggccuagugggagguccugacuuugcccacugucugcuggugaguauuuauaagcugccuacccuccuucuacaacuuuugcaguauaaaugauacauuguuuggugauagacacacugcagcauuuuuuaugcagaucuuuuuaugggcagauagucauaauguuagucauugagagaauaaguacuguaggcacuuugcacucaacuccuuuuuuuuuuuucuguaaauaagagaacuucguccuccuuuucugcgucuguagacuuauuaguuuagauguagggagaaaaaggguuugauuguuuuuaugguucccccgcgcgaugguggaaguuuuaauucucaccuagcagcauuuugucuuugucaguuuaacuuuugcuucugacuuugugaguuugaugaauuuaguucaauuuaauugacauuuauugagagucuacuuuaucagacacaucauaguuuacaauguuaauguugaagaagaccaaugugagggggcuugguggcacaagccuguaguaccagcuacucaggaggcugagacuggaggaucacuugagcccaggaguuugaauccagccugggcaacauagugagacccccaucucuuaaaaaaaaaaaaagaccaccaaaaugaaucuaaugaggucacugccuuuaugugucagcaaauaauuaccgugcagucguaaauggaaagauauaaguacccacaaaauacccacguaauagaagggagaaagggauucacuccgggugaucagggaagaccuugggagaugaugucugaacuagguuuuaaaggaugaccaggaauucaacaguuggacaagguagggguguaugugucagagcuuugaauacuggguauguaauacugauucuugugauuucugucucuaguucugacuuuuccauggaacuccugagguagauugauuaauagauaaguaugaauauauauauauagagagagagagagagagagaguuuuuuuucugucuauguauauaggccuaugcuuuuuucuacuuguaugucaaacagguauuucaaacuuaacauacccaaaacaaaacuuagcuuuaucccccaaauacaccucucauuuaguuguuccacuucaguaaaugguaucacuaucuucccacuugcacaagccaaaaccuagaauguauucuugaauccucugugccuuguuccacacaucuaauccauuaguaauuccuauagagucuacguauauuucaaauaaguccacuuucuuccaucccuccuauuaccagccuaguccagacugucaucuuuccucuagauugcuguaguagcuuccuagcaaugcuuuccacucuugccucucacccgacucuuacaguucacaucacccagcagauggcucacucucugcuauagcucuuagaaaauccaaauucuguaccuuagcuuacaaggcuuuuuaugacccgccucuguaggauuaucauaugcccagugguacugcaugagaagaggugacaguaggcagggaacagacugcaaaaggccuugauaaccucuuccauucacauuggucaucuuucuguuuuuugaacuaaccaagcucauuauucccuuaggaccuuugcccuaggucuucccucuaaugaaaagcucuuucaagcuuucuguggcuggcuccuugucauucagggaucaacuucaaugcaucuccucagggagguuuuccccaaccacucaacuuaaaauagccucacagucaucccuuacuacaucauccuacuccuuuuuucuauagaguacucaucaccaucuacuuauuuucuugauugauuguugucuuacuccauuagaauguaaaugccacuagagugaggaaccuugucugccuuguuucuucuguguccucaaugcuagaauauaccaauaauaauguauugaaaaaaugaguuucagaggcuuggaagcaugaaacaggcuggguucaaaacugccggaguguggcugggugugguggcucacaccuguaauccuugccuugggaggccaaagcagcaggaggauugcuugaggccaggaguucaagaucagccugggcaacauagugagaccccaacacuuaaaaaaaaauagcugggcaugaugucaugugucugaguccuagcuauucgggacgcugaggcagaaggacgaggagucugaggccgcacugagccaugauugugccacugcacuucagccugggcaacagagcaagacccugucucuuaaaaaaaaaaaaaaaaaagaacugcuggagugugaaguguugaggcuggguaggcagaguggucaucaagggccaggcagaguucaaaucaagagaccacucauaagcaauucucaggagcauggccucauccuguaguaaugauagcuauuauccagugguacugcacgagaggggguuacaguaggcaggggacagaucaugaaaugcauuggcaagugagaaacaguaucuuuucaaugaguuucugaaauaccuucuaggaaagcugaauacugucuaccuguguguaucaaacaauuuuuaaaauauauuauuagacacacuucuuuucuuuaacucauuaugcuucuguuucacucuugguuaguucuauauguggguuuuaugcuuuaaaaucuguagcucauggcauguguagaaucuaccuggacuacaugcaaacucaguaaggcagagguucagagagccagccuguuuacacuuuuuacuaggccaugccauauucaguuacugcucuuaauccagaccauccaccccauuuggcuucuuuuauuucuaaagcuguaagcaagguguccuaccaucucuguacuuuaccuuuuuuuuuugagacaagagccucacucugucacccaggcucaaguacaguggcacaaucucggcucacugcaaccucugccucccggguucaagugauucucaugccucagccuccugaguaagcuggguuuacaggcgugugccaccaugucuggcuaauuuuuguauuuuuuguagagacaggguuccaccauguuggccaggcuggucucgagcuccugaccucaagugaucugcccaccucggccucccgacggcugggauuacaggugugagccaccgugccuggccagucucuguaguuuucacuugauuguucugucagaaacuccuuucugcccuauggcuaauggaaaguugcugaauguguucugaaaaaagcaauuuugcauucagcauuuuauagguuggauaaaaggaugggauggagaugguggauaaggguugcuugcaccucugggaaugguggaaagauacugaaaaggcuguggacucagugaccugacaagcuguuauccuguauuuguggugccuaacauuggucauaguuuuguacuuacucuugaggaaauauacaugauccugucugaauuuggcuauguaucuuuuaaaccuagugauucaacucacaguaauauuaauauugugucaagucuuuuacacugugucauuuguagacaccaucugggaauugccaucugggacacgagaucuuggcuuuucuacagaagucgugucuuuggguuggccgcaccauauguuaucacugugugagcugaaaguaaccauuugguaugaugcagcuaacauucugguuacguguaccaccucccuucagucacuuuaaaaggugauuaucuguuucuaaccugauucaauaaguuuucuucucugguuuuccuuuuuaauccauucagccuccuuuggaaaaucuggcaacuguggaagagacuguuguucgugacaaggcuguggagucccugagacagaucucccaggagcauacuccuguugcucuggaagcuuauuuuguaccucuggugaaacgcuuagcaaguggggauugguucaccucucgcacaucugcaugugguuuguucagcguuugcuaucccagggcaucaaaugcuguuaaagcagaaaucagacaguaagccaugguauuuuuuugccuuguuaaagcagaaaucagguaguaagcuaugaguuauuugggauuacuggggacuuguagcugacaauuuacauaguaccuuguuaccaaugaguggcugauacuaggauaguaggauuuaugacaucuuucuuuuuuuuuuuuaagagauaaggucuugcucuguugucuaggcuggagugcgguggcacaaucauagcucacugcaaccuugaacucuugugcuuaagugauccuccagccucagccuccaaguagcuaggacuaccgacauacacuacugcgccuggcuaauuuuuaaaaaaaauuucuggcuggaugcaguggcucaugcuuguaaucccagcacuuugagaggcugaggugggaggauugcuugaacucaggaguucaagaccagcuugagcaacauagugagaccuugucucuacuaaaaagaaaaaaauuagcugggcauggugggacccgccuguauuucuagcuacucagaaggcugaggugggaguucacuugagcccccgacaaacaacaacaaaaauauuuuuggcauauagauagggucuugcuauguugcccagucugcuuucaauuccuggccucaagcaguccuccuaccugggccucccaaagugcuuugauuacaggugugaggcaccaugccuggccuaugaugucauuuuuuauuauccaguugaauauguuuuauuuuuguuacuucuauaaguagaagcuuagucacugauuauuguaagauaaaaccucuaaaagucugucuguguguauggggggcagguuuauucaguguuauuugaugggaaauaccuucauuguuuuauguugcaggcaauuccguuccuugugcucagaugacacaccaaugguacgacgugcugcugcuuccaaauugggugaauuugcaaaaguuuuggaauuagacagugugaaaagugaaauuguuccacuguucacuagucuagcuucagaugaacagguaaacuaacucuuaguauuuaagggacacagauaugcuccuuuccucuaaauuuucagaauuucuuuggggaguuuuaguuuucuuguuaggauucuuuuuacagaauuagugcugauucuggccugguuaaaguguaacaugcuuaucucaauguucuuauguuucuuucuuaaccagaccaugauuucucucuuacauuagcagcuguuaaaagaguggggagucagagaggaaaugggagccauaauuagaaaggaagaccaaagcugcauggaggguaacauaccuuugggaauugcuggcuguauuguaauaugagggaguaauguuuccuggaauuuuugacuuuucagauaaauaagcuuagaauguguuaggaaagcuauuugacucucugcuucuucuauaguaguguaugggauuacuucacauaaucguauucaauucugaagaucuagaucucuuugguguagaaauaacaauaaaacuagcaaacauccaaaugaaguacuuaauuuuucucugccuuuaaguaguuauguguauuaaguaauucaguccuuacaacagccccaugagauagcccauuuuacacauuagaaaacaaaggcacagaaaguuuaaguaacuugcugaaguuugcauaguuagcaguaguggagucagaauuugaaucuaggugguuuggcuccagaauuugugcccuucacagcuaggcugucccgcuucucuguaauggugcuuaauaggaucagcucccagaguuccuggacucuagaauaguccuuuugggcuuuuaauuugcauguugccugcccuaagaucgcuucauguguacaggaccacaagccccaggacacauauuaaugagucucauuuucagauccuaaaucuaaagaucuaaauccuacuuugaaaauaauuuuaaaaauuauuagaauuuuuauucuaauaauaaauguacaaaaugaauguauaacuuaaugaacuauuagaagguaauaccaacuuguuaacgaucaccuaugauaggagacaucacuuugacagccacuaucccagaaucccuccauggauucccuuucaaacacaaucucucuuuccuccuccacuugccacuccauuuccuuaagaguaacauuauccugacuuuuaugguaagcgcagccuuuguuuucuuugcacuuuuucuuuucuuuucuuuucuuuuuuuaaaaggagucucacucugucaccaggcuggagugcaguggugcaaucucggcuuucugcaaccucugccucccggguucaagcaauucuccugccucagccucccaagaagcuaggacuacaggcgcaugccaccacgccaagcuaacuuuuguauuuuuaguagagacgggguuucaccauguugaccaggauggucuccaucucuugaccuugugauccgcccaccuuggccucccaaagugcugggauuacaggcgugagccaccgugcccggccuucuuugcacuuuuauuaccuaaauguuauaguuuaaaacagugcuuuacaacagaaauauaauguaagcuaccuguugauuuuaaguuuucuacuggccauguuuuuauaagaaaaaagaaauaggugaaauuaacaauauuuguauucgaccaaaauuuuccaaaaucuuauuauuugaguguaaauaacguguaccagccacauuucaagucucagcaugagaugauguuguuaauagggugguagugaagauggaaaggauuuggaugucaguuuggaagugggaucaauagguuaguauuauuggauuggaucagugggagaggaaucaagaucuccuagauuuuuugcuugagcaacuggguggaugauggugucaucguuaagauagagaaaauucugggaagaggaacagguguaggagagaaaacgaaguucuggaagagaaguaauuuuuuuuuuuuuuuuuuugagauggaguuucacuccugucgcccaggcuggaguacaauggcaugaucccagcucacugcaaccccugccucccggguucaagugauucuccugccucagcuuccugaguagcuggaauuacaggcgccugccaccaugacuggcuaauuuuuuguauuuucaguacagaugggguuucacuguguuggguaggcuggucucgaacuccugaccuugugaucuguccgccuuggccucccaaagugcugggauuacaggugugagccacugcaccagaccagagaaguaauuuuuuaacaaauauguauuagcuuauauuucaguaguugauuagcagucccaugauuuagcaucauuuucgaaauucaaaaauaucuguguagucacuaccaagaacuuaguccugucuuuuuuagccugugcaccugcauacagaggaaugugugugucuuuggcauauagucaguuauuguugauacacaguuucuaagauuuguaauauuuuggaaguuggagucacuguuaugucucucaaguauguguauacguauauacauaacuguuauuguacacacuuaaaauuuuuuaccuauuucuccugggugcuaauguuuacauguauuaagauucuaccuuauauauguauaauacacaaaucuacagucucaauuucuaauuucucauugauguuucuuuuuuuucgguguuuuuuuuuuuuugaguuggaguuuugcucugucacccaggcuggagugcaguggcgcgaucucggcucacugcagccucugccuccuggguucaagcaauucugcugccucagccaccugaguagcugggauuacaggcacgugccaccaugccuggcuaauuuuuguauuguuaguagagaugggguuucaccauguuggccaggcugguguugaacucuugaccucaggugauccgccugccucggccucccaaagugcugggauuacaggcaugagccacugugccuggccccucacugauuugucuuguauauuuuccacuuguucaaaggacguaggugucacguugacauuggcuguuuacauuuggaaaguugaguucauuaaucccauacuuuucuaauuucuguguuuuucuagccacagcuuccucaaaguuauucuguccuugaucuucgacauuuaaauccaacugauuuuuguuuuugauuucuaacuuuuaauuguucuguguauuucuuuccaagucauuaucuuaugcugccuacacuccuguuacugcgacccugaucugaguuuuuugaaaacuaagcuuucuaagugauuuccuuuacucuuacucuuaccuuuguccuaaucuguuauaaauaacuuguacaaauauuguuuucauuuuuaucccucaacuuucuguuauaguaaggcuuugaaggcaucauuaaaauguuuuuuuuuucuuuuuuacuuaauuuuaaaauuuucauuuccuuuauagaaacucugcauucuagccaagguaauuacuuggcuguuuacucauaguacaaagucauuucuaucuuuaugacuuugacaugccauuccaggcaaagggagcagcucuuucuuuuuuuuuuuuuccuuuuuguuuuuugagacagagugucacucugucgcccagacuggagugcaguggugcagucucggcucacugcaagcuccgccugcuggguucacgccauucgccugccucagccucccgaguagcugggacuacaggcacccgccaccacgccuggcuaauuuuuuuuguauuuuuaguagagaugggguuucaccguguuagcuaggaugguuucccucuccugaccucgugauccgccugccucagccucccagagugcugguauuacagacgugagccacugggcccggccgggagcagcucuuucaagauauaaauacacggccaggcgcaguggcucgcgcuuguaaucccagcacccagcacuuugggaggccgaggcagguggaucauuugaggucaggaguuugaaaccaggcuggccaacguggugaaacucugucucuacuaaaaauacaaaaauuagcugggcgugguggcuccugccuguaaucccagcuacucgggaggcugaggcaggagaaucacuugagccugggaggcggauguuggaaugagcggagauugugccacugcacuccaaucugggugacagagugagacccugccucaaaaaaaaaaaaaaaaagaaaaagaugucaagacgugaaacuauauaagguguggcagucuuggugguguuaauuuuuuuaaacaccugcaccaccccacagcaguuccccaugggucucaguaaaugucugaauuacagaaauuuuguuccuuuaggauucagugcgccuccuugcuguggaagcuugugucaguauugcccaguuauugucucaggaugaccuugagacuuuggugaugccuacacuucgacaagcagcagaagauaaaucuuggcgcguucgcuauaugguggcugacagauuuucagagguaaagugaucauuuuuaaguacuaaggaaauaaaccugaaaacacauagauuugcuguuguacccaaaguuucugaauuaauucuuuucaaugggaagugcuguggcaaaaauauguauuuacagauugcacaauuuuguuuuguucuuguuaauucuuuuguuaguauacauuaaaacccguucaaauucuuuuauagcuccagaaagccauggguccuaaaaucacccuaaaugaccucauccccgccuuucagaaccuacuuaaagacugugaagcugaaguccgggcagcugcugcccacaaaguaaaagguuaaggaguucaauuuauguuggaacaugugucauucauuuuggugcauuuuuuuguuagucaauuuugcauguuuuuuguucuagaauauguuuuuaaaauacauagggauguuuuuaguguguggaaauguuacauugucacuuaaagauagucucuuuauauuuaaaaccaagaaaucauuuugucuuguuuuuguaaaaaaaaaaaugccuuucagguuggauuggugugauaugcaauggcauagagaguucacgaaaaaguuuauuuagaacaagagcuguuuuccuuauuugcuuaaacauauaauuuaauugaaauuauugauaaaccugguuaaauguccucauuuggcucuuuguaaauggcccugugaaagcauucuuuuuuucuauuuaucuuuuagaacuuggugagaacuugcccauugaagauagagagaccauaauuaugaaucaaauucugccuuauauaaagguaaaccugacuuuauuuuguuucacucucuuuuauaugaagguaaaccuuaaucucauuauuuuuguuuguuuguuuaccuuaaagcucuuugaguuuaaagguugacagggaaugaauggggaagauguguuaaugugcaacauuguuauucaucacuuauuagcccauuguaauuguaaacugcucuuuggugcauagguuuauguuaccuaacaaguagucugaggaaacauuaucaacuaaucaguauugaaauagugcugucuuuaaauuccuuggggucaggcauggugguacaugccuguaauccaagcacuuugggacgcugaggugggaggauuucuugagcccaggaguuugagaccagccugggcaacauagugagaccccauugcuacaaaaaauacaaaaauuaguugagccugguggcaugcaccuguaguaccagcuacuugggagucugaggugggaggauugcuugagcccaggagguugagauggcagugagcuaugaucaugccacuguacuccagccuaggugacagggugagacacugucucaaaaaaaaaaaaauuaggccaggcgugguggcucacaccuguaaucccagcgcuuugagaggccaagguaagaggauugcaugaacccaggaguucaagaccagcccuggcaauguaguaagaaccugucucugcaaaaaaugaaaaaaauuagccaggccugguggugcaugucuguagacccagcuacucuggaggcugaagugcuugagccugggagggugaggcugcagugagccaaggucaugccacugcacuccagccugggcaacagagcaagacucuguuucccagaauaaugguauggaaguuucuguugucuuguaauaaaggcuuuuaauuucgauuuuauuuuaggaauuaguauccgauaccaaucaacaugucaaaucggcucuagcuucuguaauuaugggauugucuacuauuuugggcaaagaaaauaccauugaacaucuucuaccucuuuucuuagcucaguuaaaggaugaggugggucuugcuuuauguucuguugccuuugauaguaauuugauuuuauuugauuuugguuuaggguuucauuaaaauagaacccccaaaaagaaaauggauaaaaaaaucauaacuuauuuuaaaccaaugacaccugugauuuuggguaugggguuauagguuccucagaaagugggcaaaaguacccauuagaguaaaccuagaaauaucuguuuaucaucuuuaccugauuuuugcuuuauacucccugguuucuuuaaagcuaaugugucuuuguuuaaaaaguuucauuuauuuaaguuuaaauauaguaucaaaaauuauaaugauaccuaauauuuacugaguaauuacuacauggcaagcaugagccuuagugcuuugcauguauuuuuacaugcaauucucacaacaauccugugagguaggucuuauuauuaucccuuuuuguuuguuuguuuguuuguuuuguuuuuugagacggagucuugcucugucgcccaggcuggagugcaguggcgcaaucucugcucacugcaagcuccgccuccugaguugaugccauucucuugccucagccuccugaguagcugggacuacaggcgccugccacagcacccagcuaauuuuuuguauuuuuaguagagacgggguuucacuguggucucgaucuccugaccucgugaucugcccgucucggccucccaaagugcugggauuacaggugugagccaccgcacccggccaauuaucccauuuuacagaugagaaagcugaggcauagaggguuaaaguaacuugagcaaggucuuucaacaaugacagaucugaaauuugagugcaucugauuuaguuccagagauuaugcucuuuaccaucuuacggacuuuucuuguagucuuuaguauuacggacuuuuaauugaaauuucugauuaagaucauuuauguuccuugaguuauuuauguauucacuauuauuucuucaagauuauccauuuuuuuuucaccugagucuuaccucaccuuuuaucuuacccugacaggagacuguugggcagaguacuugauuuuuaaauguggucuuuuggggcuuguguacuugcaguguccugacguucguuugaauaucaucuccaauuuggauuguguaaaugaagugauuggaauccgucagcucucucagucucuccuuccugccauaguggagcuggcagaagaugccaaauggaggguccgccuggccaucauugaguauaugccgcugcuggcaggccagcuggugaguauguguugcuccaugaacugcaggguagugucagauagugacaauuuaccauggcaaguaggaggccuaguagccuguaugcuuauguuuguuuagaugcaugaaaguauggccuuguucuuguuaccuauaggaugguuuuuauguuuguuagugcauacguuucuuuucuuuuaagauggaguuucacuguuguugcccaggcuggagugcaaugaugcaaucuuggcucacugcaaccuccaccuccuggguuuaagcgauucuccugucucagccucccaaguagcugggauuacaggaauaugccaccacacccagcuaauuuuguauuuuuaauagagaugggguuuuaccauguuggucaggcuggucuugaauuccugaccucaggugauucacccgccucagccucccaaagugcugggauuccaggcgugagccacugcaucuggccuauuagugcauacauuucuaacaaaaagguauagguugaguaucccucaucuaaauacgcuugggaccagcauguuugggaccagaaguggauuuuggaauauuugcauuauaaauauuuacugguugagcagcccaaauucaaaaaugcaaaguccagaaugcuccaaugagcauuuccuuugagcaucauaucagugcucaaaaaguuuuggauuuuggagcauuucacauuuuggauuuuuggauuugggaugcuuaaucuguauuacagaaacauauuucaccucaucaccaccgaaaaacaaagccauagaauaaucaguuucuugguauauauaauguaaauuuuauaauauuuaaugccuuugugacuuaagaaauguuuaacugagaagaaaagggauuaugguuuuaggguaagucugcugugauuuuugcucaaggaaacuucccuguuugccuuguauucuaagcaaaaugucccuagguaccacuugcccuacauucugauuaaagggaguugaggaaucaccauauagaaaagaaguauugaaaggccgggcacaguggcugacaccuguaaacccagcacuuugggagccagaggcaggcgaaucacuugaggcuaggaguuccagaccagccuggccaacauggugaaaccccaucucuacuaaaaauacaaaaauuagcugggcacggaggugcacaccuguaauaccagcuacucgggaggcugaggcaggagaaucgcuugaacccaggaggcgaaggcugcagugagccaagauugcacuacugcacugcagccugggcaacagaguaaaacuuugugucaaaaaaaaaaaaacaaaacaaaaacaaaaacugaagcuuguaauguuaguauuuuggucaaaguccacauuaucacauuaucuguuacuguuugaguuucgugaucaguguuacccuaacuaauaccauguuaguuaaaauuucaaagcuggguuuuauagccacauccuuuccuuuuuuugaguagguggccuagacaguucuaaguuugauguaccuucaucucuguugguagcacuuauuacagaguauuguaauugucuguuacagucuaguuggagagaugggugaucucuuuuagggcagggacuguauuuuauuuccagucccuaccauagugcccgucauuaauuaggcacuuaacauuuuuuauuuugggggcagggucuugcuguugcccaggcuggucuugaacucauggccucaaaugauccuccugccucggccuccugaguagcugauaauaggcaugagccacuguguauagccaacauuuguugauuguugaguauuuuuugagaaagaugugucaguuuacuauugacaucgcuacaguuuguuuccccuuccucacucccacuuccauuccuuucaggucacaacauauggaauuuauuuuuucuugucuugaaccccugaauuuguauuuuuaauuuuaguacauuuaguuuaugaacaugcaauuuguggaugucuguggcauuauauguuuuauaaaauugaaaguguccgauucuuugaaaaguauaccagagguauuagugcauggcaaaugggaucaggugaaguuauuuugucauccuuuuugucugucacucccaagugcuaugggucaucuucucuucacuggugauugucauggaucuacuuuucagaguggagaggagcagugauuaacugauuugcugaagaccaaaacuaucuggaagggagggugcauuuuaguaccauuucuuuuaaccucugcuccuucuagaccuggaaaguuucccaggguugcuagcucuauagagagcagugugaaagcaaggcagauggugucuuuggcugacuuacaccugucuggcaggggugacaugccucagucaugaacauuuugcuuuacaauuuuaacuucuuguuaguauauauauucuccuuaauuucucuucauaucuaaauauuuuuauaucagauagucauuuuauaaaauucucucaagacuuuauguaugaccuggcuuguggacgauguuaaguaaguguaaaguuaaacuacaaaaaccggaaaauaggccaggcguaguggcucacgcuuguaaucccagcacuuugggaggccuagguggguggaucaccugaggucaggaguuugagcccagccugaccaacauggugaaaccccaucucuacuauacaaaaaauuuagccgggugugguggugggugccuguuacuugggaggcuucuugggaggcugaggcaggagaauugcuugaacccaggaggcggagguuguagugagcugacauugcaccacuguacuccagccugggcgacagagagagauuccgucucgacaacaacaacaacaacaacaacaaacuggaaaauaaaaguuaauuaaaacugaaggaaaauucucaaccugaaaugaaaaagaaaucuuggcugacguaaucuaaguguaugccaaaauuuguucauuaugaucuuuuaguacaaagcaauuuugggccaggugcgguggcucaugccuguaaucccagcacuuugggaggcugaggcggacggaucaucugagucaggaguuaagagaccagccuggccaacauggugaaacccugucucuacuaaaaauacaaaauuagcugggcaugugcugcauaucuguaaucccagcuacuugagaggcugaggcaggagaaucacuugaacccgggagguggagguugcagugagcugagauugugccacuguacuccagccugggcaauagagugagacuccaucucaaaaaaaaaaagcuauuuugucuuauucaaucacuauuuucaaagcacugacacauuauauuaccucucuuuuuuuaaaauauagaaucaccagucaggaacuucuuagaguucaaagaagcaagacuguaaauguguagaccccagaagggaggcacuaggaaagugugucacagcauucuccaugugguguggaagccccgggguuagaggacuguguaaaucugcucccggagcccauccccagccugcacugaaguggccaccuguugacagucgggaggaacagggcugggagagcaagccaugccugggccauaugcccuguaguccugggccugcuuuauucucccuccagggcuuucuccuguugucucgaaaauacucucuuuaacuggggauaucucuaugucuugaggucaguugcuuuauccuuaaggauuugucauaauaguaaccaaaaagggaagacgauugagaauuaguaauauuacugacagguguuuuccuggguaauucauuuuuacagguaauccagauuugcuuggcagaccauacacagugcauucuuccugcucuuuugcaguguuguggcugacuucuggccacccuguucucuuuuaccuagcagggccuaugccagcucacguaugcuuuuuuuuuguuuaugauuuccguccaauaaauagauuuaugguuuguuuguaauuccugugguguuucuaucucuuauuuguuuauuuggaaacaaguuuuuuuagccuucagguaaccuugguguaauguaaauagaccaucuuuauuucugaauuuuggcaauguauguuaauggaaucuucuguaucuguaggguguggaauucuuugaugaaaagcugaauucuuuauguauggcuuggcucguggaccauggugaguagauaaaaacagauuauugaaagcccauauauccaugauuuucauacauuuccuuuuagaaaggaaucucagucugaccagauauuuugccuuaauauuguaggaaugaagaaaggcucuaauuaaaguuuaaucuucugaauauaaauuugacguuucuaccaauuuuuuguaucuucgauuuuauuuucuccauuaaacaauuuauuugcauuauuuucuuacucaaucuauuacauuaucuucagaccaucucuuuuauauaucuacuuacuccucccuuaucugaagauccucuuuuugaccauccuguaauuggugucuucagcagcuauacacuagguuguauggagauuggaaucagaugaaaggccugggugggagaaauggcuacuuggcuuuuugaggugacauagaagaggagaucuacagugagacaguagaggauucuuaggugugggaaacacuagcuuugccauagggagagagagggccuggauuucugguuugggugaaaggaaggcuuacugcuuguacucucacugcugcugcuacagugcuaggagagggugagcucagggcaggucagauaggacagcaggaaugagcaagugacuuccuggugaggcuucagguagagguauauguguguauccccuugugugccaggcagcagugggugacagauguaccgucucugccagaucccagguccagacuugacagcuucaguguugucuuagaccuguuucgaugagugugagugccccuauggggucaugugacauuguccuugagcuuuguuuccauguuuugguggauauaauagauaaccugagucaguuccacaguaucuuuuauauacuugauauauguauuuaguguaucucuuuguucaucuaugggugcuuaugccuggaaauuugggaggaaugaggauauuugugucugcuuauacgugugggugguuuuguuaaaggcauguuugcaucauauggaggaucauaugguuaagagugugaagaggaaggaugugaaaaaauaugugaaaauguauaagggcuuauauauguggguauuuccaguguuuucaaacuggauuguagacuucuuucucuuuuucuucucuaaaguuaucuuauuguggccuauuuauuucuuuuuaaauaaaauuaaaauuuggcaaaucauaggaaagaaauaccacuuuuaaaaaaaauguuuauguuauaucugauaaauauuugacguuacugggaauggugcauccuagcaaaucauucugugcuuuuuuaaauuuuauuuuacuuuaaguucuaggauacaugcauagaacaugcaaguuuguuauguuacauagauauacaugugccauggugguuugccgcaucuaucaaccugucgucuagguuuuaagccccacaugcauuagguauuuguucuaaugcucucccuccccucgccccucacccccugauaggccucagugugugauguucccuucccuguauucauguguucugauuguucaacucccacuuauuagugagaacauguacuguuugguuuucuguucccgcguuaauuugcugagaaugauggcuucuagcuucauccaugucccugcaaaggacaugaacucauuccuuuuuuauggccgcauaguauuccgugguguauaugugccacauuuucuuuauccagucugucauugaugggcauuuggguuggccucaagucauucuaugcuuucuuuaaaaguuggcauuuuagauuaagaugguguuuuauuuugaggaauuuuuaaaguucuaauauuccacaaagaauuaaauuccuggcacccuuucucuguaagauugucuucucuaugcaacuugauuacuccuuccucuuuucggauuuucucuuucaguuugggagcaggagaaacccuuguuuauuucacugcagcagcaugcugaaguggggacugcaagaguuccaugaaccaaugaaauaacagcucugaaauuguuuuguacuuaaucacaggagcuuuuuugcuuuugcauuucagauaaguguuauauaaugaucacuggaucaguuagaguuuuugaaacuuuuccccuaguuagguaacuacuaaaagaacauugugaaaauuccagagaaguauaaggaagaaaguaucacucaccuauauuccugugguugaguagacaguuuugaucagagggaggaauguagaagggaaauuuauuuauuuauuauaggagaaaggagaagguaucaguuauugagcauagauagacauucaaagaaaccuugcaggucagccaggccuugagaggagauggggagagagaaagagacagaaauagacaaaagaaaacaggcagaacucuggaaugguuugcauucuucugaaaacagucagaggaaccaagaacauaguaggcaucuggccaaguagaguucagugcaguuaaggucuuggucaaggcuaugcauguguguuccccagucucugguuuuucuggcaguagagaucccuuccuaugguaauggcauuaugauaaaaaucuaaagcguguuaaaaaaaauaguaauuugcugagcaugguggcucaugccuguaaucccagcacuuugggaggcugaggcggguggaugacuugaaguuaggaguucgagaccagccuggccaacauggugaaacccugucucuacuaaaaacacaaaaauuagcuggauguguuggcgggcgccuguaaucccagcuacucaggaggcugaggcaggagaguugcuugaacccaggaggcggagguugcagugagccgagaucucgccacugcacuccagccugagagacagagugaggcucugucucaaaaaaaaaaaaaaaaaaaaaauuagaggagaagacacaaauacucuagcuagcuccucuuuaguggggaggacagggaaggguuugggccaaagacaaagacuauggauaugaagggaaggaaucuguauuacaguaaaacaguugacuugaguuugcuccuuagugcaucugagucuuaccgaaagguugcuucuccuguagacugucaguuuaaguguugauaaucaguuguaugggucacuugucuaugcugucuugcuuguucucaacaucauugcccagaaggaucuaugaauagaagaaguugccuauuucuugguuggaggcuuguauaaauugccuaggacugggacuguggcuuggauagcuauuccugcccuuccuaucaucccaggaagguugggcccaccuggggagagaaguagaauaaggaauuaguaccuaccacccucgauuuguuaaucugagcccaaauuuugagucuuacuggaucuguaaagugaagugacaccaggcuuguuuuuguucagugcuguauauagcaacuaauugugagaggauuguagcugagaccuuuauuaucuagcuuuaugucuuugauaaaugaucaaaggauauagggaauuauuagauguuaaggcaggcacauugauucaaagacauuugacaucuuguuucaaccuaagcauuuucauggagaggaagcaagucagucugauguuuguauuugcuguuguauagaugaccacaguggccucuacaccauuuccuuguugucuuucucagucaacgucgcuucuccgugauguugcuggaauaaucuugcuaaaauuccacauuggucaucaggucacaaguuugcuuuaaaaacccaucacuguuuuuccuaaucaaaucuaagucuuucauaaugcucugcagucuggguccacccuaauugucuaacuuagaagucucacagguuucaguuuuuucuguuuguguccuggauacaugucuuuacccuuucuaggaauuccuccccgcuucucuccacuuacacagauccucccaaaucuucacugcccagucaaggcuucuuucugugccgaagccuuccuagaccuucccuguucacucuucucugcacugcuacaacccucacagccuuuacuacacaaugccacacuucauucuaauugcucuuacaccaugugacuucauggaguguguuagcuuucauuucucugauaagagcauauuucuugugagggaaaguaucuucuguguucuuuuuguagcacauaguaggcacuuguauuuguuaaauaauugaugaugcauauggugagcuccuugcaucccuuuucuguggauaugcacacuuggaaacugaguuggagcugagcaugcuugucauugcagcaugauuacauguggagucugauugcagagggguuuugcuuuugguccacauuugauuuucauguaaguaaacuagguuaugcuuaaaaaacaauaagcgauaugagaacauguuuuugaccucuucugcaguauacgccauccgagaagcugccaccaacaaccucaugaaacuaguucagaaguuugguacagagugggcccaaaauacuauuguucccaaaguguuaguaauggcaaaugauccuaauuacuugcauagaaugaccacuuuauucugcauuaauguaaguauaacauaacuguuauugcuaagcuuaaucauuaaagcaaaauuauucaugacuauuucugaauuaucaguauacugucuucuauuuggaauauaugucuuguauugauuaauuggaauagacaggagaugagagaaaaugucaauuuuaaaauucauguuaaaaucuacaguauuggcugggcacaguggcucaugccuguaaucccagcacuuugggaggcugaggcgggcagaucaccugaggucaggaguuugagacuagccuggucaacauggcaagaccuugucucuacuaaaaauacaaaaauuagccgggcaugguggugcaugccuguagucccagcuacuugggaggcugaggcaggagacucccuugaaccuugggcagggggcagagggugcagagguugcagugagcugagaucgcgccacuacacuccagcuugggcgacaaggcaaaacuccgccugaaaaaaaaaaaaacaaagaacaaaacuacaguauuuuaaaaguucaacuuauuugugaauucuggucuaauucucugaucauuugaaugauucuugugucccccacucagcugcucaaacuagaaauauuuuccuauuggucaauuauuuucuuauuaaauauuaauuuguuucauuagauuuuggaauuuuuuaaaguauuuuaaaugugccaucuuacuuauuuuucuaggcacugucugaggccuguggucaggaaauaacuacuaagcaaaugcugcccaucguauuaaaaauggcaggagaccaaguagcaaauguucgcuucaauguggccaaaucucuacaaaagauuggaccaauucuagauaccaaguaagauuuuaguguuuagucuuguuuuaaaaguguacuuuaaauuuuaccuuauaguggggaguaauuagcuaaaauuaaguucagggauuuucacuuuacuuaagaucuggguuugcuuaaagaaaauaauuuagcaacuauuuuugaggauguccacuaugacuuuuauauuuaagcucuguaaauguguagauccuugucugaagcugauuuugcugagaauuucuuuagacauuauuuuguguauuugucaaguuuauaaaugucuuuauuuuuuuacuuuaaauuuuaacaauuaccauuaaccauauacaccaaaaaggauuucuauggcccauuagacugucuuucacagauaauacuuuugaaugucagugcuuuacagggagaagugaagccaguacuacagaaguuaggucaagaugaagacauggaugucaaauacuuugcacaggaagcuauaagugguauguauuuccuucuuuugccuugcagcuuaugccuugguuaacugggauuuaucucuauuaugugagagguguuaaguggguaggaugauaaguauuaugggaaacagggaggguaguaaguuccuggaaugcuggugucucucugauuagaacccucuuggcccaccauuuucucauaagugagcaggcuauuuuucuuaguuacauguaggacuggguaggaaauacgauucucacugguaagaauaguuuuucguuuggaauuuaaccaguuuuuaaaguuucacuucugauuagccuggcugaguaaagacaguaaccacagugagaaguuguuaguuugauacguuuggaucauuguuauugugcuuaauauucacauagaucguucgugaacuuucuguaccacuaaccugauuuuguuuggaauuuuccaguucuugcauuggcauaaugaggagcaggagggaaaaggccuuuacuagauucuugucacaaauuucuagucaauguguucuuaacuggguggagaaagaauggaaaaccuucaagaucucauccaagcaaauggcaacaacuuagaagaaaucauuuagugacuuaauucuuucuaaagaugaaaugggauuguuuuuuacucgucuuccuuguuaaaucauuauuuaagccguucuuauugaccaauuccugacacuugauugucuccuaaugcuuuauccaucaccaccugggcuccugcauccucacuguggaaucaggcaccagccacauaauguuccagacaaagccuggaaggguguggacccagacguggaguggagugauucucuugacguuuacauauaucucugugucucuccaucauuccaaagcuaaauguacauguuuagaauaacuuauuuuauaaacucuucgggagacauguugagauuugaccguaaugaaagccacauuuuccugaauuaugauggucugcauuagucucaugugaaaggggaauguggaagcucaggguuaauguagugguuguuuugguuuuuauuugcucaauuuugucuguacucaugucauucagaaaccugaaguguggcugcaucuugcugcuaaugugugauguugacgccuaacugaauuugaacagcucaccacugugccuacauuuaaaaauacuucucucucuuuucuaaaaagcuuuaacuguagugccuccuaauaagcaguauguuuguuucauugugagauugcaguucuguauuucgaaugagucuaagaaccacagggauaauacugugcagauuuccuguucuuuaccuggcucugcuuccagcaguauugacaccuaguccuugcugcauuguacaguagcuuuucaaacugcaguuuuauugcuaaguuuuuaguaugggugauacuggagucuuaucauuugaaguguuugcuuuucuacuuuuacaguaaaaccucauuaauucugaaauuuaagauaaugaguuaagcugaagaguuuacugaagcaaauuaauagugaggaagccuauuugaacuacuuaaacaguauuaaagcccuuuuuaaaaagcaccuauuugggaucauuugaggucaagaauucgagaucagccugaccaacauggugaaaccccaucucuacuaaaaauacaaaaaaguuagcugggcgugguggcacacaccuguagucccagcuacucaggaggcugaggcaggagaauugcuugaaccugggagguagagguugcacugagccgagaucgcgccacugcacucuagccugggccauagagcgagaguccaucucaaaaaaaaacaacuauuuuucacauaaucaaacucaccuugucucaugacuuuugguuaaggggguuuucccauaguuuauuuuucucucagugcaucuugcuaugagguuugcuuguuacccuuuugguuuuugaauuguugauuuuguucacaaccucuuuuaaaucuaacaaguccuguucuguuuagugaaggcccaaagacuccucuaagacuuuguauauuuguuacauaaaaccaaguuuuacuaaauacuuuaaaauuuguccuacauucgaaaaauagaaauuguaaaucagagguuaucugucugcauuuuaaacugccaaauuaccuuauaguaaguuucuauuuuaugacuuugggccaagaauuaaguauuuuccuaagcacaaaucuuuuucuauauucucauuuuaauaucuuaugcuauuauucuguaaacauuuuaauuuuaguuucaugagucuuuauuuuuuguuaccugcaaguuauguucuucuucauugaauuucauauuugagagacauuugucuucaugaagcagauuugcacuggaaccauugcuuuacucugguuggaaaugccauuguuuuggggacagacuuuuaaaaugcccuugugucucccagugaggagcccuaagcauugacuucucuacccuaaaacuguuugagagagggagagugggcccuggcuuucucaagcaugggucggggguucagcggggccucugucuuuuguggugaccccucagggguuucauuguuuccuucugacuuaagcaauagagagagaauuuguuuugguacucuucagaggaauugugcuuuggcucauaacuuggccauguucuccaugaauuaguucuccuauuuuuuuuuuuaacuaccuuaaacuuaagggaaaaguucuccuaucuugauuucacuggaauauaggcuuuaggagcucuguaaggcugguauuuuugucuguuuuaucuucuacuguaucgccagugccuggaacagugucuggugcacauaauaggugcucaauaaaaauguguucaauggaugaauuucuaaaauauccuccaaugugugcauggaacaaauaaucaaaagaaccagacugugucuuauucucccacugacagaaagauuuuccugcuuucaggaaacaagcuuuauguggcccuuuucugguccccuggcuuagacuacaguucuguguggauuugucugauugcuucagacauguaauguuguuuuucauccuuggcagcuuacaucaguuguuuguuugauuagaaaaaugaagcagacacacacacacacacacacacacacacacacacacacacacaaacauauaaccuaugccaauaaaaaugucucagcaacaguggaauucaccuugguguuucucucuguaauuugugugggguuuaccccucacagguuuaagagaccaggucuuguuucucucucugugcuaccaagaagaugugaaccugaggaugcaucuuguuucauaagaaggaaggcaggugaauaugugguuucuaacgaggucuuguugaaauaacgggcugcccucagcucacagaaauaccacagcucagccacugugaugcagagccccaggggucuuugccagacaacuuguccugacucaacagagacggcagccugaccuuugagcuggcuuguccaggcauucagguugcuugcguagacuuccagggaagcaagccuguccuuccugacccggcgguuaaccuggugcacuuuuguuccuuuguuaacuguuguguugucacuaaacugaaaggcuggggcuugcccuuagacgucacauuggcucugucccuguggcgauggcagggcaggguggccaaacaggucaggugcuuguucuguccucuugccuuuuacuuaaauuccucugacuuuuaaaaauggugacacucuuaucguaaagcuucuuauuuuucuccacugcuuggauaugaaacuguagagggagaggcccuguugcccaguguucuccugguuuagcagcugaggugacugcagucugaugugauguaacuguuucccuuugauucuccaguauuccuguuuccauccaguuccuuacucuccucuuuccucuucccucgcaugucucccuccaguccucuguaccuagaauagucucacugucccccguuugccuccacgagccugcuguuuccaggaaauuacauaacguucaguugggauggaaaucuuccggaggacgaauagaguuuaauuacucauugcgucggaaagccaagccauuucugucuccagaguuguucucuuaaacugauaugaguucugaaaggagccaggucuuuccugugguuggggcucuggagaccaucagugaccaggauguggggaacagccagguggacaccaaaaggcccgaugggguggcgcuuuccagggccccgagggaaaggcaccucagcacgacccugggcugccccagcuuucucugcccagugccccauauacuuguaggcugcugcuggacacccaacucugcuggcacaacugagggcauccuggcugggaagcacaggugggcuugggagggaugugcccuggucagggacaguuacagcgccacugucugugucucuagugguggcacaaaggcugaggaagcuagaauuuccugugaaggacaguggagaacccagugucccucgggcugacaagaaccacuucccaagacccacagugccuggagaggacauggggaagguaagugcccggaagccuggggucaaguccugcccucagggcugcgggcagccaggguggcauggugugcagggagcugccacaggguaggcggagaagcagcaccucucacuuuguccccaggggaagaguccaauuuuaagggccgggaguagaugguuaaagccuguugcuggcuuacuucauucugggaaugcuuucugagaggugggucgccggccagagcugucacucuuguagcuugaggcccaucuccuaucaccucccaguccaacagcgaggcccauacagaggacaccagugggguuuggugaagaauugcuuguaaaaaggggcuguucccacuuuccucacauaauauagaagugacuugccauaauuccucucaguuauuuccauucaagauaaaaauaguugcaaguuucucuguaacagcucagauguucuacaagccccauuggaugccacucuguguggaaauggugugaaaagccccaguucagcagucagugggugccagccacugccccagggccauucauuaggagggcgauuuguggcuuacagauacauucagaaaaggagagcagcagggcuuggcugccucgugcggaugccagacugcguuuaguucauggggaaaaaucugacauucucacacccauucuaguagguucgcuuagugaaaauucaaugaaguaacaucaaaaaggcugccuuuuaagucacauggcuuuucauuuuaugugaaccgaaaccaugaaaacguuuuuugccuuuuguugagguccagaaucgcagucacucaucuuagaacauucuugccuuccugaggggcugcacacuuguccgugggcagcuccagccguuccugcaguggccgcacagugagaggaagggcugggugaccacuguccaguuggauuccagggguggccagcccuuggaguccaugucgucuucacagaacugggccucagggaggagagcuuggcugaaggagugggagugacaguuacacauuuuuuaggccuaaaccacagacuucuuugggaagaaagggguuacgucuuccuacaaauucagagccagcugcucaugccaugaaugcgugguaugacccgaucugaguguggaucauugaggcggcccucccauggcugaccugcucagcucugacagggcccgggcugccucugcuagccgaggaguuacugagaauaaguugccguuacucgagccuuggucacugcagcaccuugucaggcacuucaaaucucaugucauccucacccacccuaggugguaggugcuaucauuguuuuuuggucccucaugaaucuccuccaaccccuggcaugucuauuugggaaucuuuuuuccaggaaaggaggcccaguggugcuaggccucugaggcuucaguucauuuaacucagaaaaaucccccgccccaugacucagggagccuuccaugcauuuguuucacuuaaggaaaaugacccgagggugagauggaaagggaauuggcuguugccaggcagagcccugugugucaggggccagcagccaagugagugauccaggaagucauccaauugcaaccagaaauuguucuuaaccccucacugucuagggugcguaguggacuugccaaucuguccgaauggggugagcgugagcgcgcugcuguugagagcccugggaacugucaguucucagccagccucagggcccucagggagccauuggacaucccuggggcugggcccgccacuugaagagaaaagggaaagggcgagagccagucucccuuggugaagagcgccuccuuggcacccuugaagucuguggaggugccucuguguuggaugucacauguguccacccaggcaggaucugccagggagcagcgagggucaccucccacaccuugcugccgcggguccggcagcggcucacuccuggacgggacacagggugcccccgcugaagcugcugacgggccuugucaggcagggguuaacaggggauuuguuuauugaaucaccaaguagcugucacaugauuuuaaucaaaacaccauuucccugacaacagugaugucagucuuguuauugcaggaaggagcagcugugagggacauucagucuccaugccgagcccagguuuggagacuaaaaucaagugaagcauccauaaauaauggcuacagacacugccugacugcgcccacccuccuccucuuccuuuucucugcacacagucuguccuguacacacacugacccgagaccagccccugcgccacgucccagcuaagaccaucuucugccuuccaugccccuucuacucuuguuucugguuuuuuccugccugccuuauuuuccccaaacucagagagucccuugggcccugagggucucugacuugugccuuucgaugcgggucucuucucuggauuuaaucagcaccugcuggugaaccaggcuguucugggccugaggcuggagccauucugcagcucaggaaccucacuuguccuagagccagccucuagcaucuagcugcauguccuguuccucccacagaguuaggcuggcagggccuucgcgcugcccuggggggucucaagggcagcucugaggagcucugcugggagugugugaaggggaggagcuccuuaagggccaaccucuuggccagcggauuuuguucucuugaacccagaaagacuacaggagaugugaguccagucaaacugaggacugaugacaaagaccaaagcccagggauguucagucccauccccaguggcuuccagcuaaggcaauuggaccuugaaguccauggggaagucagacguaggcuggugacagggcacacgggagcagguccuuaggcugaccuccugucagugcccucuccacuguggggccuaggggccgagcuguccgcacaaaaagacucccccaggccuuccaagucuuuuccacacuggagcuugaccuaacaguuggagauaaaaaaguccuccuaccugugacauagauucucagggauguucuuauguuugugguacccaugucugaugccuagaacucauuuccgaaaauucagaaauccuggggcagaguucccaguucuuagccugaagcagaugcucagaacagcacaaccacccuuaagucagugaagacagagcucacaggcaagaagcagccauuuucuguaccuaguguuggggcaggcaagaguuaaaguaagauaggcagagugggacucugugacagcccuccaggggagugggggucuuccaggagugccaggccaggcugcauuugccccucgcaguaaacccuggggugaaaccagccagccugugcuccaaguuaccacuggagacaccagccuuuacaaugauuugccuggguuaguggcagggcugagagggcgccaggggccgaggccucugucagagguucuuugcugccucccagaaugucccugccuggaggguggccaggugguggcucccgggcugggugggagccgggccuugcucucccaggcuugcucugugccuagcccuccuugccuggcccucucaucccugguucccuuccacugccugccugcccuucagcccucacuuugcuggcacaggggcacugcuaagcauuugggcucuguagcgacuggaaggcaguucuggcggaucccagacagaagagacaggcaaggcugugcgcuccgggagcuauguguggcgugcuuggaggaaagggcuuggugggcuuuuccuccauuccauugugucccacccccaacuauguggguggcccuggggugacaaugaacagucuccucagggucugauuugucagucagccccacucggggcauuucacuuuuggggagugaggagcuggagccagaacugucccagccgaccugaggagagagugacucaguucucccuuugagaagcucaaucccuaaugccucauuuuccucugggcccacauuuucugagcuuuucugcuuauccagcuuuugggggcucggcuccaggggaaguccgcuucccaugcuguggcucccuccugucuccacccucccagacacugugcuggcucgggggcucagcccagcucaugcuuucccugggcuuggaaucucucuuugccaauuucagagcagcucugagucagucugcccuaggaaauccccccagaaacacggacaaagggaggcagcagcaggaaggcuugcuggaaagaacaguggccgaggcgccuggcaagcucucugcccugccugaccuuggguuuggccugagugauuugugggcacagcuucauaccuggggggaggcaggugugccaguggccccugugucugagggagggcccagccccuucgccucagucaggacccacaucugccuccuaagggacguuguccaggaugauuccugugcgauaauccaucgcucaagggcugcucagcuuuugaagucacugguggggcugaaaugagaagggcagagcagccauguucugugcaggugacauuuccuuuguagccacauagcacccaggauuuagugcacaaagcccagaacuuccucccauggugcccacgggcugcuggcaagcaggaggcucccugucaccuggauccacccagggagggaugagaacccaucagcagggagggucccucugagcuuuguuuguuuguuuauuuguuuuuugagaugaagucuugcugugucgcucaggcuggagugcaguggugcgaucucagcucacugcaaccucugccuaccagguucaagugauucuccugccucagucuccagaguagcuaggauuacaggcgcccgccaccacaccuggcuaauuuuuguauuuuuaguggagaugggguuucaccauguuggccaggcuggucuugaacuccugaccucagaugauccaccugccucugccucccaagguguugggauuacaggugucagccacagcaccuggccaagaacuuuugagagagcagaggcugagucagggguuccuaacuuuggucccugguggggaggggggccucgggggcccaggaaccaacuccuguccugaaauucuguguccgaaguucugggucuguguacaugcucuuugggaauaguccauagcuugcaugucaaggggaucucugaguccucgauuuaagaucuaguggggcagaaagcagcugcucgccaggaacagaaccuugggcccuguucccaccuguccugcgucuugauggagaacuugggaagugcaggcacugcugucugguuccauccacugggcagaggcccuggguuuggggugcaggccucccugcugcucuccuuccccacccugcuggagccuucgacucacaaaggcugcagaacugaagaguguccuggggagugcgggguuggggccuagcuggccacuggucuguuauuuugccugcguccuggggcauuggaguuguuuuuggcaacacagaauaagaaugauggagaaaucuggugggaaagggaaaacauuguuacugaaauuuagugcuuuccuuaaaaaagaaaugaaacucagcaauacugaaauuuuggguagccaagggguaaccaccaguuuaaggcagaacugagcuauugucagcagagucaggcagcaguggacguugguggagagggcuccgcuccuuccagccucugccagugugggcccugccgacugcaccuucccaccgcuacccagagaccagcggcucaccccgcagggagggaacugucaauguucuauagcaugggcuuaauuggaaugguuugagugaaaccaaauuucagucgagauccugcugccagcaagcuggauauaacaguggccuuucacucagggccuggcacugaaacagguccaggaugcaggagagcagcuuggcacauggugccuccagcacccugagggcguggagcugggccucaaaagggugccccgcccaugugagggaaugcacugugugagcgcacgugcagugucgaggccuuuggcagaccccagagaagaugugacaucgugacuaaguagcagugucuuuugccuggcagcucgcagcaccuccccucccauuuccagccccugcccuguagcugccuguccucggggaccccugcaucugccuccccuccuccuaccgcggcaugaggcccuugcccaggcuaccugggcugaugcgcuuugcccugggacucugagaaucaaggagcaguaauuaagcagugcccagcagggcccuguccuugugcaggcugcgguuagcagugcuuccgucagcgaucugcagcggcuaacguguacucgggcgauucagagcaagguauuauuuacccugcugacgucaaugagaacauauuauccacuguccuuuucugcagccugaaaugagcaccagaacucagagaacacagccaccuuccauacucuaaaaauuccacccaaggcccgaugaggcaaaaacccuaucgcauuaaccugacauucacaucacccgggcucuuagaaaagaaguuguuuuuauuuuaauucaagaggguuggaaacauaaaaacaguacauuuuccuugcagaaaauuaccccauuuaaauuacuauuugguacagagauuauuuauuacacugcauuuuaggcaauuuucuaacauuaagugacaaguuauacuuuugauuuuuuuuuucacauuggagcuauuaugauuugcacucauaauaccaaagcuacugaacucaccaauuuuuuucuuaguaauuaaaaaaaagcacacagaaaauauaacuacaguuagauuaacuuuaucaaaaguaacucuuucagaccaaacauccagcaaaaccacccaccucccuucagauauaagcaaauaaucuugcccuuucuacaaagugcagauaucucuguaucccuuuuauuucucaaacugcaguccccgaagugaagcaaaccuuucucuccacuucuuuccccuucagagauuuuggugaaggcagguuucucuuaccacccaugguggaaaggucucaccacuugaauuuccuugacugagcaaaucuucugcagacagacaccacagagccagcagcagcccauuaucugcacuggggaaugugacauuauuccaucuggggucauauguuuccaggauguuguuuuguacuucuauuuuuaaagcuccccucuacccacccacuuugccucugaaaagacagaguauuaagucaaagucuguuauuacuuuuuuaauccuaaaaguaauaagcacuucuaguugauggggcuugacuguaaggaaauguuacgccccucguugagacaaaggcugaguucaugaccguuccugggguggaaucugcuggccugcagugguggccugaugccgugcgaugcggccccuuggcaauugaggaaggggguguucuguaggaaacugcuguauuguaacuuggaaaaacuagacaucuuugaggugagccuaaacuucugcaguuaacuggacgcugaaaggcaggcgggucugcgggguuuuugucucccucagccugguucagugcacggccaccuggacagcugcacugucaccugaaggcggccucuuccccaaagccaggcggcuguugaguggagaauaagguugugggaacaauaucacauucacccugugcuugaccaaaaugggggcuuuguuuauacagcuguuugcuuaugaaaagagucagaugcuacugaggaaagagaagggaaagagagggcuucuuccagcacuagaagccagagaaccaaaaccagaagccagucaacccaagcgcgugucccagcuccuucuaucaccagcugugaucucagagaagucacaaacuucccaaagcuuugguuucuucagcugugaaaaauaaggacaguaucuccccagcuaauuucauagaauuguugugaggguuagaagagaaagugcuugguaaaacuaauguacaaauauaagcuauugcucccuugugggugggcgagcagaguaucugggcagaacccaucacagcucucccugggugggucugcgagcacugcugccgccugguucucuaucugugccccagugugugccugagucugcugauagguugaaaccugccuggagaagauguggacacaaggugggggugcacguaggauggcugucuucuagaaucagcuaggcuaccuuaauuaggacaaaaaugguaaaauaagaaugugagaggcuacuggaaggugagaggcuccacugcuuucguucaccugccaccaagggccagacaagggcucugacauuacaggugcuucagaccacacuguagaaccugucagaagggagaugauagaaacuuuaagaaaaucucuuuguccaguuuagaaacagaggcagaugauacugcucuugucuuuuuuuuuuuuuuugagguggagucuugcucugucgcccaggcuggagugcaguggcacgaucuuggcucacugcaagcuccaccucccggguucacgccauucuccugccucagccucccgaguagcuggaacuacaggcgcccaccaccacgcccggcuaauuuuuuguauuuuuaguagagacggcguuucacuguguuaggauggucucaaucuccugaccucgugauccgccugccuuggccucccaaaguguugggauuacaggcgugagccaccgcgcccggcugauacugcucuugucuuucauacauugcucugaagauaaguucuauaaaaaaauuccaggucgggugugguggcucacaccuguaaucccaguacuuugggaggccaaggugggugggucaccugaggucaggaguucaagaucagccuggacaacauggugaaaccccaucucuacuaaaaauauacaaacuagcuggaugcgguagcacacaccuguagucccagcuacuugggaggcugaggcaggagaauggcuugaacccaggagguggagguugcagugagcugaaaucacgccacugcauuccagccugggugacagagcgagacucugucucaaaaaaaaaaaaaauuaaauaaauuccagaagcaacaaaaugaucaaagaucccugccuguacaaugacuccaacuuacgagcuucccuguucuccaauuuucaccuuucauguuuaggcacaaagagaccgaguggcucggguggcuucccaggaggcaguuagaggcagcccaguuuaggaguuugaguguagcaggucagcccuggcaccggugucagccacuguucacagggacugagacugugaaaugacacacugcauauugucucuauaggaggucgaaugggaaaaaguuaccuggaguaugaauuuucuuuaaaccaauagggagcuuaaaugugacuguugauacagguuuuaaaauguaauacaaacauauuuacgaaccuggggcuugacuagaggcuggaggaccccaaaaaggagcgccacucacucacuguguccuugcauccucaacugcccgcaugucuccagaggcugcuuagugcccacacgccugggaccaacugugacuccaggcugcugcuugucaccuugccuuaguuucuggcugaucaccuaaucacucuggagcugagaauauccuucuccccacaucuaacccgugggcagaauucugugagcguuucccugccuuuaggacugaugacacucgguguguggguggaggugggggagucgucagucuuaugaugagucucuucugcuggagacuuugguccacgagagaggguagggggcaggggagaggccgauacuccuacaggggggguccccccuugcuccccaucaaaaugcagagcaccccauuacuccagcaccagaguugggaagggacacaagaggcaagggcuggcuucagucuugggcuccugucugucccaaccacugacuccagcauacgguuuaaacacuugggaguucuugauaucugaggaagaaagggccacugacuuuuucuuuccuaggaggcaaaaguggauggaagagagaagggguuugcucagaugggcaugaacagccccugagccccauccccacuccccuggugggcccugaugcucucccacgcagggauucucaagguggaugguguagagaaccaucagccuccuuuucccacggugacagaaggcagugcaggcagagguggcgagggggcagcuggggacggucagugucaccgggaaugugaaagugggcccccucuuccugucgggcuaacaugcuguuugccuuacagggaccaguguaucaguugcguggagauacuagagacacacuugcccagcugggaauugcagagcuagugcauuucucccaaagcacagacuaauaccccagauuuaaaaaaagaacauaaaaaauaaaguaccacacauauugcacuuuuugccgaacgaaauuuuuaccucacguucaucucaccaaagucucuucagaggagccugguuuacagggugaugaagcugaugaugauacaguaguguacacacugcuaacgugaaucagacuggaaagcaagucaguacuucagaguagccccgcagaaaaagagcgauacuaagccuucuuaguguuuuguuuguuaguagugaugaagagaaaacugcuuggaagcuuccaugggucacuaguuagggacagagcagcacaggugaucagacagggcugagcaaacaccugacugaccaacagaaccagucuccucagcagcuuacauugcagucaauacagaggguuauggaauuuauugauuucugcuugaaauaaacaagauaagcaaauaggagcuuacaacacaggucccagcaggaggggucacgcucugcaucaggccgguguccacgccgcugccgugugugacggauccugauaggccuggcugcuguagggcaccucucgauuucucucuggguccuuaaccuuccaguagccucucugcagucccucaucggcuggccuaaccguccugccauagcucccaggucuccugggcuaagcagcucauggcauuguuggggggcaggaguuuaugucgaucuguaacuacaccauuccugcaguucugaaaugaguggcccccauuuucaaucugcaggcauuuuaauaucgcaaauauuguagcacuucuguaguauauuuugggaaaacgucuuccuucagucuaaacaaaucaagccccauuuuauaacuggcuauuuuguaaagacucaaaacagauuagagaucuuaaugaaaugaucucuuaaaugaaaugauguucuuuauuucacgaaaucaucaaucuuaagcacgagcaggaauaaacaacucccagaagaagcuuaauucauucuuccuggauuuucacuguguguuauuaaaucacaaaaaugacaguccccacacugcccuuucccacugacaccaaguccaaccgugagcacagugccucugcgaagcauccuggcacccauggugagcgcuggcgaccaggcagucucuggccagcaacagggacugcucaaguuaccgacguugguaggagcugggcucgcauggccagaauggaacccccuagacuuuccacacgucaccugccugaacgcuaacuacaaagaggaaaggcaacuuaaagguguuuucuagaugcagcaucaguuagucccucucuuugugcuuuaaggaagaugcuuugugcuuaacacauucaucugcugaugggacaagccauucuaaagggcagaaaugaucaucuuuagaauuaacacugacuuuguaacaccuggauguuaacuguccaaauggcaaauuauucaucauuucuagggauacaguuagcuagcuguagcaucuaauuuuuacuuacuuugaugacugaauuguaaguguugguuaaguuuuauuaguaauauaauguuuggcagaugaucugcuuaaaugguuaacacaucugugguucuuucuuugaauauugcuguaauacuugaacauuucauuacaagucaaaacuuuaacgaaauuaagaaugcugauucccacaugguggaaaacaaacucugaagugacuuuggauuuagcauugacauaaauggaaacuguugguuucuacagaaaagaaagaauuaaagcaugaucugggggaaaggcaccgcacuaccacuucacaugggacagaaaaguucauuuaucauguccuuaaaaucucuaagcccuauaugaaacuguc

SEQ ID NO: 15990 - RNA, 23276 nt, Homo sapiens
gggcggaggggcgaccgacugacuccgcgcccucccccccgccucccgugcgguccgucgguggccuagagaugcugcugccgcgguugcaguugucgcgcacgccucugcccgccagcccgcuccaccgccguagcgcccgagugucggggggcgcacccgagucgggccaugaggccgggaaccgcgcuacaggccgugcugcuggccgugcugcugguggggcugcgggccgcgacgggucgccugcugaguggugagugcgcgcgcuggggcgggggcuggugccggggugggcucacugcaccccagcugcugcugacccucuucugggucgccacguaugggacuagaaggccgucccaugccccacucccagacgcagcccuucggagucucuugcguucugggggcagucgcacggcgucugagacccacgccaguucccggagcugcgcaguucccugcgcguccuggaacgcucgaagcccguucccaguccagaguuauggggguggguuggagaauguaggagagguggggcagugggcaaaccugccccagugggugccccuucggcccgcuccuuuacacgcaucgaaucaguccuugggaccacccccgcggggcaggcuugccagcuggcccccgccuaccgcccgcuccgggaggcggccgcagagacagcgggguagggaugcuggauccccggugccgugggaacccugccuguuacuccucgucucuucugcgggguuggauggcugggucgagcgcccgguaugagagcgcuuagagaucgggaaagaacuccaguuagugugggacgagccccaccugacuccggggaaugacucucugcuuccuuccuccuguugugucacugcagccucggauuuggaccucagaggagguaaagugcucuggcuucuggcuucuuucaguuguucugcaugucggggggagaacauccgugcccuuuucucagauccuuuuugcgggugccaacagcuugaccaaacgggacagaggagacugggaaccuccucuacucuggcauccuggcuugcgaaacuaauuuaaagaauguaaaguugguuucaggaugggggcggggcggcaaaagaggugggaagcugaauugagcugcuuggguuagggcugcgugggcucuguccuuggucgcggggaacagaaggcccucccacccuucgccuuccugcaaaugagaagagaaggacacuuccugaaggcaggagaaccagauaggcccgcgggccuccuuccagcucugacggucucuggcacucacccgcagacuucggauguguggccaggcuggaccauacaggaaacucgcuuaagguguuauguuucccuugacaauccaacauggaaaguggggguugucaggaaauucaacuccagcuuauguuaugccgguggccagguuggauaaguuccugggggcucauuugccccuccucugcugcccaauuuggagccagcuuugaggaaucgcaaaagcguggcuggcccagcccccuucccggggguaucccugccucagccucucugaauaccuucuugcaagcaggucuggcuuuugaacccuccuaaugugcugcuggaccagucuaauuagaguuucucuauuaucagcaauagccaaauaaugacaggaaaagggagaagauguggaacucuuauaacuuguugcucauugagaauuccuuuaugaaagugaugagagaagaaauagaaaaugaagacucacuggagcuuucuggauaaucuguaugugcucuuucucauuuagcacuaaucauauaguucuaucugucuguggccccuugcccuauaugcuggccaguguugggaauuaaugaaugcuaucuggcucccugcgcagcuguaaaacaaguugggaaaacaagaacauuccagaaguucugggaggagguucccaaaccaaaauauuuuacccccggcacuguggcagcaguucgcacccacagcccacaauuuggcuuucucuuugcagggggacuacuccccguguugauacgugguuuucacuuugaacauuugaauccggaaacauaugcugugugcuccuguggguuaggaaguagcuuuuguuccuguauucccagcaccucgcacagugccaggcacaaaguguacacucaauaaauguugauugaaugaaaggagugaugaggcuagugucuccauugcagcaaggcuucagucacacagacgcaagcuagagcaguguguacugugagcgauuuguuauuggcuccucaguaaaaucccaucuguuugucugagaugaucuucagcccuucaggggacagacugauaagacacauuacauaggcucccaguaaaacaugagccuggggugcagcggggagcuagcaauuuaguucacugguaccagcaugauuuuguaauuagaucugggcucuaacuccggugaugcugaugaucacugugugaucuuggccaaauuacuuaacuucccugagcuccaguuuucucauuuguaaaauaagccauaaacaguaucugcaucaggggacuauuaugaggguuacaugagauaaaguauguaaguaaauguuaagcccuuaccauaguuuauggcacauaguaggaguucaguaaaccuuaacuguugucuuuaggucagagggcugacugucaguagcagaaaaccccguggaucugaugcuuuuagcuucugcuuacaccagagacugggcaaauucucaguccugcugcacaggcagaggguuccagaauagaggagcccaugccugacuucaggaagccucucuuaccuuaaagaaccaccagagacacccccuuuaagccacauuauccccugagacucccuaaugaaaguguuauuugugugccuuucagugaaaccauaaaucuucaucuacuucucuucuaaaggacagucaaaauaaaacauuugcuuuuuaagauucuguaauggaacaaacaaaacaugaugucccuacacaauauaggcaucagaguuuaaaucacuacaucuccaugcuggaaggaguauuaauuugcucugagaaccccaacugacaugauaacagucuacugauguguaaccaaaauuccuacccagggauaccuuccuuuggaugccuccacguaucccugccccgguauacuuuuugagacacugaaauagauuggcuucuuuuuucucuagggcagccagucugccggggagggacacagaggccuuguuauaaagucauuuacuuccaugauacuucucgaagacugaacuuugaggaagccaaagaagccugcaggagggauggaggccagcuagucagcaucgagucugaagaugaacagaaacugauagaaaaguucauugaaaaccucuugccaucugauggugacuucuggauugggcucaggaggcgugaggagaaacaaagcaauagcacagccugccaggaccuuuaugcuuggacugauggcagcauaucacaauuuagguaaguguguggaacccacagcugcugacucacuugacauaacucaaaaaagaggcaggcuggauccacagugccagaucaguggggaagagaagaccaaccaggcagaucucugaagggaaaguagcaccagaauagcugcugaccuaagcagugcagguggugaacuuagccuugauuugggcccaacugauguccaaggaacucuguucaggugagugcagcccagcagccuuguuucaacagcauauaaugcuugaagccaguuguucuggcucucuggccuuuuggaccagaaccucauggagagacugaagauccaaagggcuaugacucaggguaggacuccaguccacagggaauuguaauaaugggcaagaaaucagagccaagaucuaacucuguggauuggccaaaaguggggaccucaggaagccugcaguguauagggcccugcuaaacccacagcaucaagacucacucauccccuacccuggaaacaugacauugccaucaucccucccuaagaaaugcaaugacauagacaaacauuuaaaaaauaucaaaauuaaaagacagacaugagacuaggagaaugcguguaacagauccaacaaagaguuaauaucuuuuuaugauaaagaguuuauaugucaauaaaauacuaagaccccaaaauauaaagagacaaaagaccugagcagaccguuuauaaaauaaaaaaucuaaugguaaacaaucauauggggaaaggucuaaacucaucaaaagaaugaagauuuuaaaauauauucuuuaacauauaccuacuauguacccccccaaaauuuaacaaauauauauauauauauauauuuuuuaccuauuacauuuaaggcagcacaucagcaucuaucuuaguccacccauuacacugaucaggugcacaucuucauauaaguucugggaguagcuccuccaggauucucaugagccugucuuccugggagaaacuuuagaaaggaggguuaguaggaugaacuacacuuccuaucagugcagcuggucccaaggccacagaugguacuuauugacuucccuacucuauuagccaguccagauucccuuaccgucugcuggucucaacgguugaccuuguggcaugauccacauccucauaucugaagaaucugggguccuaguugccuugcccuuaucaugcuagaguuagugcacuuuucuauugaccaucaaaauugggcaagcaaauuccaagagguacccaaauagauaacuccuugcccauaauacauaacagcaggccuaucuccucccgaugguuagggccacuuuccuccugccaaaacaaugucuucucuuuuucucugcuggucccuggacacaaagauuccagaguguccaaaugacagugauaacucaucguuuaguaagauucuuguaucuucugacaguccccugugggaaccaggaccucuaaacuuccagaucccaguguugcagagacaagaagcacaaauuccuacgugggucacugccagcgauucuaaaaugaggcuacuccugcuuccaccccucagcucccaaacccauguauucuuauucuuggaaacacaggacuguauaaagggcacgugaguuauugccuuuuucagaagucccauguaaucaacuugccaccaagugcuauguugguguccucaaguguuggugcugugucaaagacuuagcauugguuucuguugcuggaaguugaacauucggcaguagcaauagcuagauuagcccuagugaaugagagccaaucuguugaggccauccauagccuucaucucugccacuaccuauuaguaucuauuguacuagcacugggguggcuaauaacaggcuggcuggcauuaccuagcugaguuauuuugucucccugcuuguucagugccucuucuaaguagauguuuccugguggucuuuaauaucugaugaaaagaguugcauauuuuauguucacucuucuauguauagucacaucccucuauccaaaaccuccuaguccacaaucuuccagucuauuuccauuuagacucuugaucagcugggcaugcuauuuaccuuaccccuaguucuuauauaaucuaaucuccaauaauuucccuuuccuuacaaagugguuaacuagauguaccaacuaaagcucuggccauugggaagauguucccuuacuggucucuuucaaggccaccucagugaaacugcagugcagcugcuguccauuucacuguguacucccauacuuagcugaccuacccuugaaccaggcucaggcugccuguaucagcuagucacaagggauuccuccaugcagucacagaugugagcuaaggaagaggcucugguccagcaguggcagaugucauggaagucugcuuuaccugcuuaugcagugcucuuugguccuggauguaccucuuccaucuuacaacggaucuauuccaagcuugccuaaucuccgauuaggugugucugacaguuccuugcucaugaugggcagguugugcuucauggucucuggugcuccuugccuaguagccagccaggaauuguuucucaaaaggugacuaauuuucagcuacagaugguauggccuugcuucaaaauccuaugggucugcaugugauucugucauugaggcuugucacaaacucuguauggcauaauuuuucccaccacugacaucucuaauaauaggagcugcugcaucauauggcccaaguggcaaaucugcuugcacacagccuagauccacuucagaguucuuuucugcugugacuccuacucaaaauggcuguauuccaugucaccugguuuaugggccagagcaauauucccaggugugaaauaugcugccucuagagcccaaagagaccuaccaugugcuaugcuucauucuucaaauuacugcaagaugcaauaguuuguucuucaauuugaaagggauguucugguauucccuagaucacuagacacccacacauuuuauugaagugguaggcuccugaaucuucauaagauuuaucuccaacccucuggaguacauaagucuuaccaaggcauccaguguacuaaccacuucuugcucaucuguuccaauuagcaugaugucagccauauaguaggucagugugauuuucugcaagaugucuaggaaauccagaucucuuuacaccauauuaugacagaggacgguaaaaauuaauauagccuugagucaagaccauaaguauauacuguuguccaucccaacaaacuguuucagauuaucuuucugauacagaaggaaaagaauguguucaccggaucugcauacuagguacccaagggcauguuaaccugcuuuagcaaagacaccacauauggcacaggcagccacaaucaggcuuccacuugguugaguuugugcuacucuauuaucaccuucaggaucugccugguguuuucaggagucaagacuagugaauuaacuagagaugcaauggggaacaccacucuuggauucuuugggucuuuaagggugacacuacuuccugccaucuuucccuggauaagauauuguuguugauuuauuaucauggcagggguggggaggagugcaguuucaaaggcuuccccacuugacauucuccaccgugauagcucuugccccacagguaaguagaccaagagacgacgcagcucaaccugcccaucauaggccaaggaaccaauguggaacuguaccaacuaaaaauaugucuguucaauucauauauuuggggacuggggaaugaugacuggcugggugccacuaugagcugauccugggccagaccucuacuuaauaccuguccccaguaugcucccauucuaauggguagcuuugaugacacuuuaagucugaguauuaaugucaacuugcacccuguguccaacagcccuuguaauauuuggauauucccucuuccccgcuguaugguuacuggaggaaauagccauggaucccuuuagggaaaaacgggaaguuauuaccaugugcaccugccgugguguugcaagguccuucuuacuggaaaccuggccucucuaucagugaguucugggucugaaaauuggcucaaguacagaaauuauacaccagacauaauauucaaccuauaagacaaaauaauguaaagccauaaggccaguggggaggggaacaaggcaagucaggguaggaggcccaacagggcuggaaucuggacuggagauaacuaaugaggugcccccagcuguccagucauaguauccaaggaguguuuauuguaagcuaagcuauuuuccaggaaauucaauccagugagugcagcaaaggauguuccuuuuaguagacaacaauacaggacuuaagcagagccuuacuguggcgcuacagggagagcugucucuugcugucucuuuccugaagagggcucugacaagagcuaagcagagcagcauugccugcucugagcaucagagcaagaucugagcccuagaaggaaacagcucaggcaacuaaccagggagguuacaaagcccagcccugagucagcacaugggguggguacucacagauguaaacgcuccauaagauccaaggcuuuaaccuggcacccacauauccaacuggguggcagcaccauuuaguuucaagugccacuggauaguaguguaagguugcuaaugcaccccucuagggggcuagggagacaaagacaagacaucuggagguagaggcugaggggcucaucagccuuaucaaguggaaacaacuuaaaaacugaaaaagaccaaaugguccuccugcuuuuguccccacccuuucaccuguuuugacagccucuauguuuggaaugucuugcucaugugcuugaauuucuuaucuacuucccagggcugaaaaggcaguugguggcuguugaaaaucauggagagaugagagcagggcaagcucuggaugagauaagccaugucucuucucagugcaucugagaucuaaaaaaagacaaacaaacccaauuagcaaaaagcaagaaagaaauaagaucguccagacuagcccugcuggcugcuuuuucucauaauuacuuuacagacaucauaugguggcauguuccucccugcaaagagauuguggcaaaugucagaugauugauugugauguccauaugagaaugcgugugguucugcuuacuggcaguacuucaauuccuaccucucucuguaucauguucugaggcagaaucuuauguuuauggcucagugagacuugacgggaaaacaaaggcuuugaagucucaggggauccuucuccaguugccucuacugcugaucccuucccuacaggaacugguauguggaugagccauccugcggcagcgaggucugcguggucauguaccaucagccaucggcacccgcuggcaucggaggccccuacauguuccaguggaaugaugaccggugcaacaugaagaacaauuucauuugcaaauauucugaugguaaugaauccucucccaagcuaugcggcugaauucucaacuucucucauuucaugagcugcugcuaguaccaagaauuugucauguggucucugagaaagcuuguugcaaaugccagcaacauaaaaccuuaagaauucuuguaaagggcaauguaaugacaauuccucaccgaggaguaauccuagcaaaggaaagguuaucagauguuaagagaagggaugagaaaaagaaaaggucuaauuuaugugugauaaagcaagucuuacaagaacgucaggaaauaagcccuuuaaguggacagccacaaauuauuacucuuuccacaugugagguuggcuguaggggcuuagaauaagcuggccauugcuccuacaagucuucuaacagcccagugagauuauuuucugggguuuuaaggaagcacgauacauauguaaaugauaaaguacaccaacugcacuuucacugggcagagauagcagguaauuugaugagcagauuuaaacucucagaccacccuguauuuaaugccuugcaaauucaacuuacguuugcuuccagaucuguuaggguuuugaacuggcuacaagcuuguaguuuugcuauacuuggguuucccagacuucuccauuauaacugacagauuugaauuugaacugauucuuaaucugcccuugaaguuucucacuucccuaaagccaacugcuuagccccaauucugcauucuuucuugauaggaguagagugacuuguuaguuauaucuaguuugggacuaaguaauccugucauuuuaaaauuguuugaacuggacuaugguuugguggcaauuuuugcugcuaaaagauguuuuucucucucuuuguccucucggaugaauucuucucuccagugaccuggcccuccccaccauacagcguugucucaggcggggagauugcaaagaccuagacugacuuagcaagucaccuuuaugaagcagugaaagcaaggcacuuguuacauacuggcuuuccaucacuuuuguuaauuauauucuauuauuaauagcuccaugguuuaaauuuuugcacuuccuuuaacaguuuuugaaaugugagguuuugaaauuugcuuuaauauccuuuuauuuuggacuuggcaccuucuuagaaaaaaucauauucuucauuacuuuuguuauugccuauauuagucacacuaaguccuggcaagaaaaagauggcacacacaaaggguuuaaugaggaaaguguaauaaaagggacauuugcugagguguaggccaagagcaagagaugguaaaauauccagggacuagcuacaauggggaacuguuauguccaggccugaaggaauaaaaggagggaaugguuuuagcagaacccgggaaaagcuuggggucaugaaagaggacccgcccaacaggagcuauuaccacaaaaugcagcuacuaucaaaccaugcugacgugggaugggggcauggggaauaaauacugagacuucucuuuccuucuauccucugaccuucugccuuugccucucauuggcuaaguccaaucagagaccaaagaacaagggaacaaggaagccccauugaaacaguuuauagaccucaaccucccaaggcacagaggacagagaauggauccaacagagggaggugggcacauggagaaaaacuaacacacugccuguuuuuggccacccaugcccagaauaguuuacacaccuuagcaugccagaagaggaucggcacaaccagacccuugccgaccuguccagcucaauucucaccacuuuaacuccucuccucauccuauuccaacaccuuuguaccaaauggaauuucccaagagcucuuaauuucuguuuccugugcuugaaacaccccuuucccagccaacucauucucacccuuuggcuucagauuagacaacaccuucucuccuaacagcuaagugcaaccagugauccuggguuggauccugaacaugaugugaugauuuccuauaaauggcauuauuaggaaaaucgguagaaucugaauaagaucaguagauuagaaaauaguauugcaucaauguuaauuucuugcuuuugaucauuguacugugguuauacaugaaaaggccccuuucccuuuguaaauauggacaaaaaucuuuaggaguaaaggggcaccaugcuggcaacuuguuugcaggaaaaauguuauguauguguauguguguguguauauauauauauauauaugcauguaugcacacacacauaaacguguguaugugauacaaagauagaggagagauaagaaagagggagaauaauuaaguaaaugaaaugugaugaaaugauaaggugaaggauaugggauaauucuuuguaccauucuugcaaauuuucauaaaucugaaauauuucaaaauaagaaguuaaaaaaauaacuuccuuuggaaagccuuccagagccccucaaagcuagguuuggugucucuccuauaaggaucguagcaccucacccacacaguacuuuaacuaccuauuuauaaggcuguccccuucacuacaugauuggcaugaagucuggaaacuuaccuguuuaaccacuugaugggcuggggaagcucacuccugugguuccagcaggagggcgcaucaucccauuaugucagaguggcaaggaacugggugaaugauaauauguaaaacuagauuugagaaaauaaucauguagaguaggcagcaugcuagccauagcugaacacuugcuuacuucuggggugugcuaaaggcacaggcauauucagugaauaucagaaacaaaucaugaggcaacacagaugcacgugcagggauugauggaaaugcugcaaugaugugccguuuuuaacuuugcaccguggauugaaguauggagggacaacaguaugaauagaucauguguugaacagaucauguuauuacguauuccaguguaauaucacaaaaucaauguucauuaauauuuuccuguauuuccagauuuuauggcuauccuguagaauauaagcuucuuagagggcugagauucuuucuuguuugcuguuuuaucuccgcuaccuagcacaguuaugucuccuuacuauuuuaauuuucguuagaauguguuugguugaaauuccuuuacagcuacuuaucagcugugagauuugggcaaguuacuuaaucuccccgaaucuugguuuccucauguacaaaaccagaauaauaauaaggccaccucccauccuggcuaacacugugaaaccccgucucuacuaaaaaauacaaaaaauuaaccgggcaugguggugggcaccuguaaucccagcuacucaggaggcugaggcaggagaauggcaggaacccaggaggcagagcuugcagugagccgagaucgcgccacuggacucuagccugggcgacagacugagacuccaucucaaaaauaaauaaauaaauaaauaaacaacaauaauaauaaggcuguuaucaggauuaauugaguuugauuuuauaaaacacuuagaacagcccaggcacaguggcucacgccuguaaucccagcauuuugggaagcugaagcugguggaucacuugaggucaggaguuugagaccagccugaccaacguggugaaaccccaucucuacuaaaaauaaaaguacaaaauuagccaggcaugguggcgcaugccuauaaucccagcuacuucggaggcugaggcaggagaaucgcuugaacccgggaggcggagguugcagugagccaagauugugccucugaacuccagccugggugacagagcaagacucucucacauaaaaaaaaaaaaaaacaacacuuagaacaguuucucucauauaguagacauuguauaacuggguuuuuuuaaauaaauggauuuacaucaccuauacacacacacacacacacacacacacacacacacacacuuaugggaagaugacuaaaaguuuuuguccuuucugagugaaacuucagaaugggcuugacauccuggccuuaagacugugauuuuuaaggucuuucccuuaaagacccugucccuacgaacaccagagcaucugauuggcauaagagacucauugccaauacaacagguggacacacucccagucaaaagcaaaaacauuugaugucaauuaucuguacaaccugauauucucaagacacuuugaaauauguacaaaagcucagagcucuagaucaccagccucugccuuggugcuggccaguggucuacugagccccuaaaccacuuucacuacuuggagaucaguguuuguugcccucuaaaacauccccauuaugaacugaaaaaaugucuuagacugcuuuaaaauaauccaggccaggagugcaggggagaggaguagggauuauuguugaaacuagaugagcuguacauugauaggaguugaagcugcaugacgauacacaggguacauuauaccaguuuuucuacuuuuuuguauauuuggaaauuaucauauuuaaacguuuuuaaauacuuuuuuaaaaacaaaaaagcaccaaaauaaagcuggggaagguuagucuuugugcaaaagcaauuauuuugauuuacuagcccaguuccugauaucugauaacaacaaauaaaguuuaucggaggaaugaaucagcaaauaaauggaugccaugaggcugugguugauuucauucagaugccauaaaaacuuacuacuuauuuuuguuuuuguuucuuucuacuacagagaaaccagcaguuccuucuagagaagcugaagguaagccuguuacuugagauuuggguuaacuggggcuguuucauagccccucuucacagguuuaaagcccuauguccuuuggacuggauuauucaacagaaaaacuagugguauuaacucaggcauuugggacagguauacaccacacccagccaugacagcuaguuuagucaucucauuuucuaguguucucacagcugaaaagcaacaguuacaaauuuuguuugggguguuacuugucaucauugacaauaucaaaggaauaauuuaaucuaaugagaccaaaaaaaaugagccaaacuguuaauuuaugguccuagaagugaguccuuggcccuuccccuugacaccuugguauuuuauguaccuugaugucagcugcuucuugauuguuuuaguacuggauucuugacagcaagggucucaccaaaaagacaaagauaauuuaaaccucuagugcagcaaauucaacccuuuacuuuucuacguuuauagauggugcuggcaaaauuucuacagcuuuuuugcaucccaauuugaacaugguaggaccucaaagaauaccugaauuaugccuuucuucaaguucacaaguccaugugucucucuccaggugaggaaacagagcugacaacaccuguacuuccagaagaaacacaggaagaagaugccaaaaaaacauuuaaagaaaguagagguaucuacaaaacucuccugggaaagaugaauaaucaggcucccuugauuacaaauuacccaugguugaauucccuacuuuguucuuucccacagcuaccuaaaaauagaacuagacagggcauguguggcuuugcaaaagcuguacuaaaugcuagguuucaucaaugaaauaugcagauggaacuauccuaagaugacuggggaaaucagacagcaggugaaaaauuugcaugaagacagagccuugggagccacucagaggucaugugggguaagguggagugaggacugagagagaaaauguagagaaauaagagcagaaagacccaagcugugaugcauaacaucuaugauuaauauucaucugcaaaacaaagagaagaaauagacaaaaacauuuaaaauguuaaaucauaaaagguaaaagaaaauaggaugacacauuggagugcuaauggauuucaaacucacucuugcccugaaguucaauaaggacaucugaguuuuugucacugggcaacuuuuaaaaaccacuuuacuucucugugcuucaguuuaauuguuugcauaauggaaguaauaauauuuuucuugccuaccugagagcacaacuguguccauaaaaugaaauaggauauugcaauagugcaguucaguucugacacuaaauuccagaguuggcacacacuccagcucaugagcacaacucauaccaagacugcccucacuucagacauugacugcaaguuuagggguccccaggccaccugcauuucugaccaauuggcuacaaauccaggagugcccaugauccccaccucuuagguuugauaauucacuagaacaaccuacagaacucaggaaaauaguauauuuaugacuagauugauuguaugggauacaaaucaggaucagccaaaugaaaagacacacagcaggacgucugggaggaguuuccuugucaucccccaccccauggaaucaggaugcauuagcauccuggcacaucaguguguucaccaaccaggaagcuccacagagcuuucguguccagagguuuuauuggggguaucaaugcauagcagucuccaaaagaggucaggcugcuaucacuaggcucaaagccccaacccuaucaucacaugguuggucuuucuggcauggccagcccccgucugaaucaucuccuuauaaacccucuuauggucugaggggcucaugaauaacaaauucacuccuauuacuggggagaguccaaggauuuagagccucucucccaggaaccagggacaaaggcccaucagauucuuuauuauauaacauauaugugaaaaaaguacaaagugcucugcaaagguggguggcauuucuauugcucauuguuauuauggugguauuuaaaguggguuuugaggguuuagggguuuuagugguggucagguuugcaaucucacagaagaaaagccaacagccucuggauagucaggaagcuugggucagugggaguaggaagaggguuagccuccaauccuugauuccucccaaagccacuugaggggaacaucuuugguucuaagucuuaaaggacuagaaaguucagaaaaguaagccucuaagugcucuucacagucauggcucauggacccaacugaaucuaauuggucuuagaaaugucagaaagguuuuacacuguaauuuacuugcuuccugugaccucuuuccugguaaugacacugaaacuucuggcuugcuucuuuuucccucucuuucccccaucccaucgugggaacuccgugacuguccuuggaggcaaaagcaucaacacugccccagcggccccugcuuuacuaagggaggacaagaaaagagagacucucuuuucucugaaaaaaaaaacaaaaagcuuaauuaacaaaagugcccuucugauauuuggaagaccuaaaaauuuaaacugauuuucauuaucacuuaggguaauaggacagguagaaaaugcucauccaucgaaaccagaagacucuuugcuaacuggcuagaugugucuugaucacucaggaaugagcucuuuggaauacucuguguugauuagccuuuuccuuuguuuuguuuuuuaauuuuuuaauuuuaauagauuuggggguacaagugguuuuugacgauuaugcuuuuuuuaagccugguuugaagcacagaaaaacaaaacaaaaaacagccaaugcugaucaugugcuuucuuucuuuucagaagcugccuugaaucuggccuacauccuaauccccagcauuccccuucuccuccuccuuguggucaccacaguuguauguuggguuuggaucuguagaaaaaggcaaguaaaaccuucauuguguaaaccuuugcaucuucugcucucuuugagauuuggauauugccuuguuuacuucauuaaaacccacggcagcaccaagaguaucaccauugcagauuggagaguggguucucugacaggucagggcauucagaaguacuaggcauuugugcuuaguugugauuaagagagugaucuuacuugcuuuacugucuguacguggaagauuuuaaaacaacuugaagggugaaauugcauuauucaccucccgugcacucacacgucacccagcaaaaaugcucucaugaauguaugcccucacucugaaaauguuuguggacugagugaaggaaugaauagugagccauaugaaaaaugacugcugcaaaguauucugguaaacaucugaaacuaaaccacuuaauucaaacugaaagagccaaauuccuuuuaacugacuuuucuuuuaauucaguacacaaguauagagugcuauaaaauagcuacacuagguggcaucaacaauuucuguauauggucaggaucgugugccacuauuuuauuuuauuuuauuuuauuuuuaguacugaaagcucuucucaguuaccuuuuuauucuccaucaucaugguauauggagaagaugucuaguauucccauuuacaacaggaaaacuaaggcccaauuuaagauuugacucccuuuaaagaccaauuugagaugaauuaguaagauuccaauguaaaaucuauuucaguuaauuguaacuuccuuguaggauuauuauaaggauuaaggcaguuaauacuugcagaauaaguauauacuaagcacuugaauguuaccuauuauugggauuauuuuauuaguuauuuccuuugaaucuuaaaguagaauuuaguucaaaaaauuacaggcauauuuuccagcugccuacucugccuacucaguugguucuugauuuccuuuccugacucucuguuuuguacuuuaacaggauuugggaauugugacucuaaagcuggggugucugucuaucccaaggguuuuuaaucuuuuuugugcccugcagcagucuggugaggccuauggacuccuuccagaacaauauuuuauuuuauuuauuauuuuauuuaaaaaaauauauauauauauauauauuugagacagagucuuucucugucgcccaggcuggagugcaauggcgcaaucucggcucacugcaaccuccgccucccggguucaagugauucucgugccucagccucccaaguagccgggauuacaggcacauaccaccaugccuggcuaauuuuguauuuuuaguagagauggguuucaccauguuggccaggcuggucucgaacuccugaccucaggugauccgcccaccucagcugcccuaagugcuaggauuacaggcaugagccaccacacccggcccaguacaauauuuuaaaugcauaaaauaaaauacauuggguugcaaaggaagcaaucauacuguuauauaguuuagcaaaauauuuccaaaaaugaauaugugauuaguaauacauguacuccuuuauuaaugcuucuuuauuuagugcuggguauaauuauuauaauuuugaaguagagaugagguuaaaauauuucaaggcaucuauaacugugauaugaaaacaucuauaauuucuaguagugaucaagucaaagauauuaauccugcuguuuuaucucuuacauucauaauggaaggacaugcuaaauuucacuuauggaugagucguguuuuuuguuguuuugguuuuauuuuauuuuauuuuauuauuuuauuuuauuuuauuuuauuuuugagacagggucucacucugucgcccaagcuggagugcagcgguaccaucacagcucacugcggccuugaccucccagguuauccucccaccucagccucccaacuagcugggacugcaggugugcaccaccaugccugguuaauuuuuguaucuuuuauagggacgggguuuuaacauguugcccaggcuggucucaaacuccugggcucaagugauccaccugccucagccucccaaaguguuaggauuacaggcgugggccacugugcacagcugagguguuuuuuuguuuuuuuggguuuuuuuuguaaugugguauuuuuucucuauucaguucuaucccuggacacuccagggacucuagggaaccccaggauaauaacccugcccacacuugggcagcagugaaugacagauacacaaucacuuugaacauaacaucucccuguuugguucccucccacuccgaagcccuggccuguaaguuacauagacgagacaugcagcugggugacugcccagggcugcuuccucucgucucaacaggaagcacaaggguauucucaaucaccuggucuaaaacacucagcccugguuuucuuucuuccuagaaaacgggagcagccagacccuagcacaaagaagcaacacaccaucuggcccucuccucaccagggaaacagcccggaccuagaggucuacaaugucauaagaaaacaaagcgaagcugacuuagcugagacccggccagaccugaagaauauuucauuccgaguguguucgggagaagccacucccgaugacaugucuugugacuaugacaacauggcugugaacccaucagaaaguggguuugugacucuggugagcguggagaguggauuugugaccaaugacauuuaugaguucuccccagaccaaauggggaggaguaaggagucuggauggguggaaaaugaaauauaugguuauuaggacauauaaaaaacugaaacugacaacaauggaaaagaaaugauaagcaaaauccucuuauuuucuauaaggaaaauacacagaaggucuaugaacaagcuuagaucagguccuguggaugagcaugugguccccacgaccuccuguuggacccccacguuuuggcuguauccuuuaucccagccagucauccagcucgaccuuaugagaagguaccuugcccaggucuggcacauaguagagucucaauaaaugucacuugguugguuguaucuaacuuuuaagggacagagcuuuaccuggcagugauaaagaugggcuguggagcuuggaaaaccaccucuguuuuccuugcucuauacagcagcacauauuaucauacagacagaaaauccagaaucuuuucaaagcccacauaugguagcacaggcuggccugugcaucggcaauucucauaucuguuuuuuucaaagaauaauaaaaucaaauaaagagcaggaaacagaguguuagucugugucuacagcccuuccucugcauguggccacaggggaccuuuuuuuguuucuccugacauccagacuuggaaauaucuaacuacuugcaaaacuaaaaaugaggccaggcgcaguggcugacgccuguaaucccagaaccuugggagaccaagauuggaggauagcuugaguucaggaguuccagaccuuccugggcaaaauagugagacucugacucuacaaaaaauuuaaaaauuagcagggcaugguggcaugcgccugcagucccagcuacucaggaggccgaggugggggaauugcuugagcccaggagguugaggcugcagugagcuaggaucacgccacugcucuccugcgugggcaacagaaugagacccugucucuaaacaaaaauauuuuuuaaagaaacuaaaaaugaaauuugagucucagcuucuaggcuuauguacucccaucccugauacuacacguuguucuguuugcauguuuguuacugcagcaucaacauaacaugacuaauaaugaugacaguucuaccuuuuguugacagaccucauuguuucaauuguguuuggccucaaauucagagaaaaguuucucagcccagcaucaaucauauacacauuggaggucugaaagccauuauuuaaaucaccagcaauuucccucaaucagcuucauaaucucauauuuuaaccuuuccucauaugucuuauuuuuuaauagcucagcaacuuugcuucacauauggagccccaaccucuagaguuaacuagucugggucaaagcaguaucgaauguaguggauuggaaucccugccaaauuaucugcccuacugcagaacugaauauacuaggaaacaaaacucccuguuuugggaaguguguuuugugguuacauuucaagcaaaaacugagcacaugguccugaaggacugauucacugcucuaaaaugcccaagguuccauucuugcuucagacagccucgcucuaucaucugcccuguauccugcacugugccccacaacucuggcccuuauuacacugcaagcuucgcuaguaggaauccuaucugccggucagcaucauggguccugcaacccauggcagcaccuugcaggguaggcaaucaaugucuauugaauggaugaacaaugcaucuuuucagacugaugucaaauaguuugaauauuucagcuuaaaaguuuguuuuucacagucccccuagguggaggagguaacugagucauuguaauuggaaugccucccaagaaggaagcauaguaacaaguaaacagaugcuggugaauugugcuaacaacuuacuuuaugucacucaugcuugaacugaggacccacuguuaaucuauaaagggaguaagguuguaaucagaacagacccucagcaucuucccuucccuuuuuucauuaauguguugucucuucugggaccuagagaucucuucuguguuuguacacagccagucuuacccugcauuuuaauuauucacuuucuuuuuccuccucagguuuacuagccugaguuuacccaacuccauuucuaucucuaauaauugcacuucacuuauguaacaaauauuugcuaaauguuaaggguuugcuauguucccguugagcuugagcuuauucauuaagcuaguaucauauggaaauuuaguaaguuuguuucauaauugcuaugauuugaauguuugcccccuucaaaacucagguuggccaggcauguuggcucaugccuguaaucccagcacuuugggaggcugaggcaggaggauugcuugagcccgggaguucaagaccaggcugggcaacauaacgagaccccgucucuacaaaaaauaagaaaauuagcugggugugguagugcaugccuauagucccagcuaugcaggagcugaggugaaaggauuacuugagcccagaggucaagguugcagugagcucugaucaugccacugcacuccagccggagugacaagugacauccuguuucaaaaacaaaccaaccaagaaaaaaagacaaaaaaaaccucauguagaaacuuauuccccaauguggcaguauugacagguggggucuuuaagagaugauugggucaugagggcuuugcccucauggauuaauggguuuucacaggaguaggacuuguggcuuuauaagaagaggaacagagaccugagcuagcacccucaggccccucaccguguuacgcccugcgcugccucaggacucuauagagagucuccaccagcaaaaagacgcucccacaugcagccccucaaccuuggacuucucggccuccagaacuauaagaaauacauuuuguuucuuuauaaauuacccaguuuuagguauucuguuacaagcaauaggaaauggacgaagacaaccauuuaaaaccguauuucccaaccuuuuuuuccacugugacacacaugacagauaaaauguauguaucagacaaccacuuuggucucuuuacucgacaagcauuccuguuuguuuguuuguuuguuuguuuuuugagacggagucucgcucuguucccuaggcuggagugcagggucaugcgaucuuggcucacugcagccuccaccuccuguauuugcaacuuuucuuaguuugaaauucuuuaaggaacagcaucugcaaacacagguacuggaaugguugguaacauauuacuugcagcacaccuuccaucuaagcucagcacacagggguuugccaugauguuggaguugagagcaucuaaaagccucugauccaagauaaaaauaaaucauuaguaaagcugucaaucaguacccaagccccaggcucaggcccaggaccccaaaccccaccuuugucauuuccuugcaggcuacagggagccaugugagccaccccacagaagugaauccggagauuccuuuccuccacaguuucccaucccuccccugugag

SEQ ID NO: 15991 - RNA, 1279 nt, Homo sapiens
ggcucucugcuccuccuguucuacagucagccgcaucuucuuuugcaucgucagccaaaccacaucccugagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccugugcuca

SEQ ID NO: 15992 - RNA, 648 nt, Homo sapiens
uuucuuugcugcgucuacugcgagaaugaagacuauucucagcaaucagacugucgacauuccagaaaaugucgacauuacucugaagggacgcacaguuaucgugaagggccccagaggaacccugcggagggacuucaaucacaucaauguagaacucagccuucuuggaaagaaaaaaaagaggcuccggguugacaaauggugggguaacagaaaggaacuggcuaccguucggacuauuuguagucauguacagaacaugaucaaggguguuacacugggcuuccguuacaagaugaggucuguguaugcucacuuccccaucaacguuguuauccaggagaaugggucucuuguugaaauccgaaauuucuugggugaaaaauacauccgcaggguucggaugagaccagguguugcuuguucaguaucucaagcccagaaagaugaauuaauccuugaaggaaaugacauugagcuuguuucaaauucagcggcuuugauucagcaagccacaacaguuaaaaacaaggauaucaggaaauuuuuggaugguaucuaugucucugaaaaaggaacuguucagcaggcugaugaauaagaucuaagaguuaccuggcuacagaaagaagaugccagaugaca

SEQ ID NO: 15993 - RNA, 68411 nt, Homo sapiens
ccuugaaggcaugagcuuuugucacuuuauuguuaaccaaugaauauuauccaaaauuagagauguaauuguaacuuaauuguacaacacaaaauuaugcuaaugguaaaagccuacugggauuuaccaaauacucauuaguguauuuuuacauugacuauaugaacaugugcucgcgacugcuaauaaguuauaauugguuuaaucucuaagaaauccauauugcaaaugguucuuguuuagaaaaauucacacagccuuaaaaauggauuaaauccauuuuaauccuaaucuacaaauagaucauaaacagcaaaauauaacugauaauuuuucaauacuguaucaaacugauguagcuaugguagugcacauaauucaaaaugaggaaaauuaacaaaaauccaaugaaaguucagguuuuuaucuauuaugcaauugcuuuaaagugaacauuuaugucucaaaacaugaauaguaggguccaccauccauuccuuugauguacugcaaguaggaauauucucuuccauaggauucugaagcaugugcacaaccaugguacaacagucacuucaagguuaaccagcuauguuuuguccuacaaaguucaaaaaauauauuaaacgcaaccuuucuuuuacauaaugucugcccagauuaauccuuuuaaagucagcaaaaucaaaaaagcacaagagauauuuucagacacaacuugaaucuacugugcaugaaaauguuuaauaaaauggcaauuuuaauagauaaauguaaauuugacuguguaauaccaaauggaaaguagcugaaccacacagagaaaacaaggcuuuacguaucuccaaauuuagcuguuuuacaauaaacaaaguauuagaacaugugaauauuagaaccuccuucuaacuggaaagauuucuucaguaagcuauaaccgaaauuaauauaaacuaaaauuauaauuucuaaaauaagaauuaacaaaccaaauuuaaguauuuuuagucagagauugaaacaaaauaagcacagugaucuagaaaccaaauauacugauuauguaacuaucguaucaagguacagacauucuucacaugcuacaagguuagcauuucucucucucauacacacacagaguacacacacacacacacacacacacacacacagucucucucucauucucucucucucuugcucagccauacaacaccccuccaggaugauaguauaccagugaggagcuuacaauuuuaauacaaaucagaaucccacaguuugacucgacaaaaaggcaguuaaaaauuuagcacucuuaagauauucugaaggaaaaugaaauuucgaaaguauuucuugaugaucgaggcuaugguuaugaauuauaaaacauauaccuuacacacuccauuguguuugaacaaccagucaucacagauguaguagugagguaguauuguuguccccuccucgggacugauguuuuuauaugcugcccuuccagaaaagguccagguuuuaaaaaauaacauuaguuaccaacaaauguauauuuucuuuuuuuaacuaaucauuuguuuuucuaaaucagucuauaaaagaacaaaacuuuuaaaaucuugcagaggcuguuucaucaguaaacucuccuagggagcuacuacugcugucuaaaccucugugaaaugguaggcaaaaaaagccaucaaaggaucacaggagauaaaacaccaaucaguguaagcuguuaaagaugacugugauuaaauaaccaaauaucaaauauccaauaagguaauuaaauuuagauuaaaaaaaaacuaagcaccagcuguacauacauuauuaaauguucuaaucucuuuccugauucauagccauauucuacaugaugaucaaagacuguccacugugcuaccuaccaucauuuuaaacacugccugaucuguaugaugguggaauuauggcuauggacauggcagauaagagaagggcacacugagaaaaugugagugagagagaauguggaaauagguuaaauauggaaagggcaagggaaacccauuaaaauguucaccauuauccuuuaaaauguacacagaacugaaaccacacauacacauuugucagacgugauaauuaguguuaaucuucaacagaaaaaaaaaagaaaaagaaaaaaaaugugaaaagaggcaauggaacaccauucuccauucccuggaccaaaagaaaaaagaaaaccaagcaugauaucauacugccuuaauguugaagagcuccccuuaaauuugucuuuuagcuagcacagucaaacugguguaagugcuuuggcaaggugggaugcauuccaucauaucugcaaaggccugcuuuucucuguuggugguucagcuuaugaagaacauauaugcaaaauaacagcucucacauugcuucaaacucaucgauacgcugcuuuguauugccuugucgaaucugucgcagagucuuguacuuaucacggccugcuuuaacauucucagcaugaagaacaucauuuuguguuuucuugguuucaucucuggcuugggcuaauucugaacuuaaugccuauuuaaaaaauaaaaaguacaacuauuauuuuuuucuuagauuuaaaaaaauuuaugaaaauggcuuuaagaugcaaaaauacauauaccaaaucauuuccacugugaaaccuuuuucuuuagguauaaguuuguuuuaguaauagugguggcagugguaagggaggaauacacauggccuuuccacauuuaucaaccaugguauuuuguacauuauucuaaauuuccuuaacuuucuaaucuaauacuugaaauggcuaaaaaguucaauguagccauuacagacuaauauuacuaugagauuuaaaaucuauaccucaagggaagccuucuccaaaagucuuaauacauuuauuguaacuaucaccucauuuucuuuuaauauuuaaagauuuuaacaauuaaaauauuagauaacuuauugggaaaaaagaaagcucauaauauuaaaauccucuacuuugaccuaguuauguccauguaauauacugaccuuuugccaauauaaaaucucaacaaauaauuaagauuauguaaugucuuaaacauaguauauuaacuaucauucuuuccaauguacauuuuauuuuauuuuauuuuuuugagacagagucacuuacuauuguccaggcugaagugcaguggcaugaucucggcucacugcaaccuccaccucccagguucaagcaauaccucagccucccaaguaacugggauuacaggcucauaccaccauacccggcuaauuuuuguauuuuugguagaggcagaguuucaccauguuggccaggcuggucuugaacuccuggccucaggcaguccaccugccucggccucccagagugcugggauuacaggugugagccacugcgccuggcccucaauguacauauuacugaucaaaaacuaaauucacguuuuucaacaugacauuagaauacuuucuaccuuuuaaaaugggucaagcuguaauuaaauaacucacuaguuaaggucugauuauacaaagcuaacagguauuugcuaauggguucacacaacggaagaaaugaaauaacaugacuauaggccaaacacccacaaaccaaucacaagggcagccaguauuaaaacuucuauauucuuuuuaacuaaguuugucuaagauggggaaaaugcaaacuauauuucaaaugcacauacaacugcaaauuuuaaauaccugaaguugcuucuuaacacgcucauuuuucuguguuucgguuacacguucuuccucgcuucuaugguucauuaccccuucauuugauaauucagcacuagcuucagcauuauucucaucguguucaucauguucguuuucuguuggaggaaugacugguggugguggagguggagggggggcagacaucacaguuuuuaacucuucuuuggucuuuuccaagucuuccugggcugcaaaagccugaacauuaaaaauacguuuaugagcaacuuacuucaaaaauuaauaaucaaaacaaucaaguuauacucccuuuuuaauagaaacuguauuucaagguaaugaaaauaggcccuauuuaugaaaccucuauuuucauaaaagaaugucaacagguaaaagagaaaaucaaaaacauuauuaugcaaacccuauuagaauuacucugugagcuucaaagugacagauuaaaagaaaaacaagcauacaugcaaaaaaagaacuauuaauucuggcaaggauuaucaauuguuugcuaaaacuguugugcaaauaguugaugagaaauagauauucauauaaugccuaagaaucucacacccaauagauuuuauuugagccacaaggggaaaauguaaccgaauaacggaggaaugagacugucguuacucaaauccaaugaucacuaaaaaauacuaauggugaguuaacuagauauuaagugucuucugauaugauacaaccugaaauaucuaacaucaccaauuauuugggugaucauauuaucuugguuuaccuggaaaaguccuguuacacuguuguccugguguaauuaugaacaauacccccuuuuucucaaaaguacuccaguuuagauguucaauuauauggaagucucaccuuugaugcacuguagucaaaacauuuaauuugaauuccccagguucuagaucuaacuucugguucaaaggaaauacuggaguuaaaggauaaggucaaugacacaaggaaguaacuaaacaaauauaggaggugagacauucuguaggucccuucaauaaaucaaaauaauaaaaagagaaacugcccuccauuaaaagagacuuacagcaaauacagacaaugcaaaguccucugaacacuugucuggcaaauuagcuaugagacuuuuugggaaauucuuaauauagucuaauauucugagaugaaaauugacuaaaaugaaauaguacauacaguaagauuucauguugaauauauaaacaggaaguauccuggaagaauauguacuaagguuuugcaguauuuccccuaguuuaugggaauacaauugucuuuugugugcauuuucuaauuuucuauaauucacagacuugauaucuguaauaugcuaauuuuuuaaaguuuaugugucucuaaauuucauaaaucaucccuaaaagggaucuaaaaaauucuaauaaacaaguagaguaacugggaaauuaacaguagcauuccuuuuguaguuuuauuuauauauaacuaauuuucaauacauauaaaauuacccaaugaaauuuaaacugcuacaaagauuuacuuaagagugcaagaaaacuguuuucuguauaaguacauuuuauuguagaaaaaucaucuucuaaaacuaaauaucaucuuuggggguaaaaaaauuaucuuuucaguuaagaguuaauguuguuugaauuaaacucucauuaucuuauauucccccacucuccaaccaaagccugauuuuacaauugugugcuacuuuagacaacagugguuucaucuacuuaggacucauauuagaaaucucggugucagcugcacacaguggcuuacaccuacaaucccagcacuuugggggcugagaugggagggcugcuugaggccagcaguucaagaccaaccuggguuacacagcaagaccuccauucucaacaaaaauaaaaaugauggugcaugccuguagucucggcuacugcagaggcugaggugggaggaucccuugagcccaggaguucaaagcugcaaugaauuaugauugugccacugcacuccagccugggacacagaguaagaccaugucucuaaaaaaauaaaaauaauucaacuucauauccaaucacugguucccaugccuuuuugugaccacaaaaugucucuuauaucuucccauuccucuuuauucucauuuucacauccucaguuugggucuuuaucucuuaaguauccacuaucccaauccuuucuucacacugaucacuacaugguuuuuauaaaaucauaucugaucauguuacaauccuguuuugaaaucuucuaagccccaagucaaucgauacucccacugccuugcuguagcagagcauuuauuuaaagccuuucacaauucccuauuaucaaacuugagggccacaucuccuaacauuucugaacaacacuaagccucggcugcuuauugguuauccucaaaucuauuauauacauucauacuuccuauacucauucaguucccucugucuagaaugacuacuucuucagucucuaacuauucccaauuuuacaucccaaucuuuuguacccccaaaauuuaauucauuauucaagacccagcuuaaauguauaugggucucccgacaacucucuggucccccagaaauuaaucaccucuucuguguucccaaaguacuugguuuauaucuguagauagauauuuacaauacacauaacacgaguaucuuucccacucuaaauuaugacaguaucuuacacuuaucacuacaaagucagcauaauccuggguauaaaagcuauucaauaaaagcuaguaaaugaauaaaugauuacuuuguguugccacucaguagcuuccucuuccuuuuucuucuuggcuuccucuagaagugcaaucuuggcagugaauucagcaaguucugcugccuaaaguaaacaauauaauuccaaaauuaaaauaacauauuuugaauaaucuuauaagucaacaaaguuuuaaugcacaugcuuaggcuguuuauguuuuucuuagccuuccauuuaaaaaaauacaguauuucuuaagaucuuaaauagcuuauuuacaauaaguccuuuagguaaugagcuaaggagacaaaauuaaaaaauuacuauuauucuacagacuaguuaauccugcuuucaguagcaggaacuuaaaauguguaacuuaaaagcuuuuuuaaaaaauuuccaucaauaaacuauuuguuaaaguccacaaaagauaaaauauuuaucuaaugcuauauacuuuaaauggcacuuugucaaaucaucucauuuaauaccccaauaauccuaacagguaguaucauuaacagguaguaucauuccuccuuuuuuuuuuuucagacagagucucguucugucacccaggcuggagcccaguggcacaaucucagcucaccgcaaccuccgccugccagguucaagcaauacuccugcuucagccucccgaguagcugggauuacaggcgugcaccacugugccuggcuaauuuuguauuuuuaguagagacaggguuucgccauguuggucaggguggucuugaacuccugaccucaggugauccaccugccucggccucccaaaaugcugggauuacaggcgugagccacugugcccggccaucauuccucuuuucaaagggagggaacugaggcucagaaagacccaaagacacauacauagcaaguacaugugugaacuaauauuuaaauccaggaucuuuuaagugacacgcuuacaucuaauuauuugcaaguccacuaaauaaaaaaacccaaccaauuauggccucauaggaacuauaacauauuauauaucuauaauauauuauauaacuauaacauauaucuauauuauauaacuauaacauauuaauuuaucuaaagcaaaagacgccaacugacuuauuaccgaaccuguccaaugucaaagugaaucagaaccuuuugcugacaguagacuccauuuacaaauaaucuauagaaaaaugccuuauucuuuuguauuuuuagguuuuuguuuaggcagaaauaaauuuucuagguuuuugucuacauuuuguuauuaaguuacauguuaucuuuggcuugcucuccagaaagcacaaaaugguugcuuuucuuuuuuucuuuuuuagaggguucacucuaugcuuuuauuuaaacuuuuuucucuaagaagacaguuccuuacuagcugcuccugauucuucaucuggucggcagcuuguuuugcuauggcagacuuugccucuucagcagcucgacgcuccuuuucaagucguucugcuucuucuuuugcucguuuucguucuugauccaguucuagagcuuuucgagucuguucuucuaguucuaugaaauauguguauuccccccaacagugauuaauuccaaucauucucauuaucaaaagaagcuaaaauaguagcaagaaaucaaaucuguucaauuucuaaaaguuagcacacauguaaauacauauauaccucuuuguuuucuugagacagggucucgcucuguugcccaggcugaagugcagaagcucacugcagccucgaacucaugggcucgagcaauccucccgccucagccucccaaguagcuaggacuacaggcgcuauaccucguuuccaacuuggcaaaagccuaauaauuuuuaaagagaaaugaaaaucuucugcaauucaaguuauguaaaaaggcuacaagcacguaacuauuuuauuuuuaaaaaauaaucucuccaucugaaguuuugaccucaguaaacaaauugccauguuucagaaaucuauaauacauuucaaaacuuccauuaagguuuuacuuaucuaaacuaauaaguaaauccaagaaauuaagauugaaaacaguauuuacugaccccaaaauaggaauuuugaugugauuauaugaauuauugaaaaaugugaguuauugguauauauucauuccuaaagcaugaagauaagcaauauugggagauaaauaacaugaauuuuaauccuuaggugcauagaucacuaaaucaacucuuuucuuauuccaaugaguugaacaggaaaggaaaauaaauuuuuaagagaguuuaacaguacuaacuuuaaauauuauuuugacaauuauuuaagcccugugacagaagacaauagaaugccaccuaguaagacaguacaagguccuacaaagaauuauuuucccuuacuguauacuaagaaaaucuauaugucaugaaauuugaaagcuaacuguaacuuacaagcuuuuacuuacuguucuuaauuuucuuggucuugaucagaacuaguugaguaauugcaguuaagacuuggaagguuuuaggccagguguuguggcucaugccuguaaucccagcacuuugggugacugagguggguggaucauuugaggucaggaguuugagaccagacuggccaaccuggugaaaucccgacucuacuaaaaauacaaaaauuagccaggcauggugaugggcgccuguaaucucagcuacuuggggaggcugaggcagaagaaucucuugaacccaggaggcggaggcugcagugagccaagauugcaccacugcacuccagccugggcgacggagcaagacucugucucaaaaaaaaaaaaaaaaaacaaaaaaaacacuuggaagguuuugagaggguuggagaagaaugacucuuugguuaggcuuugguuaggcucacgccuguaaucccagcacuuucgaagggaaaggugggaagaccgcuugaggccaggaguuugagaccagucuggucaacagagugagacaucaucucuucuuaaaaacuaaaauuaaaaaaaaaaaucaguagcuauuuauauauaacaacaguaaacaaucugaaaaagaaaccaagaaagcaauuccauuuaccauagccaaaaaaaaaaaguaaaacaccuaggaaucaaucuaaccaaagaagugaaagaaggacauuggucuaggcaaagauuuuuuguguaagaccucaaaggcacaggcaaagagagauaauggguguuacaucaagcuaaaaagcucuauacagcaaaagaaacaaccaacaaagugaagagauaaacaaagaauagaagaaagugucuacaaacugucuaucuaaaaaaggacgaaaaaccagaauauauaaagagcucaaacucgauagcagaaaaccaaauaaucucguuuacaaaugggcaaaacaucugaacugacauuucucaaaagacguacaaauggccaaaagcuauaugaaaaaaauguucaucacuauaaucacagaaauauaaaucaaaaccacaaugagauaucaucucaccccagucaaaauggcuuguaucaaaaagacaggcaaggcugggcaagguggcucacgccuguaaaucccaggacuuugggauuuacaaaaauuagcugggcaugguggcacauguaaucccaguuacuuggguggcagaggcuaagaaucacuugaacccgggagguggagguugccugggugauagaggaagacucuguuuuuaaaaaaaaaaaaaaaaaaggcaguaacagaugcuggcggggauguagagaaaaggaacacucauacacuguuggugggaaugcaaauuaguaaggccgcuauguagaacaauauagaguccucaaaaaacuaaaacuacggaauuaccauaguauccagcaauauccaaaacauaguauccagcaauauccagcaauaguauccagcaauauccagcaauauccaaaacaaaggaaaucaauauauuggagauaguuguacuccuacguuuauugcagcacuauucacaauggccaaaacaugaagucaaccuaagugcuuaaagaaaaugugguauacauacacuauggaauauuauucagccauaaaaauaaaugaaauccugucauuugcagcaauauggauggaacuggaagccaucacguuaagugaaauaaaccaagcacagaaagacaacuauugcauguuuucacucauaugucagagcuaaaucucauaaagauaaauaaacuggugguuaucaaaggccaggaaguggguggggggaguugaagggaggagaaaaagaauagaaauguauuuauuacuacugaacuguauacuuaaaaacgguaaaaauaggccgggcgcgguggcucacgccuguaaucccagcacuuugggaggccgaggcgggcggaucacgaggucaggagaucgagaccauccuggcuaacacggugaaaccccgucucuacuaaaaauacaaaaaaaauuagccgggcgugguagcgggcgccuguagucccagcuacucgggaggcugaggcaggagaauggcgugaacccgggaggcggagcuugcagugagccgagauggcgccacugcacuccagccugggcgacagagcaagacuccgucucaaaaaaaaaaaaaaaaacgguaaaaauggccaggcacggugguucaugccuguacucccagcacuuuugggaggccgaggugggcagaucaccucaggucaggaguucgagaccagccuggccaacauggcaaaacugcauaucuacuaaaaauacaaaaaauuagcugggugugguggcgggcgccuguaaccucagcuacucaggaggcugaggcaggagaaucacuuaaacccaggaggcggagguugcagugagccgagaucacaccacugcacuccagccugggcgacagagugagacucugucuccaaaaaaaaaaaaaaaaaaaggggcgggggggcaaagauguguacauucuguauuauauguguauauuuuaccucaauaaaaaauaaauaauauaaaaauucuauguggcuauuuggcuauaaagacaaaauguauacggcacuggauguuaccauagcgauauucuacgauuacucauuuuagaaucugccuucuaaaauucagauaaucaagcuggccuaucaaacuuuucuuucuuucuuuuucuuuuuuuuauuugagauggagucucacucuguugcccaggcuggagugcaguggcacgaucucagcucacugcaaccucugccuccuggguuuaagcaauucuccugccucagccuccggaguagcugggauuacagacgugugucaccacacccagcuaauuuuuuuauuuuuaguagagaugggguuucacaagguuugccaggcuggucucgaacucccgaccucaggugauccacccgccuuggccucccaaagugcugggauuacaggugugagcuauugcacccagccucaaacuuuaauaauuaauucuuuucaucugauugacugauauauaaaacaacacccacaaagcucaugguuuuaucuuccaucuaaacaagcaaacaaauaacuaaagaauugaaaguagggucucaaaccaauaccugaauauccauguucauaacaguauuauucacaauaacuaaaacacaaaagcaaccugagugcccaucaacagauaagcaaaaugugguauacaaauagaauaucauucagccuuaaaggaaggcaauucugacauaugcuacaacguggaugaaccuugagggcauuauguuaagugaaauaagccagucacaaaaagacaaauacuguaugauaccacuuauacagguagaauacucaaaaucacaaagacaaaaaguagaaugaugguugccagggguuguggggaggggggaaauggggauuguuuaaugggugcagaguuuuaguuuuacaagaugaaaauaauuauguagcuggauaguggugauggcugcacaacauucccaauauauuuugcaucagugaacuacauuacuuaaaacggcaaaaaacuggccgggcacgguggcucaugccuguaaucccagcacuuugggaagccuaggcgggcggaucacaugaggucaggaguuugagaucaggcuggccaacauggugaaaccucguuucuaauaaaaauaccaaaauuagccagacaugguggcagccaccuguaauuaggcaggagaaucgcuugaacccgggaggcagagguugcagugacccgagauugcacaaucgcacuccagccuaggggacaagagcaagacuuugucucaaaaaauuuaaaaaaaaaaaaauuaaaaaaaaaaaaagccaaaaaccucaaugcuuuauuuucucucauaauaaaaauuguuucuguauuaugagacaaaaaagagaaauaagucuggguuacaaaguuaaauuuugaaacauuccccaauauucauuuuaucagcuuuuuguaauaaaggucaauuugaaaaaugacagauaaggcaauagcuauuuugugauauauuaagaauuguauaaaaguguaaguuuuaaaaaauguuuaaaaugaauucugaaaacaucaggucuacuccagucccuccuaaaaaaggaagcuuuuuaacagucauauagcccauaaaugguuucugcuguuuccucuccaauuaacugaguuaauacaggaguuagcaaacuauggcucauggagcaaacccaauccaaugcuuuuuuuuuuuuuugguaaauuaaguuuuacuggaacauagccacccucauuuguuuagguauuauaguacacagcugcuuucacacugcaauagcagagcugaauagcugggacagagaccauguggucuguaaagcaugaaauauuuaucaucacugguaaucaagaaaauaaacuacagacagaguauccuaauccaaaaaucugaacuccaaauuacuccaaaauccuaaauuuuuugagcauuugcaugacacucaaggggaaugcuuacugacagcauuucagauuuuggaauuuugaaugagggaugcucaaccaguaaguauaaugcaaauauuccaaaauuuuaaaaaaagaaaaaaaccaaaaaccaaaauccugaaaucuaaaacacugugguccccaaguauuuaagauaagggauacucaaccuguauauucacuauauacucaccagaauggcuaacaaaaccaaacccuaacaauaaaaacuaguggaagaagugauaaggacauagagcaaauguacuuucaaacacuaguaacaggaauaaaaacugauccaugucugggcacaguggcucaggccuguaauccagcaauuugggaggccaaggcaggcagaucacuugaggccaggaguuggagaccagccuggccaacaaguauauaacccugucucuacuaaaaauauaaaaauuagccgagcgugguggugcacaucuguaaucccagcuacucagaaggcugagguaugagaaucgcuugaagcucagagacugaggcugcagugaaccgcgaucaugccacugcacuccagccugcgugacugagcaagaccuugucucaggaaaaaaaaaaauacaugcaauauaaauguccaaaaagcacauagaaagacacucaacgucaccagguauuagagauaugcaauaaaaacuauaaaauaccacuucacacccauuaagaugacuauaauccaaaagacaaacauuaacaaguauuggugaaauguggagaaaucaaauuugcugguggcaggguaauaugguacagucacuuuagaaaccaauguggcaguuccucaaaaaguuaaauacaguuaccacaugacccagcaauuccacuccuuagguuacacccaaaagaaaugaggacauaugaacaacaaaaaccuacacaaugaauguucauaacagcauuagucaccuuagucaaauaguggaaacaauaaaaaacaucagauuucaaacaaauaaauaaaauauaccauauccauaaaaugaguuugagaccagccugaccaacauggcgaaaccccgucucuacuaaaaauauaaaaauuagcuggguguggugguggacgccuguaaucccagcuacucaggaggcugagacagaagaauugccugaaccugggaggcgaagguugcagugagccaagaucacgccauuugcacuccaaccuggggcaacagagugagauucuggcucaaaaaaaaaaaaaaaaaaaaaaaaagagaguggagugcugauaaaugccacaauaugaacgaaacuuuagaauauuauguuaaacaaaagaagccagucacaaaagaccacauuuugcaugauuccauucauaugauggucuagaacagacaaaacuuuagagaaagauucgugguugucuacagcagagagaagggguacugagaagaaaugggagugaccgcuaauggguaugggauuucuuuuugggauaaugaaaauguucuaaaauuuauuaugaugauagcuguacaacuuugugaauauacuaaaaacccuuaaacuguauacuucaaauggguaauuacaugguguguaaauuauaagcuauaucucaacaaagcuauuagaaaaugauaaacaaaacuaaucucuauaugaugguauaagucagaaugacagaaaucacauuugaaguuauaagaaaaagagaaaaggagacugugugagggcagauaauuuugucuaucauguucagggcacuuaugggaguaaauucacuucguaaaaauugagccucauacuugagaaauacguauauuacuguaucuguacuucaaaguuuuuuuuuuuuuuuuuugagacagagucucgcucugucauccaggcagaagcgcaguagugcagucuuggcucacugccaacucugccucuuggguucaagugauucuccugccucggccucccuaguagcugggauuacaggcaccugcuaauuuuguaauuuugguggagauuuacacuccaccguguuggccaggcuggucuuaaacuccugacuucaagugaucugcccgccucagccucccaaaguacugggauuacaggcaugagccaccacgccuggccaaauuuuuuguuuuuuaaaaaauaaaacuauaaggcugggugcaauggcucaugccuauaaucccagcacuuugggaggccaaaugcaggagaaucacuugagcccaggaguuugaggcuacaguaaaccuugaucacacccacugcacuccagccugugcaacagagugagaaccugucucaccaaaagaacccaccuagaaauuuucuuuuuaaucucagaaugcuaaauuagggauuauuuccauuuuagaaauuaggauccuaaggaaauuaagauguuaaaaugacuugcuuauagucauauucuagguuaaugacagaaguaaagcuuuuuaaaauuguaaacaauauauaucuaaauuagacacuccccuccuacccacaacuacugcuuucauaacauuaucauguuuccuuuccuuguagcacuuaaaacuauguaaaauaauuguauuauuuaauauauugcuuugucuucccccaguaaaauguaaacuccaggagaauaggaacucuuuuuguccaguacuauaaucucacuacuagaaaggugccuaguacacacaagguguauccaaaaugaaugaaaucauuauaccaacucuuuucugugguuuaucuucuugaagauggaauucacuuugauauuugcugggacaguaacugaaugcaggucuggugcuauauauauagauauuucauuuuuuuugagacagggucucacucuguugcucaggcuggagugauccucccaccucucagccuccugaguagcugauacaacaggcauaugccaccacaccuagcucacuuuuauuuuucggagagauaagaucucacuauguugcccagacuagccuuaaacuccugaauuuuagcaauccuccugccucaaccuccuaaagugcugggauuacaggcaugagccaccgcacccagccuagguuauugcuauuuauucuccuagaaguauuauuucuaauccucuuggaauugaaaugaucaaucagcuugcgcauuuauagcaaucuuuguggcuuuccccucuagcuacucucccuuacaauuauucuacucauugcucaagaguacgucuccaccacagcaggcugguguaagaaaucaaaauauaucuuaaauaagacugaguaucccuaauccaaaaaacgugaaaucugaaaugcuacaaaauccaaaacuuuuuaagcaccaacauggcauucaaagaaaaugcccagggccgggcaugguggcucacgccuguaaucccagcacuucaggaggccgacgcggguggaucacuugaagucaggaggucaagaccagucuggccaacauggcgaaacccucucucuacuaaaaauacaaaaauuagcugggccugguggaguacgccuguaaucccagcuacuugggaggcucaggcaggagaauagcuugagcugagaucaugccacuguacuccagcacagaugacaaaguaagacugugucucaaaaaaaaaaaaaaagcuccgauuuuggauuuucagauuugaaaugcucaauaggacaaugcaaacaucccaaaaucggaauauuucuguucccaagcauuuucaacaagggauauucaaccuguguuggcuauuuccaacagaacugaauagcuuguuuuaccaauuguaagaaagcagauuauuaaauagagcuuuuauaaagaguguagacuucauguuaccccugagagccugcugcuuagagaggagaaaaacauuuuauugaugcaauacuuuuuuuuucuugcuuucuccacuauucgcugagugaaagugguauauccuaaaguuacuuaauauaaaccacauauuauaaaucuaguauauccuuucuauauacaguagcacuuugguuauauauugccuaagaaguaaguucuuccaaacacauuaccaaaaacaaacaaaaaacguuauaacacgucuauguguuguguauuuucuaguagaauaaaguaaaauauuuuuaggaauugaguuccaaaaaaguucauauagucagaauagcuuaaauuacuuuaauuacuuaaaugccuuacuuauacagccauaaagcauugcauacuuuucuuuaaaugccauaauguauugcauauguguuuuuuguuuauaaagcccauauauacauuuacaauuauuuaagaauacauaugaaaaauauuugcauguuuaaaacaaaaaacuaaaaaaagaaaaauaucugcauguuuaagagaaacaucagcacuguauaaaugaaugugccuuagugaaacauguuuaugaugugauuccacuaaguauuaauuugccaauuaaauauacaauuguccuauauaacaaauaagguuuaagaguacuaaaaaaaauaccacuaucugacaacagagcaauaauaauuuuuaauccauuuucaaaaaagaaacuuuuaccuuucugagcuuuaauugucugcucuucaauuuguuuuagacguuccauuagcucuuccuuuucacguucuauucuuuccuuuuccuuuucugcuauuucucuuuucuucuuuucauucucuaauugugcccuuaaaaggaauugcaauugcuguuacaaauuaauacacaaaaauauuauucaugugauggaauacuacucugccauaaaaaguaacaaaauaaugucuuuugcagcaacuuggaugaagcuggaggccaugauucuaagugaaguaacucagaacauacaaaugccauauguucucacuuauaagugggagcuaagcuaugaggaugcaaagacagaguaauauaaucgacuuuggugacuugagaagcaaugguugggaauggggugagggacaaaagaccacauauuggguauaguguacauugcucgagugacaggugcacuaaaaucucagaauacacaaugauagaacccauucauguaaacaaaaaccaccuauauuccaaaaacuacugaaauaaaauaauaauaauuggaaauaguauucaugugaaaccuaagaacugaaucaacuaagaagaaaugacaacauaaauauuuuaacaggguuuucauuguauuacacuuguguucaaaauagcauauguaguuaaaaguacaggacuaugacauacauacacucauguacguacauacaugugcuggguuccaauguauuacuuauuguggguucacaauaaagaccacugagacuauuuuuaaaaaauauuaaaaacuuagacauuuaggaacauccucaaaggaugaguuuacaaaacugcuaguaaaguauaacugucaaauauauauuccugcauauagaacaugcuuauaaggcacacuuuaaugggggaaaaaucagauuuaccauuugcauacgggaugaacucugacaacaaauuaaaugucagcaccaaaagaguuaaccacacaguugccaugccccaagaaaauaucuucuuuagauuaaccggagaccuccacuggggaaauaauaaaggacugaagggagcaaacaaaggcauguaucuuaaauaaaagggagggcaacaauuuucaaucauuaaaaaugaauuaauccaaguuuaauuucuuggguaguacccauuuaugccuagauacaagacaacaaaucaauuucaccucccuucacaauuccauuagaaugacaguagguggcuaaugaucuuaaaaaauaucaucagagcucagugggaaaaaaugccuugaucauuuagcugcaccugccaugggccugaugagaguguuucuuuuaaauacugccaaauucauucaccaaacaucuaccaagagccuaccaugggucagaaucuauguuaggggcaaaaauauaaagaggaauaaaagucacauggggaaacucuuauuaucagacaauauuguuuacuuaaguugaaucaauauucaaaucacuacuuuaauaacuuaaaaaucaguuaugauuucaucucugaaauuuaucugaguaugcuuuaauguuccacaaaaagagcacugccaccuacugucaauucugaauuucaagcacaaaacccuguaguuucucaacuugcagucucugauaaacuuaucagaaaaguuuugcuaucaaaaauuucgcccuuauuuauaaaccuacauuuuaaaauuccugcagcuccuagauacccauuugccccuaaaacagaaagagagcuuaccuuuggggcaaacagguagaggugucacaagucagcaagaggucaaacacugauggugaccuccuagugcaugcacuaagcuaaaacauaacgggucaccacaccuugcugcugguuuaaugaauccuuccaccauuuaauaaucuagagaggcugggcaugguggcucaccacauugugaggcaaaggcgggaagacuaccugagguuaggaguccaagaccagggcaacauagcgagaccucaucucuucuaaaaauaagaauaaaaaauuagccgggcaugguguguguacccauaguccugguuacucaggaggcuaaggugcgaggaucacuuguguccaggaggucaauguugcaguuagcuaugaucgugccacugugccccagccuggcaggcaacugagcaagacccugucaaauagaaaacaaaaaaacuagggccugguggucauucauguaagggaagcuccaucucuguucuggaguucccuaugccuacgagguacuuucgcaacagcaaggaggaagagccaguaacuauuccuaaccccaguauuugggcucacucugcaggacauucaccucuuucucuuuauccuauuucaauuuauaaagcauauacaggcagagagauuuaaggagauacaagcuuccacacuucuagaagacgugaguuuaagggaaaguuuguguuucccaaucucuccgggcaaaagaaaggccugguggcccccacaguggcugcugaccuuucuguguucuuuagauagcugaaacaucacgcuuugugugaaagcaaaagaagcaaaagcacaguacuuuucaaguaauugcuaguaaggccaaaagcuauucuuguccaugccagguugucugccacccuaggauguugauuagacuacccaaucacuccccagccucuaugcaaucacauccaguucugccacaguucccaagccaacuaccucccucccuccuuucccaaggucccaagacaauucucgaggacuuacacugcaaaccagaucucaaccagaagucuaccaucauauuccaccaacuaagagccuuucagacccagcucuggcauauauggcccuuucugcagauggaugugcugguuuuauuuagcuuuucccuauugauguuucauuuguucuucagggauggaggugaaggagauauggaagcagaaaaaaagaaucaagauaaucuggccauaugcaaguugggaggggguggggaauggucuuccuacugaaaaauggaauaaguauacagcagauauuuaaacugauuauaauauuuaaaacauguuguaguuuacuguacucugugaggcucguaucucacauuuuauaagaauccuacccugacaauagccaucuccagccaacacuucauucaaauaauacaaaugccuucagcccuuuacauuacucagugauaucuaguuuuuguaggccugucuugucuccuuuaugaaaccagaucuugcugcuccccuaaaugcuguucauuuuagaggaccucacuggcccauaggcacaccacacauauuuuuaucucuacauauucaucuauguuggcuucuucuucugaacguaucucuugcucucucuaaccuucaagcuucagucccacuuuccucaugaagucuuuugugauuacuguaacaauagaugcagauauuuuuauuuggaguuuggguuugaaaacacucauuucaaugcaguuguucuauuucaaggacauaaaucacauuaauaaacuauuauuccuuguauuaauaugcaaaaaauuacuuuagaauaucuuacuuuuuaaagaucaaaugggucuaauuacacuuuucuuccaugaauauuaaaaacauauccaacuuaguuuauaauaauauuaggaauuauuauaauggcuauuuuuuauuaaguaccggguacuuugcuaaaugccuguauaccacugucaugauuucuuacaaaaacgcuugaagguaagaauauuauuuucauaguaagagcaaggaaacacaggcucaaaauuaucuguucgauugaguguuagaagaggagucaagcccagauuuaucuaguuccaaagccuguguucuuuguaugacacuagccagccuuggugcagaaucucccacagcuaaccuacaauugguacauagguauguaacucuaaacuguaaacuuggggcuuucaguuuucacauguggaaacaauuuuagccauacaaaaacgugcaaaaauuaucagucauaauucaauuuggaugccaauaauuuaagagcuucaaaaacuacauggaauaaccacucauaguguauaaggucauuuucauugccaaaaaaccccuagguuauaaaaauuauagggaguaaauauagccaaauauaccaaaguauuguagggaaagaggucucuuugcuacucuuucccaacuacuguucuugcccaagagagucuagcagcacaggcagcauaccucugggcauucucccagguauaucugcuggcuacuuugccaaugggcuuaaucaaaauuguuuccacacauacagcugccauuucucucucucugaccuguaaagcagggaauaaaugacucagcaugccauuucugaaagacugccaauuccuaggugacuagaauaauauaucuccuaggcauucaaacugaauaaaaguuacugaauuccaacugaguauaaagcagucaauaaaugcuuacuaaugaagagcucuaacauuuauccaggagaacuacggauuauugugccaaaaaagaaacuuaagucuuccacuuccaucuaagccuuagaguaacuaaaauauagcaccauuaccaaaugauacuaaguaaacauacuaccuguacuagaagcaauacaguauuucucuauaagccaugaaauaaaggauauauagauaaauauaguaaguugagaauguaaauaauauaucaacauuaugaaugagcagaacaguuaggcauacuauagagugaugaguaugagauacaggaacuguauauaaaauaauuccucauuuaucucaugcuagaaaaccuuuaagagacagugaaaucuuuaagacgauuuaaaaaaauuaaguggaaacuaaaagaagucuucccuuugacagagggaaaugcaaggcuauguguauaagaauguacuguauagaaaguaaagcccaauaaagaguauuuuuaaaaagcauuuaagauuagaaccacaauguaaugcuacagcacaugagcacaauaaaaaaggacauagcccaucaaaguaacaauccaacucauuacucuuuuuuuuauuuuuauuuuuaagagaaaggguuuuacuacacugcauguugccuguugcccugauugucuucaaacuccuguacucaagcaauccuccugccucagccucccaaguagcugagacuacaggcacaugccaccauccucagcucaccaacucaguaucuuuaaugaugggauuaguaauuacugacaagcuucaaacccauauaaaaaauguuuuguuaugugguuaacuucucuaaggaagauaauuugaguuaauaugacaaaauagguaaaaaucaauaaaaucucuuacacagaacaguuguugaauaagaaaaaaaaucauucaauauaaaaccuaaaacuauaguagcaaaaugguaucuagcagauggcuuccuucuagauacaaaguaccuuauauccaauauuuaaaauacauauguuuagggcucuucaaauuuuuuuuaaggacuuacucuauuucuuagacuaucacguuguuccauaaagauuuauucaauaaagguuaacuuuaguuuggucucuaaauuuuuucaaguaaagcacaaaguugaaauuaaucuaaaaccagauuuggaaauuaaugucacuggacccaguaaucugauuccaggguugauauaaauuuuauucacuaccauucaauuuuaaaaauuaucaauuuaauauauuuaacaguuucuuuuuuaagucuaagagaaacagaguuaaaaagauuagggucuuuggcagggaguacugauguuacccuacuuggcacagugacguuucaguuguguucuacaaugucacugacauuguuucaaaguuaaauauucagcacauucuuacccugaaaaaauuaagaaauauaagucacaagcaaaacaauuuugaaaguuucaaacuacuauaucuaaaacaaugucuaucagugaaaagcaagaaaugagucacaaaaagcuauuuucuucgagauaugugucaaagauuucuaacuugaaaauuauacauacucguuuuaaaggacagagugauaauacugucuuugaauuuuaauauaaugaaaauauuaauaaauacaaauuuaagguacauuuaaaaaacugagcagucuuaaauuuuagauagccuacuccuaucaauuaaaagugaaaggucauaaaccccauaccuuuccaacugcuucugauguuucuccucccuagccugagccuucaucuguuguacuucaauaguaucaggcuuccuucuucgcauguauaguucaugguuucccauacauaaggccaaaauccgcuuauugauucucagacgaggugcauaaaacacaaaauccuaaacauaaaguauucugaauuuaaaaucuuccucaaggauacugucucucauaacaaucuguacuaaauuuuaacaugagguaugaauuuuaaugucauauuacauauaguuuagaaauaagaaaucauacaauuucauaacucccagugagcaugacauacuuucacauaacugguuccucaccuuuucauauccaaccaguuuuguaaagaggcuaauauucuuauccuugcaauacauuaaaugucauuuauuccuuuuuguucucgaaaguaacuaugagcaccuguuccuuauacaccauuugccauuaaugucaaaauugguucuucguucauggcuguagaguuuuuuuuaaccuagaauuguucuuuuuuuuuuuugagacggagucuugcugucauccaggcuggagugcaguggugccaucucagugcacuccaaccucugccucccggguucaagaaauucucaugucucagccucccuaguagcugggauuacaggcaugcaccaccacaucugacuaauauuuguauuuucaguagagaugaaguuucaccacguuggccaggcuggucuugaacuccucaucucaggugaucugcuccucucgagccucccaaagugcugggauuaugguccugaaccauugcacccagccuguucuucuuacuuuuaccuuuucaguaacuaacaggguuaggauacuagaguauacuugacauuagaggaacuuuaaaaaucuauuuaaauaaaaagauuucuuaaguucaaggcuucaaguuacaaaaauacaaaguucauaaagcaaaacuguauaaacgaaguuaauuuagaauagggcuaccucuacuacauucuagccaccaaugaagaaacacuuuaaaauugcuucuuaggaaugguguuuucauuagccuccuaauaaauauuaucuauuuauaacugaaucucaaauaaaauaaaauucuaauauuuacaucuuacuuuaaaaaauuaaaucuuuggauuuuuauuaacauauuauuucaucacugggaaagcugaccuauggaaagagaaugguccucagaagcaauuuaauaaaugaacacuguuauucuucaagugauaucaugggaaacuagcagauauuaaacaguuaauacacaaaauauuaaagaaauuacuuacaggugccuuuuugucgauuggcuuuauaacaaauuuuuugucauuaaaugaaauauuucugauuucacuccagggaaaaccaauuuuagguguuaaccuuaaaaaaugaaagcaucuccuuaauuaaaggcaggaaacaaugaauaaaauuccuguuuaggaccuaaacugacugaaugaccaaucuuaagaguuccagauuuucaaaauguauuaacuuauucauaacuacaguugaccuuaucuuuuaaggggaaaacugauaaaucauauaaaacaaacaacuguccaaagauuucauaaaugugucaugaaccuuaaaagcaguguauuuuccuaaaauuaucuaaaaaaacuaccuggugacccaaguguagaacugagccuccugggguuugaacuagcuguucaguuuuuauuguuuggauucaagcuacaacuacaguuuaaauauguguaagaagugggaagaaaaaaaaaggccuuuauaacuucucaugugaauuacgggcaaguuacugcaaauaaaaaaacaguacuuccuuccuguguuuaauuugaaaaugucuggauauucacgaauauacuaaaaauacuuaauuuucaguauauuuugaaagaaucuuaugguauaugaauuauaucucaaaaauuuuaaacacucacauacauaaauauuuggauaaaugauagagauggaauucaaacucuugagacuauacacagcaguugacuccguuuuaccacccuacacacaaagauauagggaaucauauuggaauaagugauuuuguuucugccuuuucauguauuuuacuguuucagacuaccuaucaaaugcaucacuauuguccuauuguccuaauaacuaagacugagaaaugauuuugacaccuauacuggccagaagacaucuuuuagccaggcuucugacaacacagcaugaauuuuuaccuauuuauauuccuuuuaguucucaagcagaguagguacugcagcacagcagagucuuuucuacauaaaacauucuuuacucaauaagcauauuagaggacccucuaauggccccugauauaagucaaaguaacaugcuuaaaacggagacugcaggaaugcaacauaguauuuuagagaacacuaugcuacguuuauaugcuacuuugaaaaauucuaaagcaauugccucauauaauucucauaacacucuugugagguaagccuggaagcuaauacaauaacuuuuuuaacauuuaaaaaaauugcuccaauaugugccagaaccaccaccaccaaaaaaauuaagaagccaggcacaguggcucacgccuguaaucucagcacuggagaaagcagaggcgcaagaauugcuagaggccaggaguucaagaccagccugggcaacauagcaagaucccauucucuaaaacaaaagaaaaagauucaguuuacaaaaauuagucuugaagucauuuuugcuuuucaaaaauuucucuucuaaaugauauaaccuucuaacuugcuuuguaauaaaaacaugagaagauauuaggguaaaaauaguaaaaugcucuuguuuggaaucacauaugcuuugaaauuaguauuuuauuagauaucuguaguaauaaaaauuaaaauucuggagccaaccuagaauaaagaauaaugccuuaggaaaaggcauuaauuacuggcauagacuugcaugcuuaugugguaugguaaauaaauuaaagucuaagacaauugaguuauuaauccugaaaaguaagagucugauguauuuuauauugcauguguauguguauaauauaccgucucuauauaguauuuacccauguauuuguauaguacauauacauguauauguaaauauacauauauuauacauauaauaaaauauugaugaauuauauauguauaauaaaaaacuauuuggucaauuucaagauauaauuacaguguucaauauguguaauacagggauauucuauuguauuaauguccaaacauauuuaaaacaauuccuauauauaaauguucaaaaaaauccucuaagaugugauagacauauuuauuaaauccauucucucauugcuccugauuucuuauguauguucaauuucaaucuauuugucaagcauaauagcauuuuaaagaauuauuucucaccuaucgagggagcaaauuuuaauuaaguuacuagacauaacucacaagagcuaaaagcagcacaauucaaauaaaagucaaucaucucauuugauaaauacacugaaaaguagaacucugaaacugcaaggugauaagaaaauggagguaaaauaucuacaagucuaugugucauuaauucaucuuuuaguuugaaaauaguaaggguaaucaagacaagaaacuacuuugaaaaacaggacauaagauuaacgucauuuagaccacugaacaaugacuaguucacuaugcaacuaauuuacuuacuugucgucaugcucauaaauauucagacccaaagcaucaacaccuagccacaauucaguuccuuuuuuauuuuuuauuucaaaauaguugacuccauacauuucuagaucuugugcaaucuucagguauuccaucauagaauccucccuguugaaauaaaacuaaauguaauauauuuaaguaggagcauaucaaacuaaaguugcaaaauaccuggaauuaaaaauuaguacuuuacauaagucaaacaaucuuuuggaaauaauguaauaauaaauguuacgacaugaaaauacuuugaaggaaaaaagaaaacauagaaaauagcuacccaaauaccuuaacauuccucuauguucuucaugccaguucuguauucuuucuucccacuguucuuuuguuaguuuguguuguuccaauacacuaagaggaccaaaaaaaaaaaaaaauuauaaugacuuuaagauucaaaagcauacacuuuaaaaguaaagaauccuuucaguaacuugacugugguaguugucagacaauuaauacacaugaugaaauugcauagaacuaaauuacauacacacagaaaugagugcagguaaaacugauguaaucugaauaagguggcuagauuguaccaaugucaauaucuuguuuguaauauuguacuguaguuacacaagauguuaccaucagggaaugcugggagaaggauaccagggaucucuuuuuuuuacaacugcauaauaaucaguaauuaucucaaaguuaagugucuaggauccuuaaauuccuugaaauaauacuugcuccauaaagugauuacaaagauagcuuauaggaacccaaacaguucaaaggaauaaaacauuagauaaaaaaauggcucauuguuaauagauaaagaccagacugaaaaccagaauucuugggcccuaauucuuccuuuauguauuuacuuuuuugcuacuaauuuuguuguuuuagguagguaauacuuucaauuaaaaaguagagugaaaagucauacuccaguccaauaccccccaaauaacuuguuuuuguauccuuccaguguucuuaauucaaaugugagcaaauacauucuuuuuuuuuuuuuuuuuuuuuugagauggagucucgcucuguugcccaggcuggagugcaguggcacaaucucgguucacugcaaccucugcuuccuggguucaagugauucuccugucucaaccucccaaguagcugggauuauaggugugugccacgaugcucucggccucccgcguagcugggauuacaggcgugcgccauaaugccuggcuaauuuuucuuuuuuguguguuuuuuugguauuuuuaguagagacgggguuucgccauguuggccagguuggucuugaacuccugaccucaagugauccaccugccucgaccucccaaagugcugggauuacaggcgugagcuaccacgcccagccaaauacaaacauuauauucuacuacuacuauuuuaacaccaaaucagcaaagucaacaugauuauaaguuaccuacuaugcacacuacaguuugugacuucuauucucuuuggcucauaugauaauuauucaccuuuauuuaccagauccuacuuuacugacagcagaagcugugguguuaaaauauuacuguuuuacuauauaaaaaaucuugcaugaaacccaaggauuucuuggcagcauaaaggaaugauaaaaucucccccuggauaaguuaccuacuacuuagaguaaauuccuuaaaggggucucagacauacuguuauguucuuauuauacucugcuccuuucucuaggcaucuuuuccaagcucuugcuuuuggggagaagaguuucaucuuccuucugagagagcuuagguuuccacaguuucuugucuuucuugcugucuggccucugggcucacagagaggcaugcaaucagccuuggagacauaacccagugcagucaauugcuuaccauaauuauaugcccaaugccaguacuaaagagggccucgaaaauuuguagagugaauaaaugaauuaaucaauuuuucccaaccccuauuuuuuuuucuuuuucagagacaacuuucuuuuauggacuguccauuauacacuaaccucaauuuccauaccugacauccacugcccccagucuaccauaaucuggcucaaacacccaauacucuaugguaacuguucuucuuuuuuuuuuuuucuuuagacagaguuucgcucuuguugccuaggcuggagugcaauggcaugaucucggcucacugcaaacuccaccucccggguucaagcgauucuccugccugagccucuccaguagcuaggauuacaggcaugcaccaccacgcccggcuaauuuuguauuuuuaguagagacgggguuucuccauguuggucagccuggucuugaacucccagccucaggugauccgcccaccucggccucccaaagugcugggauuacaggugugagccaccacacccggcuggaaacugcucuucuaaggucacuaccaagcuccuuauuccaacagauacuuuaguucuccucauauuugaccucuugguaccauuuggcagugcugaccauucucuucaucaaaguauucuuuuaccuuggcuuccaugauauaauacucuucugguauuauucuuguuuucugagauggagucucgcucugucgcccaggcuggagugcaguggcgccaucuuggcucacugcaaccuccgccucccggguuccagugauucucaggucucagauucccgaguagcugggauuacaagcaugugccaccaugcccagccaucuucuaguauagaauuauucuugaaucuguggccagugucucaguacaguugucccuccauauccauaaaggauugcuuccaggacuccccuuggauaccaaaaacuguggaugcucaagucccugauauaaaauggugcaauauuugcauauaaccuaugcacauccucuuguauacuuucaaucaucucuaggcuaauaauacuaauacacuauauuauuacuacuauguaguauaauaauacacuaauacacuacaaaugcuauguauuguuauccuguauuuuuaaaauuuuguaccuuuucauugcuguguuauuuuuuucacauauuuucaaucugugguugguugacucugugaaugcagaacccaaagacaaaagcugagguccaacaagaucuguccuaggucuuuuucucauuuuuauguacuugguagguugaucucuuucauucucaugguuuaauuaccaucuauucacugauuacucccaaaacuguaucuauaguccaagacuguuucuaaaaggucugcacccacauaugcaaauaaauaccagauaucucucuugguuauauugcacauauuucaaacucaauagguucaaaacugaauucaucuucccccucaaauguauuuuuucuuccacucauuuugauaaaagguauuaccaaauacccagccgcccaagucagaaaccugguauguaaaaguuuauguauauuuagcucuuuucaaagggaagcaauacuaucugguggagcuaauuaucuauaccacaagagcuaaacuuuucuacaguaagaacagauugcucaucuggguuuuucaauacaagaaaucagaauguaucagaaucacuaaauuauuuuauuugauuuguuaucaccaaauaaccuaauuacucauuuccuccccagacuguacuuagauacugagaaaaaguguccgauauaccauacuggaauaagccaaucacugugaaaauauccucucuguucuaaacagaaaaugaaaaaaaaaugguauucuaacuuuaugacuaagucucauuuuaagauaacauggcuugaauuaguccuccauggaauaucaacucugaaggaacaacugaccuacaaaauuaaggaacaaaucuugaaauaggcauuugcacuagcaaccacaagcaacccuaucuaaagcauuuagccaccuuccuucuuuuuaaauagaguagguuagagcacacccauauuuaaaauaaacugugcuuguguguuauuguaguguuuaagagauuuuuuucaaucacaugaguuaugaaauguaagccaauuacuucaucugcugcucaaccaaacagcaaucuggcuuaacacugaaagaucaaugcuguacuuguuuagauaaagcauuccuauucuuuaacauuuaaaaaaaaaauuaaaguaauucugauuauaaaacaaaagguaauccuuauaugaaaugaaauuccaccauaauagucugauuacucaauucaguaaucuaagaugaagaaucuuagguuagaauaacauucaaaaccagaauauaaacagacuaucagauaucucauauuccugacucucuuggugaacaacuuacauaauucuauccuuuuccaaggugacuacuauugcuacaaaauuaaagggcggaacacugugacauuuaauaauugaauuuuggcugagcauggugacucacgccuauaaucccagcacuuugggaggccgaagcggguggaucauuugagaucaggaguucgagaccagccugaccaacacggugaaacuccaucuccacuaaaaaugcaaaaauuagccaggugugguugugugugccuguaaucccagcugcucaggaggagacugaggcaggagaaucgcuugaauccgggaggcggagguugcagugagccgagaucgugccacugcacuccagccugggcaacagagcaagacuccaucucaaagaaaaaaaaaaaaaauuaaaaaguaauauuugauguuccaucuucuagauuccaucaauacuacuaaauaacacguuucacacuugacaauuaaaacuguaaaucauauaguucauuaauuauaaucauaaacuagaagguagccagagaaggauuauuauccccacuuugcagauuuagauacugagcucagagguuuuaggucauguaccuaaggucacauauauagcaaaggguggaaucgguacucaaaauuuaggucuucugauaauuuuuuccuaugccauauuauuuuaaaauagccauuauagaagcagcaguacacuguagauaagaacaaugcaccagccuaggagucugaaaaccuaguuuaaaaagccuuuucagaaagucagaaaauucagccaggagcaguggcucacgccuguaaucccagcacuuugggagaccgaggugggaggaucacuugaggucaggaguucgagaccagccuggccaacauagugauacccugucucugcuaaaaauacaaaaauuagcugggcauggcggcagaugccuguaaucccagcuacucgggaggcugaggcaggagaaucacuugaaccugagaggcagacuccaaucucagcgagcugagauugcaccacugcacuccagccugggugacagagugaggcucuaucucggggggggaaaaagucagagaauucuaugaagaaaacacagccugccacuuacucucacuuauuaagcaccugccuguguuagaauuuguaccaagcagcaacagucacauccuuuccucaaguccaaauuaucacugccuccauuuauugcuuacccuaugggaaugaggaaagaagagauagaucaaccuuagguaauuacagagcauauaaaucuauggaggugcuagguaaugauuuuuagaaguauaccccaugauccagcuggcaacuuaaaaucuggaaaaaaaaaaaaaagaggccaggugcgguggcucaugccuguaaucccagcacuuugggaggcugaggcgggcagaucacuugagcucaggaguuugagaccagccugggcaacaugaugaaaccccaucucaaugaaaaauacauuaaaaaaaaaauuagcggacauaauggcaugugccuauagacccagcuacucaggaggcugagguggaaggauggcuugaacccaggaggcagagguugcagugggcugagaucacgccacugcacuccagcaugggugacagguccagacccugucuccaaaaaaaaaaaaaaaccugaaaaacguuuuauuuauagacuucuagaauacaauuuucagacaauauaaugcaaacgcauguuucacuuaccgcugggguaggagucuaucauuagccagguagccuggcuuaugaaucucuuuauuguaaucuccauacuuggcuuggacagcauaggaagccaaaagaacugcaguuucuggcgggcaauauaucucaucauuuaagauggcuucuuuaacuugcaagaagaagagucucuggguuauuucuugaauuaauuccucagaaacaucuucaggaaagaauuuagcucuaaacuugaacuguaaaggauucucuuuuuuaacauccugcuguguuaccuggaaaaauaauuucaaguauaaucaacaaaaaucuuaaguuuacaauaauuagaccuagucacaucaaauucuuuuuggaagaaaaugaagugaaauagauucuaaaucuaugaagauuuuaguguguaauagucuaaaucuguaaacaaauauaugugguaaaagauucuaugcucuugaaugugaccuauaacucagauucuaauaaccaaauugaaaacuuuuuuucauauucuugagaagcuuauccuacagguauuuacaucaaaauugaaguacuuaguaugccauuuguaauaucugcuuuaauauuuguuauaggcuaaguuuucaaauaggaaaaguaagcauuucuuuuuuuuuuuuuugagaugauaagcugauggugccugauugaauuuaaaaaaacaugguaccucauaaugauuaacagauaacuacaaaaggaagcuugcaaucagucagacuuagcuuuuccagcacaaauucauaacuucaacuuaacauaauuauuaguuuaauguuaucguacauauuuuaccuuuuuauuuaguuuaagccauguagaauaaccuuugcugucuacauacugcagcccaaaaaaccagaccucacgcaaaccaacuguuuucaccaccuaaaacacaacaacaacaaaaaaacacaauuucaguccaacauacacauugugucuagaugauacuacacuucaaaaggagaacaaaacuauguaaguauacguauauuccuuugccauagaaaaggcuuucccuaaauuuaagauauuaaaggaacauuuuugaaaacucaaauucaaguuuucuauacucaauuuuucuuuuuuuuuuuuugaaaagaaguuuuuuuuuuuguuuuuuuuuuuuuuguucuugucacccaggcuggggugcaauggcacaaucuuggcucaccgcaacuuccgucuccauucaagugauucuccugccucagccuccaaaguagcugugauuacagguaugcacuaccacgccuagcuaauuuuuuguauuuuuaguagagaugggguuucaccauguuggccagguuggucucaaacuccugaccucaggugaucugccugccucggccuuccaaagucuugggauuauaggcguaagccacugcaccuggccucuaauccucaauuuuguagugucacuucaauccucuuacuugauccacuuuuucauaccuccuuuuccuuaucuaucaugaccucaacaauaacaagagucuugaaaauauauauauauauauauauaguuuucauaaucauacguuccaauuucuauuuacccccacaaguacccuauugguauauuuagggcaaaugguaucauuuuggugauaagaaaagucugauauauuccauguucuaccuucacugagcaagaaaccauucuuagaacauaccauaaauuccacccuucuacaauuuugcugauguuuuuuccucugccuagaaugggucuucuguauuuuuaugacuuauugaacaauuuauucuuuaaggacaagcucaacuaacgugccuucugugaauaaagcucuccuaccaucuagauaaaauuaaucacuuguucccugauauucccauaggacuuuaucuauccugcuauuagaaaauuuacucuaucauaauuguguuauuagcagugugucuauuuacccuccuugacugcauaauacuuauggacagagauuauugauuuaugugucuuaaaauccauagcaucucacagaaugaucagccugugguagauacucaaaaguaagacuaaguaggcugugcgcaguggcucacgucuguaaucccagcacuuugggaggccgaggcgggcggaucacaaagucaggagaucaagaccauccugacuaacacggugaaacuucaucacuacuaaaaauacaaaaaaaaaaaaaaauuagcugggcgugguggcaugcgccuguagucccagccacuugggaggcagaagcaggagaauggcgugaacccgggaagcggagcuugcagugagccgagaucgugccacugcacuccagccugggcgacagagcaagacuccgucucaaaaaaaaaaagaaaauaaaguaagaguaaauaaagugguggaguuaggauacacacccaggacuuacccacaccuaacaaaagcauauguuuuuuaaaaaaaucuguauuuaaaauaaaaugaggaaaaugauccaggggagguaaaaguucauuaacauuuuaaaagcuuuacagaaagauucaauaucaguucuuaaauaauaaacauucuugguuuuuugugggaguuuuugcuuauuuuuuuuuuuuaaagacagggucucacucuguacccacaauggaguacaguggugugauucacggcucacuggagccuugaccuccugggcugaagcaauccuccugccucagccuccugaauggcugggacuagaggcacauuccaccacaccuaguuaauguuuuuuuuuguuuuguuuuguuuuguuuucuguagaggcaggggucuugcuaugucgccaaggcuaaucuuaaacuccuggccucaagugauccucccacuucagccucucaaaaugcugggauuauagaugcaagccacugcgcuuggcccuugguuuguuuguuuguuuguuuguuuugagacggggucucacucugucacccaggcuggagugcaguggugcaaucucaguucacugcaaccuccacccccaccccaggcucaagugauccucccaccucagccucccgaguagcucggaccacaggcaugcaccaccaaaccuagcuaauuuuuuauauuuuuaguagagauagggucucacuauguugcccaggcuggucuugaccuccugagcucaagggaucugcccaccucagccucccaaaguguugggauuauaggcaugagccaucgugcccagccuguuuuuuaaaaaauaauguuaaaacauuuggcagggcaggguggcucacgccuauaccagcacuuugggaggccaaggcagcuagaucacuugaggcuaagaguucaagaccagccuggucaacauggugaaaccccaucucugcuaaaaauacaaaaauuagccaggugugguggugcacacccauaaucccaguuacucaggaggcugagacaguagaauugcuugagcccaggaggcagaggcugcagugagccgaguucgcgccacugcacuccagccugggugccagagcgagacuccgucucaaaacacacacacacacacacacacacacacacacacacacacacacacacacaaauaaucuuaaaacauuccaggcuuuugguuucaagacagcaaacugaacccuuccauuuacuuucccacucuugaaaauuuucacugaaaugacagaaaaaaagaaaaaacacuggcugggcacaguggcucacaucugugaucccaacacuuuaggaggccaaggcaggaggagcucaggaguuucagaacagccugggcaauguagggagaccuugucucuuaaaaaaaaaaaaaaauuagcuaaguagucaagcaaaucuguaguucuagcuaaucaggaggcugaagugguaggaucacuuaaguccaggaggucaaggcugcagugagcugugauuaugccacugcacuccagccucagugacagagcaagacccugucugaaaaaaaagaaaaaaaaaauuaaaaauaagaaaaaagcauuuagaaaauguuaccaucaaaaaagcaaaaagugggccaggcacgguggcucacgccuguaaucucggcacuuugggaggcugaggcagguggaucacaaggucaagaguucaaaaccagccuggccaacauggugacacucugucucuacuaaaaauacaaaaauuagccgggcaugguggcaagggccuguaaucccagcuacucaggagguugaggcggagaacugcuugaacccgggaggcggagguugcacugcauugagcuaucgcaccacuguacuccagccugggugacagaguaagacucuguuucggggaaaaaaaaaaaaaaaagcaaaaagugagaaauuucuagaagauguggaauauaaagucucauacugauaaugcaaaagcugaucaaugucaaacaaugaaaaauucaauguggacaaaaggagauuccaaauaaucuaacuuugguaaaagacagauugccccagcagugccauagaaaacauucaagcuuggagcggcaggaguaguaauguacaggucaaaagcagcagagagaaguauaacaaagcagcugggcucagcuucugccuccacacucugugagauucacaaugguaaguaaaagggagaugccccacagugggcacaggggauaauagcuuaacuaacuuuagacuauuacacaaauacaaggaacaagaaagcucagcugugaaauucccuaaaaggcccugucuccccagugguucucuacuucuucagaaggugcuccuagaauguuuuuuuuuuaauuaauauauuuuagugaggcuguccuuuaagcucccauaaacuucugaucacauacuuuuagaagugaaucugcuugggcacguaacuauaacauagguauauuuauuuacaaguuacauacuaucaugcuaauacacuauaaagcauauauuuuuaaaaauguuuaaaaauacauauuauauauacauauauauauauuuuuuuaauuaauuuauuuauuuuuuugcccaaacugaagugcagaccgcaaccucuaccuccuggguuucagcaguucucccaccucagccuccugaguagcugggauuacaagugugcaccaccacacucagcuaauguuugcauuuuuaguagagacaguuuugcaauauuggacaggaaaagguacaguaaaaauaugguauuacacucuugaacuccugaccucaaguaauccucccgccuuggccucccaaagugcugggauuacaggugugggccaccaagucuagccuaaaaauauauuuuaauacuucuuucaccguaacagauguucuugcacacucuuuggggguaugaacacucuuuacacuaaucccacaagaagcagcuaaaggagaaggcuagucaagaaaaaagucagcaagaagcaaaccaaaggacuucaagcacucagaguccccaaacacagagcagcuggccucgauuuaacaucauaaucagacauggggcuuuacuacacauguacucauguagcuaugugcucucauuuuagaggacccaguuuaccccuggcuugaccugaaccugccagcuuaucccacacacacuacauacaaaaguaaagucugcauuuuucgauccuugcauuugaguucaaggaaaguucaucacugcauuugaguucaaggaaagcagucaggaaauagaacagggacuaaagaacugcugagaagaguccauaacagauaacaauacucaauaaucuagaccaggcuggacgguggcucacgccuguaauccuggcacuuugggaggccgagggaggcggaucacuugagcucagaaguucaagaccagccugggaaacaugacgaaaccccaucucuaccaaaaauacaaaaaaaaauuagccgggcaugguggagcacacuuguggucccagcuacucaagaggcugaggugggaggaucgcuugagccugggaggcagagguuacagugagccgagaucgcaccacugcauuccagccuggggcgacaggagugagagccaaucuaaaaaaaaauuuuuuuuuaauaaagaaauaaguaauaauaaccuggaccauuuacaauaugaacugugugugcaugugugcguguguguguguguagucaggguugcuuaacgauggggauacauucugagaaaugcaucguuagacaauugcaucaucguaugaacaucagaguauacuuaaacaaaccuaaaugguauagccuacuacacaccuagacuauaugguacagccuguugcuccuaggcuacaaacuuguacagcauguuacuauauugaauacuguaggcaacucuaacacaacuguuaaguauuuguguauuuaaacguaucuaaacauagaaaagguauaguaaaaauaugguauuacacucuuacgggaccacuguugcauaaguggcccgucacugaucgaaaugucauuaugcggcacaugacacuguauuuaucuacauaaauagaaagagauauacacaaaaccaucaaauacuguucuacgcacuuuacauagauuuucauuuaacucucacaauaaaccucugaagaaguaauguuaccaucauccuaauuguacaaacgagaaaaauaagacaaagagauuaauuuguccaaagucaaacagcugcaacuacaacuauugcaggcagugugacuccagugcccacacuucuaaaccacuguacaucacugcccuauaauaaaugguuucauuuuccuguauccaagugaaaguaauucuacuuaauaaaaaacaaguuuuauuucucaguauacaauaccaaagaggauaacuugcugauuaguuuuuggcugccacaaacaucucacuuacuauaaauaacauuucaauuugcuaugaaguacaauaaaugcuaacucuauucacauuuuuuucaaauaagauagacuguauauucacaaacaggaggcacagaagaaucaacagaaguggauauuauaccagaacaaaagugguuuggaaaaaagaaaaaaguggagauugguucacaagguguggugaacuuagcucuuuaugauuuugcuuuaaaauuuugcacauccacacaaaaagcuuuucaugauccaaaaaggccuuaucaggacuuuuaaauuuaugaauuaccaaaucaggagauuaaguauauuacuugucaggagaauaaacaacuuuagagaauuuagaauuuuuauuucaucagauuugaaucuguauuugacagaaugacaacuaacaaaaccaaaguaucuaguguuacuuacugcugaaaugcuagaaacucuuuccuucuuuaagaucaaguuauucugacuacaggcuauugcucuccugcuccuaagaaaaaguguacgugaaguuuauauaaaaguuauccuccucuaaguuucaugccacacaugauauauaccaccuuccucugucuuugcaacaguuucuucauguucuuacuuaaucccuggggccaaucccuuaccucguuuucucagcaaaacuugcuuacauugcaauacaacauuaucugggaagcuuaaauuuuaaaauacugauaauuuagaguaggcccagacaauuaaaucagcaucucuggaagggguuuccaagcacugucuccuuucccuuuuuuuaaagcuccacaggugacuaauacgcacucaagacugagaagaaagauaagaucaguagucccaguuccuuaacauaccggauaccugaccuccauaucccaaccuuugccucauacauuaugaaccuaugacaccaaauuguuguuagggaucucuguauagccuauacagguugagcaucccuaauccaaaaauccaaaauccuaaaugcugcaaaaucugaaaccucuucaguaccaacaugacucugcaaauggaaaguuccacaccuaaccuaacgugaugggucgcagucaaaacucaguaugcauaaaauuauuuaaaggauuuuauaaaauuaccuucagccuauguguauaaguuguacacaaaacauaaaugaauuuuguguuuagacuugggucccauccccaagauaucucauuauacauaugcaaauauuccaaaaucuaaaaacauccaaaaucuucuggucccaagcauuuuggauaagagaugcucucaaccuguaauucccuaugccuuucacuccugcuguuccuucugcccaggauuccuacucauuucacucaacaacuuuguggauuauccuugaaucccuuuuagucaccauuacaaugauucucauaaauguuaaauaaauaccugcugaaaauuauuuucaagaaguccucucccacaaauguaggaaugugaaagaauaaagaauaucccuacugcuguaguagggauaucugaauagcuacuaugaaaaauuccaagugguacacuguuggauuaucagcaaaaguacagaaaaacagagaaagagguaugcaacaacauucacacuauggugucaaaaguugcauauuucaugcaguguaauaccuggucaaaaaguuguuugccaguuguauugggcugaauggcaaauuccagcucagcauccauuguaguuacucuuacguugaucuguaauaaaaauaaaaggaauaauaaguagaagagaaguuauuaggcgugagaaaacuuuuaugauuuucuuuauuaaagugauaaaguuuuauuuuaaucacaagaaaucuuaaaucuauuugaaaaacaaagagcuuauaaaguccucauuuaggaacaucuauugaauacuuaacauauacugggcacuaagcuaugggcuuuccauacucucauuuagcccuugcuauaauacuaggagauacuaccuuuauuucuacagaaacgcaaagaguuuccauuauucaccuaaggacacguggauauuaaaaggcagagcaagagcuggacauggugccucacaucuuuagucccagcacuuuggaaggccaaggugggaggaucucuugaggucaggaguuugagaccagccuggggaacacagcaagacuaugaaaaauuuaaaaauuaguugggugugguggcaugugccuguuauuuccaggaagcugagaugggaggaucacuugagccuaggaguuugagggcugccgugagcuaugauuguacuacugaacuucagccugcacaacagagcaagacccugccuccaaaaacaaagcaaaacaaaaaaggcaaaggagguauuuaaauugaggucuaacuccaaauucuuugaaugugauucacuaucccauauuucuuucaacaugaaaaucagauuucauuuuauucauacuguaaauacauuauucgcuuuaggaaagcauuuaucuacagugcuuuauuugcuagauucuauuuuuuguuguuuuuagagacagggucucacuauguugugcucaggcuggagagcacuggccauucaugcgugcaaucauggcacacugcaaccuugaucuccuggacgcaaaccuauacucccaccucaaucuaccaaguagcuaggagcacaggcgugugccgccaggccuagcuccaaacucuauuuuaaauaauaauuuuauuguguaaauaccuaauaucucaaaaacuuaacacgccuuaccaaaauaauuuuaccacagaauagcaucuucaccuagaauucuucacaugauccaaauauaucuuuuuagcuuuuuaaauuauuuuaucuuuuauuaacuuauuucuccuuuaauuuucccacacuucauuugcuguuucuguaucgauuuucuaacaaucuuuacuuuucccuuaaccaguauaaaccuguagcgauuccuacuaacacuguuucuguaacaacuguauuuaaaauuuuauauuaauacguauuacugcauuuguuuuuauguaucuuuuuccaucagccuguagguuuacugaggacacagcuugugccauuuuaucuaacuuuaacucacacuauaaaaacucuaaaucagacuucuuauuuccccauaugucuaacaaucacaaccucagcacauuauagcuuucaccuggaauaacuucuguaaucagaucuuacagauucauccuucuuuaaaauaaucuuauuuuuuucuuuucuaaaacuguaucuuauuaagaaaugauauauacaaaacaucuaucauauauaaacaaugaagaauaauaaaacgaaacccauaaaucuaccauccaacugaauaacaagaaaugguaaauaauguugcauauaccacuguuauuuguucuuuguaaauaccaacagguaaucacuaaccuaaauuuuguuauuaucuugcuuuuaaaaaaaugguucuaacguaaauauauguaucuguuuguaaaauagcuucauuuuucuugauuuuuagcuguauuauaacugcacgauauuuguugaucaaguuuucuuucuugaugugggcaaugcuuacauggguauauucacuuuacgaaaauucaucaacuacacacuuuuuuuucccuguugccuagguuggagcacaguggcagaaucccagcucaccgcagccucaaccucccgggcucaagcgauccuaccgccucagccucuugaguggcugggacuacuguuacuacacacuucucauauauucuguuugguauguauauucuacuucaauaaauucuuuaaaauugcacuauacuaguuuaauuuuucaccauauguuucuaagauucauugauguuuuuguaacugaacuuucacugcuaugcaacauucugcauguggccaaacaaacauuuacucacccauuuuccugucaaugaacacuguuuccaauuuuuuggcuauuaagaacaauacugcuaugaacauucucguacaugucuccgagugucagaauuucuccagaauauacucagaauucuugaguaaugaagugugcacaccuucuacuuuuaccacauaaugcugaauuguacaauguaacugugucaauguauacuccugacagcauuguauaagaauucuugcuuuucuguauuuccaggaacagugggcauuaucagauuuauuaauaucugacaauucaguuagcagaaaaugguaucucaauaugguauuaaagugggauccucgauugcugaugacauccacauuucuguacauggcaugugcauacagaauuuuaagauggccccuggugucaugcucaugauuauguugcauuacaugauuaaagggauuuugcagaaguacuuaagauuacuaaucagcugacuuuagaacaggaagauuaucuaggagggccuaagcuaaucaauuuaucuggcugguugcagaauaaguuauaccuugauuucagccuuauaagacuuugaagcagggaacucagucacaucaucccagauuucuaaccuauaaaacugugggauaauacaugggugcuguuuuauaacacuaaauuugugguaauuugucauagaccaauggaaaacuaguacaauacguuuaacugaccacucauucucaucugcgaauguucacgcauacggcuuauuuuucuauuggguuguuuuuucuuacuuuaacguaggaagucuuuauauauucuugauacugauccuuugucaguuauuucuuacaaaagaaccucccauauugugguucgucauuuuacuuucuccauaguguccuuuaugauaaacugacauucuuaauuuuaauguugaauuuauaaauauuuuacacacagauaccaguuuuuuaccauccuuuuuuuuuuuuuuuuuuuugagaaagcaucucacucugucacccaggcuagugugcagugacgugaucucagcucacugcaaccucugccuuccagguucaagugauucuccugccacagccucccaaguagcugggauuacaggcaugcaccaccaugccugacuauuuuuuguauuuuuaguauaaacgggccaguauaaauguuggccaggcuggucucaaaccccugaccucaagugacccaccugccucagccucccaaaguguugagauuacaggaaucagucacugcacccagccaauuuuuugccauccuuaagaaauccuuccauacucuggagucauaaggauauucauauauuuccuauuuugauuuucacaauuuucaaugauuuuugcuuaugauguuagagguccaauuucauuuuuuaaucuccauaugaaugaaaauaauacaggguuuuuuuuuaaucccaacauaauuuauuaauuaguucauuuauucuccaaagucugugcugucacaaaucaaguaucugcauaaguguggaucuaauuuuguuccacuggucaauuaaacuacucaauaucauauugucuuaauuaguacuucuuuaaauaagucuugauaugugguagggcaagucuccauuauucuucagaacuauuuugacuagucuuggaucauuaucuuugcucuugguuccauauaaaacugugaacuuuacaaaauacaccauuuaugauuuaguauuggaacaacacgaaauuauuugguaucuuuggguaagaauuaacauuuuuauuaauauagacucuauacaugacuaugguuuucucacuguacauugacuuagaucuccuuuaaugacuuucaaaaucuuuugaaagaagugcuuauaauuugcuccauauaaaucaguuuacucauuuguuagguauuuucuccuagaucauuauggcuuuguggguauuguaaauauggauccacaguuccuauuccauaauuuugacauccuaaaagcacggaaaccugaagaugaguuaauuuugaggaaaaaucugacaugaagugauauaagacuaucacuuguagugaauuaauuuauuccacuucacgugacuauucacucauuaaacuauagaaauacaaauguuuuagaggugaugccauagaccuugaugggaguuucauguuauaaugacauaugcacauaauauaucguauauucaucuuucuaaaauccaaaaacuuccacauucugaaacuuaucuagcuucaagaguguuuucuccacaaggcaaguucuauacuuccagaaucuuuaaugaaucaacaacacacaauugauauccaacugcauauaauuuugacucuuuaaggaacaauaaacacucuccacucaauuauacuggcaaagaguuuuccaaaguagcuguaaacguucacauuccuaacaaaaauacaauaaagucgcagcugcuccacauccauaucuacacuggauuauuaccagucuuuuuuuuguuguuauuuuuuguuuuguuuuuuugagacaagccucacucugucacccagguugaagugcaguggugcgaucuuggcucacugcaaccuucgccuccuggauucaagcgauucuccugccucagccucccaaguagcugggauuacaggaaugugccacaaugccuggcuaauuuuuguacuuucaguagagaugggguuucaccauguuggccaggcuggucucgaacuccugacuucaagugauacucccgccucagucucccaaaguacugggauuacaggcgugauuuaccaugcccggccuaccagucuuuaauauagcuucuuuugugaaauaucugcucaaauauuuuguccacuaaaaaaaaaaaaaaucugaguuguguuauuauucaacuguaaaagaacuuuauauggcaauuauuuucucccacugucuugccuuuauauguuuuuauugcugucuuucaagagcaaaaguuuuuaauuuugauuaaguccaacuuuuucuuaaugguucaaauuuucuguguauuacauaacaaauuuucgccuacucuaagaucacaaaaauuuuuuccuauguuuucuucuagauguuuuacaguuugagcuuuugcauguaggucuauaauccauugaguuuauguuuguaaauugugagacaacagucaauguucauguuuuucuguauggauaacccuuugugccaauaccauuuguugaaaauaauuauaguucuccaguaaauugugugacacccuugucaaaaaucuaaugaauacauauguguauauguguguugguguauuuucauuucaccgauccuauuaauuuauucuuucaccaauaccucaaugucuuauuuuaguggcuuaagaauaaaccuugaaauccaggaguguaaguuuucuuuuuuuuuuaauugcuuuagcuacucuguacacauuuuggcauauccauauauuaauauauuuuagaaucagcuagucaauuuuaaucaaagaagacugccuggauucaacugauuggaacugaauuucauuuacgaacacuuuuauggagaacugacaucuuauaaagaucucuauacauauuuuauaguucucuauguauuuaaaucuuuaauuucucauagcugguuuucaguguagagaucuugcacagcaucuguacauuuauuacuaagugugucauguuuuuuaauaacuaaauaaccaaacuaguuuuauauaaaaaaggccauugauuuuuuuuuaauacaaucuugcaucuggcaaucuugcuaaauucaguuauugguucuaguauuguuuuauagauuuaugaggauuuucuacagaaacaaucaugucaucugcaaauaggaaauuuucuuuuugaucuuuaugccuuuuuuuaauucuucucucccucuaacaaugcauacuuugcgaccugcugagucuuuaagucauucugaaguguuauccgugcuagaaaaucccaaaaaugauaacuaaugacuuucuuuaaaauuauaauuggccaaaagaaacauucaaaaaaaaaaaacaacucacuuuauuagauuaagaaaagaacauuuacaccuuaagaauaaaggaauccuuagucaagaagaaccaaauaacuauaaaacuaaguaaaauaaucacauguguacccuuaaauaaaaaaaaucuaagacuauauaauaucaguauggguaacacuugcaucuaaacuacaauuaugagaaaacuaaaaugcauagaucuuccugaccucucauuauuuccucccauuuaacaauguuaccauuuacugggcacuaaauauauaucagauucuucuaacccuuaccauacucccuuggguaacuaauuauaucccauuuuauaugcaaggaaauuaaaaauuggacagauugagcuaaauuaacaaaggucacccagauugguggcagaaccaagguaacaacuaagacaguuugaccuuagaacucaugaccacauaauaccauaguauuauggucuggccaacauggugaaaccccaucuauaccagaaauacaaaaauuagccgggcaugauggcaggugccuguaaucccagcuacucaggaggcugaggcaggagaaucacuugaacccagaaaggagagguugcagugagccgacauggucccacugcgcuccagccugggcaacagagcaacacuguguuucuaauuaauuuggccacauuaaucuaaagagaaauaacaguaguaucagugccuuuuucuuccaacaacucuaccaacauucuuugucuuguuccaaaacgaauuuaaugauaucuuauuauugagacacugucaaauguaauaaaauacacuuacugguuucggcauuuucuuucucuuuuuguuaccuucuuuaaaaauucuccacuucaaugaauucuguuaucacuuucuguuaaaaaaaaaaaagcauaaucuauuaucuuuuuauauaagguuucuauuuuaacuauaauuuguguaagauauaaauuaaaauauuugaaaagguggauuuaaaguaacaaggagugauuucauucucauuuucaauaucuucuacuagcauugcacauucccuaagaagacugaaaucugaagauuaaaaauaccacacaucucaaauaacauguuauaaacacacugaucuaaccagaaguuuuaauuacagacaacaaagaacaaggaaacaucacugcuuagagcccaaaagcuugcucucugagucagguucaucucuguauccaggauguuagagaaaggaacaauaaaagugaagacagauggauucagacucugaagagcuuaagaauacuuauucaauguuuuuuuucuguacugccaaaaacaaaaggaaauucugauuaauguaaucuacaaaaaaauggaagaaacuaauuuuuuuuuuuuauuuuuuuaaagaugggucucauucugacauucaggcuggaguacagugguaacaccacagcucacugcagccuaaaccucccagguucaagugauccuccugccuugggcucccaaguagcuaggaucaugagcacgugccaacaugcccagcuaguuuuuuuauuuuauuuuuuuguagaggcaggguugcccuauguugcucaagcugucucaaacuccuggccucaagcaauccucccaacugugccucccaaagugcuaggauuacaggcaugcgccacugcgccuggcuuauuuuuucuucuuguaaauuugaaaauaugaauggagaaaaauaugaauagcuuauucacccaauguguaugaaacaggcaaagcucugcacacuaacaaccugcauucagcuagcacagcggcucacaucuguaaucccaacacuuuaggaccuguaaucccagcucuuugggaggccaaggugagaggacugcuuaagcccagguggcugaagcugcagugagcggugaucacaccacugcacuccagccugggcaacagagcaagacccugucucaaaaacaaacaaacaaaaaaauguuauugauugcuguuuaagaugccauaacuaaggcugggcaugguggcucaugccuauaaucccagcacuuugggaggccggggcgggaggaucauuugaggucaggaguuugagaccagccuggccaacauggugaaaccccaucuauaccagaaauacaaaaauuagccgggcaugauggcaggugccuguaaucccagcuacucaggaggcugaggcaggagaaucacuugaacccagaaagcagagguugcagugagccgacauggucccacugugcuccagccugggcaacagagcaacacuguguuucuaaaaaacaaaaaaagaaaagaugccauaacuaauaaaagagaaauucucuaaguuguaauaaaaaugaaauuuagguaaggccauuucccuaaauucuagucaaucacaaguaacugauuaccaauaaaccucuucagaggaaauuuccuccugagauuuuuuuuuuuuuuuugagauggagucucacucugucgcccaggcuggagugcagugcucgcaguggugcaaucuuagcucacugcaaccucugccuccuggguucaagcgauucuccugcuucagccuccauagcuggaauuacaagcguccaccaccacacccagcuaauauuuguauuuuuaguagagaaaggguuucaucauguuggccaggcuggucucaaacuccugagcucaagugauccgccggccuuggccucccgaagugcugggauuacaggcaugaaccauuaggcaaugaaauucugcuggagguauaaaccccucauuucuuaauucuuaucauuuccuagcuuauucccaucuacacucaccuaccuucaugaaccuaaauguauuucaguccaauuuuuaaauucuauacccucuuuucaucccaacuacuauuacugccuuaguucaggucuuaucaucucaggucuugauuaaaacagccuccaggccaggcgcgauagcucacguguguaauuccagcaauuugagaagugggaggaucacuugagcccaggaguuugagaccagccuaggcaacauggcaaaaccccaucucuaucaaaaaaaaaaaaaaaaaaaaccaaacaaacaaaaaaaaaacgagccaggcauggugauggaaggaaugcuugagccugggaagugcagguugaagugagcugagaucaccaaugcacuccagccugggugacagagcaagaccccaucucaaaaaacaaacaaacaaaaaaugaccuauaaccuauugguucagaaaaauugcuucaucucacauuucauagaacaauuuuauucaaauucuucacacauauauaagacaugugugucugcaucaaaacuuuggccauuuuuugaaucauaauaguuguuuagauuacauaagcauuuuuuugaaucaguaauacaaucacuaaagguuuuauccuaagccaaaauggcuuguccuaaguuacgugggcaauaaauggccaaacuacaagucuuuugacaccuagcauccagaguucuacaacguaucagccugucuuccuuuuuuuuuugauaugaaaagacugcuaacuaauuucauuuguggaaauauaccugaagaaaauauuaacaaauauguauaaugauacaacuacaaagacucuaauuauaguacaauuuauaaaaguauauguaaaacugagaguuuagcuaggucagucaugguauaucuaaggauccacuagaucacaaugcagccuaucaaaauguuauagaaaaauacuaaaugacauaggaagauauucacaaaccacuaaguacaaaggcagguauuaaacccauccauaguagccaggcaugguggcucacaccuguaauuccagcacuuugggaggccaacgcaggaggaucacuugagggcaggaguucaagaccagccuggguaacacagacagauugugucuccacaaaaaauaaaaauaaaccaggcauaguagagugcacauguaguccuagcuacucaagaggcuaaggcaggaagaucacuugagcccagaaguuugaggcugcagugaguuaugaucaugccacuacaacccagccugggcaacagggcaagauucugucuaaaauguaaaaaauaaaacauuaaaaaaaaauccacaggauaucaucacuuuuuuuaaaaaaacaaaggaaugaaugaaaagaccagaaugauuauauucuaaaauauuaagaggcucgaauaauuaaaaugaaaucuguaaacuuguaaaaugaaaauguagagguuuugucauaaacuaauuucuuuuuuuuuggagauggagucucgcucugucacccaggcuggagugcaguggcgcgaucuuggcucacugcaaccuccgccuuccagguucaagcgauucuccugccucagccucccaaguagcugggauuacaggcgucugccaccaugucugacuaauuuuuguauuuuuaguagagacaggguuucacuauguugcccaggcuggucucgaacucuugacaucagguaaucugccugcuucggccucccaaagugcucacagaugugagccaccacacacacccggccuaaaaaacuaauuucuuacgaugaaaaaaacagaauuauucuaaauaaguaaacuaaaguuggacucauaacuucacaauaccauuuaauaaaauguaaguaaguuaauauuuuuuucaaaaagaaaggagaagcaguggcuccuacuuguaaacccagcacuuugagagccugagacagaugggcugcuugagcccaggaguucaagaccagccuggaaaacauagcaagaccccgucucuauguuuuuuuaaaaauaaucuaaaacaaacaaacaaaaagacagacuugaaaaaaauuauaguuuuggaagaauaacauaauaugacuaagaaagauauauagguuauaauaaaaacagauaaauauauuuuauuuuaaaucucuacauagguaaaauaaauaccaaaauaaaaaagaguagaaaaauuugcaacaguauaauaaagcuguuaugcaaaguaaucaaaugguuaaauauauaaagauauugcucagauuccacucaguaaacacuucaauaagaaacuucaccaacaaaacuuacguuaaaaaaaacacacaaauguucuacugauuaaaacuacaaauguuuuaccaaugauauacucauuaaacuagcaaaauaaauauuaauuacgcaugcuaagguugacgaacaacguugguaaacaaguagguaaguauuguagguaucaccagauauuggcuccacauuuccagaaaguagagagagaauacauaacaaaagcuacacagcuuuuuugaaugugaaauucugcuuuuguaauaaauccuccagaagauauuucuccccccaaacuaaauauaaaagaaaguaaucuguaucaagauauucacagcagcauucuuuacaauagccaaugauuacaaucaccaaaguaauguugauacuaugugauaacauggacuucuccaggguuguggggguuuuuuauuuguuuuuugguauuauuaaaacaaacugugucaacauuuagauaagguuaaguggaaaggcagaauauguaacuacccauccaucaacacagaaaaacacagguauuauuauuauuuuuuuuuuuuuugagauggucucgcucuguugcccaggcuggagugcaguggcgcgauaucggcucacugcaagcucugccucccggauuuacaccauucuccugccucagccuccccaguagcugggacuacaggcgccugccaccacacccggcuaauuuuuuuuuguauuuuuaguagagacgggguuucaccguguuagccaggauggucucgaucuccugaccucgugauccacccgccucggccucccaaaguucugggauuacaggcgugagccaccacgcccggccaacacagguauuauuaaaaaggaugucugaauacacagaaaguuaguacuuaacagaguuuuguuaaguuucuaauuuuaaaaaucagagacagagauaagaauuuuaaaaacauauuucaugaaauugcuuauacauaucuuucauuagcuucuacaacacacagauguaaaaauucuaccuuaaauuuuucaggacaaagcuauguauaaaugcuauuaaaaccuauguuuuuacaccaauuuagugauuaauggaaaauauuuauaucaagagaauauuguugccgggcacgguggcucaugccuguaaucucaguacuuugggaggccgaggcaggcggaucacgaggucaggaguucgagaccagucuggccaacauagugaaacccggucucuacuaaaaauacaaaaaauuagcuggguguggugugugccuguaaucucagcuacuggggaggcugagauagcagaauugcacgaaccugggaggcaggggcugcagugagccaagaucgcgccacugcacucaagcccaggugacagugugagaccucaucucaaaagaaaauaaaagagaauauuguuuaaccucaaugagacauuucuggcuagguaugguggcucgcgccuguaaucccagcacuuugggaggcugaggcaggcagaucacuuaaggucaggaguucgagaccauccugggcaacauggagaaacccugucucuaguaaaaauaaaaaauuagccaaacaugauggcacaugccuguagucccugcaacucaggaggcugaggcaggagaaucgcuugaauccaggaggcagaggcugcaaugagcugagaucacaccacuacacuucagccugggcgacagagugagacuuugucucaaaaaaaaaaaaaaaaaaaaaagagacauuucuagucuauaaauauauuaguauguuuuuaauugaaacuggcaucuauuaguagcagaauagauaauuucauaaaaugucacauggaaaacaaagaaaccuagaugcauauccugggguuccaucucuaacuugaaacaaaaccuggucuuucaagucuuucuuuucuucuauuaaaaaaaguauaaaaauaauaauaaaaaauaaauugccuaaaccauuauauaucaaagacacauauuuauauaccaaauauuuguauauuuccacucuucccucauaaaaauauuuacucccuccuccccacucuuaauucucuuaauuuuaaucugcaaguuuauugguuuaaacuuaauuaaaccaauuaaauccuuaauuuucucccacucuuaaaugucuuaaaaguggucuugcccugccucuuuuccauaccuacuucuccuaaagcaauauauugugcucuuuuccauaccuacuccuucaaaagcaauaaaagagcagucauggcagcaacauacccagcaagucgucuggagagaugcugccagccagcaaacgucucccaucucgagaaaaccacucauaugaauauguacucaaacacagugccacacauuagagacaacauagacacaauaaacauucucuccuuugucuuuuaacucugaggguaacccucagucuccuuucuaccuaaugcaauggaaaaauagccucaugcucgacacauugagcucuguuaggucaguggcacaagacucacaccugucaggugguaaaacagguguuauaaagucuaguccaugcagugccugcacugaagcaucaauaauucauagcagauugccugauuuuacuuuugagauacucuuuucccuaagccuaauuuuaauuauuuuaaauuuuuuucugccuuuucggacuuagaaaugaccucugaacauaauuguggucucuccagaaaccaaaauauuccaagagaacucaucugccaauuuacugggagaaagcugcacaacaaagaacaguauaaacugaauaaggcaacucuggcaguccaaucaacacaauaauggaaucuacuaaagaaguucuuaaucauuuuauuuuuccugcaugggcccugcuggugaagccuaugaacucuuucuaagaaaaguauuuuuaaaugcauaaaauacaugcacacaauacagaaaauuacaaaagaaaccaauuacacuggaauaugauuaucaaaauauaaaaaacacaaaccuugaguaauauauaugcuuuuuuaauacuuuaaguaacaguuaaguuauuucgagacagcuuuaauguauuccaaaaguaucuaccguuucuauuagaaacagucucugggcugguuaugguggcucaugccuguaaucucaacacuuugggagaccaaggcaggaagauggcuuggggccgggaguucaaaaccagucugggcaaucuacaaaaaauaaaaaaauuagcuguguguagugaugugcaccuguagucccagcuauucuaaagggucacuugaacccaggagugauggugccacugcacuccagccugggcaacagagugagaucccaucucuauaaaaaauaaaaauuaaauuaaaaaauagacgacacagucucugguacuguacugcuaaugcuaauguugucuauacucauaacaagaaaauguaaaaauaaagauguaacuuuuuccccauucaaggucauagguccccggguuuaaaaccuuuaauauacaaagaacuaugcuuauuaugcuguuagcucaguguuaauaaauuuuauggcaauaauaaugcacuuuuaccuaaauaaugacaugucaucccgucaucccaaagugaagcaaagaggacaagaauuuuuagcuccauuuugcaaguaaagaaauaaggccaaaagcaagaaggguagugaauacagggagcaucuguagaaugcucacucuccacucugccuacacuuccuaucuucacaauaacugcccucccccuuccugcccaagacagguguuacaaucucucauucuucuaaaaaagaaauuaagauucagauaaaugacuugcucaaugucagggggcuacuuaacaagacauaaguccuuuaaaauccuagucuugggcucuuuugauuaucuuauucuacuuuucucagauaccauuuuagacaaguucauucgaaacaauuacuagggcuuuucaagaaguaggcuauuaaagcucucuauuguuagcaggucaagagacuaccucuaaagauguuuuaagugcacauuaauaacugguaugaucaucucuguaaauggauuuccuguaagggugagaggcaguuuuaaauaagauauuaagucuugcucauguagaaaugauuucugguuuaaugauauuuucaaggaaaugaaauauucaacguuugaguaauauacauguuacugaaaaugcaaagcaaauuucuaaaauuuauaaagcugaacugcaauauuaacaccaaaguuuuacacugaguuuaggaucucuucuaagaguuuuguaaauuuaaaaaggaaaaucauaccuguauuguuccuaaggugagcagaaaacaaaauaauacacuaucauuugcaauuauuaaauacuaaaagguaagaaagcuaaauccaguucaacuuccucauuucacucuuaagaaaacauuaaacauucacauaaaaauguuuagaaaugggaaaacagguucaugcaagucacuuauauaacaggaaagaagcaaacacaaaauaauucucacaaauaauucuacccuuaaugugcuuugaaacaucagauauuauagcuuauuuucaaaacagaacaaagucaguauguuucuuaaaugucuuuauaauuagacaauauucucuaacacagucaacgaggcuauauggcaguucuauugcuauaaaaaaauuaagcuucuaauuuucuagauauuaacucccuuuuuugaaaaacugauacaaugccugguucacaguugggccucaaaaugucuguugauuuuguuggugaauuaaucuuacacauaauacuaguuuuaauuuuucuguugauuagugucaagggcaauaguuuccucucuuuuuuuauguuguaaaaugaccaaacuaauaagcaucacuaagaagagagaaccaacaugaacauggggaacaaaaaaagcuccuuacagcugggcgugguggcucacaccugcaaucccagcacugugggaggcccaggugagcggaucaccugagguugggaguucgagaccagccugaccaacauggagaaacccccaucucuaccaaaaauaaaaaauuagccgagcgugguggcgcaugccuguaaucccagcuacuugagaagcugaggcaggagaaucacuugaaccugggaggccgagguuguggugagccaagaucgcgccauugcacuccagccucggcaacaagagcaaaacucuaucucaaaaaaaaaaaaaaaaaaaaaaacuuuuuacaacuaggccucccaaauucaagccuuaaccaucucuauccaaaacuguuuuaauaauuucaauuaaguugacaaucaaauuaaaggccagauaauuugacacacuuaaugauaacuguaauuaccaugcugcuuguugauuagauauuagcaguaagcuuucuggugauauauacuaacuuugcugaauagccaaacuaaguuuuuauaguuuuucuaagucuagaaccuauaaacagcuuaaguaucaggaguccucacaauggcuaagaaaauuuaauccaagccaaagggaucuaaagucaauuaaccacagcugagauuuucuauguucccauucucccuuucacucagaguccuuauguugacugggggcgguggcucacaccagaaaucucggcacuuugggaagccaaggcgggugaaucacuugaggucaggaguucaagaccagccuagccaacacggcgaaacuccgucucuacuaaaaauauaaaaauuagucccgucucuacuaaaaauauaaaaauuagucagacguggugaccuguuugguggugugcaucuguagucccaacuacucgggacgcugaggcaggugaauugcaugaauccaggaggcagaggcugcaaugagcugagaucaugccacugcacuccagccugggugacaaagugagacugucucaaaaaaaaaaaaaaaaaaaaaaaaaacaaggguccuuacguugcauuaaugcauccacauuauuccauguacucaccaggauuuuuuguuauaaacaaaaauacccacucugguuaacuuauuaaaagauuaucagucaauuuacaaaaacaacaggaagauuuaacaaagaaaaaaaaacagaggaagcaagaaacauccagaacucacagcacagaauacugugcuuaaaaugcugcugcaaggaguauuaauuaacuuauacacacuacugugacacuuaacaggccaggugugguggcucacgccuguaaucccagcacuuugggaggcugaggcgggaggaucacuugaacccaggacagccugggcaacauggugagaccccgugucuacaaaaaauaaaaaagccgggagugguggcaagcuccuauaguuccagcuacuugggagacugagguggagggaucacuucagccugggaggucaaggucacagugagcuauaaucaagccaccgcacucuggccugggcaacagagacagucucaaaaagaaaaaaaaaaaagcacuuaacacacuuuaugaauacaauauggcacaucuaucugcccauuagagugagaacuccugaguauuuuacucaucuuuccauucucaaaugcaaagaguauguggcauauaauaacuguccaaauguacgacugacaucuuaaagcaguggucggcaaacuuuuuccguaaagggccagguaaguaaacauuauaagcuuuguaagccacacagucucuguugaaaccauucuacuguuguagcaggaaagcagccauagauaauauguaaacaagucagcuacgauguguucaaauaaaacuuuauaaaaacaggcaguaggcuggguuuagcccauggaccacaauuugccaaguauuuuaacaagaaucaacacuuuuccuuucauaauuuaacugaaguugguaccuacaaagauaugagcucacuacauaugacuaucuguaauggaucaauuuuggauaugacuuuggguggggguaaaaaaaggaccgaagacauguaauauagaugaauaaugaaaauaacagggcugggugcaguugccugcacuuuaggaggcugaggcaggaggaucacuugaggccagaaguuugagacuagccugggcaacauagugaaacuguaucucuaaaaaaaauuaaaaucagccaagcaugguggugugcacauguagucuuagcuacuccagaggcugaggugggaggacugccugagccccggaguucaaagcccuggaguucguggcauggagcuaugaucaugccacuguacuccagcagcagagaggugacagugacagagagaaggagggagacagggaaaaagggagggacggagggaggaaggaaaaagaaaaaagaaguaucuauugggaacagaguuggaagaaagggcaauuccauuacccuugccaguugacugguuagguauagaaugugccccaauccuggccaaugaggcucgaaagacaucugcuuggggguuucuggaaacaguuccucuuauuccuuuggauacugcccugucuggaugggaugcagcagccaaacugggacaaggggcuaacugcaggcuugaccucccaggcucaagugauaccccaaccucagcauucugaguagcugggacuacagguccacaccaccgcuccuggcuccuuugcagcagccaaauugagauggguaagggcugucuuaguaugaaguuaauagggaaaaucacagggaagagaguuggaaagagaaggaguccuugaugucauuauugaaccauucuugagccucuggacuuuuaguaugcaagacauuaaauuuuggccaggcaugguggcucacaccuguaauccucccagcacuucaggaggccgaggcagaaaguccaaggcaggaagucugaggcaggaugaucauuugagaccagccugggcaacauagggauaccccguaucuacaaaaaggcuuuuuaaaaaauuaguuguuggccaggcacagugguucacaccuguaaucccagcacacugggaggccaaggcgggcagaucacuugaggucaggaguuugagaccagccuggccaacaugguaacacccugucucuacuaaaaauacaaaaauuagccgggccugguggcaugugccuuaaaucccagcuacuagggaagcugaggcaggagaaucgcuugaacccuggaggcagaggcuguagugagcugagaucaugccacugcauuccagccugggcaacagagcgagacccugucuuggaaaaaaaaaaaaaaaauuagcuaggcaugguggcacacgccuguguuggcagcuacuagggagacugaugugggaggaacuuaaaggaucacuugagcccaggaggucaaggcugcagugagcuguaauagugccacugcacuccagcuugggugacagaggaagacucuguuuucaaaaaaaaaugaagaaaaaaaugacauuaaauuuccucauuguuuaaaccaguuggagaauuuucugcuauuugaugccaaugcaucuuaaaggaucuaagggcucaaaacugaagagcgcucacuucacaaauuuaccugcagucaguccuaguugacuuaaacuuuucacaaauaaauuaaaaaaaaaaaacauuuaagguccugaaagccauagagauuaucuacaacucagaagaaaacaguccauuaucucaauuacuaauagcuuuauaaauucuauaaucuuagagaaaauaaacaaugaaguaccuguuucuucaauacuguaucuaaaauauccuuucaacaggauguuuuuucuaaggaguuggcaaacuuuuuuuguaaagagcaagauguggcuauuucccacaccaaauuauaaaccuccuuuuuuaaaagacaccauuucucauugucaacuauaugccauaugcuagaaaacaaaaaguaaacuucaucuucaaucauuaaucaagaaaaucuguacacaaacaaauuugcacauacacacacuugagaauuagcguagggaauucuauugugugcuuuuauucaaaugaugaaaacaugagaaauaugauuuacucaauguuuaacacaaguuaauaagcauccuuucaaugucuguuacaauauaacccuauuuuaacaagacuuuaaaaucacaaauaagggauauaaaguauauguuuaucccugcauaccuacuggcauuuucuauaaacaaggaauugccgacagcagcuaccuauggaaaacaggacugggaaaggggcugggguguuccagggaguaaggaggacuuugaccuuuuccuugacauuuuucugaguuuuuaaacuuugccauaaaauauaucacuuuuauaguuuuuuuuaaauggcuuaagcuauacauucaauauaaagauauacaccaggaacuuaaaguaggaaaggcaggauuucucuaaaauaggcuagaaauugaggaacucucuggggccagauuggacaccucuaucaucaaagcaguacgcacacccuggcugcagcaaucaaggaaguuaccagaacagucuucagcuggaucaguaaugccaugagacuuaaaauaaucuuuuaaggguagaguccauagcaacccaauccagcuccacugaaucuuguaccccagggguaguaucaguuaaguaccaccugccagcucguggucugcaggaagguuccugccacccaacagugacuugcuugacuuccccgaugcacagaaguaacacgaaauuauauuuaucuacaccuuacauauaaacuccagcagcauauagcucaguuuucacaaccuuaauaaaacagauuuuuuuagacuuuggccuacaggaaauauugguuaaaauuugaccccguuuuuaaacauuaguagcauaaauuaaaaugcauuaaauuaaaaauggaugaaaaaacaagacucucaccaucauuuaccauuucagacuauuauaucagaucacacauaguagguuaaaagauugagaacugaaagcaaaauaaaaauauauaaagacuuucacuucaacagccugccaaagauaaaaaaugaauaauaaaauccaauucuggccgggcgcagcggcucaugccuguaaucccagcacuuugggaggccgaggcgggcagaacgccggagguccaggaguuccagaccagccuggccaacauggcaaaaccccgucucuacuaaaaaugcaaaaauuagccgggcaugguggcgcacgccuguagucccagcuacucggguggcugagguacaagaaucacuugaacccaggaggcggaggugcagugagccaagaucaugccacugcauaucacccugggagacagagcgagaugggcuaacuggauuaaaauaagcaucgguuucauuaaaaaggacuaacuugaagauaaaucuuuugacucuagcucuuuagaggaucuaaagugaccuugauggacaguggaagaaaucacaacauggaauuccuugaguaaaaauuuaucgacuuaaaaaaaaaauccaauucugcuuuugggaacagugaaccaauaaacaaaagacaacgcguuccccaucccggagacuaaugagacucagcaagggagggaaacaacagcaaagucugucauuucuuaccaacaaaaggaaaguaaucaauuugacuuucaguuaauuaaucacaauuucaaaaaaaaaaacaaaaggacagacucaacguauuuucccuacacccaaauuaauuacaucuauucuacagcuacuucugagacucuccuacauacucuuccauguguggggauacaggagugaacaaaacauuguaugugauuccuaaggucaagaacucaacguuuuuucaaugccacaaucaaauucugucucauuuaaauaaaacuguaaagaaugccaaugucuauucauuccuugcuaauaauauaccaacuguuuauuaaauuccaucauauauaaaaaagcgauuaagcaaagaaagucacugcaaucgucuuuacagcauacgauuaacuucaaaaggaguguuuuacauguugcuguauuugaaggaaaguauuauuaaucucuggaagauaaagcacacuggggaaagcaaagaaauucugaaaauaaaaaacugcaauccugaauauuagucuccuuucucaaauccagugaugcuguuuuggcaaauggaucaagccauuauuuauccagcaacaugaacgggguaauuguuccuucuuagcuccaucagucauauaaaagaguauuuaguguucuaaaaaaaaaaaaaaaaaaagaaguaugcuccuuaaacaauagauuacaaugucuaugucaaaguacucguuuaucaaauaaacccuuauuaucuuagacuuuuauauuuacauccugccagucuuagugccacaagaaugccaucgaguuccucagcaacgugucuuccaccaaaaucucaaauguauuuuaaaauauauuuuuaugaaguugacuuuuaacacauuuccaaccuaguaacuacucuuuaaggaaaaaaaaaaaccaccaaauauugggaaugucugaagaaacaugacaucugucuaggaagugauguagucuguuuaaacugaaaaaaaaaaaaaaacaaaaaugcacugcccccuuucaaaguuaguccgggaauugaguuuagaauccuuuaaaggaaaagagggauaucauguacugaacuugucugguggggucugagacacuaaaacugagcggccucaagggcccgagaaaguuacagggcuccgagagcugcaacagcagcagguagagcugcggccgggaaccgcggcccuggccuggcgggugcgagcggcgggagcgacuggcgccccaaagccugucaugcaacauccccuuugccacuggggcggaacgcacgcucucuaguaauuuaacaccccuccuuucaaacuggaggccggggaacaaguucuaauaaauguaaaaucgaauucuaccuacgcugaauaucuggauuuucaaacaacccuugggaccaugccagcccgggcccggggcccaguccaggcagcgggagcccaccguccccagggcgcuggggguccgacaccggcgcugaaggcagacuccgcgccccgaggaaaggagaaucccgcggcggcgaaggucgacuuuggcccggccaggcacguucgggccgcggcucagccacgacucgggcagggccucgcggccccuaccagccccgggaggagccuggccggccgggccguuaccacaguggcgccucggccagcugggcgcgagcggaggcgcgccaagcccuggcggcggcgccacggccgggcagcacgggccccgcaacuucgcgccgccaccuuagcgucuccggaggaaccgggagcggggagugggggaagggagggcgccgcgccuuacccggagagcgggcggcuucugcccgccggcguguggcuggggcgcugcgcggcggcgcggcugcgacagggagggagaagcgguggugcgagcgcuggcccgcgggagacgagaggcgccgccgccaccgcagacagcuccgcaauauggccgcucggcgccuccgcgggaaaaggcggggcugcccggcgcccccccgccucccccugccggccggccguccucgcgccgcggacugagcgccaacgccgccgcugggggccgcccccgccccgccccucccgcaggcucgcagccgcaggccuggcuccgggcguggccgggggucgcggucuggggccggccaacgcgagguggguggcugcgggcucgggagcgcccagggaaauagggcgaaugcgccggagggucgagcccuuccagagagcgcugggcuccagcuaaaccugcggucgagggaagcggagccgcccagcccaaagcucggagugugcccgccgccuccccaacgaguggaaacuugaaacucccgcuggugccagcaaacucacugagggcguugccgucgcccccagaggaggaauucuucccagagggagccggggaccaaaugaagcgugagacuuggcuguuagguuugaagauccuggacugggaaggagaaaagggccuaccugagcggaauuuagauuugcaacaaagaacguuuacauuauuuuggcagguuuuagccaacuagaaaaacuuaauuuuucagcgacaauuuucaaacuucaccaaaaccucaauggauaagaccccaaaucaggagugcaaauuuuaauccaagcaaggaugugugauaauuuuuuauuaccaacgacaugcuuuggcaguuggaaggaguugguuagcaagaaaaaguuggaaguagggccccaaagagccgccaaaccuacauaauucuagauuuagagaaaguuaggcauucgaucuuaagacuaagucuagcccacucacuuuaguuaguggcugggaugagacaggaagcuccugacuucuggaucagucuucugucaucuaauccaugcugaguccccucaguauugucugcugggaugauucagggagcaaaacuugcuaugaguauacaaacagcaagcgcacaaaaucagauucgccuggcuugcccuguuugcaauacuuuuuuuagcuuaucuuuugugaacaaacuuuagauucaaauaacaaaacgccugaguauacuuacuuuuauaggacaaauaacuccuauacuuccugccuuagcauuuaccuuaggugagacaguagcuuuuccaggaaauaucugcaaaucacuuucacuagccugccucuucagugaguuuccacuauugcccuuug

SEQ ID NO: 15994 - RNA, 26425 nt, Homo sapiens
uuacagaaauaccagggcuauaagugguuacaaccucuuucuuaaaaaacaaaagguaucuuuuucaacuuuuuauuuagaaaauuuauuuuauuuaaaagguauauauauacauaagucccaagauauaaaguucuaaacauagauuuaaaaagagcaaaauggaaaaaauauaaauauuugcuguuccuguuuauaucuuuugugcauuuauugucuuuucuaagguuggcauuuuucuuuauuuugcaauuugauccauacuuacaguaaaaaaaaaucuaaauauuauagaaagguauaaagcaaaaaguaagaauucccuucacuccaucuucuccucagauauuggugaaucuccucccaaacuuucaaccacauagaugcauuuuuguuuucaaaccagaaagccauuaacacuaacucuuuaaaggcugcggcugaauuggcgagaugaagaauuauguagauuaaggcugcugucucccuauagaauuuuuugagggauuccaccuuuuuuuaaagcacauccuuccuguuccacacacugaaucugccugguuugucucaacuugcuuuuaacuauuaggccuguuuggcagaggcaauauaaauuuuuaaaaauguaagauguuuaaaaugccauuagccuuuagcaccuggaauuugaggcagaaagguaugaguuaggcaaccuuucuugccauaaucccaguuuugacaagccucaaacacaauguacaauauuuaagacacaaauucauuagguaugggcucaggacagcuugcucuuauuuaauacuugcgugcuugugguuuugcacaauggauggguauuagaguuugccuuggauacuuggcauugauuagacuguucugaaauuugguuaugcuuagucaaaaaauucuguuuauuguucuucagcaagaauagauguaaccacuuuaaaaauaguuacauuguuuuccagauuaaguaaauauuucaguuaggagaauacauauuuuuauuuuuauuuucaguuuuugagauggagucucacucugucacccaggcuggagugcagugguguaaucucagcucacugcaaccucugccucccagguucaagugauucuccugccucagccucccgaguagcugggauuacaggcaaaugccaccaugccuggcuaauuuuuguauuuuuaguagagacgggguuucaccauguuggccaggcuggucucaaacuccugaccucaaaagauccgcccaucucggccugccaaagugcugggauuacaggcgugagccacugcaaccggccagaguacauauuuuaaaauuuggaaugaggauagcucuuguuuuagaacaugcacuuuagugaacugaaccuuggacugaugguuacaaggaguauguaaugagcuuucaggcuaugaguccuaaauccugacccuguccuaaaagagaaaggaaauuuccaaagucuucaucguagcaacgacacccacugaaauagaaaagugguggagugaggaauggaugcuugccuuuguucuuggccuauuauuagugaaucccaagauagcaggcuuccugaagauuguuguagagguuuucaguguuuucaaggauccccuuuucagcuuaaaaauaaugaaugccuuucaccugacuacaguuaucuuucaccuauucaauauagagauaaugaaugaugccuauagcauaccuucaucuauguuaauaacuguauugucuuugauggguauacaacucagauagauuuggaauuacuaacuuaagguacaauuucuccuuaauguugucucgggcuuuggcaaaauuuaguuuaaaggauaugaguagugcuuuaaaaaauauucccuccacagucuccaugccaccuuuaauaacagagucauucucuucuuccuuaaauauccuuaucagaccuucuaaaaggaagcuguuauuaaugaaagccaaaagcagcuuguaagaggagaaauuaugcagugacggggggcggggggacaacccugaacaaauauuuucucuucauaauuggaaguggaagagaaaaagugaacaggggauagaaauaaaccaauaaaauauguaaaccaauaaauauguaaacaguuuugcagaggcugauuuauauuuuagcaagucucucuaucggcuaugauccccaaguuuucuuuuuagagaaacuaugaugcugauaauagcaguuuuuacgcaaaagauauuaauauucaaugauauuugguaaugcuuguucaaauacagguugaacauuccucauacaaaaaucuaaaaucugaaauaccccaaaauccaaaacuuuuugagugcugacaccaccacuugggucgcuaagauagugacaccuuugcuuucugacaguucaauguauacaaacuuuguuucaugcacaaauuauuaaaaauauuauauaaaauuaccuucaggguaugugaacaagguauauauaaaauauaaaugaauuuuguguuuagacuuggaucucauccccaagauaccucauuauguacaugcaaauauucccaaaucuuaaaaaaucugaagccugaaacacuccugguccuaagcauuucagaugagggauacucaaccaguacugcuauauccaucuacauauauaaagccaccgggagaacuaguccacuuggugcagucuucuauacuguccuucacagcuuagauucaaucuuuccuuaaaguguagccgggauacacaggagugugauucugggcugacucaaaguucuucucuugaaggcuuuuuccuguggcacuggcagauggcugugcuaucuucuggcugaggaacaaguuccauuccaucacguacuucggguuugcuggacuggcgcucggcauauuucugaaacguggguuuaaagggaacugaaagguuaguucacacugcauucuguugacucccccacccacucccauccgcagucacgccaucuuuucuaguugcugugugucugcagacuaaaaccaaaggucugguuuauuccaguccuaaaguuacauuuuaacuuuagcuaucacaggcacuaguuauaauucauaaucuagcaagaaaccccaauccacaauuuuauguguugguuggaagccucuacaaaagggaugccaagccagacgucccuaccugaaacaaacagcagcucucagcauuuauuuuccacuuguuauugaauaauuaacuuuguugaauacucaagccagcaaacaaacaagauaaccaucugaaaaguuggcagucucacacauucuuucuuuuaggccuauagucacacgcauuuuugaauggcaacaggucuguguaauguuccuccacuguggcccugagugaaauauuucuauaaauggaguuuuuuuuguuuuuguuuuuuuuuuuuuuugagacacggucuuacucugucacugaggcuggagugcaguggcgugaucuuggcucacugcagccuccaacauccuaggcucaagugauccuuacaccucagucuccuaaguagcugggacuacaggcgcguaccaccaugcccagcuaauuuuuuucauuuuuuguagagauggcguuucaccauguugcacagccuggucuucaacuccuggacucaagcaaucugccuaccucagccucccaaagugcugggacuacaggcaugagccacccugcccagacauaaauuggauauuucaauucaaugauuccaugucccuuuugcuguauauuccugguacuggaccaaaugcaacaaaauguugacacaguagauaagccuaauuaauauuuuagagagagaaauuccuaacauuaaaauugaaacuauuugggaggcugaggcuggagaaucacuugaggaaccagggaaacacggcaagagcuuguuucuaaaaaaaauaaauaaauuagcugaguguggugguguagucccagcuacuagugggaggcugaggugggaggggggaagaaucgcuugauccuaggagguugaggcugcaguaagcugugaucaugccacugcacuccagccuaggugaccgaguaagaaauauauauauuuuuagaugcauuuugcucuuguugcccaggcuggagugcaguggugcaaucuaggcucacugcaaccucugccucccagguucaagcgauucuccugccucagccuccugaguaguugagauuacaggcaugugccaccacaccuggcuaauuuuguauuuuuaguagagacgggguuugaccaugauggccaggcuggucuugaacuccugaccucaggugauccacccuccucgaccucccaaagugcugggauuacaggugugagccacugcacccggccaagaaauuguuaaaaaaacuguuuaacgauuaaagcuagaccaacagaggggacagaccaauuuaagggaaggaagggcugcuucuaguaaauaguguaacuuaucauuuuuauuuuucuaugaaaaugaaaauaugagaggguaguauccacaagcaucuagggaaauuuacuuuuacuaugccuacagaaaaauaaauuuagguuaaaaacaagaacauaauuuccuuuuuuuauucuuccugucuagauuuuucugaguaaaacucaagguaguuacucaaaagaccaauccucggauucccaauaaacacuauacuucaggauucagcccuaagguguuagaacuguuauacauauuucucauuaguuuguuugcuacagcaagcuaaauauuugcauucugccuuguacuauaaaaggcaugaaucuuaaguaucaaggagaauaaggaggcgacauuuugaguaaaaagggauguuaaugaucuccaguccaaccaucuuguuuuccaaauaagaaaaaauguuuuucucugagguuccagaacaccuacacuaggaauucaauaaagcauuuaauaaaagagagcacugagaagaugggaggaguugcuaaucuauauuugugagggcucccagcgucguuuuacauaauauggaauaaagaugaaaauauggaggccacggcugggcgugguggcucacaccuguaucccagcacuucaggaggccaaggcaaggcagaucaccugaggccaggaguucaagaccagccuggccaacauggcgaaacuccguuucuacuaaaaauacaaaaauuagcugggcaugguggcguguaccuguaaucccagcuacuugggagucugaggcagaauugcuugaaccuggaaggcagaggcugcagugagcugagauugagacacugcacuccagccugcaugacagagugagacuucaucucaaaacaaacaaacaaacaaaaaacaaaaaaaagggggccaccaaaugaagacuuagcacuaucuuucccuaggcaagugccuuggcuuagccagugguccauaggcuugacugugaguccuucaggaagccaggcaggaaguguacaggccaagcggguagucugaggacacccgacccagcaguguggacggacacucugaacugaccugcaguacuugguaauaguagcaguaaagccuguguggcuguaguaggucccuagccaucaacuguccuucuuuugcaaucuucuuggcuucuucaucauuuuccugaaagguuaaaaaaaauaaaaaugaaugaaaauuacuacugcgacccacaaagagaggguuaagugugaggugggacagaugugggguugaaagugaacagcaugggaaagccagaacauaauggaauuauaacuuaagaaugaggcuacaggggccggacaugguggcucacaccuguaaucccaguacuuugggggcccaaagcuagaagaucacuuaaggucaagaguucgagaucagucuggccaacauggugaaaccccaucucuacuaaaaauacaaaaauuagcugggugugguggcggguaccuguaaucccagcuacucaggaggcugaggcacgaaauuccuugaacccgggaggcagagguugcagugaguggagaucgugccacugcauuccagccugggcgacagagugaaacucugucucaaaaauaaauaaauaaauaaauaaauaaacuaauaaauaaauaaaugaaagaaugaggcuacaggaagagacagaguauuuuccuagacaucuccguuaaagagaaacgaucacauguuuggccccucuuccacaguacuaggaagccacuccuucuccccacagugcaacaacccacaugcagccccuauugugaccaucuugguaccuuccuggccacccaggaaguacucuucagcuuccgcaucugucccaccagccuauuuccucucugcauaacaggagaaugaauccguuuucacguuacaacaucuuuuaaaagcuccaugcaaauacgcagucaacgucaaaaaguuguguuauaaaaugguagcuauaaaagacuguauugcuuuuguaaccgaaaaauucagucauuaguacccacaggcuguucauucaguaccagaaauagucagcguuccuaauuauacuuuuggaaaacaguuaaucuucuacaaugcugcccgcagguaagccauuugcaagcaacugaggcucuuaugaagggucacaaaagugauucugccucaggcgcccaauuauuucuauaaccauauauuguuucuuagaaucuuaguauaaagucucauaauggaaggguacauuuuuauagcuuuauaauaaaacgcaacagcuuuuuaauacuuuuccuuuuaaaaaaggaauuccuauuuuauaggaaacgugaugcuugcguuguauaacacgcauucauuaagaauuugugccuuuuuucuaacuggggauaagaaaagaguacuguaauugccugaaauauuuucuuguucauaaagcaccuuaacucuggucuuucagucaguaauuugcauuuuguauauucuuguuuguauguguaaacauagcauuuagaaaaucuguauuuuauauaaggcuggacuucaaaucuucugaaaaucuucaaaaauguugauagaggguaugcaaaaugauucugaugcugauucuuuagauauuucaagggaacagcaauuucagaaaauaauauuucuuuucauuccauuaugucaaaucaaauuguauugugauggaacucaucuaacacugaugaauuuguuauugcuuaaagaaauaaaaauugcuggacgcauaccuuagcccauuuaacuuucucuaauaaaucacucagauuucuuuuaauuggaacauaaugcuuccaagguucuagugccauguagaaauguucauaauauggcgaguccugcuuuaaaaccagacugucgcccagcaugagauauggauaucuguaagcagccacggucccauccacauuuacuugauacuuguacuggaagaugaaaaacaaacauaaacaaacuuucaguagucauuugcuucacuucugcuccucaucaacacuguaauaccaacuacagaggaauuauuuuccauuuuccaacuuuuuuguguuuaaaaguuuuauuuuauaacuuacaucuucucuuuguauaaaaaucacaagcagcauuucucagauuaauuuuaagaaauacauuguuuaaagguaaggugcuaaauuuuuggaaauaggagugaagaccuauuucaaucaugucucuguaauaauggaauccagauuucuguaacaagguaggaaaacuauuuucuuuuuaaguuuuaauuaauuauuauuauuauuuuuuugagacaguguauugcucugucacccaggcuggaguguagcggcgugaucuuggcucacugcaaccuccaccuccuggguucauacaauucuggugccucagccuccugaguagcugggauuacaggcacccaccacugcagccagcuaacuuuuuccuauuuuuaguagagacaggguuuccccauguuggccaggcuggccucaaacuccugaccucaggugauucgcccgccucagccucccaaagugcugggauuacaggcgugaaccacuacgcccagccaggaaaacuauuuucaaaauucuuaaagcucaauacugauaacaaugaacacuuucauuuauucauuauuucauuuguuccuuauacgcagucuaugaaacaggcaggcauugucucuauuuuacaguuuuagagcugaggagauagaaaccuggagacauuuaaggacuugggcaaugcuggcaacauaguagguaagcugucugcauauuuguuggguuaauauacuuuguuuuccauuucaaauguaguuuucauaggcauuaaaccucauucaauuagaauaaucugaagcagguauuauuaaccccuucuuuuuguuuuuacaaaugagaaaacugguauucagagaaauguauaaaccucauucucugaguccaaauccccuguucuacucauuguaucacucugggaugaagaggacacacucccagauuugguaaauaaauuuuucuuaaauaauugguacaagggaguuuuugagcccaucagguuuugucacauuguucacaucucuccucugggccucgugauaaugcucugaaggaguaggcaggcaucacacggguuuaaagaccaaggcaccaagacaggaaggucccauaguugguggcagaggcaggauuagaagcaggccuugaacccuaaucccaacucccacuuuacauauauggaauuuaugcuuuuucuauuuauaaaagacauuugagaucacuuuauguaaaagguauuuauauucccaguuuaugaaagcaaauacaaaaaaaaaaaagaaagaaaaacgagacauaaauauaccaaaaucccagguuaauccuuguacuauauuuugagaauuaaguacaguucugagcuauuugguaaacuuaacaaugaaagaaggaaaccacaauggguuuuguaauuccugauaucuaauaagaaagugugaacaugugugucaguucacaagccaggugaaauuugcugaagcccaccuauuuugguagacuuuuaauacaauuuuaucgcuucauauccauagaagaagacucaaaugcauaccuuaaagaaaucaaagaaacccaucaacuuggcuuuuccaagcuccuuuucuuucucuuggaaaaagaaauauccuguaauuccugcaucuaguagcugaggauuuucuuuggacagcuguaccaacuggagccucuccucucggcugucucuaccucugaagaaagcucucucuguuuuauugauccaggaaggcccuacaaguuugaagccauaaaaaaauuaggauuaugaauuugacauuuuaauauggcaagcauaauccucuuuaaucuaccauugucauuuaagaugcuaaagcucuuuuaucaacucaucuucuaaaguagauguuauuucaacgaaaauaugggauugagucucaauuugccagaagcacuuucaaguuuagaguuuaaaaaaaacagucuuuuuauuugcuguauuauguaaaagaaugcucuaauuucauccauuugucugcuagugaaagcucacgcaaguauucguguauucuguuguauaauacuaggaaauaccugaaauaaugucggaccguguucaaagcaaaaaagagauucagugacuggguccacucaccaaggcauuagcuucuuccauuuucuguguuucacaauaaaacgugagcuagcccuuuguucuuacaaagggugaccagaaaaaacuauauaacugaggaacauccacaaaucuuuaaucccuagguuggucagaauuuucaguacaagacuuuuucuaauaugcuacugaaugcaaacauauauguauaacccacucugucucuaagcuuuuucuucauuaauuagccuugcauuucccugaauaccuguauuucccugaauagagaggagaucauuuguaacaccccgcauggcuucaagcauggagugggugaugucauacguuggaaggacaacaucucuugaauccagagagccacaccaugaaaugauagguauggggcuagggguuccauugacuuuucgaugcuccaagggccaaucuccaagauuaacauaaaauucuaaaucugggagaaggaccuaaauaaacauauaaacaaacaucagugcugggaagaucucagucuuugguacuaaguacaacaguucuuugguuuucuuacauauuuuugacagggcuaaccauucaaaaacagagaagagagaagaaugccugucauugacaggauggcugugaauuugucaccugugaggauccugcaugacaaauucacuuaaccaggagucagcuaccucuguccagagaugcauguaaaauucaguguuugaggcugggcgugguggcucacaccuguaaucccagcacuuugggagguugaggcgaguggaucgucaggaguucaagaccagucuggccaacauggugaaacccugucucuacuaaacuuacaaaaauuagcugggcugguggcaggcacuuguaaucccagcuacucaggaggcugaggcaggagaaucgcuugaaccugggaggcagagguugcagugagccaagaucgcgccacugcacuccagccugggcgacagagcaagacucugucuccaaaaaaauagaaaaagaaauaaaauaaaauaaaauguaguguuagagaagugaaaauuguguagagagguaagaaugaauagcuucgauaacccucugccagcugccuaagcaagagaaucuacaaaguuagaaccaaacccuuguuuuccuucacuguccccaucuuugccucaugugcccuugccucuggaaccugccaguccauuuccaucuccacggucaaugucucaguuuagacucucaucauuucuugccuagauugcugcaauaacuuccuuacuagguguucugauucugggcucuccauacuguaaucugcucuccacaaggcugcucagauuuccaaaacuaaaauuaauucuaaaacuaaaauuucuaaaauaacuuuguuaaugucacuaccaagcuuaacagaaccuuaagccuauggcacaagaucucaacucucuggcuggcauucaaggccucacaaucuugucccagcuuggcuauaagccucaucuuucaucugcccaccuaccaggaaaccuuaggcuacucucugaaaaugccauccaccucaacauguaauuccauucacuuggaauguuuuacuuauuuaacuuggcagucuccuuucucauccuccaagcccagaucuaacaccaccucuucuaugacucacccuccucaggcacuuaaacccuagguacuuaauucucuugaggccuaucaucauauugggauauaauuauuuguuuguauucacaucccacccccacuuccaaacaacaaaaacaaaucccacuacagugggcuacucagagacuaggacugagucucacuuaucuuagauuuauuucuuccccagccacugggcaaagaacaaaaggaaagggcaagagaugugaauauucacccucuugcuucccugucauuauuauuauuauuauuauuuugagacaguguuucacucugccacccaggcuggagugcaguggcgugaucuuggcucaccacaaccucugccucucagguucaagugauucuugugccucagccucccaaguagcugagacuacaggcacgcaccaccacacccggcuaauuuuuguauuuuuaguagagaugggauuucaucuuguuggccaggcuggucucaaacuccugaccucaaaugauucaucugccucagccucccagagugcuaggaugacaggugugagccaccgugcccagccucccugcuauuauuuauaaacucuuuaauaaacuccacauuggaagugcucacuguggaguaggguuucucaagcucauauuauugacauuuggggcuggauaauucuuugcgaugggguuggggggugcuauccuuugcacuguaggaugcuuacccacuagaugauaauagcaaccccugaguugugacaaccaaaaaugucucuagacauuggcaaauguccucugaggggcaaaaucaucccugguugaaaucuacugcuaugaagccagcaacauggauuaaagaggcaagaauacagggcacaguugacuaguuguagcccgggaagagagcacuaccuuuaggagcagaugcccaucacaugcuuguauccucacauugugggcuggugguggagggguuggggacugcuauuuaaaguaagaacugacugcagccacacagucagcauacuuggggaauuguauaacauaucaggaaaacuguguuuuuuuugguuuauaaaacucccuuggccaggcgcaguggcucaugcugagcacuuugggaggccaaggcgggcagauuacgaggucaggaguuugagaccacccugaccaacauggugaaaccccuucucuacuaaaaaaacaaaaauuagccaggcauggcgugcaucuguaaucccagcuacucagaaggcugaggcaggagaaucgcuugaacccaggagacagagguugcagugagccgagaucgugccacugcacuccagccaggguggcagagugagacuccaucucaaagcaaacaaacaaacaaacaaacaaaaaaacucccuuuauggucucucuaaguaagaaagauaaauauugcccaccuccauccuucacccuguaugaucagaaacaagaacaaaaggugguuuaaguugcucugcuuaagaggaauuuagaguucugcaaauguggaaagagaggcugaauagugagauaagggggcgcuauugggggauguggggagccugaaaaacagagggccuaaccacauuagugagaggcuaagaacuuaaggucaaggacagcccugagaaauucccagaggcaaguaugacugagagucugauuagugcagagaugucuauuuuuaaauaucaggguuuuuguuuguuuguuuuuuaguaugcacuggugaaaaaaaaaacaaccuguuucugguagcccaagcuuugacaaaaugucccaugcacgcuaucuucuagguaugcuuaggguaaaacaaggaaaauguguucuaaguucaagucauuuugaggugaagagaagaaaacagcugcagaaggugaaaucuaagcaggaguaguauucagcggaacagagaacuuaaagcggccucuugacaugguugugcaugccuauagucccagcuaggaucaaggcugaggcaggaggauggcuugagcccaagaauuugagaccagccugcucaacacagcaagaccccaucccuauuuaaaaauaaauaaauaaaugagacuguucuguuuggauauuguaaauauagacuauuugaaaaaaagaauaagaaguaaccuuguuauaaaucucuggaagcucaaagaaagcuugggaguguccuguauggcauaccuaccugggaugggggcucagccacuuuauucuauuuuauuuauuuauuuauuuauuuauuuauuuauuuauuugagauggagucucacucugucacccagguuggagugcaguggcgcaaucuuggcccacugcagccuccaccuccuggguucaagggauucuccuaccucagccuccugaguagcugugauuacaggcgcccaccaccacgcccagcuaauuuuuguauuuuuaguagagaugggguuuugccauguuggccaggcuggccuugaacugcugaccucagaugauccacccgccucagccucccaaagugcugugauugcagguaugagccaccaugccuggccucaagccacuuaauuuuaaaucuuacaggaaaguaagauccacaaagauggagaacaugaugaacacucagguugcaaauaucuuagaugcccauuucucagccugaaaucuguuucauccuuugucauuauaauucuaaacauuuaaauguuauaccuaaauaauuaaacuguauuaucaauucauucauucuccuaccuuucuugucaaugauaacaaaaucucaucagagaacaucuugaagucuguguauuucccuaaagaucuccgguaaacaugguuauugagaaucguguaaugaacaauggcaccucucucauccccaaaccuuuuggggacuucuuuuagcauuugcuggagauugaugcugggaaaggaagcaaaaucuuuugcaaucugugguuccuugguuggacaagaaagagucuucugccaggccugaggaucuuccggacacucacaguacucaugguacacugguccuagggaaggaaaacaugaaaaaggccgcacuccauuagcaagcaccacaacacagggagucacuucugucucugcuucuuggugaauucuaagauuauccagagauaaucugcccuagacaaaucagugguguaagugauuauguuagaguccuacacuuuuacuuuccuuuucacaccaccuuggauaaacaguuuaguauaugcccucucccaaucuaaccuacucucggucacuuagcucauaaauucaucucuaauaagguauaaauggcuggcaaacaugaaacaacuuaccuuuuagcaaggagaaaaagaacguauuaauuuuuagacauuauguaaaccaaaaauaaaauucuaagccuccuagaccguccaaauggaucccuccuuuuggccaagggcauuccaaaguuaaucugaaaaacuaguucggccacgaagggaaaggggaaccaggcaugccucauuauacccuccucccuuuuggaauucaggccuagcugaccagcauuaacaucaacacaaacuuuguugaacugacucuuuaagucugauaagaaacauuugcaaucuccucugucgccugcuaccuggaagccucaucugcaugauaaaaucuugguuuccacaaacccuuaucauaagcccagacauuccuuucuauugauucuaagucuuuacacaauaacuuaauucuuucaaccaacugccaaucagaaaaccucugaaucuaccuaugaccuggaagcuacccccaaccccucccaaccacccccaccccuuccaguugucccuccuuuccaaaccaaaccaauguacaucuuaaauguauugauuaaugucuuaugucuuacuaaaauguauaaaaccaaguuguagccugaucaccuugagcacagguucucaggauguccugaggguugugucaugggccauuggucauugagucugagagaugggggaacaauaagguaagcccuacaauuccuacagcuuacugcuuaagggagcuucgaggcuguagugcagggagggaaacuguaggcaaaaacagguagucucacugaauugaauauuuggcucagaauaaagcucuucaaauauuuuagaguuggacucucuucuuuuuucuuucuuucuuuuauuuuuguuuuuugguggcagggggacagagucucacacuggcugagacucuggcagagucgcccaggcuggaguguaguggcgugaucucggcucacugcaaccuccuccucccaugcucaagugauucuccugccucagccucccgaguaacugggauuacaggugugcaccaccauguuuggcuaauuuuuguauuuuuaguagagacgggguuucaccauguuggccaggcuggucucaaacuucugaccucaggugauccaccugccucggccucccaaagugcugggauuacaggcgugagccaccaugccuggccauaaguuugacucuuuucauugacaacaaguaacagggacugauguaccaccccaccugaaacaaccagaaaacacucccacaaaacauaugaaacaauaguuuuuuguuguuuuuguuguuguuuuuuugagauggagucucacuguguugccuaggcuggagugcaguggugugaucucagcucacugcaaccuccgccuccuggguucaagugauucuccugccucagccuccugaauagcuaggauuacaggcacucaccaccacgcccaacuaauuuuuuguauuuuuaguagagacggaguuuugccauauuggccagguuggucucgaacuccugaccucaagugauccaccugcuucggucucccaaagugcugggauuacaggcgugagucaccgcaccuggccuuaaacaauaguuuuuaaggcacuagguauuaggcaaugaaggacagugagucugagagauggggaacaaauaagguaagcccuacaauuccuacagccuacugcuuaagggagcuuugagguuguaguacagggagggggacuguaggcaaagccaggcagccucacugaguugaggagacagagcuggcaguccagggagaccaaggcagcucuagacuuuguaggacagaguaucuaaaaaggaagcacugcacagagagaacguuagagaucuauagaagguccucuucacauauugagcagagcauaugaucagugcauuuuggauggguucuuccccuguauugauucuaaaaauaauacaguuuaauuauuuagguauaacauuuaaauauuuagaaugauaaugacaaaggaugaaaacagauuucaggcugagaaauggacaucuaagauauuugccaccugaguguucauauguucuuggggaagacaggggaagaacccauccaaaaugaccagagagaacaguacuuaucgguggguaccagccagauuggaaagccuccuaauucacagggcuuggguaaaguaugcagaaggguauuaccucaguagcggggaauaauuagcccuagacuacacauggcucuagucccaccuaacaaacuguaaaagcaaaacuuggaaggauuaaacuauuucccagugauuuaacugcaccccagaaaagagcucaagaagaugaaaaagcaucaagaggugaaaacuacacuguauaggauugacaacagaucguacauugcagaagaaaagagaacuuagagacaguaauagaaacuauacgaaaugaaacaaagagaaaaaagaauuuaaaaaaugaaaaggguaucgaugaaccacaggauaguuucaagcccaauauauggguaauuaguauccuugaagguaagguggaauggaacagaaaacauauuugaagcaauaauggccauaauuuuucuaaauuugaugaaauuuaaaucacuuggaugguuuaaauuccaagaaguuccacaaauccaaaacacaggaaacauuaaggaaacugcaccaaggcacauaauaaucaaacuucucaaaagaacugauaaagagaaaaccuuaaaagcaacacagaugaacaaagauaaggaaaaugcuagauuuauuguuagaagcaaugcaagugagaagacaguggaaccacaucuuuaaaguaucaaaagaaaaaaaacccaucaaccuauaacuauaacuagagacaaugucuuuuaaaaacaaaggcaaacuaggccgggcaugguggcucaugccuguaaucccagcacuuuggggagccgaggcagggggaucacuugagugcaggaguuugagauuagccuagguaacauaaaaagacccuguagaaacaaaaaaauguuuuguagaaacaaaaaaauauuuuuuaauuagcugggcauggugguaugugccugcaguccuagcuacuugagaggcugaggcgggagguuugcuuuaaacuagcaguuuuuguuucuguuuuauuucguuuugagacagggggucucacucugucccccaggccagagugcaguggcacgaucacagcuuaccgcagccucgaucucccugagcucaggugauccucuuaccucagcccccugaguagcugggacuacagguaugugccgccacacccagcuaauuuuuuguagagauggguuuuugccauguugcucagcguggucuugaauuccugggcucaagugauccucuggccuuggccucccaaagugcugggauuauaggugugagccacugcacauggccuagcccagcaguuuaagguugcagugagcuuuuuuuugagauggaaucucgcucugucacccaggcuggagugcagugaugugaucuuggcucacugcaaccuccaccucccggguucaagcgauucuccagccucagccucccgaguagcugggacuucaggcaugcgccgccaccaugccuggcuaauuuuuguauuuuuaguagagacgggguuucaccauguugcccaggcuggucuugaaugccuaagcucaagccauccacucgccucagccucccaaauuguugggauuacagaugugagccaccacgcccagccugcagugagcuuugacugugccacuguacuccagccugggccauagagcaagacccugucucaaaguaaacaaaaaacaaaucaaacaaacaaaaggcaaaauaaaguuuuuucagacauucaaaagcuggaagaauucaucaccagcauucucacaguaaaauaaauauuaauaaaaauccuuuaagcagaaggcaaauguuacuagauggaaauauggaucuacacaaaggaaugaagaguuucgcaaauaguaacuacauggauguaaauacacaagauuuuuuucuuaucauuuaaaucucuuuacuuaauuuucuuucccuuaaaauuuaaauugagcuccaggagguauguauacaauguuuacuuuacugcacaugacuuugaggucaucagguuuaggccauucugaaaggcaugggaccuacacacaaggcugacucuggaguauauaauaaucacuuaccuuucaaaauauagggagacugagccacauguucaucaccauaaaggaccucuaucuucaggccuucaucgacaguuucauacauccuauaucucaucaaaaauguuccaucauuccuguccaaagguuuagggacauguauccggaccaacucuuuaggugaaagagauuugacuacgacuuugaaugguguuucaccuaaaaggaaaagaaauauaaacaacucuaccaugucaugauaaugauuuacaauuauuggauagguguuauuggauaacuuaaauauguugcuuuuuccugcagcauuggugguuaaaaaaaaaucauuuccuuuggaagaucuuugaggccaggaacugucaugucugguucaugcauucuuuuuuuuuuuuuuuucuuuuuugagacagggucuugcucugucauccagcuaggagugcagaggcagaauccuagcucauuacagcuccaaccuccugggcucaugaaccuccugccucaaccugcaucagccccaugaguagcugggacuauaggagugugccaccaugcccagcuaauuuuugaaauuuuuuguagagaugguggggggcgggauggguuggagggggucuugcuguguugcccaggcugaucucaaacuccugacuucaagcgauccccacugccucagccucccaaaguguugggauuacaggcuugagccacagagcuuggucugguucauguauucaaaccacggaucagacucaacauuugaaucauuagucauucaauaaagauuuacugcaugaacaaaagcaaaucauuuuuuaaaagcaaauaaaaaauaaacuuuuugcuuauuuggucuuuccuccuuuggguaggauuaaagcccaaauaguuaaaaauccauggacucuaagcaugacagaucucucuaguaaucgaacuuccuccuuauaaaacacacacaagcuuucuuuguauaccauuucaguaucuaauaaccuucauuucugugaaaauuuccccguuuauuaagcccaaauuucaagugguacuucuaaggccauuuccuuacguagagagagauuacagcuaguuaccagacucuuguacaagcucacacacacacacacacacacaaacacacacauacacaucuuuguaaauacuagagauuacuucugagucuguuuccucagcuugaaaugaaacaguuacacuguaauaauccauuccaccuucaaaguuuugugggguuucuguucuacguaaauaauaacuauucaacaaacuuucccuuuccuauuagcugacauuuaggcuuugaaaugauacuguugugauuaguguuacuguggccaggaauaaacuuugaaacuucuuccuucagagagugcagaggauauaccauuuagaucaccauaucaaaggaaaaugcuaaaaaaguaaugaauccuuggaaauccacaguccuagcaaaaggaaaauugugaccaaaguuguuuuucacuucgcauauuauaaaauuuagaauauuuaaaauauaucuuuugaaauuacuaaacacguuugugaaauucuuaguuucuaaaucgagugaguguaauaucuacuuucuuuugaucuuuaaggguuuuuuuucuugugagucugcagaaauguuucucagucucuucaauuuaguaauaacaaugugguaucugacaucuugcuauuaaauauuaauaaucgaguaccaaacauauacauuuuaggauccuugaaacaaguaugauaaaauuacgaaauaaaucugcuaaccuaaaugaaguauaauaaacauggaagaugcuauaaagugguaauaauuuaauaggaaauuauuagaaauguuggccaguuaccugaacugcacaaaugaaacacauaaauuauugcuuugcauuauuucccacaugguuucagaaaggcaacauggcacagcagaucgaaaucugaagaggaaagucugggaauuggaaagccauuuucauugcucccuccccaaacuggaaauguacaaaaagguuuucuuauuuccugaucaaacagucuuauucuccauauauuauuauuuuaaauaaacaaaacaguuauaagacaagaauauuauugacuaugugacuuuugggaaagacagaaaaaaacaacuagcuucaaaaugcgucaauuauuuguaaauugaaaguaucagacuaaagaauuauggucgcuuccaguuguaauauuuuuugucgcugaaauaucauuuaaaaguuacauuucaaaauguauguauacaacuauaauauagccauuggaaauauauauuuuaaauguucaguuauuuuuuacaguaaucugucaugccugugucauuguugacaugaaauuaauguuagaaucaaugcaagauaauauggaucaggacugaaacagaaauaagaauucuaaccucauaaaagagaaaaugagaagagugaaauuucaaauuccuucaaauggaaggcaugaaaauucucauuagcucuggguacuaauauagugggauagaauugaggcucaacggcaggcgugguggcucacgccuguaauccgagcacuuugguaggccaaggcagguggaucacaaggucaggauuuugagaccagccugaccaacauggugaaaccccuucucuacuaaaaauacaaaaauuagccgggcaugaugaugcgcaccuguaaucccagcuacucaggaggcugaggcaggagacucacuugaacccaggaggcggagguugcagugagccgagaucgcgccacugcacucaagccugggcaacaaagcuagacucugucucaaaaaaaaaaaaaaaaaaaaagaauugaggcucagcuugaguuuucuacucaauaaauucaaacuuaagaaaaauagcuaacuggaugagaaugcagugacuauguagacaaaaggagguuggcagcaucaaaguguuacaucauuagaaucagaaaucuugaacacguuugauuugguaagaaaucaaaagcauauuuagaaauucacuuagcacuuuuuaugggcuugagacuuucauauguauuuucuaugucauuuauuuccuacaagaaauuugagguagguaucugucacucccauuuuauagaucaagaaaccaaugcuccaagaaauaaaguaacuugcccaaggucacauacauaaugagcagcagagccaauauuugaauguagcuuugcagcagucacaguuggaggaauacuucuggcacuucggauacaauggagucaucuccuccucuguuguuuaggaagcucauuaaggcccucuacagcugcagcaaaaguguugaccccacacggucaagggaaacaaaaucccagaaggcuaagguguuguaccaugaggcuaaauggaaauccuccaaaaauaucuggcuagcugccaacgacgaacacccuccaagaucuuauuguaaacugacguacgacaaucauauuaaggaugauuugauaaaacagaaagagcaaugaaguagaaguucaaagggcuguuccugccuuggcucugacacauucacuguggagcccacugggcaaggcauuuuagcuucacugagcccaguuucuuauguguaaagacaguaauaucuauccuuccuaccuuacaagacuauuuuggaggacaaauuaagcaagccauaguauaaaacacuaaaguacuacacagccaggagguaagauuauuuuaugaagauauuauuacugaugaagguagaagacugaguagaaaauaaguauuuauauccuuccaucuugacauauuucaaucaucccucccuccaccccuuauuucuuuucaucuacaauaguuacucagcaucucuagcaagcauugugcuagagacugggaauauaauaguaucaacagguacugccuacauucauaauugaaggaaauguucaauuuaagcaggaguuuacugaaaauaaagauacaguucuuccccccacccaaggacaaagacccuauaauuucuguuugugaaccccaguuugagauguccugcuuuagaucacugaaguucacaauauuuuuguuaucuggguacuuggauauauguagcauaauaguggcauucagggaaauucuacacugucgaaugggagugauaauaagggaaacuuucuaaguuguguacaacaggcuacagcuugagaagauuuuuccucuuuuccaauuaguucuuuugugugugugcaguggcacaaucucagcucaaugcaacugcagccucccaggcucaagagauccucccaccucagccuccccaguagcugggaccacagcugugcacuaccacgccuggcugauauuuuggauuuuuuugguagauggguuuugccauguugcccagacuggucucaaacuucugaguucaggcagucuaccagccuuggccucccaaagugcugagauuacaaggcaugaauaaccagcuauucaguugguucuugaagagggaaagacuucaggacuuggaagugaauguugguggcagaaauguaagaaacuaguugggugaguuuucagaacuauacggcaccuuuuuaacuggaagccagaaaucaagaggccugaaaggaaacaaagggaauccaaaggaaugaaaguaagguuguccaaaaaguuccauuuuauuuauuuauuuagagaaagggucuugcuauguugcccgggcuggagugcaguggcacaaucauaaugcacugcaaccuugagcuccugggcucaacugauccuucugccucagccucccaaguagguaauuuuuaaaauuuuuauuuuaaguagagauggaaucuugcuauguugcccaggcugagaagucuuucuaagacuaaaaaagguaaaaaaagaaaagucacagaucacagggguaaaccaugcagaaucauaaauguaacuuuccuucuguuaagauauuuaauagaaacugucuguaaacuuuuucguuuguuuaaauauauuuauguauauauaauauauguacauauaaaacauauacacaacuuuaagucauguaucauuuggauuuuaacugagagucuuuaacauacauuagagauugacaaacuagcuaauccagcucagugccuguuuuuguaaauccuguaagcuaacaaugauucuuauauuuuuaaaauggggaugggcaugguggauuaugccuguaaucccagcauuuggggagacugaggcaagaggaucccuugaggccaggaauuugaggcugcaguagcuaugacuguaccacugcacugcauccugggugacaaagaccuugucucuuaaaaaaaaaaaaggaggagggggguuggagaaaaaucaaaauaauaauauucugugacuuauggaaaacuauaugaaauugaaauuucaguggccauaaaaaguuuuauuguaacauaaacggguuuguuauauguccauggcuacaaagcacagcugaauaaaugugagagaugauaucaccuacaaagccuaaauuauuuacuaucuggcccuuuaaagaaaaaguuugugaaacccugauauacacacaugcguuucugucaauagagucggaauuauuuuaccuaaaugcauaucaugcauaugaaaccaguugucugaguauuuagggucuaacugguagacacguuaucaaagcaaugcccaaagacaacuucaggagugguguucugaaucaaauguagaaaacaagccacugagguaguuaagggagaggcagauucuugccucagcucaaauuucuccaguggcucucuuuuaucuaguuauaaagucauuugcuuggcauucaaggcgcuugaagaccagaggcuacaaucaaccaggcuuuuccgcucaguaucauuaaauuacaguacuuauuuucccgaacaccacggucuccuacgccucugugcuucugcacaugccauggcguccuucuauaugccugcccagcaaaccuucucauccuucaagucucugcuccugaaaucuuccuggauuucuccagucucuggcagugcuucaauguugccacugcacucuguacauaccuucaauuaucuuguacagugaucaguuauuugcaugucuuugaccaacagacuguaaguuccuugauggucaggcauugucuuuucauccuuagauucccagcagaauuaccaaacacagaaguagacaucaaagaaguauuucuugaaugaaugaaauuuuaaaaaucauuaaaucuaaaagugaauuauguuugguuccuaaauucucugcuuugcccagcugucaagacccccuuaccccuuucccaaguugggacacacuucuggcagcuauguucccagcuggacuagcaggggcagaggcacugguuuauucuaauugucucuucgcugauacaacaaggugcuaguuggccagagccccaaauuauacauuagcaaauccugacugacaacagcgugaaaccagcaggacaaguuuuaagaaguugcaaagguuaagacgugaaggacaacgugggaggaggaccgggcagaaagggauucaggacgagauccaucucacccuccguggagggaaaaccgaaugauuucuacugaguuucccuaguuccuguaaucugcuuucaaaaacucagaacuaaaaaggaaacaaaaaacuaacacguaaaccccuccuccuuccuacggcucugacauuuccucugcguaggauuucguugcuccaaacccaccaggccuaagccauguaauccgacgcgauccgucggcuugaugacucaccacuggaaagcgcucccugcaaucccucacaguucagacaacuaaguccgagauggaaggcaacgugugacucacggcacacuccuuguaacgcccgggcgccguccauucgcaacaucagucccugcacauuaaaugcggaagggcccuucaaguucauucauucauucauuccacaaacuuucguggugauuuuugcccgcuuugaguaugggcgggaggagggaagaggagcugaccagacccaaaaaggggcgacacacgccggggagggacgccacgcaggccgcgggcggacucccgggcggcggggacgcgcggggacccggccgcgggacgagggaggccggcggcuggacacuaccugcgggagagcgagugagguucuggcccuccgaguugaccgccugcagguagaaauagcggaccggcaggacgacggccgccugcagcccgggcccccacaccaggcuccgcggcgcgcugaccagcaccuccggggcccccgcggccaccagcagggcgaggcgcagcugcagcagcagggcccgcgggaggcggcgcauggucggcggggcacaacugcgguccagcuccgcggcggcgaggaggggccggcagcgccgcggaccgggcggggacuggggcccaccgcggggcgggucuuucgg

SEQ ID NO: 15995 - RNA, 146346 nt, Homo sapiens
caugggcauaccgugcucugcggcugcuuggcguugcuucuuccuccagaagugggcgcugggcagucacgcaggguuugaaccggaagcgggaguagguagcugcguggcuaacggagaaaagaagccguggccgcgggaggaggcgagaggagucgggaucugcgcugcagccaccgccgcgguugauacuacuuugaccuuccgagugcagugguaggggcgcggaggcaacgcagcggcuucugcgcugggaaauucagucgugugcgacccagucuguccucuccccagaccgccaaucucaugcaccccuccagaguggcccuugacuccucccucuccucacuccaucuuuccuggccucucuccgggugcuuagcggacuuggccaauaaccuccuccuuuuaaacgcccugaauugaacccugccuccugcgcauccucuuuuugugucaccuuaggguucagauuuaacuacgcgacuugacuagucaucuuuugaucucucucucguauuuaguacuuuuagucagcgagcauuuauugauauuucaacuucagccucgcgguuaagagcuugggcucuggaaucauacggcuggaauuggaauucugucagucguguggccgcucucuacugucuugugaagauaagugagauaaucuugaccuguggugagcacucgugagcguuagcugcuguauuuaccagguacagauaagacaacuacaguggaugauaauguauguggugauaggggaguacucugaugguagaggagugacuuugguucucugcaaacucagccugagacuaucaauucaguuuguggugagaccucgcaguguuaccuuggcagaugguagaagccuuccagauggaaggaaaaaugcguguaaaggcacaaaguguagaaggacccugaagcuccagcgugaggccuggcauugaaugaaauauauuuuguggguuuucagcugcugaagucauaggaauggaugagaccaagaaaacaaagcuguuuuugagguaugagcggaagaagagauaucaggagacuuucgaaacagucauaacggaaguuaauaugaucauugcuaacauuugcuguguuucaggcacuguaagcauguauauggguccuuaaagggacucauagagguagguacuaguauuguuuuuccuuuuaucauugagaaacugagguuugaagagauuagugaacuugcucuagauuauacaguuuguaaguggcugaaccaggauuugaacuaauacaaucugacuacagaggccacacuccuuagcacuagaaaagaauggcaugccaagggcagaguuauuucuaggaagaugggauauaagcgucauugucaaguugugcaaaggggucaacuugguugagaucuaaaaaggaacacugaauucgucaauucagaggcucguaggaaguaggaaauccuuaucuuuucguuugaaccuugaguggaaccuagauauucuggauuaauguauaaaugaaguucaucuuuauauggugacacucauacucuaguugacuaccuaauaguuccucugccuucuuucaguuccgccaacauacuguguucuuuaacauuguagaacccuuuggcuaugcuagucuccuucccugaaguguugguccucuagcccuuuuuuugauuggcaccaguuaguucagaucuuggcuuuauuauaaacuccucugagauauauguucccugacaguuuaucuaaaaugauucucucuacaguuauuuucuauuacuguguuuuuguuuccucagaggcauacaucacaauuuggaauuaugcauugguuuaucaauuuacuuguuuauugucacccugcugcccagauaugacuucaugaggguaggauuuguaucuguuuaguucauuauuugucuagcuauaaguaguaaauauuguuugcaucuaucagugaaugagcaucuucuguuuauguagauaauacugaacuguuuuguuuucuucaaaguaaucauuaagcugaagguaagaaaaacaaguucaaggaagucacaccauggggaaaaaaaagucaaguuuagggcugccucuuccgggaagugucaaaucuuuaguauauuuaggaauaaaggugccaaaccuuaugguucuuuggauauugcuaagguauuuucauugguuagauuaccaguuucauuuuccuuauugacucaagagggcuuuaaacugagauugaagaaguaagaagauuccuagauaaaaccauaaggaauggaaaaacaaaaaugauaauacuuguccacaggaaguauauaaucaaaugaaaagaacucaaauaacaaucuguaaucuauagcagaguaaagcggaaguuguaauaguguugggggaugggggaagucagaagaaccaccagugaauauaaaaggagaagagaaucagagccaucugcuaauaaaauggguagucagcucuuuuuguuuuuuuugucuuguuuuguuuugagacagucucgcucugucgcccaugcuggagugcaauugcgugaucucagcuaacugcacuuuccgccuccuggguucaagugagucuccuaccucagucuccccaguagcuaggauugcaggcacaugcuaccacaccugguuaauuuuuguauuuuuaguagagacgggguuucacgauguuggccaggcuggcuggucucgaacuccugaccucguggaacgcccaccucggccucccagagugcugggauuacaggcaugagccaccacgccuagccccgguagucagcucuuacugagaauauucaaagacagggcauucauuuuguaagagacauuccuuccuucauaggaagauuggaccuggucuuuuaguuccucccaauuuugagauucugugagauugaaucggggcagagaaacauacuuaaucuugaaagauuaaguagaauuuagauggauggauaggagaaggacuuucccuaccuuuuuacuucuugagauauaguuauuuguagguauaauauacauaaauauauguauuuuuucucuguuuacagacauucauaguuuaauaaaaaacuucuuuguauuauauaaagguuuagaucagaacuaguaaaacagaaugcuguuucuuuuuuuuucuuuucuauuuuacuuuagguucuguggguagaugugcggguuuguuacauggguaaauugcauguugcugaggcuugguguacgaaugauccugucacucagguagugagcauaguaccugauagguagcccuucaagccauaccucccuuucuuuccaacccucaaacaguccccagucucuguucuucccaucuuuguguccauguugaaaugcuguucuuacuacauuuuuuugaaggacaucaaaagagaguuugauuauaucagaagcccccaaaagaagagagcuacucaguggaaucaaggcauaguaaaauauaguugauccuugauauuugcaaaggauaccaccauagcauagaauuugcuucauuuccuuuuaaaacagaaaugucauuuuacuccuauuguuauguguuaaauaagaaccuuaauaccaguugagauggaagugguagacaaagcuuacuagcucugauaaccuccuacuuaucagcuccaaagcauguuuuaagccuuuggcucagcaaaaugacaugucucuccauauaagcaagagugcuuuuuuuuuuuucuuugagacggagucuugcucugucaccaggcuggagugcaguggcgcgaucuccgcucacugcaaccucugccuccuggguucaagcgauucuccuaccucagccuccugaguagcugggacuacaagagcacacuaccacgccuggccaagagugcuuuuaaauaguucauugucaauguuaaauccuugagugcucauuuccuuauuuaccuggcuguuuucuauucaucuuucaugucucaauuuaaaugucauguuucuuuggucucagaguaauaaaaaguaaauauacuucccccaucucccgccccgcagagccuuccucuguugcccaggcuggaguacaguggcucgaucuuggcucacugaaagcucugccucccagauucaagcgauucuccugccucagccuccugaguagcugggauuacaggcgcgcgccaccaagcccggcuaauuuuuguauuuuuaguagagacaggguuucaccauguuggucaggcuggucgaacuccugaccuugugauccucccaccuuggccucccaaagugcugggauuacaggcgugagccacugcguccaguguaaauuauacuuuuauuuuaauccugcuacuacugcaagcaaggcaaacauuuuuguguuacagcauuacuuguauagauuuuaagaaaaucucauuuuaaauacggaaauguuaagaaaaauuauugugccuuugaccagaaugugccucuaauuguacaguuaaaucuaacuauaaauacugcaguauaaaauaauuauauacacauuuuuucacaccucuuucucucuauauaugcauauauacauauacauauauauaccuauauguauuuuuuuuacagacagugauguguguucugaaauugugaaccaugagucuaguacuuaaugaucugcuuaucugcugccgucaacuagaacaugauagagcuacagaacgaaagguaguaaauuacuuaaauucaauuuuuccuugaaauaagugugauuaguaacccauuauuauuuccuuuuuauuuucagaaagaaguugagaaauuuaagcgccugauucgagauccugaaacaauuaaacaucuagaucggcauucagauuccaaacaaggaaaauauuugaauugggaugcuguuuuuagguauucuauucaaauuuauuuuacugucuuuauuuuucucuuucauauuuauuucuguugugauauuacuuuuguguguaagucuuaacauuuaucuuugcuuccuauauaucauuaugccuugcauaugaauuuggcauuuaauauuuauccaaaacauaauuuuuaaagguuguucauauagaaacuuaaaaauuauaaauuauuucuucaauaaaauguuuuagacauaucucacucaaaauugagagagaauuucuuucauuuuaguuaguucacaagacuucagauuagaggaaaaaauuauaauaaauguuaggauauuauuuucacaccuuuaaauauuacucugauuauaaguaaaugcuguguguuaaauuguaauaaaacaaguaaaaggaagauuggaauacuuguguaugaauuugguuaaaaacaaaaaauaccucgaacaaugaaaaaacacaacugauugcuggacaggaguggcaaacaggguugaugcauuuuuacauugagacaucauuuucaaccgugaaauccauuuauaacuagaaacagauuguaaggauuaggaaagaugaauaaaguauuuuaaauacugagaguauuaaauaaacuagaaauaacauuuguagucaagaggaaguguguauuuaguuguccuucaguguuuaugacagauucuguuuuauuuuuagcuccuguuugguauuagauugacuguuacagauuugaaagcauauaaaaugaaacaugcaugcuguuuuuccucugauuuucuaguuuauuuuaaauaccacaaauauaauuacaaccugaagaugaauacuauuuuguauaagcugaucugguaggucaaauaugcacccagcauuccuggcuaguuaugaauaucuucuaggcaggcuuaauuuauuggcuggcaacauuaccaacugccuaagaaacagguagauccuguacagaauaacagaaggaguugagagaggauugagaggguccuuacuagcauuguaagcuuuuaaugacaaauuuagaaaacaggcaguaaagcaauagaaagucauagaagauuaagagcuuugcagaccagauauuaaauuggucuuguaggaguuaggccuugaaagagagauuuaauuguuuuauuuguuuuuuucagcugauguaguaaucuaagcaaggugguuuaaaaguugcucuuugugauggcaugaacagcuuuugaaauuauuauaauuuaaguauucaacgaguuucugaaauugcauuuuguuuucuugaagauuuuuacagaaauauauucagaaagaaacagaaugucugagaauagcaaaaccaaauguaucagccucaacacaagccuccaggcagaaaaagaugcaggaaaucaguaguuuggucaaauacuucaucaaaugugcaaacagaaguaagugauguuauaaauuauaaauaaauggcuuaacagauuacugucgcgugaguuuuuuuuuuuuuucagaucauuuuaaggacuuaacuguugcauaaguuuguucuaaauagaauaagauaaaaguugaguguaaguacauauaaugauuuuuauuuuuauuaaaagguuuuuuuuuagggcuagucaagugaagcagugggaguuuagaaggaacaaagaaaucuguaacugguugugaucaauucguuguaaacaccacugcacucaggccagccugauuuuuaauauuacaaguucaaauauuuggggaaauuuaugcaagcauagaaugacagaaaucugaggauugaagggauuuauuuauuuaagagauagggugucacucugucacccaggcuggagugcaauggugugaugauagcucacugcaggcugaagcuucucuguuccuaagugauccuccugucuuggcuuccuaguagcuaggacuacagaagugcaucaccaugccaggcugauuuuuuuuuuuuuuuuuaagagguguuauuucacuguucugcccaggcugaucuugaacuccuggccucaagcaguccucccccugcucagccucccuaguuauugguauuacagaugugagccaccaugcccagugaaggaauuaaaaauuacuguuuaaacuacccagucuuggaugcccucucuacgucccuagccuuuagguagaagugcagucuucaugauugaauauacuuucaaggcuuucuuuuccaucuuugaauagcauuaacaguauuaaaaacuggccaggcgcaguggcucauuccuguaaucccagcacuuugggaggccaaggcaggcagaucaccugaggucaggagaucgagaccagccugaccaacauggcaaaaccccgucucuacuaaaaauacaaaaauuaauugggcauuguggcgcacgcuuguaauuccagcuacuugggaggcugaggcacuagaauugcuugaacccaggaggcagagguuguggugagcugagauuacgccacuacacuccauccugggcgacagagcgagacugucaaaaaaagaaaaguauuaaaaaccugucuuuuguuacugcuucucccuucugagaguauaucaaaaacuccuauuuauguuuuuagugugacauccuuagagauguuugaaaguagccacaauauuuccuaaguccucaucucuaaaguucauaaucucacuuucuucagcucacgugaccuagguuuuaugcuacucuccucugaauauucuucacuuuaauugucugucuuaaagugugggccucuacuuacagggaagaggccagaaaaacaaacaaaaaagugugggacucauuuuuuuuaauacaggcucuugcucuguagcccaggcuggagugcaugcaguggugcaaucuuggcucacugcagccuccgccucccaggcucaggugauccuccugccucagccucccaaguagcugggacuauaggcaugggccaccaugucuggcuaauuuuuguauuuuuaauagagacaggguuucacuguguuggccaggcuagucucaaacuccugaccucaagugauuuucccgccuuggccuccugaaaugcugggauuacaagcgugagccacugcaccuggccaggacucaaucuuuuagguauauucugauuaguacagagugaagcaauucuugcuuaucuuucauucuguacucuuacugauuaauucuaagaucaugugagcuuccuuggcugucagaaccaacacuuaacugacauuuuacuugcuaugauuugaggaaaaaaacaacccccaaaaauauuuuuuucuccugaugagccaaauaguucccaucuuuaacuuguacaauuaauauugugaagaguugauuuuucggaaccaaaaugcaggauccuggcaagcuuuuguaaggaaaugggcuuuacacauacugaaaagcuagaggcagaaguguguguucagggacuccugggcucuucacagauaaggauguugcuuugugauaccaacucuuaauuuaagaaucaggagugugaggcgcgguugcucacaccuguaaucccagcacuuugggaagcugaggcgggcagaucaccugaggucaggaguucgagaccagccuggccaauauagcgaaaccccaucucuacuaaaaguacaaaaaauagcugggugugguggcgggugccuguaaucccagcuucucgagaagcugaggcaggagaauugcuugaaccuggaagguggagguugcagugagcugagauugugccauugcacuccagccugggcaacaagagugaaacucugucucaaaaaaaaaaaaaaaaaaaaaaagaaucaggaaagcccccaaauugguaaauauuuaguagaaguaugcagauuauuagugaauauuucagauuggugguaugagacuugaguccaaagaauaaugguuuagucaauuuucuaccuccucugagaugcgaguucguguggauagcuucaaccccuugucagagacuccagcagagacaaaggaaaacuacaccaaaauauucugcacucacuuuugcucuguguaguagcuuuguauccaguaaaauauuuuauuugcuaauaaugcugggauauaguagguacuuacugaaagagugaaugagagaaagauaacaugucaauuuuguagcccaccagaaaaguuugcaauguguacaguaguuuugccuugcagugaacaaaccuuuuaauugcaacauuaacaauggagauuacguuugaaaaugcaucagccuguugguuuauaagaaauaguuggugaaauuaucaaugcuggucauguaaguaguugaaaauuuguuuuuuuauuuacggcuuccuuuucuuucaaauuugacuuuguuacuuaaaccuuuuuaauauuggggcaaaaccagggaguuacuauucccucaccccacuucaguuguuuuuguuuguuuguuuguuuguuuuuuacgaaaagauuggaggguugauggaaauuuaacauaugucuaaacuuugccauucuugcuuagcauugguauccaagguaugaugaaagaaauagagauuaguaaaaaagaaguaaaaggcagcugagaagaaacaaguaagcaaauauuguugauuucucuccuuuuuuuuuuuuuuuuuuuuuuuuuuuuuugagacagagucuugcuuuguugccuaagcuggagugcaguggugcagucuuggcucacugcagccucuucuuccugggcgcaagcgauucucacgugucagccucuagaguagcugggacuauaggcacacgccgccaggcccgguuaauuuuuguauuuuuaguagagacgaggguuuugccauguuggccaggcuggucucaaacuccuggccucaagugaucugccugccucugccuuccaauaugcugggauuauaggugugagccaccacacucacacacccagccuacuguucauuucuuuucuuuuuuuuuuuuugagacagaguuuugcucuuguugcucaggcuagagugcaauggcgccaucuuggcucacugcaaccuccgccucccgggcucaagcgauucucccgccucagcuucccaaguaacugggauuacaggcaugccccaccaugcccagcuaauuuuguauuuuuaguagagacgggguuucaccacauuggucaggcuugucucgaacuccugaccucaagugauccaccugccuugucaucccaaacugcuggguuuauaggcgugagccacugugcccacccuguucauuucuuuauguuagcauuugucugcuuuuguacaaagcuuaaauagagucuagauagugcaaaacucagcugcgaaaaauguuaaguuccauaagauuccugaaagucucuguaaguaggcugggcacaguggcucaugccucucuaauccuaguacuuugugaggccaaggcaggcagauugcuugagcacaggauuuugagaccagccuggguaacauggugagaccucaucucuacaaaaacacaaaaauuagccaggugugguggugaccaccuguagucccagcuacuuaggaggcuuagggaggaagauugcuugagcccagggggcagugguugcagugagccacgaucaugcuauugcacuccagucugggugacagagugagauccuguguccaaaaaaaaaaaaaaaaaaaaagucucugcaggcaacuuaguuguacuuuuaagaaagauuugaucccagaaguuugagaccaaccugggcaacauagggagaccccaucuuuaaaaaaacuaaaaaaauuagcugaguguaguggugcuugccuguaguccuagcuaccugggaggcugacauggguagaucccuuaaguccaggaggucaaggcugcagugagucauaauggggccacugcacuccagcuugggugacagagcgagauauucugucucaaaaacaagcaaaacuaugaaaaaaaagucaacauuucuugaaauacuucucauauuugguagaggagggagauauauugggauaaaggacauaggaagauaggauuuuauuauaauauuaauuucuguaguuauucaacacaaauuaauuuuuauugagcauuugcuauuagggcagucacugggcuuuuacgucagaauauagagauuaauuccuuuccuuaaggaucuaaucauacaauggauguuuuagauuagaaaaauguuacaaggacuauaagagaaaugcacaggguacuagaaaaaaggaucacaugguugugcauuucauaacuggacaaugccuaaaauuaugaagugagccauaagugaagaugauuuugcaguuauaucaguguauauuuguuuaccauagccugugaauauaacuaguuucaucauaggaaaacccuaauccagaauauauucauauuuacaugaguuguguucugcucauaguuauggcaauaaauauauucaauuuuaagauugucaguauggaaaaauggcauuucugcugugacguaaauauaauuuacugaaaaugauaauuaaauuauuuuuaaauguaauuuuguuaccuucaagaauauguguguagucaugccaaguuuucagaaucucuaguaaguaaauaacaugcuguuaaaaaugacacagguacaggggucaagcacaguggcucauaccuauagucucagcacuuugggaggccaagacaggagaaucccuugagcucaggaguucaagaccagccuggggaacauugugagagauucugucucuaugaaaaauuuaaaaaauuagcugggcaugguggcacaacaucuauagucccaguugcucaggaggcuaaggugggaggaucccuugagccugagagguugaggcugcuguugggugugaucaugccacugcacaccagccugggugauagagcgagacccugucuuaaaaaaaaaaauuacaaccugagguguuuguaugccauaaaugcuauuauaggacuuagaacuaauuuugcuuuccaagguaaauauucuccuuguaaucuuauguuauucuaauaaauucauucuucauaaagagugccaaaaaacuugggaucauuuuuggucuaacaccagaaauugugaauuauuaagguuauaauuguuuaagaaugauugcuuuucgagaugagcagaucacuugaggucaggaguucaagaccagccuggucaacauggugaaacccugucucuacuaaaaguagaaaaauuagcagggugugguggugcacgccucuagucucagcuacuuggaggcugaggugggagaauuacuugaacccaggagguggaggcugcagugugcugaguuugugccacugcacuccagccugggugacagaccaagauuccaucucaaaaaaaaaaaaaaaagaaugauuguuuuugcuauauauuccuauaaaagaggcguuggcaaacuuacuguguaaagaggccagauaguaaauguucuugacuuuauaggccauguggucaccucugucuuaauuacaaaagcagccauaaacaauaaguaaaugaaugguugugacuauguuccaauaaaauguuauuugcaaagaaaaaaaaaaugaauuuugcuuggggccauaauuugccaauuucuucucuacaaaagaaguuuaguuaauaguaauuucccaaauggaauuauuuaaauaguugccauuccaagugucuuauuuuuguucaaauuuauguuuuucuuuauuuguuuauuuugaaauaggagcaccuaggcuaaaaugucaagaacucuuaaauuauaucauggauacagugaaagauucaucuaauggugcuauuuacggagcugauuguagcaacauacuacucaaagacauucuuucugugagaaaauacuggugugaaauaucucagcaacagugguuagguauguuuugaagguuguuguuugugaauuuuuccucaugaaaugaaacuucaccaaagaaagcacucugucuguaucugucuauaucccccaagugaccugacaguuuaacaguacuuuaguaaaauuauaugguuaucgaacugacccuuaauuuuuauuuauuauguagcuuuugaauaaagucaugaauaauauaucaggugccugauaucagagccggaauuacaguugaaaaauaccaucuccaucgucaaggaguugacaguggcagaagaaaacccaaguaaaccagaguucauaaugugcugugauacagacauauuuggguucaguagguauacaaaacaaugacaccuaaacucaaccaugauuuaaguagaaagggagaaaaccaagagagggaaguaccauaaaagugaaagcaggcagggugcaguggcucacgccuguaauccuagcacuuugggaggccaaggccgguggauugcuugagcucaggaguucaagaccagccugggcaacauggugaaacucugucuuuaaaaaaauagcggagguaauggcucuugcuuguagucccaguuacuugggaggcugaggcaggaggaucaccugagcccuggagguuaaggcugcagugagcugugaucacacugcacuccggccuccaugacagagugagacccuguuuccauuuaaaaaaaaaaaaaaaagugaaagcaagagaguugaaaguucaaaggggcguggccaacauuuuaaguguuguagaaaggauaagacacaaaaguauccauuggaugaggcaguuagcacgcuacuucuaagguaauggaaaucaaauauauuagaauagaaugcauuagaagacaauguacagaacccagugauucauuagauguguagagugugugcuagggaggaaucugguguuguuuccuguuuauagcugggagguacugagagaccacaaaggaaggaaguuauggucagagauugaaauacuucaguuuguugguuucaaagauggagcauuucuggguuugagaauaagugaaaguaggauuugacauuaacaagaugauuuuaagucaggugucaaagucuucuaauacacgaacucuaaaaguuuagaagcuuuuuuuuuucauggaaaguauuuaagcuaaauuuugcuagcuaaauuaaaagacauuuguccauauucuuuauugccauuuuauuauuucaaaaugagauacaugugaaccacaaaacuacuaccuaaucaguacccucacuccugcauuacacucuacuguuccccugagaauaaaugccuucucagcuaauuucuuaggagucauuuguagccuuuacguuacucugaacacaagauaggcugugucuguaacagggcccucaacaagccuagagacagccuuugggaauaggcuggugauaucuagguuaccuaaccagaucuuuccccaguauggcuggucauauuuaggucauuuuacauuaucacuuacaaccauggcugucacugaaacaaaggcagucuuuccccuagucugcuuacuauauucugucaucuaguuuguucucugaaacccccuuuuuauuuuuaaacuaacuacucuuacuucuuuuuuuuucuuuuuucuuuuuauuuaagcuaaccuuugccacuucuucccggauguuacuucuuauaauuagcuuuuuugucaaaguauuuuuuuacuuagcuuccuuuuaaaacuugcuuagaugaggacucuguggaagaagcgaagucugugcucaaaauauauauuugguacagguggugacugaagccaugacuauggaugagauuuguauauagaguuuagugugagaugagaagaauggccuaagauugagucagcauuugcauauaaauuuuggaaucagcuuacugauuucuacaaaagaucuugcugggauuuugauacuaauugcauugaaucuguugcacaauuugagaagaauagaaaucuuaacaauguggaguuuuccaauccaugaacacuguauaucucuccauuuacuuagguuuuuuuuuuuuuuuuuuuuuuuuugcuucuuuguuuguuuuuuugagacagagucucccucuguugcccaggcuggagugcaguggcacgaucucaccucacugcaaccuccaccuccuagguucaagcgauucuccugccucagccuccugaguagcugggauuacaggcaugugccaccacacccagcuaauuuuuguauuuuuaguagagacaggguuuccucauguuggccaggcuggucucgaauuccugaccucaggugauccaccugccucagccucccaaagugcuggguuuauagacuugagccaccgcgucuggccacuugucuuuuuugauuucuuucauuaguguuuuauaauugucagcauauagauuuuuuguuguaaauugacaauuuuuuuucuuuaauuuuauauauuaaaaaaaauagagacaggaucucacuguguugccuaggcuggucucaaacuccugggcucaagugauacccuucccuugaccucccaaaguguugggauuauaggcaugagccaacaugcccagcugcaaauugacauuuauuuauaauuguauaaacauaaagauuuuguauauguuuuguuagauuuauacugcaguaguuuguaauugcauuguuuuuaacauuuugauuuucaaauuguucaaugcacaaaaauuauacagaaguccaguuaauuuuuguauagugaccuuguauuuugggaccuugcuaaaaucacuuacuaaaucuaguagcuuucuuugaauguucuuuuggauuuucuuuguagacaaacaugucuucuguaagcaguaauuuuuuuuucuuucuuucugagccauguggcuuuuauuuuauuuuugugcuuuauuacauuggcuaggaccuccagugugauuuauugugguaaaauauauauaacauuuauaauuuuaacuuuuuuaaguguacaguuguguaguauuaagugcauucauauuguuguguaaucaucuccaccauccaucuccagaacuuuuuuuucuauacucaguaaacaaugauuuaccauuuuccccuccccuauccccuggcagcuaccauucuacuuucucucucuaugaauuuggcuauuugggguacuucauuuuuauggauugaauguugugucccaccaauuauguugaaaucuaacucccaaagggaugguauuuggaggugugggauuuaggagguaauuagguccuguggguccagccuucauggaugggauuaaugcccuuaugaaaagaggccagagagcuaacuugcugucuuucugccaugugaagauacaguucaaagucaguagucugcagccccaaagagggcccucaccagaaacccacaaugcuggcaccugagcugcuuucagccuccaaaauugagagaaauaaauuucugugguuucuaagccaccuaaccuauaauacuuuguuauagcagccugaaguagaggacuccuauaaguauuuguccuuuugcaaccugcuuauuacacuuaccaaaaugucuuugaggcucaucaguguuacagcuuuugucagaauuucacccuuauuaaaaacugaacacuauucuguucuguguauaugccacauuuuguuaauucauucguccauugguggacauggguuguuucuaccuucugauuauugugaauaaugcugccgugaacaugaguauacaucuccugaguuuccugcuuucagucuuuugauuauauacccagaaguagaauugcuagaucaugugguaauucuauauuuaauuuuuuaaggaaccaacauccuguuuuacacaggagcuacgccauuuuacauucucaccagcagcccacaaggguuccaguuucucuacauucucacuagcacaacuaauagaaaaugaggauuccucuucuaggccuugaaagugcugcauaauuuugcuucuuccuaccugucuaacuuaacuaaagcgcuucuaauuucugugcucaagcuacacugucaauuauucaguuucucaaaccuagugguuuccauuuuuuuaaauugacuuuuaucuuuuagaggaauuuuaaauuuacagcaaaacggaguggaaaguccacuggacacacacagcaugcccuacugucaacaucuugcaccagugguacauuuguuaccaucaguaaaccuaugcugggacacaucauuauuauccagaguccaagguucacuuuuggugguacauaugcuauggauuuugacaaguguuuugacauuuuuaaagaucuuuuucuguaucuaaugagauggucauauuuuuuuuuccucugggagagaaugguaacaauuuuucacuauuacagaaucauacagaauacuuucacugucagaaaaauccucugugcuucaccuuuucaucucuuccuucuuguaaacugugggaaccauggaucuuuuugcuaucuccaugguuuagccuuuuccagcaugucauauacaguugugcgucucuuaacaauguggauauguucugagaaauacaucauuaggcaauuucuuuguugcgugaacgucauaggguguauuuauacaaacuuagaugguauaacacuacgcaccuaagcuauaugguauuacugcuccugcacuacaaaccugugcagcauguuacuauacugaauacuguaggcagcuguaacacaauggcaaguauuugugucucuaaacauauauaaacauagaggagguacaguaaaaguauaguauaaaggauaaaacaugguacaccugucuagggcacuuaaccaugaauggagcuugcaggacuggaaguugcucuggguauguaaaugugugguaauguaaaggccugggauacuauauacuacuguagaauuuguaaacucuuauucuguaccaaauuuaaaaauuuauguuuuucuuucuucaauacuaaaguaacauuagcuacuauaacuuuuuuacuuuauaaacuuuaaaaauguuuaaacuuuuugacucuuuuguaauaacacuuagcuuaaaauacaaaugcauuguacagcuguacaaaaauauuuuuuccuuauauacuuauagauguuuuuucuuuuguucuauaagcuuuuuaaaugaaauuauuauuacucuauuuuuuccuuuaaacuuuuuuguugaaaacaaagacacaaacacacacaugagcuuaggccuacauaaggucaggaucaucaguaucacugucuucugucccugcaucuugucccccugggagaucuucagggacaugcacagagcuuucaucuccuaugauaauggugcuuuauucugaaauaccuccuaaaggaccuaccugagacuguuuuacuguuuuguuuuguuuuguuuuuuaagaagaagaaggaggaauauaguauaaaauggugauaaaaagcauaguagaguaaguacauaaaccuaacauuuuaccaguaacuuagucauuuauuaucauuaucaagguuuauguacuauacaugauuguauguauuauacuuuuauaugacuggcagugcaguggguuuuuuuuacacaaguaucaccacaaaugcuugugaguaauuucuugugcuaugacaucacuaaguauuuaaauaggaauuuuucaguucugauacaaucuuacgguaccaccuuuucauauugccauuugucauugaauagaauguuguuauguaguaugugacugugguuggaaucauaacaguauguaucauuuucagauugccuucuuucauuuaguaauaugcauuuaagguuccuccaugucuuucucuuucuuucuuucugucuuucuuucuuucuuuuuuuuuuuuuuuuuuuuuuuuugagauagggccucacucugucacccaggcuggagugugguggugagaucauggcucugcagcuucgaccuccugagcucaaaugauccucccacccccuuccaaguagcugugaccacagacacaagccaucacacccugcuaauuuuucauuuuuaguagagauaaggucuuauuauguugcuuaugccagcagcuugaacucagccucccaaaguguugggauuacaggugugaaccaccguucucagcuccucgaugucuuuuuauggcuugauaggcugaagugggaggaucacuugagcccaggaguccaaaucuagccugggcaguguagugagacuuccgucucuuaaaaaaacaaaaaacaaaaaaaagaggaccaaaguuacugauauuagaaaugaaaugagaucuaauugcagauccuauagauauucaaaggauaauaaggaaacacuaugaacaucuauuaauuuaaaugggccaguuccucaaaaccauacauuaucaaaagucauccaauauaaaauagauaauuugacuagucccauaacuauuaggagaauaaauugaauccauaauuuaaagccuuucauaagacaaauugggaacaagauaaggaugugcacucucaccacuccuuuucaacauuauguuggagguucuagccaggguaguuagacaagaaaaauaaaaggcauacagauuggaaaggaagaaauaacacuccccuuuguagaugacaugauugucuauauauaaagucccaauauacacaaguauaacauugugaauaauguuauuuggggacugggcacaguggcuuacaccugucaucucagcacuuucggaggcugaggcagguggaucaucuaaggucagaugauggcuuccucuaaaacaggacagauuuacuuguagccuauugauuauaaaaagcuugagguuucucuguuauaacucaguccacuguuuucgcagugucaagugucccauuucaccuugccuuugguacuggggaacugaugcaaaaaugaagguagucuggcuaccaucauuacugggagaaauaaacuguccuuuuucucuuaucaggaaucucagguuuccugcuagcacccaggaaacugucaugcuaauuuguuagguuacaaguagauaaaaucucagccaggcacaguggcuuaugcguguaauccuagcacuuugggaggccaaagcagguggaucacuugagcccaggaguucaagaccagccugggcaacauggugaaauccugucucuaccuaaaauaccaaucaguugggugugguggugugggccucuagacccagcuacuugggaggcuaaggugggaggauuaccugagucugcugagauugaagcuacagugagccgugaucuuaccaccacacaccaguuugggugacagaguaagacucuaccucaaauaaauaagaaacaaaccaagcagaguaaaauuucauacccuucauaggucucaacacauuuuuugcauauuauuaaucaaacaguauuauuauuuuaaaaaacuguggaggccaggcccaguggcucaugcccauaaucccagcacuuugggagaccaagguggguagaucacuugaggccaggaguuugagaccagccugaccaacacggugaaaccccaucuuuacuaacaguacaaaaauuagccaggcaugguuuugugcgccuguggucccagcuacuugggagacugaggcaugagaaucacuugaacccaggaggcagagguugcagugagccaagauugcaccauugcacuccagccuggacgacagagcaagauucugucucaaaaaacagaagaaagaaaaacccauggagcauguacuguaagugcuuucuuaggccuagaugauggaacagaggcuuagagaaguuaaguaauguuucugcgaccuggcucuuaaacuggugcucucacagcaguuuauaguuauuccugucuuaaaggcauuuuauauaagauaaaauuaaauacugauggaguacuuuuacuauguuaaaaauaaauuagugcaguuuuaaaauccuuuuucuguaugggauuauggaauauuuaaguuaaauuguaacauuuaauacauuuugauuuuuaaaaaaucaugacuaauaauuuuuuuuuuuuuuuaagaauuguucucuguguacuucaggcucuaucugaaaccuucacaagauguucauagaguuuuaguggcuagaauaauucaugcuguuaccaaaggaugcuguucucagacugacggauuaaauuccaaauuuuuggacuuuuuuuccaaggcuauucagugugcgagguaaucuaaucucuuuuucuuuuguuuuguauugaaauacuuuugaucuugcaagaccauguuuuagacucaguaacuaaaaauucuaccuuaaaauaaaacauugauccaucauaacagaacuaguggauuccuaaagagacaaccaaguccaacacuuucugaauauccaauaugcagaacacuacgugaaguuuucaagggggagaugugucuugcugauguucuguugaccaggaaaguuaaauauccucuaagucauugcauuucccccauuuugaggaugguuuuaauauaccgagaauaaaauaaaauaggaaaauauuuuggaaguauuacuguuguacauuaguauggcaguacucaauguauaaugugaaacauuuuauaaaugguguuacaaaucaguuuuguuuauuuuuauacaauguuuuagcaggagggagagcuaacagaaguggucucuuaacaccaaauaagaacuaauuuuuugucagugugaaguaaugcugugauuuuuuuuuuuaaugaauaguuuugaaauuaagacuacuguuugaaaauuaggguuuuguuuuuuuuucuuucagcauaccacuucauaacuguucaguuuguacaguuuguucccccuguuauacccaguugagcuuguuuguuucuucacagacaagaaaagagcucuucaggucuaaaucauaucuuagcagcucuuacuaucuuccucaagacuuuggcugucaacuuucgaauucgagugugugaauuaggagaugaaauucuucccacuuugcuuuauauuuggacucaacauaggcuuaaugauucuuuaaaagaagucauuauugaauuauuucaacugcaaauuuauauccaucauccgaaaggagccaaaacccaagaaaaagguauaaaggaaauguuuacuguuuugaauuugcuucuucauucaaacauagaagucuaaguauaaaauuaguguucuuuaggaggauaugacuuuccucuggauuucucugguugauaauguuacuuagccaugagaauguuuuucauagaguuuuuagaauuugaagcagugguagcagauucuguuaugccuuucuauuuguucaauacaauauuagguauuaugggaaauacaaaaaaaucugagacauuguucccucuaggagcuacuuaugcaucaauacuuagauacuaaggggucugacacagacuguagggcaaaagaauuuaaagaaagcaggaucuuguuuauccaccuauuacuuuuauuagaagauaaaauacguaaauuggacuaaaaccagucagauuauucagcuccugaggaagauacauacauauuacuuuaauaggaauuugaggcagaaacagggaaauugcugccuuaagccucauaguuacucuagggcccuguuugcccuagaguaucacuuguuaaggagaaucacuuauucuccuuaauuccuucauauauguccuauaccaagagaguauugcccagaagguauagugcuuuucuguaguuaggaacuuuauuggcuggaacuggaguuuccucuugcucugucuaugauugccuuugggcuuauacuagccuuuggaccaacucaucauggcuaguauagugacuuucuuaaaacagcauaccacauugaguaauagcagcuauaauggaggaaaugucuuguagccacuuuuuuuuuuuuuuuuuuuuugagacagagucucacucugucgcccaggcugaagugcagugacgcaauguuagcucacugcaaccuccgccuccuggguucaagcaauucuccugccucagcguucugauuagcugggauuacagaugccuggcaccaugcccagcuaauuuuuguauuuuaauagggauggggucucaccauguuggccaagcuggccuugagcuccugaccucaaaccauccacccgccucagccucccaaagugcugagauuacaggcaugagccacugugcccggccguguagccacuuuuuaucaaaaguagcuguguauuuguuuuaugggcucuucuaauaaguauaucuagauaauauguagcccaugaaacuacuauaagugaaagaauagugacuuuuaauaguuuuucaucuuuuacucaccucuuaucuccaggaugaagaucaggcuuauuaggaggugauaugauauguuuagggauuuaguuaacugcauauuuagggugaauuuaaaauuggcaggaugaugaggaugccagaaaagcuaauguaguuucagacuacuuuaauagauuuuguaguaccuuguuugugagaaauaauagaccuuuuguuucgcauacuagucaagccacaguuggauuaccauguucaccagauuuuguauagucagcauuuuaaguugacuggaaugugucuugggaaagaugacugaaauggugagaagucugaauaauaugucauuuuuacacuaguugaaggaacucguaauauuuuucucuuaggccagaaaaaggcauacggagaacuugguccucauaugaaagagggaacauauuaauuguauuugccucaggugggagaauaaauuggagaaagacagauuuuaggucagaauauggaagaaauuuauaagaaacacaguuaucuaaauguaaaauggacaguuaugaaauagaguuugucaaggaucuugucagaagaggcauuaguacugaauggaagguuggaccaggugucuucuaacgcugaugcagcuugacagcugaauaauuuugugggagcuagcaguguaaacagaguacauacauaaaaauuacauuuuaauuuuuuggauuacaggugcuuaugaaucaacaaaauggagaaguauuuuauacaacuuauaugaucugcuagugaaugagauaagucauauaggaaguagaggaaaguauucuucaggauuucguaauauugccgucaaagaaaauuugauugaauugauggcagauaucugucaccagguacaguaaguaggucaugucacauuuagaaauuuccuguuaauuuuuuuuuuaaacugggcauuuugggcuuuuaaaaccuguguucucacaaaaagccuauaaaaugacucuguacaugcaacuauuccuuucaaacuaucagaaauauuuggaauuacccuuuuaacuuaaaaguuaaugcuuuugcagauauuugaaaacuaacaaugaacuuuuucauucuuaaaugauugucucuaggaaauaaggugacccuaacccuaaugauucgauucgacucgacuguauucuacaaagugcugggauuacaggcaugagccaccaagcccagucuguuucuuuuuugcaauuaagcuagaguucacauagcauaaaauucacgauuuugaguuguacauuucagugguuuuuaguauuuuuacuauguuguacaaccaucaucacuaauucuggaaacuuuuuuuauuuuauuuuuauuuuuuugagauggagucuugcucugucacccaggcuggagugcaguggcacaaucuccgcucacugcaaccucccuuucccggguucaagugauucuccugcaucagccucccgaguagcugggacuacaggugccugccaccacgcccagcuaauuuuuguuuuuuuaguagagacuggguuucaccauauuggccagccuagucucagacuccugaccuugugauccuccugcaucggccucccauagugcugggauuacaggcgugagccaccgugcccagcccagaacuuuuuuaucaucccaaaagaaaccucaucccuucuuagcauucagucccaauucccugcaucuccuagauccuggcaaccagccacuaaucaaucuugguuuuuguggauuuuccuguuugggacaguucguuuaaauggaaucauacaauaugugagucuuuugugucugguuucuuucacuaagcauaauguuuucaaaguucauguuuuaccaugaaucaguacuucauucauuuuuauugcugaauaauauucaguuguauggauauacuccauuuuacuuacccauccaucaccugauggccuaauguuucuuaaauaaaacucuguuccccagagauuugguuaacauccugaguaguaauuucacucugucaaauauuuucuuaauauuucuuaaaauuucuuaaauuuaaaaacuugaaucccuuugaaaguaaagguuuuugcuuuacuuuuagauuucuuagugcuuuuaguaaauguucccaggaaauaaaacuaaugcauuacuugguaauaccugcuuucuaaagugccauuacugucaugcaaaauguuuguuucuuacuauguuaucagauuuauauguuucuguaauguauuacucuugcuuuaugaguucccuguaucuucauuucagaaagaauuuuuuuucccccuaaugaaauauuagaagacaauagcaaugaaaaaaguguauuuggccaggcgugguggcucacaccuguaaucccagcacuuugggaggccaaggcgggcagaucaccugagguugggaguucaagaccagucugaccaacauggagaaacucugucccuacuaaaaauacaaaguuagcugggcaugguggugcaagccuguaaucccagcuacucgggaggcugaggcaggagaaucacuugaaccugggagguagagguuguggugauacgagaucgugcuguuccacuccaaccugggcaacaacagcgaaacucuggcucaaaaaaaaaaaaaagaaaaaaguggauuuauuuuuauuuuacagguuuuuaaugaagauaccagauccuuggagauuucucaaucuuacacuacuacacaaagagaaucuagugauuacagugucccuugcaaaaggaagaaaauagaacuaggcugggaaguaauaaaagaucaccuucagaagucacagaaugauuuugaucuugugccuugguaaaguguuaccauuuucucauucagugucauuuuaaucucuuguauguuauuuuucagaaaacuuucaguggaauccuuucaucucaaccagaacuaagucauuugucuacccccaaaccuauuacuagcaaagggauaugugauugccaugacaaaugagaucaaucauuaauggcucauuugcuugggccaagugcagggccaccuauuuuaaucauauugucauagcaaguuaagaaggaggacuggcucucugauaggcaauuagaagugugcaccucauggaauucacugaauuguacgcuucaacaauagauuuuagcauacguagcaccuucuaauagaauuaggaagaaguuaaagauaaucuuaagaaaucacagaauaauuuugaccuuaugccaugauaaaaaguuauuuucucuuauuuucuaucuucuuuauucucauguaacguucacauauauuuaaguaaucaaauaaauuauggauacuuuggaaucccaaaauauuagaucugguaaggauguuuagaauuuaucuaguucagccuguuugcuuuacugaaaagaaacugaaacccagagagguuaagcaacuucuguagggacagagauuuauagauuauagucaaacucgugaucagugcucuuuugauuaccauguugauggaauguuuaaguguaagugacuucuggggaaaagcauauugauuuagauaccuauugcuuaagcucauuuuuauauaguuaagaguagcuauuuaagauucuuaauuuguccuuuuagucaagaguaauuuauugaacaccuguuaugggcuaagcguuagauauacagagaugaauaacauaagacuccuauucuuaaguaucacacauucuagagaauacacagcaaauguuuauuggauuaacugaauuaauguaaaggaaaaacaguuuuuuggguuucuuuguuuuccuguuuuagaggaaucguuuggugacuaaagagcaaggauguacaagauaacucagaaauaaaauauugcuaaauauauauauauauauauauauauuuucugagacggaggcucacucugucacccaggcuggagugcaguggcacaaucuuggcucacuacaaccuccaccucccagguucaagcaguuauccugccucagcguccugaguagcugggauuccaggcaugugccaccaugcccggcuaauuuuuguauuuuuaguagagacuggguuucaccauguuggccaggcuggucucaaacuccuaaccucgugaucugccugccuuggccucccaaagugcugggaaaccaccuggcccaaauauugcuaauuuaauauccuuuaaaauauuuguuuaagggaaacuuaacagcuuacccagcuagccaaacguugacaauuuuccugccaauuuaggaaguaggacauaguaacuauuaacagccaguuuauuuuuagaguacuauggaaaugauggugauucucuaauuaggauauuguaagaguaccaugucuauauauuuccuuuuaguuuguuaaugugauggaauaguuuucaaauuauccuuuuuuuuuuuuuuuaggcuacagauugcaacccaauuaauaucaaaguauccugcaaguuuaccuaacugugagcugucuccauuacugaugauacuaucucagcuucuaccccaacagcgacauggggaacguacaccauauguguuacgaugccuuacggaaguugcauugugucaagacaagaggucaaaccuagaaagcucacaaaagucagauuuauuaaaacucuggaauaaaauuugguguauuaccuuucgugguauaaguucugagcaaauacaagcugaaaacuuuggcuuacuuggagccauaauucaggguaguuuaguugagguugacagagaauucuggaaguuauuuacugggucagccugcagaccuucaugguaaguucagcaugcauuaugucugacuuacagauaaacacacacagacacacacacacucacauaucccugaucauuuucauaguuuguuacuucaguuaaagaugucaaauucuauuucagaugcuuuucuuguuuggccgagaagacuuaauaaaugcauaagugaauuuaguuucaaauguugacaaauuauuaaagacuaauguuaaggaauuucuuuuuuaguuaaaaaauuuuuaauugaucuauaauagaguuauauauuaucaagguacaugugauaauuugacacacucauaugacacacucauguagggugaugggauaucagcacccuacguaucuuuucuucaugcuaggaacguuugaauuauucucuucuugcuguuuggaaauguacaauagauuaauguuaaccguagucacccuacugauguaucggacaccaggucuuauuccuucuaauuguauacguguauccaaaagacuuucuuuaaagaauuaugaagaguuuaaauuucuuuuaugugcaauuuaucauuauuuauuaaauagccauguuuaaauuguaguacuaugcacuguuaauaaacgagcuauuuuuuaaucaagaaucuucccaaauguaaucagacuuuuaacaguuuuuauguucauuuagucaccuuaacuaaauguaugugccaggcacuguccugauagauaaagucuuugccccuccaauagcuugcuuuucacaauuguccuuuguuuuguuauaguccugcaguaugcuguuugacuuuggcacugaccaccaguauaguuccaggaacgguaaaaaugggaauagagcaaaauaugugugaaguaaauagaagcuuuucuuuaaaggaaucaauaaugaaauggcucuuauucuaucaguuagagggugacuuagaaaauagcacagaagugccuccaauucuucacagguaauuuaaguucauuagcaugcugcuguuuuuuuuguuuguuuuaucaggcucucuccacuuauuugaugccagauggcuuuauuuuauaauaauaaugcagaauuucccagaucuaaccuuaauuauuaaauauuauguuuguuuuuacaguuaucugugucuuuaugccugauugcuucugaaauaaaggguugucucacugugagaauaugggggaugugcaugaaaaaugcacauauaauucuuugagcauuuauguguuccuuucugauuuuuuaaauaaguaaguccauauauuugagucauguagauccuggauccuuucucauaaugggagugucuuuuggguaaaagauguuuuaugaaugaggugaggaaacgaggaagacaaaacaggauguaagcacuaggauaaaggaauggagucccucguccacuuaaccuuuccacagauugguaauuggaaccaaaugauuggagagcagaccuccgaauggauccaauuaaaguacuuuugcuuuaauuuuacaaccuuuuauuuauuucagaaauaauguuaaacaugcuguuucuaaacaguauuggaaaugauaauaacaaugguuguccuccuuaaauuguccuuuuagauauuaagaaauuuaguauagaugaaagcaauuuuaaucuaggauccaaauuuuagaagucaagauuuauagcuaaacauggauguuaaaguuuaaaguauucuuuacauggcuuuuggucuucuaagugaagcuuuuuguuuuucuuuguaguaauuuuccucaucuuguacuggagaaaauucuugugagucucacuaugaaaaacuguaaagcugcaaugaauuuuuuccaaagcgugccagaaugguauguuaucuaauaaugcucuuuaucauuuuaagcuauagcuuuaauuacaaagaugauaauuuuagcuggguaguagcugcaucuuaauaauuguaaacuaaauugguccaaaaaaauugcaacuguuagccagggaagagguuguuuuaauucagugauuguaaucuauguuauauaacauuagaccaagcuuacuauuuuuuaaugcuguauaguauaauaugugacaagugccaaugagaaaaacugaaugguuaugcugggaaauuaagaauauaaaauuuauaugaaauaaguucuuaaagauguuacccauuucuguacaucaacuaugauuugacuauuuguuagcuuuaaaaacuaaugauaauugaaaacaaaaauaaaucuaaaccugaguuuaguugauugacucaagagacuuagauuguauugcugugacugaaaaugacucacuggcacaaacauuccuuaucucccucaagagggcaaaaggaugcguaacugcuuaccuauaccagauguuaaagguuuuuaaaccuaugcucuuuacuuccucugcuuggugaaaaaagggauauguuugcagacaauguuaugcuuaacauuuauaucugguguuuuuaaaaauacuuucugaauuugccuuugagauuguaacuuguauuuuuucucuaucuauuaguaaaauuugcuacugaauaaugacauuugauauaaguaggucucaaaguccgaagaagagaagcauuuaaaagaauaaucuauuaauuauauaaguagucuuugaaugauguagauacuagguuaauguuuuccuuuguaauauauugcuaauacauauaaggcaaagcauuagguacuugguuuauauauuaaagaucuuacuuucuugaagugaacaccaccaaaaagauaaagaagaacuuucauucucagaaguagaagaacuauuucuucagacaacuuuugacaagauggacuuuuuaaccauugugagagaaugugguauagaaaagcaccaguccaguauuggcuucucuguccaccagaaucucaaggaaucacuggaucgcugucuucugggauuaucagaacagcuucugaauaauuacucaucugaggugagauuuuuuaaaaaaagaacuaagcuuauauaugauucaacuuugguaaacuguuaggaaggagaaauaggggcaggaaaaacagcaaggauggugggaggcuucauuuuaaaagcaaaguggcaguaaagggcucuaaauuggacaacuuagcauaauuaaaggaaaacucaagaauaauaauuugaguacuuccuuuguacuggaaauuaugguagacauaaaauaauuccuuguguagguuagugaggaauaguaagaguuugagcauagggauuauaugaugaaaaaaaccucuaaauacaaaggagggaaauguuacaguaauagaaaagaacacgauguaaacaaaucuaauagauuuugguggcaucugaagagagaugagugauuaguaaagacaauaaauggacuagcaauuauuuuagacgucaucuaggaauuuccuuuagccucaaaaucacgaguucucuucauguauacuauucucuugccaaaacuugcauuuuuuaaaaugugaaaugucuuucuaccuauuucuguguauucagaucauccacaugugaaaauccuugcuaacgccuuucuuagaaucucagaaaguaagauucuaagaauuuuuauuuuugagacagagccucgcucuguugcccaggcuggagugcagugacgugaucuuggcucacugcaaccuccgucuuccaguucaagcaauucuccugccucagucuuccgaguagcugggacaggcgagugcuaccacgcccagguaauuuuuguauuuuuaguagagaugggguuuugcuauguuggccaggcuggucuuaaacuccugaccucaggugauggacccgccucagcaucccgaagugcuaggauuacaggcgugagccacggugccuggccuaauaauuuuucaucuuuuaauuucauaguacuuaauguuucacauuuuuaauggcaguuagcaucuucuuuauaccauggauauuuacauaugguuuguauacaaauaucucuugaacuauaacucuuaaacauaaacucuuaaaagggcauacauguuuuuauuuaucuuuauauccuccacagugccuuauuacaugguaaaugauuaaauaaagccuacaauccauucaaaggagugaauucgguagccagggaaaaugacuugaggacaugagaggggacagugugccucuuuaugaucuuuacugacauucuucugcaccacaauuguaaccacuuucauuacaaaguaauuuaguuuuguauauuuucuccuaaaaugccguuuccuacccuguaggaacaaaaaaaaucugaacauuuuguguguaacuuagcagauucuuaguaauucuauaaaauugucuaaacuuuuuuuuuuuuuuuuuuuuugagauggagucuugcucuguugcccaggcuggagugcaguggccugaucucggcucauugcaaccuucgccuccuggguucaagcaauuuuccugccucagccuccugaguagcugagauuauaggugccugccaucacgcccugcuaauauuuguauuuuuaguagagacaagguuucaccacguuagccagguuggucucgaacuccugaccucaggugaucugcccgccucggccucccaaaguguugggguuguaggcgugagccaccaugcccggccagcugucaaaacuuguaucuacuagaaaaaauguuuuaugcuauucuguggagucuaaaaagcugaauaagucaagguuccuauucuucagaagcuuaaaaugucauuuuaaugucucuuuauaugacuguaauuucuacuuguguucuaagacuuacagucauuuauuugccugugaagcuuuuuuucuuuucuuucaucccuaccucaaauauuuaagggccuauguguacaguacacccuccacccuaagaugauauauccugcuuggccaucaggagauacuuaggcuauuuuucuugagaauccugguuauaauucuacagugaucuccuaguuguuuuuagagcuauccaggauaugccaccuuuaacucaguuaacugaacuuuuguuuuuuaauauguauguagaauuuguucuuacaaaagauagaguauacuaaauuauuuaugaaauauauauauuuuuauuugugguuuacuuuaagauuacaaauucagaaacucuuguccgguguucacgucuuuugguggguguccuuggcugcuacuguuacauggguguaauagcugaagaggaagcauauaagucagaauuauuccagaaagccaagguaggagaauuuauacuaauaaaguuucggauaaauuugaaugaaauguauuccugugaaaauuauuacauuuguuuggaagacauuaaauuuuaugcagguuaacccuuucucuuuuauuuauguaaugugagaagaaauuauacuauguauuuuuuaaauuguuuuaauuguuuaauuuuuaauuauuauuauacuuuaaguucugggguacaugauguagagcaugcagguuuguuacauagauauacagugccauggugguuugcugcacccaucaacucgucaucugcauuagguacuucuccuaauguuaucccuccccuagcccccgacccccugucaggcccugguguauaauguuccccucccuguguccauguguucucauuguucagcugccacuuaugagugagaacaugcaguguuuguuuuucuguucuuguguuaguuugcugggaaugaugguuuccagcuucauccaugucccugcaaaggacaugaacucauccuuuuuuauggcugcauaguauaucaugguguauaugugccacauuaucuuuauccggucuaucauugaugggcauuuggguugcuuccaaguuuuugcuguugugaacagugcugcaauaaacauacgugugcaugugucuuuauaguaaaaugauuuauaauccuuuguguauauacccaguaaugggauugcugggucaaaugguauuucuaguucuagauccuugaggaauugccacacugucuuccacaaugauugaacuaauuuacacucccaccaacaguguaaaagcauuccuguuucuccacauccuguccagcaucuguuguuuccugacuuuuuaaugauaggcuguaagcaugaaacucuuucuuaucucuugguaguacucugucacugguaugauuugcaagaacagaguauaagauuugccauuuuaaaaaauuguuaaugaguuuugcuuauacuguaugacuacguggaacuucuaaaaacauuucauuuuuucucuuaagugcacuuuauuuuuuauuuuauaguauguccaagaucaaaguacacuguaaaaagcaauacuaaacuauaauuuuaacuggaauuugcauuuuuccuucuauucacaauagucucuaaugcaaugugcaggagaaaguaucacucuguuuaaaaauaagacaaaugaggaauucagaauugguuccuugagaaauaugaugcagcuauguacacguugcuugagcaacuguaccaagguaagauuuucuucuucuuguuuuguuuuuugagauaggaucuuucucugucacccaggcuggagugcagugggauugucacaacucauuguagccuugaccuccugguuuccagcaauucuccugccucagccucccaaguaauugggacuacaggcauguaccaccuagcuaaaauuuucuuuuuacuugaaaguguagccuaugcagggaauugaucacugguugguguuacuguuuugguguccacucguaaguuuauuuuuuacuuuuauuuuucuuuuuuuugagacagucucucacucuuucacccagagugagugaucacaucacugcgauccagcagccucgaccuccugggcucacagcagccucgaccuccugggcucaagugauucucccaccucagccuccuuaguagcugggacuacaaguguacaccaccaugccuggcugauuuuuguauuuuuguaauuuuuuguauugaugggguuuuacacauugcccaggcuagucucaaacccugggcucaagugaugcuuacaucucaaagugcugugauuacaggugucagcuaccauaucuguucacauucauaaguuauacaaauugauuuaaaauucaguugaaugguacauaaagguaauauccagacaaauaagcaauaggaaucugaguuucucaugaaacuaauuuuauaauuucaggaauuuuucugagauugccuuaugacuuuuauauacaaccauauagaugacucuuuuauuccugggacacuuucauucauuuaauaaaaauuuuuugacccaaacuaugugguaugcguagcggggcuagugagcaacacaacaauaacuccagcacauaguuuacuuucuuuugcucagaucaccuuacauaacauuugguagaaagagugcuacuguguuuaaucuuuguuuuuaucugcagcagccugugggauagccaagccaggccccagaguauugauaauaauuggaaauauauuucaaaccuaguauuagguacauggccauauagcaauauuaucaacauauuucuugguuuuguaauguguuuuuccuccuuuuugguguaaguggggaaggagaaaaguagaauaaacucuaaccuauaauuauagcucacuuaucuuuagggucaauagcuguuacuuuaauguuguuaaagcacaaugaaagauguacaguauaguuauuauaacucuaagaaaagauguguuuuugaagcagcauauauauuggcccuaauaguaaacuauuuaucuacauuccauucaagauagagaaaacacugucugccaagaauaauuguuuuuauuucuuuguugcuugguucuuuguuugucuuaauugcagaagaguccaaauaagauugcaucuggcuuuuuccugcgauuguuaacaucaaagcuaaugaaugacauugcagauauuuguaaaaguuuaguaaguaugcuuccuguuuugcuaucauauuuugauucuaauaggcauaauuuuuuuguugaaauaucuuuguaaauaaggaugcaucucacaacauauagcucuuaacauuuuuacaaauguggaaauuaaggccaggugcgguggcucaugccuguaaccccagcacuuugggaggccgagguggguggaucacaaggucaggagauugagaccauccuggcuaacacggugaaaccccgucucuacuaaaaauacuaaaaauuagccaggcguggugacaugugccuguagucccagcuacucgggaggcugaggcagaauugcuugaaccugggagguggagguugcagugagcgaagaucgugccacugcacuccagccuaggcgacagagcgagacuccaucucaaaaauaaaaaaauuuaaaaaauuaaauaaaauguggaaauuaaauaauuugucuuguggggaaauauaccugauugcuucuuaauaucaauaccuagcauaguagugccugccuuuaguuucucaauaaauaauacauuuaaaaauugggaacgaaucauccaggcucacagcuauaucugcgcaacauuguaccaaaauuuaaaauaauuauuuguucuuuaaaagugaccaaaaaucuugccaggcaagcaacauauucuuauuguaguauuuauuuuucuuccauacaaaugggcuuaugccacauacauucuuuuuucuggaacacugccgggcauacaaaguaguuauugaaauaucuauugagugaaaacauauucuguaacuuauuuccauuuuaugacacaucuuaaucauuuuccaugucacuguacuuauuuuauaagcuaucugcuguuauacuuuauuuauuuagcagugcaugguauucuauuguguggugauagugaauaguauauauguauaugaaagcuuaucugcucuuuuuuuuuuuuuuuuuuuuuugagacaaagucuugcucuguugcccgggcuggaguucaguggcacaaucucggcucacugcagcccccaccuccuagguucaagagauucuccugccucagccucccaagaagcugggauuacagaugugugccaccacaaccggcuaauuuuuguauuuuuaguagagaccagguuucaccauguuggccaggcuggucuagaauuccugaccucaaaugaucuguccaccuuggccucccaaagugcuuggauuacaggugugagccaccacacugagccaaaaagcccaucugcucuuaauuaacauuuuaagugguuucuaguuuuuuggguuacaaagacuucugugguacagauuauuguacuuuugucuauuuguauuuguguguaugauggauguaggauaauuucuagcaguagacuugcuuguucaaaaggaaugugaauuuuacuuuuugauggauauugucauuguccuccaaaauagucauaccaauuuaggcauuuuccuacacccucuuuggguaacacuuuagguguuacaaaacuucuuaauauaagaaauaauuuugagggaggagccaagauggccgaauaggaacagcuccggucuacagcucccagcgugaacgacgcagaagacgggugauuucugcauuuccaucugagguaccggguucaucucacuagggagugccagacagugggcgcaggucagugggugugcgcaccgugcgcgagccgaagcagggcgaggcauugccucacucaggaagugcaaggggucagggaguucccuuucugagucaaagaaaggggggacggacggcaccuggaaaaucgggucacuccccgaauacugcucuuuugcgacgggcuuaaaaaacggcgcaccacgagauuauaucccgcaccuggcucggaggguccuacgcccacggagucucgcugauugcuagcacagcagucugagaucaaacugcaaggcggcagcgaggcugggggagggaugccugccauugcccaggcuugauuagguaaacaaagcagccgggaagcucgaacuagguggagcccaccacagcucaaggaggccugccugccucuguaggcuccaccucugggggcagggcacaaacaaaaagacagcaguaaccucugcagacuuagaugucccugucugacagcuuugaagagagcagugguucucccagcacacagcuggagaucugagaacgggcagacugccuccucaagugggucccugacccugacccccgaacagccuaacugggaggcaccccccagcaggggcacacugacaccucacauggcaggguacuccaacaggccugcagcugaggguuuugucuguuagaaggaaaacuaacaaacagaaaggacauccacaccaaaaacccaucuguacaucaccaucaucaaagaccaaaaguagauaaaaccacaaagauggggaaaaaacagaacagaaaaacuggaaacucuaaaaagcagagcgccucuccuccaccaaaggaacgcaguuccucaccagcaacggaacaaagcuggauggagaaugacuuugacgagcugagagaagaaggcuucagacgaucaaauuacucugagcuacgggaggacauucaaaccaagggcaaagaaguugaaaacuuugaaaaaaauuuagaagaauguauaacuagaauaaccaauacagagaagugcuuaaaggagccgauggagcugaaaaccaacgcuagagaacuacgugaagaaugcagaagccucaggagccgaugcgaucaacuggaagaaaggguaucagcgauggaagaugaaaugaaugaaaugaagcgagaagggaaguuuagagaaaaaagaauaaaaagaaaugagcaaagccuccaagaaauaugggacuaugggaaaagaccaaaucuacgucugauuggugcaccugaaaguaacggggagaauggaaccaaguuggaaaacacucugcaggauauuauccaggagaacuuccgcaaucuagcaaggcaggccaacauucagauucaggaaauacagagaaugccacaaagauacuccucgagaagagcaacuccaagacacauaauugucagauucaccaaaguugaaaugaaggaaaacauguuaagggcagccagagagaaaggucggguuacccugagagggaagcacaucagacuaacagcggaucucuccgcagaaacucuacaagccagaagagagugggggccaauauucaacauucuuaaagaaaagaauuuucaacccagaauuucauguccauccaaacuaagcuucauaagugaaggagaaauaaaauacuuuacagacaagcaaaugcugagagauuuugucaccaccaggccugccuuacaagagcuccugaaggaagcauuaaacauggaaaggaacaaccgguaccagccgcugcaaaaucaugccaaaauguaaagaccauugagacuaggaagaaacugcaucaacuaaugagcaaaauaaccagcuaacaucauaaugacaggaucaaauucacacauaacaauguuaacuuuaaauguaaauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagagacaaagaaggccauuacauaaugguaaagggaucaauucaacaagaagagcuaacuauccuaaauauauaugcacccacuacaggagcacccagauucauaaagcaaguccugagugaccuacaaacagacuuagacucccacacauuaauaaugggagacuuuuaacaccccacugucaacauuagacagaucaacgagacagaaagucaacaaguauacccaggaauugaacucagcucugcaccaagcagaccuaauagacaucuacagaacucuccaccccaaaucaacagaauauacauuuuuuucagcaccacaccacaccuauuccaaaauugaccacauacugggaaguaaagcucuccucagcaaauguaaaagaacagaaauuauaacaaacuaucucucagaccacagugcaaucaaacuagaacucaggauuaagaaucucacucaaaaccacucaacuacauggaaacugaacaaccugcuccugaaugacuacuggguacauaacgaaaugaaggcagaaauaaagauguucuuugaaaccaccgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaagagcagaacugaaggaaauagagacacaaaaaacccuucaaaaaauuaaugaauccaggagcugguuuuuugaaaggaucaacaaaauugauagaccgcuagcaagacuaauaaagaaaaaaagagagaagaaucaaauagacgcaauaaaaaaugauaaaggggauaucaccaccgaucccacagcaauacaaacuaccaucagagaauacuacaaacaccucuacgcaaauaaacuagaaaaucuagaagaaauggauaaauuccuggacacauacacucucccaagacuaaaccaggaagaaguugaaucucugaauagaccaauaacaggaucagaaauuguggcaauaaucaauagcuuaccaacaaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauacugauaccaaagccaggcagagacacaaccaaaaaagagaauguuagaccaauauccuugaugaacauugaugcaaaaauccucaauaaaauacuggcaaacugaauccagcagcacaucaaaaagccuauccaccaugaucaagugggcuucaucccugggaugccaggcugguucaauguacacaaaucaauaaauguaauccagcauguaaacagaaccaaagacaaaaaacacaugauuaucucaauagaugcagaaaaggccuuggacaaaauucaacaacccuucaugccaaaaacucugaauaaauuagguauugaugggacguaucucaaaauaauaagagcuaucuaugacagucccacagccaauaucauacugaaugggcaaaaacuggaagcauucccuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuugcagacgacaugauuguauaucuagaaaaccccacugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauauugugaaaauggccauacugcccaagguaauuuacagauucaauggcauccccaucaagcuaccaaugacuuucuucacagaauuggaaaaaacuacuuuaaaguucauauggaaccaaaaaagagcccgcaucggcaagucaauccuaagccaaaagaacaaagcuggaggcaucacacuaccugacuucaaacuauacuacaaggcugcaguaaccaaaacagcaugguacugguaccaaaacagagauauagaucaauggaacagaacagagcccucagaaauaacgcugcauaucuacaacuaucugcucuuugacaaaccugagaaaaacaagcaauggggaaaggauucccuauuuaauaaauggugcugggaaaacuggcuagccauauguagaaagcugaaacuggaucccuuccuuacaccugauagaaaaaucaauucaagauggauuaaagacuuaaacauuagaccuaaaaccauaaaaacccuagaagaaaaccuaggcauuaccauucaggacauaggcaugggcaaggacuucaugucuaaaacaccaaaagcaauggcaacaaaagacagaauugacaaaugggaucuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcagucauuaaaaagucaggaaacaacaggugcuggagaggauguggagaaauaggaauccuuuuacacuguuggugggacuguaaacuaguucaaccauuguggaagucaguguggugauuccucagggaucuagaacuggaaauaccauuugacccagccaucccauuacuggguauauacccaaaggacuauaaaucaugccgcuauaaagacacaugcacacguauguuuauuguggcauuauucacaauagcaaagacuuggaaccaacccaaauguccaacaaugauagacuggauuaagaaacuguggcacauauacaccauggaauacuaugcagccauaaaaaaugaugaguucauguccuuuguuagggacauggaugaaauuggaaaucaucauucucaguaaacugucgcaagaagaaaaaaccaaacaccgcauguucucacucauaggugggaauugaacaaugagaucacauggacacaggaaggggaauaucacacucuguggacuguugugggguggggggaggggggagggauagcauugggagauauaccuaaugcuagaugacgaguuagugggugcagcacaccagcauggcacauguauacauauguaacuaaccugcacaaugugcacauguacccuaaaacuuaaaguguaauaaaaaaaauaauaauuuuuaaaguuugcauauuauuuuguuauguagacauauuacagguuauauauccauuuuacuauuguuggacauuuaguagaaaaaguacuguaguuuucauacuuacacaugaaccuugaauuguuugauuagguaaauuuuuuuuuuuuuuuuuuuuuugagacagagucucgcuucgucaaacccaggcuggagugcaguggcaugaucucagcucacugcaaucucugccuccugaguucaagugauucuccugccucagcuuccugaguagcugggauuacaggugcccaccaccacacccagcuaauuuuuguauuuuaaauagagacaagguuucaccauguuggccaggcugguuucgaacucccgaccucaggugauccaccuggcucugccucccaaauugcugagauuacagaugugagccacugugcccagccugauuagguaaauuuugacuacagcaugcuccugcaagaagccaucuugaacaucuuuguuucucuuccuugaaggcauccuucaucaaaaagccauuugaccguggagaaguagaaucaauggaagaugauacuaauggaaaucuaauggagguggaggaucagucauccaugaaucuauuuaacgauuacccugauaguaguguuagugaugcaaacgaaccuggagagagccaaaguaccauagguaaauacauauuuacuacuugggauuucuuuuacuucuuuauauugauuuggcaguauaagaggccucauugauaucaauuuugugcuuauuucauuuucucuuaguauagccuuuuaggauuguuccuuucuuauauacuuuauuuuuuuuuuauuuuuacuugaauuuauuaguuucauauuuuauucuucauagaaggaacuuaagauaacuauuaaagaaauaaaaccaggccaggcaugguggcucacgcuuguaaucucagcacuuugggaggccaaggcgggcugaucaugaggucaggagaucaagaccauccuggcuaacguggugaaaccccaucucuacuaaaaacacaaaaauuagaugggcgugguggcgggcgccuguagucccagcuacucgggaggcugaagcaggagaacggcaugaaccuggggagguggagguugcagugagccgagaucaugccacugcauuccagccugggcgacagagcgagacuccgucucaaaaaaagaaauaaaaucauaugauagguuauuuccucaauagaaagcaggaaaugaaaacacaccuguaaugccauugcuuuuaaccuuuuucuauuauuucucuguagaaacauucaaaauuguagucaacaucaacauucacauguuaugaaugccuguuuaauuauaaguauuuuuccagguaguugcuuuucuugauagucauacuuuuuaauggcuucaccauuuuucugucauaaauaccauaauuuacuugacauuuuuuauugucagaaauuuagauucuuuucuauuuuccuacaauaaacauuauugcaaugaucauuugucuaaggguuuuuuuuucucauauuuuaaauuauuucuugacaacagaaucuuggauaauuuuucaaaaagacuuuugaagcuuucaguauauaauuaauuucacuauaauuuugcuuuucauauacuuuuuuuugugaagaggaggaaauuugaguuaauaugacuauauauggcuguugugcccuucucuuaguguuaaugagugcuuuuuauuuuuaggugccauuaauccuuuagcugaagaauaucugucaaagcaagaucuacuuuucuuagacaugcucaaguucuuguguuuguguguaacuacugcucagaccaauacuguguccuuuagggcagcugauauucggaggaaauuguuaauguuaauugauucuagcacgcuagaaccuaccaaaucccuccaccugcauauggugaguuacguuaaaugaagaagcucuuggauuuuaucugauguugcugacuaaauguaaugaguugacauguaagaaucacauggugucuuugaagaauugaaauugcuuucuugagaaaugaaccugagacuaguuggaaaauaacacuuuuaacgugcugugagcaaauuuaaguggaugcugaaauauuaaaacuuagauggguuuuggauagauuuauucucuuuagguuuaauuguuauaaauuauuuuaauuaggcuaagaaacauagacccugaauguaaaaauauuacauaacauuguguuugaaguuggaaccuugccuuugaccuuaguuuauauauuuucaguuuuuuggauuugauuucaaaaugauagugaaguuacaagaauacuacaguuaacguuuuaccauauuugcuuaaucauucccucucuccacacacacacucauacgcagauacacacaucauuuucucugaaccauuuugagaugaaaucgcacacgugaugcuccuuauacuucaguguauauuuccuaaaaacaaggauacacuucuguuuagccacaguauaaucaucaaaaucaggaaguuaacauuuugucauugcauuuagguguguagucuguuuagucuccuucaaucuggaacaguucuuuuuuuuauuuaucaugaccuucauauauuugaauaguacaggucccuugcucugaguuugucugauguuuccuuaugauuaaauuuauacuuugacgagaauguugcaaaaguaauuccucuucugccuucacccuguccauuuaucugucuguugauagauaucuucaaauccaagccaacaucacacaguuuaucuuuuuuucuguccaaauuuauaaauugcuuuacuagcaguuaaaaaaaacaccccaaaaccugacuauccacucaaccugaaugcauuuacuuauuugcucaacaaccuuauauauaacuaaucuaaccaugugggccauuuucuuagcccuagccccaguguauguggagguagagccucuggccuagcgaguagcaaguuggguccuaggucauguccccaguuccagcaaauugucacacaugccuggugagucccuaauuagaaccucugaucacaguaaauuguaggcugagucauugguggaaucccuggucauguuucccacccuuggugaaaaugcacgucaaucccuuagagugagaagacaaguuugguugugcccuguuugggccccugguuuagguccucgcagauacucaagucucuaucccugaccaagaggaaguuacaugcuuuucuugaaguauugauguuucaagucacuucagaacauucaguaaccucauguacaugacucucaugucaaauaaugaaaaggaucauuuaauuuccuuuguuaauaucugaaaaggauuaagaaauauauuauucuauauguaaauaggaaaaaaaaucccuuauuauuucaguauagccagaaaauuauuugguaguucucggaaacuggcugcccagauaauaacuaccauuauaacuggucguugcagcagcccuuucugugcauaguaccauaaagagccuuacaagauugccuuaugggaagauaggucaagguuuuugacuucuucccugcccaugauuaucucugcuuuccaaaauucauuaauaguuuucaaccacuggucuauuauccccaagcauuauuuugggagaguggagacuuacaguuucagaaucuugcucaagcucuuaacugcaacagugguaauaaugaucauuuauugaauuccacaauagaagcuagacuuuuacguuuauuuucucuaauccucacaguuaucuggccagguaagugauauaucuucacucuacugaugaggguacgaaggcccuagaugacauaaggcaaguuuuuuaccagaaaaguuaaggcugugguacugggauuugaauuuucuguuugacuucaaagccuuuuguuuuuacuauacaccucuuaaauauuuacagcuguguguguguguguaugugugugcauguaugaauuuauguuuauauacuuaaaaaaaauuuuuuuuugagacggaaucucgcucuguugcccgggcuggagugcaguggcgcgaucucggcucacugcaaccuucgccucccagguucaagcgauucuccugccucagccuccugaguagcugggauuauaggcgccugccaccaccccuggcuaauuuuuguguuuuuaguagagauggaguuucaccauauuggccaggcuguucucaaacuccugaccuugugaucugccugcuucagccucccaaagugcugggauuacaggugugagccacugcacccggccuauguuuauauacuuuuuaaaguaaaugauuuguggauaaaccugauuuuuuucccuccuaccaucuuaguaucuaaugcuuuuaaaggagcuuccuggagaagaguaccccuugccaauggaagauguucuugaacuucugaaaccacuaucguaagaaauuaaaaccuuauguuauguucacuuuaaaguuauaaaauaacugauguguucuguuaagcuuauaaaguugaacuuuuuuuuuuuuuuuaccacagcaauguguguucuuuguaucgucgugaccaagauguuuguaaaacuauuuuaaaccauguccuucauguagugaaaaaccuaggucaaagcaauauggacucugagaacacaagggaugcucaaggacaguuucuuacaguaauuggagcauuuugguagguacagucuauuuugugguccuauuuuucuuuugcuaucuguggauacgaaugcaaguuuuguauccacaucagugauuucuucugaucuuccuacauagcuaauacaucuuuuaagaauagcagaauguaauuuguguuucccucagucgcuugaagaacuacauugcuuuuuguuuaaggcuuggcuuucuaaaccguuuaacucauuucucugcaaauuuugaaucacuuaauaauuugacauguauagugaauaaaggauaacaagccaaaaucaguugaauuguucauguucccuaagugaacaaauuggccuuguccuuaucugguuauuuuaugcauauugucacauuccaagauaacacccugauacuuacagaggagcacauacauauaauuuagaacccuuguacuaucugauugcuaaguaauucuaaaucaauagacuguuuuuuguuuuuguguuuuuuugagauggagucucacuccaucacccaggcugcaggcuggagugcaguggugcuauaucugcucacugcaaccuccgccuaguagguucaagcaauuguccugccucagccuccugagcagcuaugauuacaggcucccaccacaaugccuggcuaauuuuuuuguauuuuuaguagagaugggguuucaacacguuggccaggcuggucccaaacuccugaccucaagugaucugcccaccuuggccucccaaaguguugggauuacaggugugagccagugcacccagccugaaugugguuuugaaaucuucaauauaccaaacaaagaaaucuucaauauaccaaacaaagaaauuucuuucuaaaguaaguuuacuguaauguaguuuagccauucuaugguagcccccaaaaaaggacauaaugguauaaaacaaauaauauacgcuaaaaugaauucuuuuacacuaauuucuuuuagcuugaauuuuuggcaaggugaguauguuggcauauuccacauaaugacaaauaaguuuagcacagaaagacauauuggaaguaacuuacaauaaccuuucagugaguuuucugagugcuuuuaucagaaugauuauuuaacuuuggaaaacuuacuugauuucaggcaucuaacaaaggagaggaaauauauauucucuguaagaauggcccuaguaaauugccuuaaaacuuugcuugaggugaguuuuugcauuuuuuuaguaagaucuccauugaaaauuuuaaagcagucuuuguuuguuaaugaguaauuuuucucuauuucauauuuaaccacaguucuuuucccguaggcugauccuuauucaaaaugggccauucuuaauguaaugggaaaagacuuuccuguaaaugaaguauuuacacaauuucuugcugacaaucaucaccaaguucgcauguuggcugcagagucaaucaauagguaaugggucaaauauucaugaaguauuuggaaugcugcagauggcaguagaaugucuuacauaguaacagcucacaguugcaauauuaaaaauagcuaacacuuguugaguauauacggugugccuggcauuuauguuuauucuuaauucuuauacuucugucacuuagauucuauuauuuccuucaauuuauaaaugaaaacugugacuuagugagguaaaguaacuugcuuaugccacagagcuaacaagugguugacucgagugaggugugucuacuaucauguacaggagauacggacuguuuggaaauuacugugauuuuaugugaguuuaugaaaugauaauuagcacauuuuacauugugcuaauuacaauuauauuuacuugagugaacauccagugaagcacuggaaggauucuaucaugaggaucuuuuauauuugaguacuggaauaaacauauauuaauuucauucuuuuuuuuuuuuuuuuuuuuuuuuuuugagauggaguuucgcucaugucucccaggcuggagugcaauggugugaucucgguucacuucagccucuaccuccucgguucaagcaauucuccugccucauccuccugaguagcugggauuacaggcgccugccaccaugcccagcuaauuuuuuuauuuuucguagagauggaguuucaccauguuggccaggcuggucuugaacuccugaccucaggugauccacccaccuuguccucccaaagugcugagauuacaggcgugagccuuuaaucauguaguuuuugucauucguucuguuuaugugauggauuauguuuauugauuuguguaugcugaaucagccuugcgucccagggaugaagcugacuugauagugguggauaagcguuuugaugugcuggauucaguuugccaguauuuuaucgaggauuuucacaucgauguucaucacggauaauggccugaaauuuucuuuuucuugugucucugccagguuuuggaaucaggaugaugcuggcaucauaaaaugaguuagggaagagucccucuuuuucuauuguuuggaauaguuucagaaggaaugguaccagcuccucuuuguaccccugguagaauucggcugugaaucccucugguccugggcuuuuuuugguugguaggcuauuaauuacugccucaauuucagaacuuguuauuggucuauucagggauucgacuucuuccugcuuuaguugggagguuguaugugucuaggaauuuaucacuuucuucuagauuuucuaguuuauuugcauagagguauuuauaguauucucugaugguaguuuguauuucugugggaucagugguauuauccucuuuaucauuuuuuauugagucuauuugauucuucucucuuuauuagucuugcuagcggucuguuuuguuaaucuuuucaaaaaaucagcuccuggauuaauugauuuuuuugaaagguuuuuuuugugugugugugucucuaucuccuucacucagcucugaucuuaguuauuucuugucuucugcuagcuuuugaauuuguuugcucuugcuucucuaguucuuuuaauugugauguuaggguguugauuuuagaucuuucccacuuuguccugugggcauuuagugcuauaaauuucccucuaaacacugcuuuagcugugucccagagauucugguacauugugucuuuguucuuauugguuucaaagaacuuacuuauuucugccuucauuucauuauuuaccuaguagucauucaggagcagguuguucaguuuccauguaguugugugguuuugagugaguuucuuaauccucaguucuaauuugauugcacugugaucugagagacuguuacgauuuccauucuuuugcauuugcugagguuuguuuuacuuucaauuauguggucaguuuuagaauaagugugauguggugcugagaagaauguauauuacucuguugauuugggguggagaguucuguagaugucuguuaggucugcuugguccagaguucgguucaaguccugaauauccuuguuaauuuucugucucauugaucugucuaauauugauggugggguguuaaagucucccgcuauuauuguguggaagucuaagucucuucguaggucuaagaacuugcuuuaugaaucugggugcuccuguauugggugcauauauauuuaggauaguuagcacuucuuguugcauugauccuuauaccaucauguaauguccuucuuugucuuucuugaucuuuguuggauguuuguuuuaucagagacuaggauugcaacccuugcuuuuuuucuuucuauuugcuugguaaauauuccuccaccccuuuauuuugagccuaugugugucuuugcaugugagauggguccccugaauacagcacacugaugggucuugacucuuuauccaauuugccagucucugucuuuuaacugggacauuuuagcccauuuacauuuaagguuaauauuguuaugugugaauuugauccugucauuaugaugcuaacugguuauuuugcccauuaguugaugcaguuucuucauagugucaauggucuuuacaauuugguauguuuuugcaguggcugguaccagcuuugccuuuccauauuuagugcuaccuucaggagcucuuguaaggcaggccugguggugacaaaaucucucagcauuugcuugucuauaaaggauuuuauuucuccuuugguuaugaagcuuaguuuggcuggauaugaaauucuggguugaaaauuauuuucuuuaagaguguugaauauuggcccccacucucuucuggcuuguaagguuucugccgagagaucugcuguuaagucugaugggcuucccuuuguggguaacccgaccuuucucucuggcugcccuuaacauuuuuucauucauuucaaccuuggugaaucugaugauuaugugucuugggguugcucuucuagaggaguaucuuugugguggucucuguauuuccugaauuugaauguuggccugucucgcuagauuggggaaguucugauaauauccugaaggguguuuccaacuugguuccauucuccccaucacuuucagguacaccagacaaacguagauuuagucuuuucauauagucccauauuucuuggaggcuuuguuuguuccuuuucauucuuuuuucucuaaucuugucuucaugcuuuauuucauuaaguugaucuucaaucucugauauccuuucuucugcuuaaucaguucggcuguugauacuugcguaugcuucacgauguucucauccugcauuuuucagcuccaucaggucauuuauguucuucucuacacugauuauucuaguuagcaguuccucuaaccuuuuuucaagguucuuagcuuccuugcauuggguuagaacaugcuccuuuagcucagaggaguuuguuauuacccaucuuccgaagccuacuucugucaauucgucaaacucauucuccguccaguuuuguucccuugcuggugaagaauugugauccuuugcagcagaagaggcauucugguuuuuggaauuuucagcccuuuugcgcugguuuuuccucaucuucguggauuuaucuaccuuuggucuuugauguuggugacuuuuguaugggguuucuguguggacauccuuuuuguugauguugaugcuauuccuuuuuguuuguuaguuuuccuuuuuacagucaggccccucugcugcagaucugcuggaguuugcuggagguccacuccagacccuguuugccuggguaucauccauggaggcugcagaacagcaaagauugcugccuguuccuuccucugggaagguucgucccagagcggcacccgccagauggcagcgggagcucuucuguaugaggugucugucgaccccugcugggaggugucucccagucaggaggcacgggggucagggacccacuugaggaggcagucugucccuuagcagagcucgagcgcugugcugggagauccgcuauucucuucagagcuggcaggcaggaacguuuaaguccgcugaagcugugcccacaaccaccccuuuccccaggugcucugugucagggagaugggaauuuuaucuauaagcuccugacuggggcugcugccugucuuucagagauacccugcccagagaggaggaaucuagagaggcagucuggcuacaguggcuuuguggcacuauguugggcuccacccaguucgaacuuccuacuggcuguguuuauacugugaggggaaaacauccuacugaagccucaguaauugcagacgccccuccccccaccaagcuucagugucccaggucgacuucagacuguucugcuggcagcgagaauuucaagccaguggaucuuaacuugcuggucuccaugggggugggauccgcugagcuagaccacuuggcucccuggcuucagcccccuuucuaggggagugaauggguccgucucgcuggcguuccaggugccacugggguaugaaaaaacacucuugcagcuagcucagugucugcccaaauggccgcccagcuuugugcuuuaaacccagggcccuggugguguaggcacccaagggaaucucuuggucugcggguugcaaagacugcgggaaaagcguaguaucugggcaggaauccaccauuccucacagcauagccccucacagcauagucccucacggcuucccuuggcuaggggagggaguuccccgaccccuugugcuucccgggugaggcuacaccccacccugcuuugacucucccuccgugggcugcacccacugucuaaccagucccaaugagaugagccaucuaccucaguuggaaaugcagaaaucaccaccuucugcguugaucucacugggagcugcagaccagaacuguuccuauguugccaucuugcuguucccuuguuuuauuuuucucuaguauuuaugauaacgugaaacauauuuuaauauauuuacuucuccguauuccacuaguauauauguuccuaaaggcacugguuuuugucuguucuguucauuguuguauuuuuagcaccuaaaacaauacuuggcaugugauagguauccaauaacuguuuuaaaauaaaugaauguacuugaaaaaaaauuacaugaugcuucaaaaacaucaaagcugaaaaucauuugaguaacuuuaaaauguaagcaaucaauaauaaaagauuacuauauuguucagcagucacauaaaguauuaaaacuaauauuucaguauuugaauaugccgacaguaauguuuucauaaacuagauuuugugucuaacuccucagguuuggaacuguuuuuaguaagaccauaaugcauugcaaggauuucuaaugaauauguuuaguaguucaagcccuuauuaaauuucacagauaaaagcaaauguaugcugaacuuuaaggacugagguaauauaagacugaauugaauguaauaaggcggcaguguagugguggcauuaaaaaaacugaagauucaaaaaguauaaauucaagaauaacaugcaaguagcauucuuuuuuuuaauuuuacacuuguuagauuuugucuuagucccuuuguguugcuauaaaggaauaccugaggcuggauauuuacaaagaaaagagguuuauuuggcauauggcgucuacaucugguaagggccucagacucauggcagaaggcaaagaggaaucagugugugcagagaucacauggugagagaggaagcaaggguggaggcggggaaggccaugccaggcucuuuuuuuuaauaaccagcccuugugggaacugaauagugagaacucacucauuccuuacccucaggccuuaaucuauucgugagggaucugcccccaugacuccgacaccucccauuaggcauaaccuaauggggaucagauuucaacaugacauuuggagggguuaaacauucagacaauagcagauaucuaauguucagcuauuuuaagagcagugagugaaacuagaagaaucagaggaacauaaacaauuauaaaagcuucgauuacuaaaaaaggauaaaagacaaaguugauuaaagaguuauccuuaaauauguggguguuacgcaaaagguguacugaucaacuuuuuuccaucacauaaaacaaaauuuaaaugguacauaaaaacauuaacuuacccgcuuucagagugauuaaauguuagagcagguugacauuggaaucuguggacucaacuaauugguguucggccagagaacaguuuaucuuuucuggcuaguuugaguucagugcuguucaaauuugagcaauaguuaaaauauauuuugagacccucuucaguucuaggagaaaauagauuuuguauucaagaccuuaauacuaagcugcuggucugaaccucuuuaaauaaacucagguuuuguuagucuuuaagaaagagcuaguauguuauuaugucucacagagugauuuauuuuuguucuggaauaugcuuuggaaaguaggguuugaaauuagaaaauuauuucacuuuuuguuuguuuguuugcuugcuuguuuuaagauuguuccaggacacgaagggagauucuuccagguuacugaaagcacuuccuuugaagcuucagcaaacagcuuuugaaaaugcauacuugaaagcucaggaaggaaugagagaaaugguaauuuuaaguaacauguauuugcuguuaucauaugcuugcuaugaauaucccauaaauuacuucaccaaguuugguauaagagaguuuauaauccaguaguuuacaguauaaagcugcucuaaaacaacuguaugaauugauugaaacugcauucuuucugggucacaaugggucaaaucauagcaauuucuuuugguuuagcauuuuuauggagaaacccaaaauuuaacugaguuuuuaugggaguauaaauggcucccuuuuuuauuuuaaaaauccuuuuauaugugaucugauuaaaagcuaauuaagggaacaggugacaaugggaagaaauggauugaggagaagaaucucacacaaaaucaaaucauugugguguuuacagugaaacuugugauauuucacguuucuguagaauaauauauuuuuuaugguaaugauuaucuuagaguucaaauuuuuucauuuauuuaugcccugguuuguuucuuacaaguauuuaagguaguuaaauaacugucaagucugugauagcaggaaauugaaaggaacaauugaaagaaugugaguuuagaaaagaauuucaauagauuagaaagauaaguguaaauaacauaaaaucuaaugagauaauguauauuauacauuuuaaaucagccugucaucugcaaaaagggaaaauacugaucugacagcaauucauuuagaaaaagaccuaggaaguuuuguaucuugugauuauaguaugaaucaacauuguauuacaguuaccaaaaaggcuaacucugucuuacacugcauuaauagaagcauauugucaugaacaaaguuaauacaagaacuuggaucuuuuauacuuuuugcuuuauuuuuagaucuuuuaauuuuuauggguacauaguaggggugugugugugugugugauacggguauacaaugugaaauaaucacaucauggagaaugggguauccaucccccaaacaaauauccuuuguguuacaagcaauccaauuacacuguuuuaguuauuaaauguuucuguauuuuuuagaggauaacuauaauguuugguuugguucugaguaaaguaaaagauuuuuagccagaauguuauagaucugugucuuauaaaaaauggaugaaggaauugacuuaguggaaagcucacauuuguuuuuaaacaugucagugcuugugauuuagcaaagguauugguccuuacucuuucuuguaccaaaagacagaacuaggauuagugaguaggagguuucugaaauguguauagcuugucaaaaaaucuggaguucaguugggauuuuauaauugauuguuaaacauuuacauuuuacauuacauuuuuuuuuuaauuucuuuuuaagucccauagugcugagaacccugaaacuuuggaugaaauuuauaauagaaaaucuguuuuacugacguugauagcugugguuuuauccuguagcccuaucugcgaaaaacaggcuuuguuugcccuguguaaaucugugaaagagaauggauuagaaccucaccuugugaaaaagguauauauggaugaguauuuuauuagaagcuuccuuaggucacugugaaauaauuuaaaaaguuaaagcuagauuuucugaguggcacuuauuuaagacuaggaaacaauuuuauuuuuuagguugggaauauuggaaagcaguuauacaaaaacuauucaaaugguauauuuaugguaugcacuguuucuuacauuccauuuaagagcauuucacaaggcuuucauuguacuaacaagagugaaugacuuguccaccagacugaccaggcuuuuggaaauaguauuuauugagggaaacacauggagacaagagcagcauagguguuuugcccgguagauucuggggcagcacauugggauccagcagggccagaagucaaauuuuagagcuaucaggcuuuuaaguucaguuaucaggggagaaggacuaggguccaagccuuauaauuacuacaucagcacaguauuauagaauguuggccccgucucuuuuccaucaccucagcauuuaugguuuaggaaguuccagaccuuuccauugcaaauuuuuaugugauaaaucagugguaggucaguggacugauauuaugccaguuaacauucuaccagcauaguuuccauggugcuuuggaguaagccagccuauaaucaguuagccuuuuaccucucaguauaagacuuguucgguguuucuuaaaaguauacaaauacauuaccuaauaaucauaaguguuauguauuguuuggauuuuucuuauuuggauuuaagccuaagagaaauaauuuuacuuuauauuuauuuauuuauuuugaaagacagggucucacucugucacccaagcuggagugcggugaugugaucauggcucacugcagucuugaccuccugggcucaagcgauccucccaagccuccugaguagcugggacuacaggcaugugccaccacaccuggcuaauuuuuuuuuuuuuuuuugagacggagucucgcucugucgcccagacuggagugcaguggcaugaucucggcucacugcaagcuccgccuccuggguucaugccauucuccugccucagccucccgaguagcugggacuacaggcgcccgucgucacauccacacaccuggcuaauuuauuauacagacgggcucuugcuauguugcccaagcuggucuugaacucuugggcuuaagcaacccucccuccucagacucccaaagcguugggauuacaggugugaaccaccacuggccaguaauuuuacauuaaaucuuccuuuaaguauaaccaaauguuggaaacucuuagcauauuuuuauauuuuuauuuacuuaacauuuauuaaggguuugcuaugugucagauacugugccaguugaguacauuuucuuaauuauuauucccaucucauagaugaggaaaucaagaaaaguugaaugaauguuguuucuagguccuacucuaaauaauauuaacaagcauuuaaaugauuuauuuuuuucauuuuucuuaacacauugacuuuuugguucgugcagguuuuagagaaaguuucugaaacuuuuggauauagacguuuagaagacuuuauggcaucucauuuagauuaucugguuuuggaauggcuaaaucuucaagauacugaauacaacuuaucuucuuuuccuuuuauuuuauuaaacuacacaaauauugaggauuucuauagguaaguuuauacaugacauaugugaaauuuguuuaauuuaaaauuaguuaacaauacuuagcaaguccccucaccagcaacacacauaccauacccauacacaugugugugugggagccuacauaguaugagaagcaggacagcuucuuuuaauaagaauguauugaagggagucacuggacuucagaucugguccuagcugugccaacaaccagcuaucugacuuuggucaaaccacauaaagacccucuaugccuugguuuuuuaauauguaaaguaagcaaguuacacaaggagaucuuucagguccuuuucagcuuuaauauuugaucaucuuuccuuuggaaaaaauugaagauaaauuacuaguagcugguuauuucugccuuguuuuucuuuucuguugcuugacuauaggccucuuaguuauuacuucuauuagauuuagaaacuuaauguaaaacuuuauuuugcuaacuuuaacucuguagaagaaaaauuugaaaauggagagguuugaaacaacuaaaaaguaauguuuagguaucaggaugaugggaaggcaucucauauuuguugaacaugcucuguguuauggacuuugcuaugcauuuuacauguaguguaucacagaucugaguuucagacuuauccuaauagaguuuucuaauagauuaugaguuguauguagguaguuuccuuuaagaaggauauuccuacaaaaguaaauuuagugguccuuauaguucauucauuuuggcaagaacaauauagcuauaucucuguauaugcgagggauucauuccaggaucccccauguaugccuaaauuuacgcguacucaagucaccaaguuggcccugcagaacccacguauaugaaaagucaguccucuguauauacagacuuucacauccugugaauacuguuuuucuaucugcauuugguugaaaaauaugcaaguauaaguucaaacccauguuuuucaagggucaacugcauuuauguuaguugauuaugcagaagaaauaaauauaaauucaagucuccauuuuuauuuguuuauuguuuuguuuuuucuuuuugcuaagggugcuacugaacaaggucccauuuuuaaaucccauaauuaugguggugguauguucuaagcuuucuaauuuuuuuaaugugacuauuuagaauuuacuuaauuuuuccauuuauaaaauuaaagaauguuuaauaaucuggauaaaguaugauacuuuaaugcugaugguauuaaaacaguuuuuaagaacuauuuuauaaaauuuuacuuggaaaaguuauauauaaccuguauuuuaaauuuuucuauuuuuagaucuuguuauaagguuuugauuccacaucuggugauuagaagucauuuugaugaggugaaguccauugcuaaucagauucaagaggacuggaaaagucuucuaacagacugcuuuccaaagauucuuguaaauauucuuccuuauuuugccuaugaggguaccagagacagugggauggcacagcaaagagagacugcuaccaaggucuaugauaugcuuaaaagugaaaacuuauugggaaaacagguauggcuucaauuuuuauguacuuuucauucccugaaugauaugagauauaaccuuuaaguuuuaaggcuauuuauucgauuuauucguauuuauauauugaaacuuagcuugugguaaucauuaucuagcauagccaacccaugaauuuuuuugguuaugucguguugucucccucugauuggcuuuuaacuaaguagaaauguuuuaaauuagaaauaauccaaaaaaccauuugaauaauuuucuucugccauuuaaaaauuuauuuuaacuguuguaauacacgaaugcaaacugguuguuaaagucaaggaauacuaaacaguguacagaaaaccuucacucccucuucaaucucaccaagcuuuccacuuuucaagaaaaacaaccgucccucauuccuauaguucucauacccugcuguuuguuuuuuugugacacuuauuaccuucuaauguaugauacaauuuaccuuuuuuuucugucuuugcuuuuguuuuugagacagagucuuacucuuuugccaagacuggagugcaguggcaugaucucaguucacugaagccucugucuccuggguucaagcaauucuccugccucagccacccaaguagcugggacuacagcugcgcaccaccacacccagcuaauuuucauauuuuuaguagagacgggguuucaccauguuggccaggcuggucuuuaacucuugaccucaggugaucuucccaccucagccucccaaagugcugggauuacagauguaagccaccuugccagaccauaauuuacuuuugaauuauguuuauuauuuaccagucuucuccaguauacauuuuucucucuuuuuuuuuuuuuggcugauguaucucuaauauauuuugaguauucauuaaauguuugucaaaagaaggagucaaguaaggaaggauuuaaaaagcuucguuuguuuuauaaucauuuauauacauuuccaaaauuuuuugaagcaacuuauauuaaaacauacauacaaauuuuuuaagauaaaaaagcuguggucaccccacauuuauguauguauuuauuuauuuuggauauaaguaagggauaaguaaccaaacuuggucaauauuagauaaacuucaagggaccuuuuuuuuuuuuaguuuccuaguuaucuauauugaaccaagaaauggaacagcaaguuccuuaguugcuuagguggaccuauucagaacugguuguaagucugcagucugaagggaaauggugagcagaggacuccuuucccaaagacagcuggaacagaaauaggcacuccagagguuauggaauuugagagagauacucagccucuagccacucccauucaaucucccagcuuagucuucugagcauucuuaaucuuacuauucuuuucuuaauguauucaaaccaaaagacagcaauuuuuagagccugaauagguuuuggagggaaaaguaauuacguucaacuucgauugaaacucuugccucaagaaugaagaacagcaaaaauuaaaucacaguuucuuagcuuuuugguuaaagauguaaguuaaauucuuggccgggugcgguggcuaacgccuguaaucccagcacuuugggaggccaaggcggguggaucaccugagaucaggaguucaagaccaaccuggccaacauggugaaaccccaucucuacugggugugguggugugugccuguaaucccagcuguuugggaagcugagucaggagaaucacuugaacccgggagguggagguugcagugagccaagauuguaccacugcauuccagccugggcaacagagcaagauuucgucucaaaaaaaaaaaaaaaaaaaaaaaaaagaauuguauaaaacacacaaacaaagcaaggaaagaaugaagcaacaaagccagagauuuacugaaaaugaaauuauacuccacagagugggagugggcccugagcaaguggcucaagggccugguuacagaauuuucugggguuuaaauacccuucagagguuuuccauugguuacuugguauacacccuauguaaaugaaguaguggucuguaaucagucugauugguuauaggaggggaccaaucagagguacuuucaauuucuuaucugccacaguaaaagggaggggguugcaaagggaguagccucuuguccuuuuguuacuugagcauggaaaguugggguuuuccuuuugauuucguucuaggaggucagcauggauugaccuuagguucccugccuccagaccuuauugcccugccucauuuacguuagguuucuuucuugucaccuucuaaaauauuuuuuguuauuaggaaguauguuuuugaacuuccuuaugcauuaaguaaauuagccauuuaucacuguaauuccuuauuuggaaaguuguuauauucacccuuaagacuucacaauucucauucauuuaacuaaagugcaacauagcagacuuauucuuuauauuuagagaauuugugucuuuugugaagcuaccugucuauagugggaaguagauuaaugaaaaguccaaaucuguuggggaggguuuuauucuacuauugaugaaaggggauguggaucgcagcuagccuuagaauuugggauggcacucaaguagaagucugggaagaaguuacgcagggaacaaagaugacauuguucgcagucccugggaauucuuaacaguaaaguucuguaauugagacagaauucccaaauaaagucaagaguaaaauucagauagaggagcaguuauacaucagugggaaauuugguuggcagaaaaauuaccaggucauacaacuuaaugauagaccugaagucuuauuuaaaaugauucucuaaaauugaagaauuggauuaagggggccuuguuuggcugauuuucauacuuuuuccucuuagucuacagguuggcugcauagaagaaaaagguagaguuauuuauaaucuuguaaaucuuggacuuugagucaucuauuuucuuuuacagucaucgaauacuuuuggaaauaagguaauauaugccuuuugagcugucuugacguucacagauauaaaauauuaaauauauuuuaauuuugugcccuugcagauugaucacuuauucauuaguaauuuaccagagauugugguggaguuauugaugacguuacaugagccagcaaauucuagugccagucagagcacugaccucugugacuuuucaggguauguacauuuuaaacuuagagaacuagcucuaacuucacaaguuuuuaaagaaguuuauugguugacaccuucaaugucuauuucaauuuauagacaucacucuuuuuaaaaaauuuucuuuaaaaauagccaccuuugaauugagguaauuaccuauccucuuuuaccauagucuccccacaguaauuacucuuucuaaauugaccacuugguuggccaacccaauaaccuuuucuuagucuuucuguaauauuugaacauugugccaucuguuggcccuugaaauuuuuuucuucauacacauuauuccuaguucucuucucuuuaucuaggucuugccuuucuagaucaccuuuucuuuuuuuuuuugagauggagucucacucuguugcccuggcuggagugcaguggcauaaucucggcucacugcaaccucugucuuccaggcucaagcuauccuuccuuccaccucagccucucgaguagcugggacgacagaugcacaucacugcgccuggcuaauuuuuuauauuuuugguagagacgggguuucacuguguugcccaggcuggucuugaacuucuggccucgaaugauucccccguguuggccaaccaaagugcugggucuacaggcaugagccgccguacccagccucaccuuuucuuuauugugcguuauuaucuguacaauuuaauuuggaugugaaugucucugaguuguauaugaacaucagaguuguuucccuggcuugauuguaagcuacuugaaaauaugcuuuacuuuuuuuuuuuuuuuuuuaaugugcccuacugugcugggcauauaaaauaguaauaauaucugagaaaguacuuucacauauguaauuucaugcugucuaaauaaguguugauugccaugucuuaaaguacugcuuuuacaguacuggcauagagcuuugauucugaucugaaguaauacugaggcucauuuauugaacugccuuuuaacuuuauaagauuuuuuaagaaaaucauuauaagaucauuuaagauuauuuaaguuacugagggugaaagguauuuagauaaucugauuuauauaucuggacugugauaugucauuugugauuuuauugaaaguauaguuuuucaguagaaaaaugguuuuugaauuuggggguuauuaaaaucuaaauuuucauuuuggaaguucacuggucuaugaacaaaacuuuuuaaaacgaugacuguauuuuuucccuuaacucuguuagggauuuggauccugcuccuaauccaccucauuuuccaucgcaugugauuaaagcaacauuugccuauaucagcaauugucauaaaaccaaguuaaaaagcauuuuagaaauucuuuccaaaagcccuguaaguauacaugaugaguuuaauaauagaacauuccuucuuuuuuagcuaaaaaaacuuuguaaauacaucuuaaagaggaaaaguaaacaaaugaaaaauuuaucucauaauuaaaaaggaaaacauucauuuacaaguuuaaaugguauuuuacuugucagcauuaauugaaauauguuacauaugagaacagaaucuugugacacuuuagugauauauuagcucagggaauauaucuacuuuuucauaggaauauacuauuuaauuguaguuuacuuucugaaaauuaaauaaauuggcaauaguuuaagauaguaauuuucuuaauguaacauuuuguacuugauaucaaacccaaaucuaaauucuguuauuuaguuauuuuaaauauaaaauguguagguauucaaauauuugaagaaaaaauauaaaguguauuuauuguagccgaguaucuaauuaaacaaguuuuuacuaaaucuguuuauuuucuaggauuccuaucagaaaauucuucuugccauaugugagcaagcagcugaaacaaauaauguuuauaagaagcacagaauucuuaaaauauaucaccuguuuguuaguuuauuacugaaagauauaaaaaguggcuuaggaggagcuugggccuuuguucuucgagacguuauuuauacuuugauucacuauaucaaccaaagguaaauaacauauuuagaccaauauauaagcagucuuucuauccuguucuuccuguuuuuuugcuuuguuuuguuuuguuuugagacaaagacucacucuguccgcccaggcugggugcagucacggcucacugcauccucaaccuccuggguucagauuauccuuccuccucacccugccggguagcuggggcuacaggagcauaccaccaugccugacuaauuuuuuguguuuuuuguagaggugggguuucaccauauugcccaggguggucucaaacuccugggcucaagcgaacugucagccucagccucccagugugcugggauuacaggcaugagcuacuaugcccaaccuauccuguucuuuuaauugaaaguuuauaugcuucuaagagguagauaccagaauguugcuuucugaauuuugcuuuuuaagaugucuauuauauuuacuuauuaguuuuuaaaaauugcgcuacuugccugggaaacauagcagaccucguuucuacuaaaaauuuuuuaaaaaagaaaauuagggcaaggugugguagcucacaccuauaaucccagcacuuugggagguugagguagguagauugcuugagcccaggaguuagagaccagccugggcaacaugaugugaaaacccaucucuacaaaaauuuuuuaaaaaauaagccagggauuguggcaugcaccuguagucucaccuacuccagaggcugaggugggaggauggcuugcgcucaggaggcagagguuacagguuacagugagcaaagauugugccacuacacuccagccugggagacagagcgagacucuugucucaaaaaaaaaaaaaaaaaaaaaaaaaaaaagaaaauuauccaaguaugaugauaugcgccuguaguucuagcuacuuaggaggcugagguaggaggauggcuugagcucaagaguuugaggcugccagugagccuugauugcaccacugcauucaugccugggcaacagagugagacuuucacucaauuaaaaaaaaaaaaaaaagcacuacuucuccaauucuagaaaucuuaagaaggaucuucaacauuuuaauacuaauauucuagcuauugauggccucaaauaaauguuacuauagaauugggguuguucggccggguguaguggcucacgccuguaaucccagcacuuugggaggcugaggcggguggaucacaaggucaggagaucgagaccauccuggcuaacacagugaaaccccgugucuacuaaaaauacaaaaaaauuagccaggugugguggcaggugccuguagucccagcuacucaggaggcugaggcaggaaaauggccagaaccagguaggcagaucuugcagugagucuaauucgcaccacugcacuccagccugggcgacagagcaagacuccgucucaagaaaagaaagaaaaaacaaaaacaaaacaagaauugggguuguucaauuuagcaucucugaucuuuuccauugauuuuaaugagauuucuauuuuuuaaggucuuuuuuauugugguaaacuauauaacauaaaauuuuuuauuuucgccauuaaauggccaguucaguagcaucaauuacauuuccauuguugugcaaccaucaccacugucuauguccaaacuuucauuaucucaaacugaaccucucuacucauuccacaauaacuccacauuccuccuccccacuggccauugagaaacuaaucuauuuucugucucaaugaauuugccuauuguagauauuuuaaucuagaguuguacaauauauguccuuuugugucuugccuuguguggucacugaaaacuuuguaccuuagcuuguguuuagauaguguuugauagagauuuccuuggauaccaagaguguugggaugaggaagcaugagaggagaaaacuuuuccuaguguuugcagauuggcuuuaugcuaggauucuucuucaacacuuagccaugcuugcauugcuugggaucagccccaaauacaagcuuagggucuucucuggucuuuucugagcaagagucuuaucuugagcauguguguggcuuucugaauucccccuaauuugugggugcuuuugaauauacuaauuucccaaagaaauacgcuccccagcuacuccuaggcuuuaggcagccucuuguaugucucaacaguaaucuuuugcccuaugcaccugcagguuguuggucugccuuacaaaguuucaagcaacacccauaucuuuuguagcugguaugaaguuaaacaaaacagagcuacgcacuuuacaucaguccuugguuccagacagguuagaauagacauauacaauaguuugcaacuaaucuacuuagcuccaugaacuaccaugagccagugucucacaccgaggauauaggccacugcuuuugugauuguugccacgcugggguaggggugggcaaggacaaguaaaguuaccacaaagcuuuccugcuguuuuucaguuggauuuuucuugauucaauauuuuccugauuacuguaaaccuuugacuauuuuacagaauucuaacaaaauuaguucugacaauuuugccuguuuuucaauguuucuauuaaaggauggaagcuuagagcugccuauucugcauuuugcugaugugacuucucuuuuuggcuuauaagccauuaaaauauuuaugucaaggcauauaagaauuagagaugcugaacaaaaggacuucugaaugaauuuauuucagaguaauuuuccagaacuuacugguuguuguuguuuuuuuuucucccuauauuaggccuucuuguaucauggaugugucauuacguagcuucucccuuuguugugacuuauuaagucagguuugccagacagccgugacuuacuguaaggaugcucuagaaaaccaucuucauguuauuguugguacacuuauaccccuuguguaugagcagguggagguucagaaacagguaauuuucugacucaucuucaaaaugguauuuaaaauauauaaaguauuguuagaaggauuugaguguuuuauguuuauuugguauaauuggugauuuuauugagaauauuuuuuguaaaaugauuggaaaaauauucuuaaugaauuaaccuuuguaaucaauuacagagcacuugguacuuuugauaguuuuaucuacugugcugaaguagagagguagucaaaacuagggauagcaguucgcaacguuauggugguauuugaguuacuacuuauauaaacuguuucauuaauauuggcauuuuuuuuaaccucaguacccaucuuguaguaguaccuuacauaguuauugaauuauuugaaaacacagaaacuaaaagcuggguaucuuagacguaauuagaacauuuaaucugaucuagguuaauagauuuuaucauuuauuacaguaaguuuuguuggcuuacuuuaaaauuauuucucuccuuauaauuuuuucuuuuuaaauuauauuuagguauuggacuuguugaaauacuuagugauagauaacaaggauaaugaaaaccucuauaucacgauuaagcuuuuagauccuuuuccugaccauguuguuuuuaaggauuugcguauuacucagcaaaaaaucaaauacaguagaggacccuuuucacucuuggagguaauaaaaauuucaucaucuacuauuuuuuauuagagaacauaguaguacuuuucaaaaaucuguaaugcucuagcaguaaaaaauggaaucuuuucuuuaauugugauuaaaaauauauacguaggccaggcacauuggcucaugccuauaaucucagcacuuugggaggcugaggcaggaggauugccugagcccaggaguucaagaccagccugggcaacauggcgaaaccccgucucuacaaaaaauuagucgggcauggugauaugugcuuguagaaucagcuacucagguagcugagauggaaggaucaccugagcccuggaggucaaggcugcaauaagccaagauugcuccacugcauuccagccuggaugacagagugagacccugucucaaaaaaaaaaaaaaaaaauauauauauauauauauauauauauguguguguauauaaacacauacuuguguguguguaacgugagaucuaccuacuuaagaaauaaaaaaaugaaucuuaauguaucucuuugcauugaagccaaaguauaaauaacaaaacuuccugguaaagauccaaauuguaaguuuucaaggaaugugauguaaaauaguuuugauuuuaacacauaagauccuaagguccacugauagcucaaaacuaccaauggaucuuuucaaugucaauuuaauguuuguguuagagauaacguuuaacuuuugaaagcauauuuuaaguuuuaaucuuuauaaaccucgaaauuauguuuagguauauucuuccauacauaucuuaauuauaauuuuuaaaugauagucuguauuugacucuauguaaauauaaaaacauauuuaaguauguuaagauguaaaguuauacuacuaaagagaaauuuaagcauuuccuuccaguugaguaugcuauaacaaucuugaagucuguguuaccaugagagagucuauuagaauuuaaaggauuaggcugggugcaguggcucacgccuguaaucccagugcuuuggaaggcuaaggcgggcagaucaucugaggucaggaguucgagaccagccuggccaacauggcaaaaccccaucucuacuaaaaauacaaaauuagcugggcgugguggcacauuccuguaaaugccaccuuuucaggaggcugagacauuagaaucacuugaaccggggaggcggagguagcagugagccuugauagcgccacugcacucuagccuuggugacagagcgagacucugucuaaaaaagaguauuaaaacauuguaggguuugcaguggaagaaaucauuuauuucuuccuugauuaguaguaauagagacaugagucagugucuauaaauggcacuuaacuaauuuuuuucuuuuauuaaguuuuauuucacaggcuuaaccaauacguguuaaaagcaaguuacauuuucucuuuuaggaaauuaaccauuuucucucaguaaguguuuaugaugcacuuccauugacaagacuugaaggacuaaaggaucuucgaagacaacuggaacuacauaaagaucagaugguggacauuaugagagcuucucagggugcuaauuuuaaaugacaugggcuauuucuaccuguuucuuuuugaaagaauauuuugcaaagucuugcucuugguuucauugucacagacuuaguucagacucucaucauuuaguucagacccucauuucucaucuaacuguaaaacugguccuaacuggucuucucacccugaacucuuccuguuuuauucauccucugccagaugauuucucuaaacccaaauaugaucauguuuuucuacugccuaaauuuuuuuuuuaagagacagaguuuuuuuuuuuuuuuaagagucucacucugucaccuaggcuggaguguaguggcaccaucauaacuuacuaugaccuugaauuccuggguacaaggaauucuccugucucagccuucugaauagcuggaacaacaggcacacaccacuacaccuagcuacuuuauuuauuuuuuuuauuuuuuguagggacaggggucccacuauguugccuagguuggucucgaauucuuggccucaagugauccuccugccuuagccucacaaagcauugggauuagaggugugagccacggcaucuagccaugcuuaaacauuuuucauuucuuuuucuuuuuuuuuaagacggaguuucgcucuuguugcccaggcuggaaugcaguggcacuaucuuagcucacugcaaccuccaccuccugagcucagauucucgugccucagccuuccuaguagcuaggauuacaggcaccugccaccaugccuggcuaauuuuuuguauuuuuuuuaguagagacgggguuucaccauguuggccaggguggucucaaacuccugagcucaggcaauccgcccaccucagccucccaaagugcugggauuacaggcaugagccaccgcggcuggcccaugcuuaaacauuuuuaacaccuuccaaccauguaaaagaaaauuuuaauuccuuagagccagacauacaaguuagucuugucuucuaguccaguuuaccugaaugaaagaaauaugucucauuuuaauacuuuagucauauguguuaugugugucuauauauauguaaguauguauuuguaaguuuuucuagcuugcuuguuaauuugauuugaaauguacauuauuacaguauuugggaaacuuucuacuuuguguuuugauuuucaucuuccuauaccaauuaauuucauauuucuuuuuuuuuuuugaaacgaagucucacucugucgcccagguuggagugcaguggcacagucucagcucacugcaaccuccaccuccuggguucaagugauucuccugccccagccucccaaggagcagggauuacaggugugugccaccaugcccagcuaauuuuuuguaucuuuaguagagacgggguuucaccauguuguccaggcuggucuugaacuccugaccucaagugauccaucugccucggccucccaaagugcugggauuacaggcgugagccaccacgccuggccuaauuucauauuucucuuguguuguuuuuacucucaguacuuuuuaaaaugaauuuuaguuuugacuaucugagcauagaguuucuaauacauuugagauauauaaaauguauguaaauagaaacaccauuauuucuuguacuuguguucuugaguauuuuaugggcuagagaucugccuugugcauuacagccacuagccauuuggcuauuuaaaugaaguaaaauuaaaugaaauuugaaguucaguuuuuucauugguacugaacacauaucaaguucucaguaguacauuuggucaguagugaucauuggacaguguagauuauagacauuuccaucauugcagaaaguucugugggacagugcuggucuaaacucuaaauguuagauguuaaaaagccaagcaggcucccaaagucccuucuagcuuuaguguugaaugauucuugugcuucuguuugugauuuugcuaagguguugacuuaucugcacaauuuguuuaagacauuuuauuuucucuguugucacauauugcuaaucacuuucaaaagaaucuguuguauuaaggaaguucagauucauucccuacauauuuuuugagcuacucaugacuuaaaaccuuuuuuaaacuuuauagaaguuuucuagucagauaauuuaauauauaugcaauuauaaacaaaaguguugucuucaugcuaguuuaaacuaauuuuuaaaaaauuauuucuagauaauccgcaagaugggauuauggugaaacuaguugucaauuuguugcaguuauccaagauggcaauaaaccacacuggugaaaaagaaguucuagguaaacuacagucaugcgcugcgugacauuucagucaacugcggaucacauauaggacagauuauaauacuguauuuuuacuguauguuuucuguugccuguaguauucaguauaguaacaugcuauacagguuuguagccuagguguguaguaggcuauaccaucuagguuuguguaaguauauucugugauguucacgcaaugacagaauugcccaaugacacauuucucagaacauaucugugucauuaagcaaagcaugauuguauuggcggaaugaaugugaguuaugcgguggucaucuuuauuauaugagugguuaucuuuauuauaucuucaaaauaagugaggguuugucauuugggauauuggggaaauaugagaugcuagcuaaguuacaugccuauuuaauuaaaaugucccuaaaaaggccccuuuuguacuuuucuuccuuaaauauucauauaaaaugaaaaguuagagauuuacauauguguauaacuuaauuugaaaaugccuuguaaauauuuaggaaagucagaaauacuuguuuuuagaguuaaguugcaaauaaauugacugccgauauauuuuauaaauacauuauaacugacagguacucagugucuuuuguuauguagcagacauaagaaugaagacuuggagggcuagauuaaacuuaaauaauuaaaaaccauucaaguccuuuccuacagccauuugaggggaaaccuaauguaaaauaagaagccaacaucaucucuaguuuagguguuuagauuuagugaccacgggauggagaaaucaccugguuaaagucagcuugaagcucucgugaugguuuuuguuucuaauuagaaaaauaggaauaaguaguguuucacagauucuacuaucuuucuucaacagccuuaacuucucauuaggagccuaauaucuacaguacuuccuuuuuuguagauuuuaaaaaauugagauauauccuaauauagaaaaguauacagaucaaaaauaucuagcuugaagaauguuugcagaguacgcuuguacauguagcacccagacuaaaaaacagaaucuuaccagaacuguagaaguuuucuuuaaccaacauacuuaccuccuuguccauaguggcacugcuuuuauggacagaccugauuuacaacagaagcccuaaguggcuuuccuguguagcauaaaauuaaugugguuuguucucacagcuuucccccuaagaucaggaaugagacaaggcuguccacuuucacuacugcuguucaacaguguacuggaaguucuagccagagcaauuaaacaagaaaaagaaauuaaaagcaugccaauuagaaaggaaguaaaacuaucuguauuuacagacgacaugaucuuauguauggaaaaucccagagaauccacaagaaagcuacuguagugcuaauaaaugaauuuagcaaaguugcaggguacaagaucaacacauaauuagugguguuuguauauacuagcagugcacaauccagaaagaauuagaaaagcaauuccauuuacgauagcaucuaaaagaaauaaauagccaggaauaaauuuaaucaaagaggugaaaaacuuauauacauucuguuuguuagacgugagucacuaaguacagaccacacucaacgggagggaaguuaggcucuacccuuugaaagaagggcucucaaaaaauuugugaacauauuuuaguaaauaccaucaugauggaaagagcacgaagagcccucuggguugcugaaaauguccugucuucaucugguuagggagaacacaggcagaaaaaaauguguauuuguauguauaaauuuucauugaacuguguguuuaagauuauggaauuugugugauaccucaacaaaaauuuuaacaguuuuaagguugauucucucucucuuuuuuuuuuuuucuuuugucacccaggcuagagugcaguggugccaucuuggcucacugcagccuccgccuccuggguucaagugauucuccugccucagccuccugaguagcugggauuacgggccugcgccaccacgccuggcuaauuuuguauuuuuaguaaagauggggcuuuaccauguuggccaggcuggucucgaacuccugaccucaggugauccgcccgccucugucucccaaagugcugggauuacagucgugagccaccgcacucggccuuaagguuaauucuugaaguacagaaaaacagcauuauaguuuugaaauuagaaaauuucaguuuuauguaugaucucuuaccuaugacucuacugaaauagaauuucuauauguagaggcuguuggaagcugcuugggagaaguggguccuauagauuucucuaccauagcuauacaacauaguaaagaugcaucuuauaccaaggcccuuaaguuauuugaagauaaagaacuucaguggaccuucauaaugcugaccuaccugaauaacacacugguagaagauuggugaguauuuauugauaccuuauauguaaucucaauaugacauucauggagaaugauacuucacacaaauagauauucucaguaacuaaagcuuuguccuuuuuuaaaucucagugucuuuaugaaaauucuuauauuuuuauuaauucacauaauuauuuacccuacuaugugccagacacuugauauaauggugaacauuccagacaaggucccuguuaaaauuuuagugggacuagacaaauaaacgauaaauaagaaaaaugccagaugguucuacacagaaaauuaagauaggggaauauaaagggagauguuuuaggcucuugucaguaucagaggugccacucuccucuaagcgaggccuuauuuugauccuuuuaaaauaagucguaaagcagagagguuguuuuauaauccuagaagucuuaagcuaaucagacagggucuucuauuacuuauucucugugcaaagcagaauugcaccacauaucaaaauuucaacugguugguugagauuacuuuugcgugcaugcucuuucucucucuuauuuauuuguugauugauugauugguaucuuugaguacuccaucaccaccauauuugaugguagccucaaaggguuuuccucacaaccaggcaccuuucuaagauaaauacguguuuugauuuuuuucuguacuucccuuccuccuucucuugaggaauaaaugauuggcaauaaugucuaacugccauguuuccguuauugauuuaauguaccuguauauuucuuucuuuuguuguuguuuuuguuucauuaaacaaauuuguaugguuucuuuccaaacauuuuauuauaaaaaguuucaaacauacagcacaauggaaauaauuuuauaguaaacacccauaugcuuaucauauaguaucuauauuuuaugcuguccuugcuuaaucacuucuagccauccgucuauccuuguguuaacauguauuaauucaucucucucuuuuuuuuuuuuuuuuuuuuuugagacagggucucgcucuaucacccaggcuggagcgcaguggcaugauaauacaucauagaucauagcugacuguaaccccaaauucuugggcucaagcaguccuccugccucagccuccuaaugugcaaaguuuaugugcuugagccacaccacacucagccaguucaucucauuuuuuaaauguauaucaagguauaucaagcacaguuuuugaagagagugccacagaaaauuugcgagcauuaaauguuucauucauuucauaguaauucgaaauugguuuuucugaaacagaugcacagaaauauuagugugacuucaacuuaagaauacuaggaagcagguacaaguuuuuuguauuuuucuuuaacagggaaaaacuuuagaucuucaagggacuuuagcauaugaagauguggacaaaaggauucccagaauuuuuauuacuuauauguauuagaacauauuauuuucaaguauuucuugagucuuuuuaauuuauaguagucacaauuaaacuguauugaaugaagggaauugcaguugcagugauuaguaauucaaguuuacugaaugacuagugaaaguccuuugauacuuuuauuugauauuggagaauuuuguaaauguaaaguuuccuaauacaaauuuuaaauuuuaguuuugaaauuuuuucaguggagguuaacauucaucaagauuaauaacugguguacuugauaggcauuugaauuguuuuuuucagugucaaaguucgaucagcagcuguuaccuguuugaaaaacauuuuagccacaaagacuggacauaguuucugggagauuuauaagaugacaacagauccaaugcuggccuaucuacagccuuuuagaacaucaagaaaaaaggucucuuaaguaauaaauguuuauugaauacccagcauaucuaaaacaguucuguuugcugugggucaugacuguuaaauugcuugaaauaguauuguacuaacuauuaaccuuuccuauaaguaauuuaagccauauuucauaaauccagggaauguguuauuuuuaauuuauuauggcaguguggaaaagcucagauagguaaccugaggaaauaguaguugauuuuugggggaggggaaauucuuaaagacagaccuuguuuuuuuagaaauagaaagcgcuacuuugcucccaugaaagcuguuagcucuggguaugguuuauaguuauugugauccacaaguguuuauuuccaugucaaguuaacauaucacaauccccuggugaaauauaggaagacccauagauuucucccuuuuuccauguugauaucguaauaagguuccacuguaaguauucugugaagcauguuuaagaacacuuguuccuuccuuagucuaagcauuccucuuuacuaucuucuuuucauaaagugacugagaaauacacaguuuaguuuucaccaauuuaauuucagggcagaaacccaacauugaagcaguacuuucagugcaucauaaauauaauuuuaguguuaguaaaauuacugguaauauaaacuguuaaugaaacuaauaauauaaccuggaaggcauuauaauucuaacauuuuaaaaucucauuucauuuugaaaucaagucucugugguagauguggucuaguuuuguucaagagacagaugagucagaguuugugauuuguguaauaugcuacuaaugagugacagagcugagaguagaaccuaauuuuucugcugccuaaagcagcaguuuuugccauaccacucugccucuuguauaaacauaaauguuuucaucuuaaaagguaaacauugccuccagauuuaguuuuaacuguauuuagcuuuauucagaaagauuuguuauacucauuuuguguaggaaagguacaaugauuuccacuucucuuauuuacauuuucuaaucccuuucuuucuaguuuuuagaaguacccagauuugacaaagaaaacccuuuugaaggccuggaugauauaaaucuguggauuccucuaagugaaaaucaugacauuuggauaaagacacugacuugugcuuuuuuggacaguggaggcacaaaaugugaaauucuucaauuauuaaagccaaugugugaaguaagaagauuaauuagucugauauaauuccuuguuuaugaccuguuuaucuaaagagugcugugauacugcacaucaucuucacauaauaucacccccacucaaacuguuguaaauuuauuaaagugagcauccguauuuagucauaacuuuaugcauuagguuucagcuucgggauagcaacauacuagaggaguucuaaggggugccuugaauaauuuguuacuaaugauaguuaaaauacugcugauuauaaauuauuugcauuaaccaagagccuguucuaacuuuguuuacgucuucugauaagagcaccuuuauuuucccugauaugcuuucuugaauaagaaaaaggaguggggcagcaaucagcauagcuuuuuuauuuuugaggauauaguacaauuuaucucaacgaagaguaaagguacauaccaaaugaaacaaaguuuguacucuuccaucaaauguguaaucuaaaacagcauacuaugaugcucuaagauuuacagaguuaauuuauagcacugucaaaugugauucaacagaaaugugaaaauacaacaucugaugaggucaaacaucugcugauuacagauaacugauagagaaguauuuucguaauguacucacauugaaagcaauguaagaagcaguucuuauuuucuacagaaaaaguagugacagugaauaaaacaucaccuucucugcaauacuacaccgcacucauaccaauucagcagagugguacccugaacacacauacagcuuauuucucauuagugaacaaagcuaagauuuuuauaaaguuuuaccuuugagccagaaaauaaaauguuccaaauauacauauguacacaccccauuugugguacuuuaaauucucuagcucuaaaacugguguuuugccuugucuuugguuugaaaaagaaaaagggugcaauuaguaaucuauaaccugucuuaugugugugaaguaugaugaauaugauggauauggaguguaaugauucauucauauguuaaauauggagugcggugaauagcaaaaguaaagcugaauacuguuuuaaugugccagauguauuggagcacuuuucugcucuuuggaauauaccacaaauaauuacccaaauuuuaugcccagaaguugggcuuauuaaaaaauaaacauuuuuaacaugacuguuguaguucuucacugagguuagaaaaugcauaaaaaucagauuuccaacuuuugucuuaaacuuuugauaccuuuuucccucuucuaucauaucagaaaacuccuucuguuacuaacgcuuuucaacucugaaauuguauuuaaaguggugauauaauuucauuuguaagcaauauucuguuucauuaugguaauggccuagacuggaaauaaacaguuacagugucacuaacauauauauuugauauugauauacuagccuagugugguuuuuuaaacaccaccuaauacauguuuuuuguuuguuuuuuuagcaguauguugaguuuauggcagauuaaucuaucaucuuuuagaaauuuaauaugucaacggggcaugaaaauuuuaaguaaaauguauuaauuuuacucauuuuuacucaaacuauuggguggauuuguuuguauauucuaggugaaaacugacuuuugucagacuguacuuccauacuugauucaugauauuuuacuccaagauacaaaugaaucauggagaaaucugcuuucuacacauguucagggauuuuucaccagcugucuucgacacuucucgcaaacgagccgauccacaaccccugcaaacuuggauucagguauucuauuaaauuuuuaacauuaauacuguaaacucaguucuagagaaagauggauuuaagauggaaucccacuaaaagcacuuuacaggauuaaaucuauaaccucuaaauuuguuucuucaucuauggaauggagauaaaaguugccaacaguugcaacaaguuuucaaugaaauaauguguguaaagugccuaggauaguacuugauguauaguauucccucaguacauuuuggcuauugauaaugggucaacuaauugagcuuucaauaugugucaggcacugugcuugcacuggcaauauuaaugugaaaaagaaacacccacauucuagcaauggaaaaaacaaacacaaucagauauuuuagguacuguggugcagauacgauagaauuuucauauuuucagagcucuggccaacucaauuuaaaaagcagccuuuggccgggcacaguggcucacgccuguaaugccagcacuuugggaugccaagguugguggaucacuucaggucaggaguucaagaccagccuggccaacguggugaaaccccgucccuacuaaaaauacaaaaauuagccgggcaugguggcaggcgccuauaauugcagcuacuugggaggcugaggcaggagaaucacuugaacucaggagguagaggcuccugaggcucacuagccaagauuacaccacugcauuccagacugaacgacacagcgagacugucuaaaaaaagaaaaaaaacccuuuguauaacuauaauuaacauuuaguguauauccuucuaauuguuuaaaacaaaaauugaacuguacuuuauuuacucuuauaaccuacuuuccuucuaugacauauaauggguauuucucaugccaagagcauaauagcaaaagaaauuccaccaaggguuggguauguauaauacauauaugcaugcuugaaggcucauuaugggucaguuuuuuaaaccuaaauuuuauaaaaggauacaaaauucacagaucuuuauuguuaacugucuuuauuauauauuauuaauguguuuuauaugcaaacauaaagcuaggugcaaauucacuuguuguacuuaaagaccaaucaauucuaauacaaauguugauuuaaugugauauuuugccacaacuaaucugcuccucccaauccuuccagucacuucagcaaagguugugauuacucaguucuuccaauuguuucuuuuaguuuuacugcuacaaccuucauuugacaugacucuaaugucauuuagacuucaguuugcuaugcuuuauauuuuauguauuuuauuuucuguuggcuaacagcaauuacaaaucuacuauuuggaaaaauauaaauuauaaacauagacauagaugcccauccugugauccuacuagauuauaggcuguucucuaaaugaucuagaaugugcuuauaugaauuuuccuuaggccacugaaaugaaaauccuaaaauaaaaauucucauagaggcuuuguaaacuaucuaaaauguaucucuuaucuuuaauugggaaaauacagguauaagugauuuaagcauuuaaaacuuuaauauguaauuuacaguacuauuaaaaacaauuuuuauuacauaguuuaagguaaucauuguuuaugauaaucugguaauuuguuaucaugaacauggccaagacuuuuuucauguuuaucacuuauguauuuaugucacaaccauuggaagguaaaguaacuguuuuauuuuaucuguauacagugccaauauuuuuauuaccuuaagugaaaauuuaaacuucacauauaaaauucuguuauugaaaaggaaauacauauuuuuguaaaauuuaaaugguguaucuuuucugauggcuauaagccucauugccuucacuaaacgucccaugugcaucucaaacucagcuguccaaaagcaaacgugucaucuucuucaucccuucccccagccuacuuuuuuaaauguguaccuuuuugacaaauggcacucaguugcuuacucuagaaaccucucucacguauuucaucugauuaccaaaucuugccaauuccauauuaugaauaacuuaguccauuuguuucucucugcccuuagcauccuuacugcuuucuagcuccaugauuuagcacaguugaaauucuuucauuaaauuuuccaaguuauuucuugcuuccagccaucucagauauuauuauuauugccuguagcacuauccuuuccugcucugaugacuauuacucuucuuucagauaucacuuuuucuuuuuucuuuuuuuuuuuucuuuuuuucucuugagacagagucucgcugugucacccaggcuggagugcaguggugcaaucucggcucacugcaaccucugccccucaggaucaagcaauucccgugccucagccuccugaauagcugggauuacagaugugugccagcaugcccugcuaauuuuuguguuuuuaauagagauaggguuucaccauguuggccaggcuggucucaaacuuggccucaagugauccguccgcaucagccucccaaagugcugggauuacaggcaugagccauugcacuuggccaguaucacuuuuucuaugaaacuuuucuugucuaggugagguucccucugcuaagcuucuguagcauuuuaaacuuuccuauuauaacacuuaucauauuguguuguaaugucccaggcuagucagugaguucuguguggucugacaugaucugucuuguucaugcuuauauacugaggaccuagcacauaaaagaucuuauugaaucaauuaauuaguccuccuuugaaauaaaauauaaauuacaauguaaguucucacuuuuuuuaagauaacaguuucuuuuaaaagcaaaagaaauccuauuaaauuccuucagaaccaauuuuguguuagguacugcccaccagaaccuuauagcauagugggagacagacacauaaacaagaaggaagaagguguguaagcaagaaugccugggacugaggggagauauuuuuguuugucagagucagagcacuuuuuccgaugcuguuuggauaaaaaaucacaaagaacaaugcuugcuguuguggacuacaugagaagacaaaagagguaauguaaugaguguugcuucuuacguuuaggaucuagaguguaacuuguuaacuaucggcugaauuuuaacaugauuauuuuaggugaagguguugcaaaguguuauauuuaauuugugugauauuuauaucuccuugcaguaauccauauucaggauagcaguuugguuaaaucagugucaagaacucucaauucuaguaccagcuguaccaguaaccauguuaccuuuguuaaauuaugcagccuucuuggcuccaauuuauuucaucuauguuagggauaggagcaaguguuuuuccaaguuacauuuagcuguauuaccccucuuuuuacuuuucucuuugcuuuaguucuaagaaguaaauagaguuguguaaaugucuucuuuauguaucuuuauuuuaagauguaaguuucuuuacugugugcaguggucucaaaaucuguggcaauacugugcugugacaauguuuauuuucuuguuucugguaaauuguuuuauaguauaguaucuuuguuccuguuauuucucaugagauuuuuaacagugcauacagaaauugcuagaauggauggucugacugaugaguacugcuugagaguugaccagaacucugaagaaauaguguaguaggccuauaauuugaauagguaggaaucgaugucucauaaguguguaugguggugguaggggugguugguaaagaaugagagggagaggugagugaaaaaugaaauguuuuuaagccuaaaugcauuaauaucuuaaaaaauuaauuccuauguagucuuaaaccauucuucuucucuaguagaaaaagaaguuuuaugcuuuucagugucuuugcuucugguuauuuuaccuuagaguuuuauaccagauuaucuucugaggaggccuaucagaagcuuuaauguaguggagagcauuuguuuucuugguguugggaggcaguuuuaccuuugagucauucauuucagacuuaccauugggguagaaugguguugacauuagcaggaguuggagaagauaaaaauucuucauauuccauuuuaaugcugaauaagauccugaagaauauuccuggagaaaguaugaaugggauauagaaaaacggguaaagacaugcauucaaguccaagcuugugcuguguaaaaauuacuuguuauccuguacaguauguugggcaaaaacaaagaacaacaauaaaacaacaacaacaaaaaaauugcuugcugucuuugaaccucagucuuaucaucuuucaaaaucagaauaaugucuguagugucuuccuuuccauggggaaauuauuucacuucucugaacuuaacauucaucggaaaauuaacuuuaguugagugcuugcuguguaguagggugugccuuauucaucagcuuugcaggcauuauuuaauuguugcacccauucuccaagguccauguuguuccagcauuugcaaguaaggaaacuaggaaacugagguuuaagaaguuaaguugcugaagaucacacagcugguaguaggcaauauagcuagauuugaaccuaccuguauuguacuucaacacuagugcucuuaagcacuaccaugucccaucucuacaaugcuaguuuugaaaaagauacuaucuauggucccuuucaaucuugaccuaccuauuaacacaguggaagauuuuuauuaaguaacucaaccuaggcaauacauuaaggagaaaauaagucacaauaggaaagacauguauuugugucuuagaugaaacaauauuuuuuauuaaauugacuguuuuaaaguguguguuggggggugcuugugugcauuuguauuagcuauucuguguauccuauucuuagucugugguacauggauuucuugguagagagcagauaugaaccccaauuuuguaucaggugauagucuacagguuuuaucagauucucugauagguuugagggaaaaaagaaaaaccaaaaagauuaauuaaauaggacucuucagccauguuaucuuauaauguuuauagguauauauuggggaaaugugguuuuugggaauuuguaauuuucuguuaagcagucacuaccauuguauucuauaucaacaugcuuuuauuuugauauugaaguuuaaaaaagugaaugacauuauaucucauuuuucuuuagaccuucuucaggaacaauuuuuaaugaugcuuucuggcuggauuuaaauuaucuagaaguugccaagguagcucagucuugugcugcucacuuuacagcuuuacucuaugcagaaaucuaugcagauaagaaaaguauggaugaucaagagaaaagguaauggaauuuagaauuuuugguuuuuaaaauuaauguuggcauugucucaauaaggguauauaguaaagauuuauuuugccuccuguuccccauuuaaaagauauuuuagauagaaauuuuguuuuaaagugaaauuauaauaaauuuuuaaaaaggaauauguaauuccuguucugaaauaauaggaaugcuuauuacuuagguauuauaaaaauuuaacagauagcaaauuccuauaggacagaguccauacuuaauuuucuguauauuccccauaauagcccuagcauugagaacuuaauuuaagggugauaaauauuuuucaaaugauuaaauuauuuccuaacuucagucagauuagauuuaccacuaauuucuaaacuauucaagauucauuuuggauauaaaauauccaaaauuauaauccaaaauggcuauaaugugacugauuuauuucugugacuaauuaaguuucauuucuuuaucuaccuauauuucuagugaauuuaauucgcuuuccucugacugaguuagaacugucauaagaaucuaauaaauauacuccuagaucauggggaagaacaaaaaauaagaaaguaagaguaaaaaauaaaguaaaacacuuuauuaucccaacugcucuuuucaaauguuuguucguuugaaauggccugggucucauuauuucgcccaggcuguggugcaguggugcgaucauagcucacuguagccuugaucuuccgggcucaagugauccuccugccucagccuccaaguagcugggacuauaggcacacaccacugcauccaacucauuuuuuuuaauuuuuauuuuuaauagagacaagaucuugcuauguugcucaggcuggucccaagcuccuacguucaagcaguccucccaccucagccuuucaaagugcugggauuacaagcaugagccgcugcaccuggucccaaauuguuuuuuaaagcgguuauacccauuuguguacagaaauguaguugauaaggaaguggaucgguaggaagccuuauauuugaagaagggugccaaaguauaacuguuccuaguuuaguuaaaaaaguaaagaagguugggcacaguggcucacgcauguaaucccagcacuuugggaggccaaagugagaggauuacuugugaccaggagacugagaccagcuugggcaacauagugagaccucagcucuacuaaaaauaaaaauaaaucagcugggcauaguggccugcacauguagucccagcaacucaggaggcugagggaggaggaucgcuugagcccaggagggagaggcugcagugagccaugauugugccacugcacuccagccuaggcgacagagcgagacccuaucucauaaacaaaaaaaaaaaaauuaagaaacuggaauauguauauagguaaauauuagaggcaguaucacuuaugauaguauuuauuuuauguacuagauuauuacuguuauagacaccacagcugucaugguuuuagaauugaaguuacuuacagaacugaauguuauauguauaaaaugcauaaaguuaaggccuugaaguaggcaaaucugaguucuaauccugacugucaaacuuucuaguuuuauagucuugguuuaaguggauccuacugaucuacuuccuuuucaauaguuaauaucagaugucuuaaauuuauaucuguuaaguauuaaauucugucuuauuguggucuuuauuugugugucuguaauuauugauuggguugaauuucaggugaaaccacugacagaguauauaguaccugaauuggauggcaucugcucuauuuuuaaacaauccaaucucuuuauaaauaaucauauuuuugcauauaggcuucccauauguagauuauucuuaaaauauaauuuucauucacaaauuccuuuuccauccuagguauaaaugguauuauguuuuaaaguauaagugauuuauucuguuuuguuugccaccuucauuaguuuuuuucugucaaagucuauaguauauguauucaggagcuuccaaauaguauguucucauuaaaagagguguucuugugacaaacagaagucuugcauuugaagaaggaagccagaauacaacuauuucuagcuugagugaaaaaaguaaagaagaaacuggaauaaguuuacagguaaauauuagaggcucuauuauuuaugacaguauuuaucucauacuuuggguuauuuuguuauagacacuguacagaugccaugugauuuuuaaacugaauuuacuuacuggacuaagcaucauauauauaaaauuauggucugaagcuuaagccuuagaguagacagacuugaguucuaauacugacucugccacuucuugaguuccuuaucugaaagacgaagguaaaaccaccugucucagaguuuaugccaugcauuuucugccauagcacccuguucauuuccuuuauagcacuuaggguuuauaauuauauauuuauuuguuugcuuguuuauuguauguuacagaagaagcagauugccucuucuauaaauuucuugauauccauucuuaaauuggcucauguuacugucugggaugcuugccgaauuucuuuggucaacucauuccuccacaaugacaauuucagcuucuccauucugcuuaaaccucucaucuucucuucuaugccgcugcuuucagccugccuccuacuuggagaaaauagaaggcauagagaggaaaucucgccacaucccacucucaaacauugaaaucuccuggcaucuccuccuuuaauaaucuuccgucauguuacagaaacaguuuauccuucuauuugagacuaauucuuccugugcuuuguuuuuuuaucugcucuuucucaggugcuuuauuuuuuaauaugcuguucucccucugaacuauguucugaacauuuuaaaaccucuccuguuuaaaaauucccuuucucacaaagacaaaauaauuucccucuucccuauguucucuuuuagguaucacccucucucuuccuuccucucacagacaaacuuugugaaagaguuguccauauuugcugucugcauuucccccccuuccauuuauuccaguaaaauagcacuugcuaaugucucucauaaacuucauguugcuaagucugguggucaccuuucauucuuccuuuuccuuaauguuuuauuaauacuucacaucaucaaccaugccuugcuugaacuguguucuguuuaccuuuuugauccacucuccugauuuuucuccuuucacuuuugccuucuucauaggcuccuccucucuacugaguuuuuggaauaucguguguguacuaagcacugugcuaagcauggguacugaacuuuucuacucugaggacuugauuucacguuaugaauagaaacauuugaguuggaacuauagaauuaugccaauauaaaugaauuuguguguagaaaauauuucacagagcaagcaccauauaggcaguucaauugcuugaucaauuuucuaugcaguauaguuccuaguuuuuucuauuuuauuuuuuuuauguuuucauuuuuauuuaacugagauuguuuuaaacagaauauaucuuuucuguguaaauuuuacaacaaagauuucaguaaccaaacuacuuuauccauaucaaauuuuaccaauuccaauacaguuuugugcuauuuuucaaagaaaaauccacgaccuuuauucuuaccaaauugaguuuucaagagucagacuuuguaggacuguauuuucuaauguacaguuuuuuuguuuuuuuuuccagacaggaucuggcucuguugcccaggcuggagugcaguggugcagucauaacacacugcaagcucugccucccaggcucaagccauccuccaaccucagccucacaaguagcugggacuacaggcaugccccaccaucuccagcuaauuuuuguagagauggguuuagccauguugcccaggccgaucuugaauuccugagcucaagcagucugccugccuuggcuacccaaaguacugggauuaaagaugugagccacugcacccagcccauguacaguuuuagguguugacaagauuguuugguuuuguuugugugauuuuuuuuuuuuuaugugauauaagccugguaggucgguacuuauuucuuaucuaauucaugaaauuguaggcaauucuucucggguagacuacaguccuccuguugucuaggaccagucuacuguguugcugauccaaaucauuaguauauacaguugacccuugaacaguguaaggguuagaggugcuaacccccugugcuauuaaaaaucaggguaaaacuaaauuaguagucaaaaguuaacuacuaauagucuacuguugaccagaagcccuaccgaugauauaaacaacacaauuuuguauauguauuauauacuguauucuuaaauaaaguagcuugagaaaagaaaauguuauugagaaaaugauaaggaagagaaaaugcauuuacagaacuguacuguguuuaucaauaccguaaguuuauaucaucuguuuacaaagaaucaucugucugaaauuguaggcaaccacugcugguugauauguacuuuaggccucaaucuacagaauguaucaaacaauucaccuuuuucuuguaauggcaugacuuuucucugcaucuuggaagcaccuccagccacugugguguuaaucaaggcuuauaguauugcaguaaacacagugaaaaaauacaugagaaccuggagagauuacuuuucauuucuggauacaauuuacuagagaaaugaacugcucauguggaaauuauuagugucacauggcauuuuaagcagauacucacaacacaauaaugcuuaccacaguagcaacugagguagcugcaaaauuauuacaauaguacaauauguacgauaguuaaucuuaugcaauuaugauuuaauacugcaucuuuacauuuguuuauauuugucuuaaccacaaauaaugcuguguacaguguguguguguaaguuuugauaaauuuuaacucuuuguaauagauuuguguauauuuuaugguaguaaaugaugaaauguaucauaucaaauguauacaaaugauggaauguguagacuaguuguacauuuauuuuaugcauucaugacauaacuuuuaaaaaauuuuucaguaguucuaaacugugugguuugugaauuuuuucaaauuguggcaaaccuccaaaaaguuuucaauauauuuauugaaaaaaaaauccacauauaaguuguccugcacaguucaaacucguguuguuugaacuguauuucagaacuguauuucagaaucauuacauuuuauuucuauaacauaacauuuagaguugggaguuacauauugguaaugauacaauuuaaaauuugcuaaauuuauagaccgauuuuuuuuccuucuucaauuuuuguuguuuccauguuuucaggaucuucucuuagaaaucuacagaaguauaggggagccagauaguuuguauggcugugguggagggaagauguuacaacccauuacuagguaaauugcauuuuucuaaacaacgguauaguaauucuguuuaugaaggaguuauguguguguaaaacccaaagcuauuuucacaaucuuuucuuauagacuacgaacauaugaacacgaagcaauguggggcaaagcccuaguaacauaugaccucgaaacagcaauccccucaucaacacgccaggcaggaaucauucagguacauuuuuucccagauuugguaaagccaucacuaguguagugcugagguuauuucaguauguugguggauauuuacacagccagauaaacucuagagauaagacuagaacuuaucuguuuuucagaggauuaggcuaaacauucagggauacuccugaagcagagggaugcaaaaaaaagagaaaaaauucagggagacacaggaaagucagacaggucauugaccuaaaagauaguguagauuucuugaucauaguguuguuggauaacaacagaagacauugcucgagcauauacaaugugccagguaguguacuuacugcuucacauggaaaaucuuauguaaacuauuucucauaguuugcaacagaguuggucccagaaccuguuguuucuauuacuggcuaauacuccuuagccauucuuccaugaaauauuagagcccuuugagcucuauuuuuguguuuuuugggaaacauuaaacgauauuuugggauuaaaaaaauguuuuuggccaggcgugguggcuugcgccuguaaucccagcacuuugggaggccgaggcgagcagaucacgaggucaggagguccagaccauccuggcuaacacggugaaaccccgucucuacuaaaaauacaaaaaaaaaaaaaaaaaaaaaaauuagccgggugugguggcgggugccuguaggcccagcuacuugggaggcugaggcaggagaauggcgugaaccugggaggcagagguugcagugagccgagaucgcgccacugcacuccagccugggcaauagagcgagacuccaucucaaaaauaaauaaauaaauaaauuuuagagauaaggugucacccuguuacugaugcuggagugcauuagcgugaucauaguucacugcagccuugaccucccuggcucaagggcaccucucgcuucagccacccaaguagcuggggcuacagguacacacuaccauacccagcuauuuuaaaaaaaaaaaaaaauuguagagacaggucuugguuuguuguccaggcuggucucaaacuccugggcucaagugauccuccugccucagccucccaaagugcugagauuacaggcaugagccaccacacccagcugauauuuugggauuuuaaaugauauugugaacuaaaauuugucuaaguuaauuuguaucuuugcuguuuuuuucucugguuuucuguugauaucuuugauuacuuaacuuaaaaacaaaauaacuccuguuuaggccuugcagaauuugggacucugccauauucuuuccgucuauuuaaaaggauuggauuaugaaaauaaagacugguguccugaacuagaagaacuucauuaccaagcagcauggaggaauaugcagugggaccauugcacuuccgucagguaagaaauuugacuugauuuuuuuuuuuuugccucucuccucauucuaaacaacaacuguuuuucucuucuaugaauauaacaggaguuguuuuauauauauauauauauauauauauauauauauauauacacacacacacacacacacacuauauauauauacauaccauauauauaguguguauguguguauauauauauaaaaaaauauauaguagauguugcaagcuauagauagcccuaaauccuucaguaagauagcaauaagcaguuaaugcaccuaggcuugaauuuuacucucuuauuccauuaggacaacuucaccccaccccuaaauauuucuaaaaacagaaauaugaaaaggguuuucgaaaugaguaucaucucgcauaguuuguuggacugaggcaugccaagaaaaguauaggcauuccucuuucuacuuccugcuacaaacauuuuagucaguaagauagcacuuauauuggcuggaggauccacaaaggacugcuuaucuuuauuuaugaaauauuuucuuuuauuaaaaaauaauacggccaggcacgguggcucaugccuauaauccuagcacuuugggaggccaaggcggguggaucgccugagcucaggaguuugagaccagccugggaaacacggugaaacccuuucucuacuaaaauacaaaaaauuagccaggcguggcagcaugcgccuguagucccagcuacuugggagccugaggcaggagaauugcuagaacacgggagacggagguugcagugagcugagauagcaccacugcacuccagccuggacaacagagcgagacucugucucuaaaaaaauaaauaaaauaaaaaaaauaauaugccuacucagggcugggcacagugugguggcucacaccuguaaucccagcacuuggagagcugaggcagauggaucacuugagaucaggaguuugagaccagccgggccaacauggugaaacuccaucucuacuaaaaaugcaaaaauuagcugggugugcuggagcaugccuguaauccaagcuacucgggaggcugaggcaggagaaugcuugaacuugggaagcagagguugcagugagccaagauugcaccacugcaccccagccugggcgacagagugagacucugucucaaaaaaacaaaaaaaacacucaguuacccaggaagauaacauuuauaaucuguauauaaggucaccauguuuucugaaugaaaagccaagcaccuaaucuaauaaaggauuucauauuuauguaaaguuuuuugauaauguaaacccuaaaaaauuaauuauguuuaaguauguuuuguugccuuuguagaaaaaaaaaauuauuggccgagcgcgguggcucaugccuauaaucccagcacuuuggaaggcugaggaggguggaucacaugagguuaggaauucaagacaagcuugggcaacauggugaaaccccaucucuacaaaaaaauacaaaaguuagcugggcaagguagcaugcaucuguagucccagcugcuugggaggcugaggugaggggaucccuugagcccaggagguggagguugcagugagccgagaucaugccacugcacuccauccuaggcaacagagugagacucugucucaaaaaauaauaauuauuggaaugccuuucaaauauuucagacuguaagacugcuauaaaauuagagauauauccucauauuuuaaaaaccuuuuccugugcgaguugauucuugcuugccucuguaaaucaauauauacuauucuucuccuuccucuuguauuucagcuacacagaccucucuguguuuucuugucaggccaagcuguuucuauccaagggccuuagauguaucuucuccuuuucccccaguuaccaugcggguggcuucuuuucauucggacccuaguuaaauaauaauguaucuucagagaggccuuucuugauuacccauucuauaauagccaucuagccauuuuguuuuguuacccuguuuuaauucucugcaugucccuuguuacuuuccaauacuuauuuauugucuguuccuccaaaccagcacauaaauuccaugagaguaaagaccugaucugacuuguccacuugugaauuccccuugugccuagugccuggcacauaauagguauuuauugaauaaauaaaugaaaguagagcauauuuagaaccaggcagaguaucugaguaauuuccuuuuuuucugcuuaaagaauuuaaaugacucauaaaauuuguauuucuuaccaaaaauucuagaaaugcauuuuuuagaauggagaaauguuaauuuaaaaauuuuguccuuuggugaagcuauuuauacauguauaucuuaggguucuguuuuuaaguauauuuuuuucuuugacuuaucucacagcaaagaaguagaaggaaccaguuaccaugaaucauuguacaaugcucuacaaucucuaagagacagagaauucucuacauuuuaugaaagucucaaauaugccagguauuaugaaaagacaaaguuacuguauuuuaacauuuaaugucauggcuucuuuucugaaaacuugagaaacaauuuuaauguaaggauuugcauugaugaagagauaaagacuugguggcugugaucagauguuuccuuguaauucucugcccuccuucaaaacaaauuguuucugggauuccagguucauucuuuacccugacccuucaagaaaguuuuggugauucccucuuuguucucuuccuauacaaguauccugagaauuauaucuugucucuuuugguaauuguauggcauuuaguguucuaauuuauaaaauuguaacucacgguuaauacuuacaaacuuguuuugaggcacaaaugugaugaggcaugaggaaauaauuauaaugggguaaacaaaugcagcauuuuuaaagccguagugacuuaauaaauccuauguuuaucacagaaauaaaauuuacuaucauuuaagugccuaugauaugcuagccacuguuagacucuuuucauauguauucucuaaucaugacaauaacuauggaugugaaaaaaggcuuagagaaguccaguaacaugcccaaaguuacacagcuauaagugacagaacugcaauuuagaucuaggucugugugauuccaagguuuacaguugauccuugaaccacuuggagguuaggagugcugagccccuccuccucacacauuugaaaaugugaguauuacuuugacuccucaaaagcuuaacuacuaauagcuuacuguuaaccagaagccuuaccaauaacauaagcaguagauuaacacauauuuuguauaaguauuauaauaccauauucuuacaauaaaguaagcuagagaaaagaaaauguuauugaaaauuauaaggaagagaacauauauuuacuaguaaguggaagugggucaucauaaaggucuucauccuugccaccuucauguugaguaggauaaggaggaaggguuggucuugcuaucucagggguggcaaggugggagaaacucugaguguaaguggaccaugcauuuaaauuuguguuguucaagggucaguuguauuuuguuuccacugcuauuuuguauucacuguugcuuguuaguauuauuagaucaguagcaaagccuaugaugagaacucuuuaacaacaaauuuaaacauuuauuucccugaaaaccucuucuuuauuuucagagugucuuuucuuuuuugcuacuagaguaaaagaaguggaagagauguguaagcgcagccuugagucuguguauucgcucuaucccacacuuagcagguugcaggccauuggagagcuggaaagcauuggggagcuuuucucaagguauguaauucguaugacuuuguuauccuaaagugcagcuuuucuguuaccaauagugacuuuaaaaaauaaaaacuauaggccgggcacgguggcucaugccuguaauccuagcacuuuagaaggcugaaguggguggaucacuugaggucaggaguucaagaccagccuggccaacauggugaaacccuaucucuacuaaaaauacaaaaauuagccagguaugguggugggcgccuguaaucucagcuauucaggaggcugaggcaggaaaauugcuugaacccagcacaacaggcagagguuguggugagccgagauugcgccauggauuccagccugggcaacagagcgagacucugucucaaaaaaaaaaaaaacuauguagagaccaaauguguguguuucuuuccuuuuaucaagauauaaguugauuagcccuagugaauugugcuuuuauuaaacauuuuccaaaauagucauuguaaaaauuuaaguuuuaaaaauucagcuuaagugugcuuuucucuuuauaacuuuuucccuggccuaccaagauaaaauuguuuccucauguuuuugcauagcaugauaacacuccauucaguuuuagcacuacauuguauuacugucauuuuaucucugccuugcuaaacuagaagcucccuuaaaagugggaaccauucuauuguuuauuguuguauaccuaguguuuuuguuuuguuuucuuuuuuuucuuuuuauguuuuuuugagaccaagucucgcucuguugcccaggcuggagugucaugguauaaucucagcucacugcagucuccaccucccagguucaagcgauucuccugccucagccucccgaguagcugggauuauaggugccccgacaaugccuggcuaauuuuucuacuuuuaauagagacgggguuucgccuuguuggucagccuggccucgaacuccugaccucaggugauccacccgcuucagccucccaaagugcugggauugcaggcguuagccaccaugcccggcccccaauguuuucucuucuggugacugauaauuauguuuaguaaacauucaguggauaguggaugucaguuaauuuguaaaagguguucagaaggaauugcuucuuauaauggugagagggaaaugauccagggauuuuggaagaugaaauaguauaguuacucaggaugcuguagaucuaaauucuuuccuuuuaucaagauauaaguugauuagcccuagagaauugugcuuuuauuaaacauuuuccaaaauagucacuguaaaaauucaaguuuaaaaaauucagcuuaaaagugcuuuucucuuuauaacuuuuucccuggcccacccagauaaaauuguuuccucauguuuuugcacagcauguuacacuccauucgguuuuagcacugcauugcauuacugucauuuuaucucugccuugcuacuagauaaaagaaguggaagaguuguguaagggcagccuugagucuggcaggaugacaaaguaaaguguuuuggguccucaguuuccucauuucuaaagucagggauuuguauucgauggucucuaaagccccuuuuagcccugcuauuuugaauuacuauuauuauuauacgagggaagaaagaggauauaaaugacuaaggucacucuaccuuuaugcaaaaauaaaauuuggaauauguuuuggaaguagaaaagagaaggaaauuuuagagucagaagaaaauaauaauaguuuuuucaaaaugacauagcagaagacauacauauuaauguggcuuaggaggaaaauaaaggaacaaaagucuuuucugcuuucauucauaaguacauuggcaguacuuacugccagaaaucaagaaauuuuuccucugaaugaaagauuauccugcugaaaagaguacagaauucuuuaagaaacagugaauagaaugguaguaaccagaggcagggaaggguguuguggagggagaggaugaagaggggcugguuaaugagugaaaaaacacagguaaauagaagaaauaagaucuaguguuugauagcacaauagggcaacuguaguuaacaguaauuuacuguauauuuuuaaauagcuacaaaagaagauuuggaauguuuccaacacaaaugauaaauguuugagaucauggauaucucaauuacccaaauuugaucauuacacauuguaugcuuguaucaaaauaucacacguaccucauaaauauguacaacuauuauguauccauaaaaauuaaaaauaaauuuuaaaaagaaacaccuaaagaauaaucuggcuguuucuuugguagagaaauaggaagaagagaagcagagggaagguuggaugaacuggugcacaaaugcuuaugcucucagauuacauuccauucauauacaucaaccaaaacauuaaauaauaacaaacuaaaugcagaagcagagauaagaauucaucucguucuguuaauccagacauuaaagagauuugcaaaaaugcaaaacagugccaugcucacuaaguuuuguuuuguuuugggaaguauacaguugaaauucuuuaucuacagguuuccaucuauggauucaaccaaccgcagaucaaaaauauuugaaaaaaaaauuuuaaagaauaggguauaacacuuauuuacauagcauuuacauuauaguagguauaauauguaauuagagauuuauguauaaccugugcacauucuccuauuacacguaaucuagagguuauguguaauacuuuuuggaaauguuuaauaaaagcacaaucuagagguuacguguaauaggaaaaugcccugccauuuuaaauaagggacuuugaacaucagcauuaucaaggugucuuggaaccaauuuucugcagauacagagaaacuacuguaguuauuuuuccuaaaaauuguuauuuaugauauauaguagauuuauuauuuuugaauaaauuaauacauuuuagauuuuucucagucuuucuaauaugauaucauaucuaauaucaguagauaugguccaacgaucgaaaguucuuuggggucuucaauaauuuguuugauuguaaaggaguuccgcaaaaaguuugagaccugcugugguagggucauuuagagaggaauugaaguuuugguuccuagcauuuuuguuacuguuccuucccuaucaagcaacuaaaagagcuuucauuucuuagucaucacuuugucaucuuacucucccugcuuccucuuucuuauuucuuucaauaaaugucccugaaggauuggguaguauuucauaguucaguuauuugggaaggauacuauucauauaaacuaauugugcaauaugccuuuucuguuccuuuaauaauguugguaaaugaaaccuuugccagaugccagcuuuuccuucacuggauugugauuuuuuugacagcuauaauuaugcaucaagucauccccaguagggggucccucauuuccuugcugacauguccucauuacuacaggcaguauugaagcaggacuaaagauggaggcauucuuuaugauaggucugaugaauauguucuuguuucagaagaguauuuagaagggcugcuuuuuguaaugucagaguauuaaaaauuuuuuuugauguuugucaucugugaccucucugcuaauaacucuuaagagcucugaccgcauagcauuuuguaguuuucuaaauuuugauccauauguaggauuauuuacaaguucuagucuugucacuacaaaaguuccuuuguauuauuauaauauuauaucguaaguuccagaacuuacauaguuuuuuuuuuuuuuuuuuucauuucucuugcuuacaugaacucuaugucguggcauucagaucagucacacauagacaacucucugaaguauauauuaaguggcagaaacacucccagcuucucaaggacagugauuuuaguuuucaggagccuaucauggcucuacgcacagucauuuuggagauccugauggaaaaggaaauggacaacucacaaagagaauguauuaaggacauucucaccaaacaccuuguagaacucucuauacuggccagaacuuucaagaacacucagguaaauacaauuuaaaacuaugucaucuuaccucuugacuuuccuuuuauuauuuaaaaaacagaaagccugagggaaaaagaaaugucauuaagagauagagaucucuauuaauauauaguaaaaauaauuguuuaagaguucccauuuuggaauuagaucugacuuuuaagccuugggcaaggguacuuaaucuuuucucaaccucaauuuccugguuauaaaaugagaagauacguaacuuacuauauugauaacaauucagugauuuuauauacuguguguauguacacacagauacacauacauacauauagagagagacagacagacagacagauaggcagacgugggguggggagaugucaugcagacagagagguccuuaagauagucccugacaaguaguuaaguccucaaugaaugguaguugcugcuuucauuauuauuauuauucaugguaguaguaucaguaguaaaaguauuuauucccauaugucauuuucauuucagcucccugaaagggcaauauuucaaauuaaacaguacaauucaguuagcuguggagucucugaguggcagcuggaagaagcacaaguauucugggcaaaaaaggagcagagucuugcccugaguauucucaagcaaaugaucaagaaguuggaugccagcugugcagcgguuuguuuuuuuuauuggcuggauuaguguuuuacuguuauuuaaaaaaacacaaauguacuuuaaaauauuuuuaauaacaauuuuauuagagccuugaaauuaguaauuuauuaacaagauauuguaaaacuagucuugaaaauuaauuuguaaaugaaguuuagaaacuuuuuccuauauaucacaauucuaucaguccaucauguggucgauucauuuaauauaucccaguauuaagccuuuaacuuccuauagaauucaagaaagguaugugggaaaugaaugaaauagcuacucuaaauuugaaaugacaagugaaaaaagggaagaggaaaugaaugagagaacuaaauuagaaaauaaaagcaaguugggacaauuagguugucaauccaaaugcuuugaaaauaucacaucuaauauuuuaucuaacauuaccuguugguuuuugcaaacuuauguugcuacuucagcuguaaacccagcauacacacuggauaaaguagaggcauugguguccccaagguuugucuacaguggugucccacagacauguaccugcuuagugaauaucagcucacugugcuuuauuauuuauuuauuuauuuauuuuuugagacggagucuugcucugucacccaggcuggagugcagugguacgacaucggcucaccgcaaccuccaccucccugguucaagcaauuccccugccucagccucccuuguagcugggauuacaggcacaugccaccaugcccagcuaauuuuuuuguauuuuuaguagagaugggguuucaccauguuggcaagacuggucucgaacuccugagcucaggcaaucuacccgccuuguccucugaaagugcugggauuacaggcgugagccaccacgcccggccuuuacuguacuuuuugauguugggcacucauuguauagcaucuucuguuauuagagaaaucauuauaccaaagcacugagugccaauaugauauguguaaauauugcuuaauaguauuggcccugaaguaugugcugucuggaguuacccaacuuccuuguaccucaguuuucuaaucugcaaauugggguaauaauaguacuuauuuaauaggauucuugugagaauuaaaugaguuaauauauauaaagccuuuacaaagugucugacauauauaaguacucaauaaaugugacuugcuccaauaauggcaauaauaauaauaaacagaggaugaucauuuccuacaugggauuauuaaaauaguuguauggcaaaagcagaugaggaaaaacuuuuuuuuucccacccaccaaggaaaaacauuuuuaaccugcuuuuuuccccguacaugaagggcaguuggguacagucaugguaaugcauuauauuuuaagauuuugccuuucuuauacagaacaaucccagccuaaaacuuacauacacagaaugucugaggguuuguggcaacugguuagcagaaacgugcuuagaaaauccugcggucaucaugcagaccuaucuagaaaagguaagauuuuuggagcaacccuuaagauaguuacuuagcaugaauaugcuucaucuuuucaucaagaucaauauauuuccaaagcaaauaaaaguaugguuuuauuuuucuauauauuauuacuguuguagcucuguauagucucuaggguggagugaaacauuguuacaaaacaaagcagccaauuuugaaaguaagcccaaguauaguaucucuucuuccuccuuccuaccuccacuaccagcuacccuuucagcagguugcuucugaucauuucuucauuuaugcaucuacaaaaauaacugauuaagaauaggcaagucagcccuugcucuucauuagcccagccacccacaaguaaaggcuucaauauacuagccccuuugacuuuccuguuucucccucuuauuccuuuagauucacuaauuuuggaaauaguuaccucacuaaauaaguguaacaugaaacacaugaugcgauugucuuucuuuucuuuucuuuucuuugagaugaagucucucucugucgcccaagcuggagugcaguggcgcaaucucggcucacugcaaccucugccuccuggguucaagcgauucuccugccucagcuucccaaguagcugggacuacaggagugugccaccacacccggcuaauauuuuuuauuuuuaguagagacgguuucgccacauuggccagucuggucucgaacuccugaccucaagugauccaccugccucggccucccaaagugcuggcauuacaggcuugagccaccacacccagccugauugucuuuaaauuuuauaaaguucucuguuuuugcagaguucuuuacaaguauuagcugucuggguuauuucuacacugucaaaguuguuuugaaaagucaagaaaauaccauaguucagggcuguccaaucuuuuggcuucccugggccacauugcaagaagaauugccuugggccacacauaaaauauacuaacauuaaugauagcuaaugagcuuaaaaaaaaucacaaaagaaaucucauaauguuuuaagaaaauguacgaauuuguguugggccacauucaaagccguccugggccacaugcggcccaugggccguggguuggacaaguuugcaauaguucauauaauuuagcuagcuuuuauauguauauaaguuaaauuuuaguguauuaccuuaauuugagugauucuuuagauguauuuaguauuuguaaauauaauuuaaauugguuguguuuucuugaaggcaguagaaguugcuggaaauuaugauggagaaaguagugaugagcuaagaaauggaaaaaugaaggcauuucucucauuagcccgguuuucagauacucaauaccaaagaauugaaaacuacaugaaaucaucggaauuugaaaacaagcaagcucuccugaaaagagccaaagaggaaguaggucuccuuagggaacauaaaauucagacaaacagguaacuagguuucuacaagugacaauuuuauguucaccaguuaacugagugaguguuuuugcauagaaagagugacuuggucuuuuuaucugauauaguuuugagcucuaaaggucggcuuaacuauauauagauuaucuuggucuuuuggguucuuuucgguuuuuguuuuuuguuuuuuuuuuugagacaaggucucacucugucacccaggcuggaguacaguggcgugaucacuguacuccagcucacugcaaccucgaccuccuggacucaauugauucucccccugagcccccgaaauagcuggggcuacaggugcacgccauaccuggcuaauuuuuguauuuuuuguagagaugggguuuugccauguugcccagguuggucucaaacucaugggcucaaacgaucugcccaccuuggccgcccaaagugcugggauuacaggugugaggcacugugcccugucugucuugguccuacuguaguuaaucacaaauuaguauguaagauauugacguguucuuuugugaauaauucaugcucugcuucuaaguucauuguggagaauauagauauuagcuuucuguuuugcuuuuuugguuuguuuguugguaucauaguggaaaaggagauagauauugaaauuaauuacaaaaguuaccuauuuugauguaauuaaaucccuuuauuuaagccugucuugaaucuguauauuuuaguguaagcagagguguaaguuagcuaaauagcuuggggagaguccccuuuguccuuugaugcuuaggaaggugugugaauugcacaguuaagacaaaaguaaguuuauucccuuuauaauccuuagaaguuugcuuuuuucccugggauaaaaacccaacuuuuuucauuaaauguuguauaucaugugugauuuuguaguucuguuaaaguucauggcuuuuguguuuuaccuuaauuauucuaugcaagauacacaguaaagguucagcgagagcuggaguuggaugaauuagcccugcgugcacugaaagaggaucguaaacgcuucuuauguaaagcaguugaaaauuauaucaacugcuuauuaaguggagaagaacaugauauguggguauuccgacuuuguucccucuggcuugaaaauucuggaguuucugaagucaauggcaugaugaaggcaaguguuacucagcccaauauucuacccugugcuugaaaaacuuagacauaagccccuugaugucaggaaucguguauaccucuuuguauuccuagcacuugguccagugcucuacacauaaguagcauuuuguaguuuucuaaacuuugauccauauuuaggauuauuuacaaguucuagucuuguuucuacaaaaguuccuuuguauuauauaagcugacaagcuguaaaugaugcaaguuuguguggaggugauagaauuuagcuugguccuaugucuuugcaguuaccauaggagagggucuagaauggggcauuagauuggaggauuuagaaagcaguuaaagaugaugugaucacagguggguuuucccccugcugcagaaauaugggauuuuuacaauaaauuacuuuuguaaguagagaaaauauauuuuucagaaaaugucaagacagcaguauuguauaaguuuuucuuugaaaaccuuagauuauagugaugacaccuaauauuaaauuuaaguugacaagcuauauauuguuagucaauuugaagguuagagauaaaauguuucuccugcaggaaaauaauaagacucauaauagauacagucaaucucugcuguaguauacacuaaauauuacuuuuggccuauggggaaaagcaauuacuucauuuuauuguacacugacuucucaggaaucaagaucacagucacacucagaucacauuugucuuccuuagauuuuuuggaauauaaacaguaccaaguauucuaguucugaauccaguuuaauuuaggaccaaauauuuugauuuaccaaugcauuaaucuagaguacccauuagaaagaccuucagauaagaaaagaaaugaaggaaaacaauauaguuagugaaguuuuguuaaccacuugugcuaauagaggagcacugucuuaaaauaacuuacuugcuuagaugugagaauauuugaaauaccuuguuucuuaauuuugugucuuuuuuuuaaugguagagagacggaaugaagauuccaacauauaaauuuuugccucuuauguaccaauuggcugcuagaauggggaccaagaugaugggaggccuaggauuucaugaaguccucaauaauguaaguaaaccugaaaaucaaaccacaauaauuauuuuuauucuauuauuacuauauauuauauaaaguauauauaccauucccucuaagaaauggaaauacaaaauuuuguauuuuuugucuucucacaucacauaaguuacucauuuucucucucuaauuccucauaggccucugccuuuuucucacacaugcaggcauacacgcucuacccacugcaguaucuagacaguaauacacauuuuaauguuaagcaaaaugaaaaauauggauuauauuuuuuuguuuauuugcauaaaucuaauaguucuuuucuuacagcuaaucucuagaauuucaauggaucacccccaucacacuuuguuuauuauacuggccuuagcaaaugcaaacagagaugaauuucugacuaaaccagagguagccagaagaagcagaauaacuaaaaaugugccuaaacaaagcucucagcuugaugagguauuuggauuaaacauacguaccuuuuagaagugugauauucagucuuuccuagaauauuucuuuuuaaaaucuuguguuauuaagaugccaucuaaaaucgguucaaggcuggcacgguggcucacgccuguaaucccagcacuuugggaggcugaggcggguggauuacuugaggucagaaguucgagaccauccuggcugaccgacacagcaaaacccugucucuacuaaaaaugcaaaaaacagcugggcaugguggugggcaccuguagucccagcuacucgggaggcugaggcaggagaaucacuugaacucgggaggcggagguugcagugagccaagguugcgccauugcacuccagccugggcaacaagagcgaaacucugucucaaauuaauuaauuaauuaauuaauuaaaauugguucaaaauuccuuaauauuugucaaagcauaggagauaccaguaguaguuuacuuuuuuccucaaagcaguuggcaaagugaaacaauagauuuugaaaggcaccuaagucauugacgagaguauguaucuuugauguauuucauuuaugacuguuuuguuuguaucugaggaauuauaaucauuccauugucuagauuugugcauaaauucuguuuuucucuuuguuuuucuaacucugagaaguuuaaauguuggguaguuccuuauguaauguuuuuuguuuuuuauuaauaggaucgaacagaggcugcaaauagaauaauauguacuaucagaaguaggagaccucagauggucagaaguguugaggcacuuugugaugcuuauauuauauuagcaaacuuagaugccacucaguggaagacucagagaaguauguuuuuuuuaaagaagaaacguuacuuucuugcuguguuacucucuguagagauauauuaguuauagagccuaauaaguaaaucugcuuaaaaucacaaacguaauccaaaagcuuaauuuauaucugauggcuucagcauucccugguuacuuuuucacuuaauaucucuuaauagaacugguaauaggugacuacacuaaauuaauuauuugauuucuucugauaaucuucuggcauacauacuuauuacagagaauugcauaauagaggcaagucuauuaaaauaauugaauaacugaacauuucuagccucaaaaguuuuuuuaaacgaugugguuacuaaaacugcccugggacuuaaaaacaaaaaaaggcuuuaccauuucuuccauaggugcuaaaaugccauuauuuaauuauuauucuugcugugucaguucaaauaauuacaagcugcuauauaaucuuugguuuugugacuagucucuaaguaugcuucuaaguaucuccccauacuuuaauaauuguauuuuuuucuauucagaaucauaucuucaaguuuaaauucuuauuacuugaaaacgaaugggacuucacauauuguuucucuaagcaaacaaaaaguauugacaugucuuuuaguugcauuuaaugguaaugugacaggaguauguuaucuauguacuaugcaaacuauuacguaauuauuuuaagauguuuagucugguuccucagguggaaucuggucuaguuacccuugucagguaaccugcaaauuuacuugaagcuacauuaaccacuguugagcuuugacucugagcugcauaguggccaaagcccagagucuucauuucucaaucagagccugaaccacagauuagcaacaaguuggggccagugguaucugcugacuauuccugcuugaccuucaaugcuguuccucaguuugucacuaaaaucucuucauuuuuaaauacagaaggcauaaauauuccagcagaccagccaauuacuaaacuuaagaauuuagaagauguuguugucccuacuauggaaauuaagguaauuugcaauuaacucuugauuuuuuuuaaacuaaauuuuuuuuauuagauugaaccauuugaaauaguauuuuuauguaggucaaaauugguuaaauauuggcaaauuucauauguuucaaccuauaauuucucaguauuauauuuccuuugcccaagcccuaaaauacucaaaagcuucuccugcuuucuuuuccauugccuucuguucuacaccucccaucuuucuuaugaaggucuauagacuguuacuuucauuggccagaaggagaguuuccgugugcuuaugccaagauuaauuuuugacuuggcaaggaagguuccaauugucauauauuguuuuuaaaaauucuaugugcaguaaaauguauuggcugugauauaucacaguauuaaguaauauaguauguauuauuauaauauuaagcugacuucauaugcaugauacacuuagcucuguucuaauauucuuuuauugcaagaaauaauggaaguaauuucaugugggcagggauauauguaauaaggguuauaaguuuagaaaaugaucaucuuaaauacauugucuuucuuuucauuuugcaguuuagugcuuaguaucuaguuacuugauuugaaauguagcuguaucauguggauuaacugcuguuuuucuagcuauaucagcuaggugauuucgcugaauguuuccuuaaaaugccagauuuagcaguuauaacccagaaaacuccuucuacuguuuuccaaaauuuacuuuauguuuucgugaggaguuauuucucagaugacuuuacauauauuagugaaucuuugaugaaacaguaguuaaaguuacgagcgugagccaccacacccggccuaaaguuguaguucuuaaccacuaucacaucgucauuuguuucucuguuuaauauuaaaauugccauuuauaauguauuuuucuuuaagugcaaauaguguaucugaccuauuaucaaucauguuuauacuuuuauuagguggaccacacaggagaauauggaaaucuggugacuauacagucauuuaaagcagaauuucgcuuagcaggagguguaaauuuaccaaaaauaauagauuguguagguuccgauggcaaggagaggagacagcuuguuaaggugagccuucccuucucuggcuuagcccuuagaguuuuagugaugaaaauuuuuaguucauauuuucuuucugcuuuauuugggauuuugucuuuauuuugaauacuuacaaaugaggaagauuuguagaguagaaaugcauuauuuucuagaaccaggcuuuucuccauuuuuuuugugucucugaaagacaaucauuauuauaugguugauucaaguaaaagaauaccauuaacauguacagacauguacagugagguugcuucuuaugaaaaaaaauacuuuggugucugucucuuauuuccuugaauagugcaaguugacguccuuugcaucaguauaccgggucucguacugugccaagugcuauuuaauguaccaaaaagggagagcauucuucccuuaccauuugcugacgagcucuuuggguccuacuggggagugguggaaagacacagugcuguuuuacucagguguuugcaguaugccuuccuaggggggacuuccaguuaaucuaauuacagaaguagcgaggggaaacuuucuaaaucaguguaaauguuguagcuuauucuaaaugaaagaauggcaguagguauuuaauuauuugggagacugucaagaggugcacagaugcucagauugguuugagugcccuuugcuauucucagaugacucuguguuuuuauaauaaaauaaacuguacuuguuuauucaugcuuaauuauucugaagggccgugaugaccugagacaagaugcugucaugcaacaggucuuccagauguguaauacauuacugcagagaaacacggaaacuaggaagaggaaauuaacuaucuguacuuauaagguaacuauuuguacuucuguuaguucaccaaaaacauauaaaagaugccauuugguugggugaaguggcucaugcccauauucauaaugcuuugggaggccaaggugggaggauugcuugaggccaggaguucgagaccagccucagcaacauagugagaccccaucuugacaaaaaguuaaaaaaaaaaaaaaagccagagaugauggcaugugcuuguagucccuuagcuacaugggaggcugaggugggaggaucacuugaguccaggaguuugaggcugcagugagcucaaacucugcagugagccccaguccagccugagcaacacagcaagaucccguuuaaaaaagaagaagaagaagaagaugccauuauuuggaccaggagucuacaaauguuuucugugaaggaccaaauaauaaagauuuauuuucuuuguaaaaaguauuuauuaauguuaauuauaguuagguguuucuuauagucaacugaaguauuuuuuccuuuuuuuucuacucaacaauaugucacagaaaucuuucucauuuuuuaacagcugcauuguguguauguauguaguuuuuuauacaaguccuuaucgaugggcauuuguguuguuuucagucuuuugcugcuacaaacaacgcuguauuguagugaauaaccuugaacauacaaauuucauacaugcgcaggcaaauuuguagcauggauuuccaaaaguuggauugcuggguuagaggauacaugcaucuguaaucugguacauauugccaaauuacucucaaugggaguguacccacuuacauuuccucuagcuauuugccugagaagacaauccucagucacauucuaugagcugaucaucuuugacucuuauauuaauuauucauuuaaccaguuuagaaauaacaauaaauccuuauuuugaagggccuauuuuccauagguuugucuuuugugauuucauuccuguaccucauuuuuaaacuuucuccuucuauaaauguuguaacagggacuaugggugacaugugcuuuuuuauauauuucuaguuuuccacuaugaacguguuuuauuuuuaaaauaauggcuaaauuaaaagcccuaaauaggggagugaagaagaauaaauuagaucuacccuccaaaaugcugcuugaguuaggcuauuguaauaaaaagcagaacuugguuuugagcuucuuaacugcuuucagagacuaaauauaaaacuuauugguugggagaggggcauacuguucauuaaggaaagcacaauuuuuuccguagccuucaaguuugugagaaauuugugacauggaaccuucugcaauaauaacuaacauaauagauguuuuccauuagcaguuuaaaaagcuaauuaauccucgaugaaugcaaaaagcaaaaguugcucuauaaaggcuacucuguagagggauuucuuugaugugguuaagaucauugguacucaagcuuuagcagacaucauagucacuuagagaguuuguuaaaaacacagauuucugauccccauucuuagaauuucuaauucagcaagauuaggguagaaccugugaaugugcguuucuagcaagauaccaguuauguugaugcugcacugguccagggacaacacuuugagacccaccagucuacuuguucuaccaucuauugaccugacuucauuuuagaacaaaguugaugaucuauuagcuaucuccuaucugacagauaauguagagauugcuaagaaguuuuuagagacuagauauucuguaaugugaaugaaaggaaauuguuuaugcucuaaauaccaaacuuuuagaugacaaagauaauaggugaagaauuggguuacaaaaguaugggcuauaggagcaccuccugaacucucagaaaguagcuaagauuuccaagcagauacacaauugaaccuccaaaguucauugcuguaaagcacaaaaaagcaaaugccugaccuagaauaucuugaaagcagaaauuacugaacuuucaucucuaccuuaugacuuuuucaacagcuaguuuucacacaaaacuauuuuaccauauaaguuauuccauuaagauuucuagccgggcaugguggcccacgccuguaaucccaguacuucaggaggccgaggugggcggaucacuugaggccaggaguuugagaccagccuggccaacauggccaaaccccaucucuacuaaaaauacaaaaaaauuagccaggcgugguggcacaugccucuagucucagcuacuugggaggcugaggugagagaaucacuuaaacccggauggcagagguugcaguugagccgagaucacaccacugcacuccagccugggugacagaccgagacuucuucucaaaaaaggaaaaaugucuagaggccagaugcaguggcucaugccuguaaucucagcacuuugagaggccaaggcaggaggaucacuugaggccaggaguuugaaaccaaccugggcaacacagcaagaccucaucucuacaaaaaauuaaaaauuuagccaggcaugauggcaugcaccuauagucccagcuacucaagaagcuaaagcgugaggauugcuugaaaucaggaguuuggggcugugcaugagcugugaucaugccacugcaguccagucuggacaacagagcaagaacuugucuuaaaaaaaaaaaagugggguugggggguaacccagauaauuaauuauuuaauguuauacaucucaauauuaaaguaaaaccuguaaacacaacaguuuagguuugacuauuucuuagaauuacgacaauaagccaguaauguuauuuugagauuacuccaagaaugugaaaguugugucaucauuauguuaaacuaaguguucuugccuuuaguuaagguucccuagacuacagcgaaguagucuacccaguccagucaucuguagagucauucccaauccugagauucaggucuucuguggucauugugucaacaagagcauacauugacuaccuggaacuagaucuugguauacaaaccuugugucauugugcaaccucaaaaggagagacuuguauauugaggcaugccagauaucucuugucagagagaaucagauggaaaugaagacaguucuuauuguguauguugauagcucagacauagcccuuaacauuaaccagaauuaggguggcuggccccauuuuucuccaccaaaacuaugcauuguuacaaaguauacugaacaagucuaaaaucuuaggugucagaggauuuguuuucuaaaaggcaagucucuaauaaacaauauuuaagugcugaaaggagcuuugcacuuaaccugaucauccugccuugugccaauaaauaauuuuuauuccuugucaugcauauuucagagcaucuaucucagucaugguucuggggagagaagccauaauaucuuaagacauucacugaauauaaugaauuaacuucauuucuguguaucuaggaugauaucagcuguguacuuucagagaacugagaaaauagucaucaguccuuuuuugugguauucacacaaaauacccagauacccaguugaaaucuuccagagagucuuuaguaccagagaaaacacugucauuugcuuuuugaaauucaaauucagcucuuucuccaacaaccaacaucacaguugagacucuaagcugagguagaaaaaagccaacccauuccuuucuguaucaaucucucaacaaaaaauaaggguuugauucccccuccccgccccagagcuagauauugauagagaguaaucaauguaaaagagacuuuagacagaguacacuacacugcaagaauguuaaugugaucaagcaucaggggucacagcuaacucaaagacagcaggggagagggcauguagaauacuuauuaggcaggaagggaaaucagaaaggccaugagaucauucauuuguuuauucaauaaaugugaauuuauauaccuacguuggguuagauacucuacugagugcuaggucuauagaaguaguaaaacauugcccuaguccuuaagguguucacauucuaauagggaaaauaaacauaauaaacauaauuauaaugcaaaguguauuguuagagaugguaccaccuucacuugguugcucagacugaaaccuagaggcuuuauuuucuuuuuacuuuuauuauuauggaaaauuucaaacauacaaaaggagacaauaacaucaugaacccccuuguacuugucacucaguuucagcaguuaccaacucauggacaauuuuguuccauuucucuuuccaccaacuuccuuccaauauuauuuuaaagcaagaugucauaucauuucaucuguaaacauuucaguguguagaucuguaagauaaugucuguuuuaaaaaaccauucucacaauacugucaucacuccuaaaacaauucacaaaaauuccuaaaugucaccaaguaaugggagucauuuuaaacucuuguuucucucuucucaagucuugucuauuccaucagcaaguccuauuggucaacuuccaggcaggucacuuuaccaccccugcuauuaccacccuacuucugcagucacaucucuguagauacuagaguuuaaaccaacaguuuacuucugcucuugguuuuccaaagcuaguuuuauuaauaacuguuagagugauccuuuuaaaauugucuaagacagaguacucuuauucgguaucugugggggauuguuuccagagcccccuguggauacuaaaaucaagucccuuauauacagugguguaugaagcauuugccuauaaccuaugaaccuccucccauguacuguaaaucaucucuggguuacuuaaaauaccuuauauaguguaaaugcuguguaaauaguuguacuguauugguuuuuaaaauuuuuauuuuuuauuguauuguuuuuauugagguuuuuuuggugaauauuuuugauccacaguugguugaaucugcagcugcagagggccagcuguauuccauuuuccuguucagaaccccacaugaguucacauuaucccugaaugacaauucucuaaguuaagugaucugccucugcuguucucccuccagccuuaucuaccacucuccucacacuccucucacuuucugcuuguauagaugagucaucuccaccugacuuaccuggucuuuugcaauugcuuagacacaccaauuuguuucugccucagggcuuuucugcuucugccugcaaugcuuuucccucagaucuucacaccagucacucccuuacuucauucaggcuucugcugcaguguuacccucagaaaggccuccgaccauguugccauuacccacuuucucucuuuuuuaaacuuaaguuuuguucucuuauacuuauuaucuaauauuaugaaauguuuauuaggauauauguuccucaccagaaugaaacuuuaugagggcauagucuucaucugccuuuuucccacucuguucucagugcccuagcccuguguguaacauguaauacgcccccaacaaauaaauguuaauaaauuaaucaaaugcuuccuuaagacacaaaacaguucaacauaugugagaaacuuaaaauuuaaaaauguauagaacuaaagacaccauaaggacgagugaccagcugagaaaacgaauauaauaauguuaauuagaacaaaaaggaucauuuuaauauaaagaacaagggauuuauaugaagaauacaaugauauucaacuuuucuaguaaucuggaaaauacaaauuaaaaccacagugaaauacuauuacccucagauuagcaaaauauaaaaagccugacaauauuaaguauugcgaaaguuauggaauaacucuacugguggguauauaaaucgguacagucacuuugaauaguuauuuggcaauaucugguuaaccgaggugaagauguaucucuggcucagcuguuaaauuccuggguauauacccuagagcagacuuguccaacccacagccugcaggccacaugcagccuacaggauggcuuugagugcagcccaacacaaauuuguaaacuuucuuaacauuaugagauuuuuuuugcaguuuuuuuuucuuuuuuagcucaucagcaaucauuaguguuaguguauuuuauguguggcccaaggcaauucuuccaguguggcccagggaauccaaaagauuggacaccccugccuagagaaacugaaauauguucacgaguaguuuauuucauugcagcaguauuucauggaaauguggaaacaauguaaauguuaauaugcagauuggauaacuguuguauuuauguaguauauagcuguuaaaaugaaugauguagaguuaaauaugcucacauaguuaggauaaaauaguauugaauaaaaaaccaaauuacagaaauauacauauaguauccuaauuuuuuuacuuaauacuuacaacuauuuguguacauauagcuuugaaauaaaaauauaccaaaaaauacaagaacaugauaaaccagcuaacagucaucuugauggugggagggacuuagggucagugaagcacacaagggggagcuucaucucuuccccagcaaaugugagaaaauccuagauuugauaaagcuguuuaauggauaaaaggguaucuguuaauaucauuuucuauacuuuauguauguuuauaauauaauuuuaaaaaacuuuccuaguaaaguugcuuauuuuauauuuaggaguacauuuucucucugugaagauaauaagacuaaagcaagaguacauguaauuucaauaaugaaguuacacuaaaauugagaccacauucauggguaauaauuuccaagugaaacuccccaaauuuaauugauacuaaaauuuuaaggaaagcaguuaauuccucuccuaacuggacaaacuaaguauggauuaaugacagaugacggugaguauaguuaacaggagugaccucucagagaaucguggggauugagugaugggcaggcucucaaacaucuaggcagcaggcuggaaaauuauauucuuugagcuuaaguuuauuuccgauugguuuccuccaaggagcuuugucuucuauggacagagaaauauuaauacaacuugaaaaaaaaugcuuugcacugacucugauagcugaaugaucaucaaaugcucuuuaauggccuuuuaaaauuaaaagguauuuaaucuguaacuccaggugguuccccucucucagcgaagugguguucuugaauggugcacaggaacuguccccauuggugaauuucuuguuaacaaugaagauggugcucauaaaagauacaggccaaaugauuucagugccuuucagugccaaaagaaaaugauggugagugacacccaaaauuaaagguuauuguaagauuauuuaauggcuuauuaaagcugacagcugucagauauuauagaauacaaaaaaacuuuaauuucaucagguaauugucaaagauacuaaguaaaagaaaaacucaucagaaugaaagugugugagugaaaaaggaaggauuuuaaacuacauaauaugucaacccuugucagauaagaaauguaaagguuauucaaugugugcugauuuguuuucaauuugggauaaacuaauucuuagcaaacaaaacacuaaaaugccaggcacgauggcaugcaccuguaaucccagcuacuugagaggcugagucugggggaucccuugaacccaggauuuugaggccagccugggcaacagagcaagaccccaucucuaaaaaacaaacacaguaaacaacaacaacaacaagauuaugaaguaauuuuuuaugaaacugauauagaaaaccuucugagacauuuacaaugucacauuggccaucuagucugauauucauucgcugaaucagcaacauuuauuguauguuuucugucuaccagguacugugcugacuuaagacuucacaaauaucaaauauuacgacuaaucaucauaauccuuauccucauuuuaaaaugagaaguucagagaacuugcccaaggccagugagcuaauaaacagagcaaggauuugagccuugucuaaauccaaaauccauuuauuguucauuuuauugugcuuucugugacauguuuuuuaaaaugugugauaagugcuauagguguugugauggaagucuguacagggcacacaggguacaguguagguauggaggaggaagugcuuaguucugccugggguggggagaauagacagaaguagauccaagaaaugcuucacagaggaaaaggugugugagccgaguuuuguaaaugaguuguuuuuccaggcagaaggagcauauaagcaaaggagaggagacaugagcaggaaaagacaacauaagcauaggcuuaguguuugaggaagaaaagaugagauuggagcaguaauuguuggucaaaagauggaguguugcuuuaugaaaugcaaaggaguuugcaccuuaugcuauaggccucauaagacccuaaaggauaguaauaucagacuugcauuuuagaaagaaauuccgacggcacuguggguucuauuuuugagaaugcaaacuggaggcaugagauggucugaacugagaugaacagcaguaggaagggagaaucguggguagagaugagaaauaugaaggaggcagaauucauaggauuugauugcugauuaaaaauaagguuggggggcgggugugguagcgcaugccuguaaucccagcacuuaaggauaccaaggcaggaggauugcuugagcccaggaguuuaagaccagccugggaaacauagugagaccacaucucuacaaaaaauaaaaagucagccagguaaugguggcacaugccuguaaucccagcuacucaagaggcugaggugagaggauugcuugagcccaggggccaaaauugcagugagcugugaucacaccccugcacuccaguccaggugacagagacccugucacccugucuccaaaaaaaaaaaauguuggagaaaaggaguagccagugccucccaguuuucuguuuggggcagcuggguagauggugaagcucuuuacugcauugaagaauagaagaggugacuaaaguuugccagagaugaaguauuugaauuuggaagugauccaagugaagaugcugaaugggcagcuugagaagcacauuaagcuaaagcuuaauaaagauaucugggccaaacagauuuagaaaucaucagcacauagauggaagggaguugaagucgguaagcuuugcuucagguaguauuuuauggcaagaagauguuggaggauagagaucugagucauaucagcugccaucuaugagggauucuucuguucuuucucuuuuccuguuuucuauugcaacccaaugcugugaugccaccugagguuaucuggaacuacuuaggcauuucuguguuuauuucugcuuaagaguacaggauuauucaaauuagaauuuaaucaaaacaaguaacagucacuguaggugugcuuccucccccaacaauuaauauggaaauccuaaagggauuaucacuuguaauuaauugcuucccuguccagacuguuagcuucuuguagguaauguauccuguucaucuuuauugccccuauaucugucauauuuuuauauaaaaauguguauauuaguuuaauugaacacaauauugaaaaauaauuauauauauucucuauuuaaaggaggugcaaaaaaagucuuuugaagagaaauaugaagucuucauggauguuugccaaaauuuucaaccaguuuuccguuacuucugcauggaaaaauucuuggauccagcuauuugguuugagaagcgauuggcuuauacgcgcaguguagcuacuucuucuauugguaaucuucuuguacauauaguagauugagcacuuuguuguuuggcagguuuuauuuuuguuugauucagcacuuuuucuacauucugaguugcagggggaugauagugaugaugugguuaguaaccaacccaucuucauuauuaaaucauauguuucuuguucauccugauucuuagugucuaccuuuuuauaacuuaugcagaagagaauucuccuacuucaauaaauaauaaaaagacaggguuuucuucuuuguuuuauagugaauauggcauauuuucucuccucucaauauauuauuuucugagacuuucuuuggaaaauaaugaaaccugugauaacuuauuuccuuuaauuauuuuuguucuuuugcauauaaccucuaaauaucaucaccuagugauuaauacuuuuuaauagaauuuuguuuucagaauagaaaccaugagauauauuuaaauauuuuguguacaauauauauuuugacuuuuuuucccuaagaaauuagaauagguagauaguaugguuaacaaaauccuagaguaugagaacuaauguaaacauuagagaucaucuaaucuauuuguuguuuuuuuuuuuuuuaacuaaagacaacucccuccaucacuuacauacuauaccccaggaaggcagggcauguauguuuugaaagaguucccagguaauugugaaacucucuucuacauagagaaucacuaaucugauacaacuaguuuauaaacaagaaaguaggccuaguuaaugacagagcaagccagacacccagucauucugauucccuacccaguguguuuuuuuguaaugccaugugauuucucccauuagugcaugucaucaucugucuuaaauacagaaaugcaguuuuuuggggggauacacaccuggugaaaugaauuaaugauuaauuuguguuaaauauaauucaucaaggagaagaaaguuucacugaagagugaagaguuuauccauagacuucucauuuuauaaguauguucaauaaaaauuugaguacauauaaugcacagcuuugacccagguaaauaaugggucucaacuuuagccacaauaauuuuuuaaguacuaauauuuuaaaaugugugccuauuaguaaagagaaaauuuuuuuagcaaaucaucuaggauuuguaaaaugcaauaugcauuaaaauagcuggcaagauuugaguuaaacucaacauggccgguuaugcacaucauuuaaguaggcuaaaaauccuaaacuacuuaaagauuauaccaagucaguggucuuaauugaaauuauggcuauauauuagaaagagauggaaucagugauuucagauuguuuguuucuuuuuucuccaguugguuacauacuuggacuuggugauagacauguacagaauaucuugauaaaugagcagucagcagaacuuguacauauagaucuagguaaguaauaaaaucuauguaucuauucuuuuuaguaaauauuuggucaucauggaauguuguuugccuaccaagauauuacaaauauaagagacagauaaauugaagcaguaaauauuggguuuuuuuguuuucagcauaaacaguuguccuagaagaaacaguuaacucugccugggguacugagugaaacuuaauagaugaggugucuuuugagccuggucuucaagaaagaaagaaagcauaauucagacagaagauagagcagauucaaaagaaggaaucagggcuauuccaccaaaacaaggaguaauuuuaagauguagcauguugugggaguggugagacauuaaaugugucuggagugaaguaagccuguaguugagucgcuugagagagagauugguacuagacuguaaaaagccaggcuaaggaguuucaacuucauugcauuaaacuauaggaaauaaaugaaggacaugauaauauuuuauuuucagaaauauaauuucaggagcacuuuggggagugguauuggcagcaggaagaaaaauuaagggauauuguaauaguuuagaugagaaaugaugaagauuuauacuaaaguuguagaaaccagaauauuggauuugagggacauuuuuguaguaaacuguaccagugauauuagaugaggaaauagugggggaguggggcccccagauaacugaagcuucuaacuaaggaauauaucaaguuuuguaaauaguaagaaagugaugaauuuaguuuugcucauuauuuugaaguauuaauggaauuucuagguggaauagacaguuuaauauauaagaaagaaagaauauauagcuucuauguauauauauagacaguuuaauauaaaagaaagagaauauauauagcuaaggaauauaucaaguuuuguaaauaauaagaaagugaugaauuuaguuuugcucauuauuuugaaguauuaaugggauuucuagguggaauagacaguuuaauauauaagaaagaaagaauauguagcuucuauguauauauauagacaguuuaauauauaagaaagaaagaauauauauagcuaagaaauauaucaaguuuuguaaauaauaagaaagugaugaauuuaguuuugcucauuauuuugaaguauuaaugggauuucuagguggaauagacaguuuaauauauaagaaagaagugugaauguaauguaaagaagugugaauguaaugacaaacuucuauuaaacaguauuaaucacuaggugauaauuuuuagagguuauaugcaaaagaacaaaaauaauuaaaggaaauaaguuaucacagguuucauuauuuuccaaagaaauucucagaaaauaauauauugagaggagagaaaauaugccauauucacuauaaaacaaagaagaaaacccugucuuuuuauuauuuauugaaguaggagaauucucuucugcauaaguuauaaaaagguagaugcuaagaaucaggaugaauaugaaacauaugauuuaauaaugaagcugguuugguuacuaaccacaucaucacuauuaucccccugcaacucagaauguagaaaaagaagugugaauguaaugacggagauccagaaucuucagcaaauagauuucaguugaagucacugggcuggaggagguucugaucucacacaucauccgugauaaagagaccuaaagaugaaaucauaagggaagugagccuuggaaaggcugagccagaaaaaaacugagaaguacucaaaggaagucaggaucuuggaaggcaagaggggaaaaucuuuuaugaaagaaguagugcucaauaguaucugauacagaaaggucagagaggaugaaugcugaaaauagaccuuugaauuuaacaaguaaucaauccuagaggccuuggaaguccccuuuggauagaauggaggaaaccauacuguaaaaaggcaaggacugaauggaaguuaaggauguguagauuaagaauguggaaucugccaggcgcgguggaucacaccuguaaucccaacacuuugggaggccaaggcagguggaucacgaggucaggagauugagaccauccuggccaacauggugaaaccccaucucuacuaaaauacaaaaaauuagccgggcgagguggugggcaccuguagucccagcuacuugggaggcugaggcaggagaaucacuugaacccaggaagcagagguugcagugagcuaagaucaugccacugcacuucagccugggcggcagagcaagacugucucaaaaaaaaagaauguggaaucuuccuacaagaaguuuagaagggaagggaaggauggcagagaaauuugcugcaggaaugagagacacauuugguccuugcuuuuuuaagauaggagagguuuaaaccuguuagauauugaagauacaggagaaaaacaaaagauaauugaaauagcaagggaaaucauaaaguacgugagucugauagcauuggcuuuagauuggaggcauguuagcuuuucugcugagagagaaggaaaagugaugccaauaggaaagucuuaagcuggagaggaaggaguaugagggaauuauauuugcuauuguguuuuugcugagaaauagaaagcaugcucauuugcuaagaauuggagggaugguaacuggccuuaaaagaacaaauaaaauucuaaaauuuaccauggaaaugagaccaagaccugacuagaaagggauaaauaaauaagacaugccaagcaguuuaaggggcacuuucaauccuaaauuuguaguggagccaauaggguuguuguaugauuuuccagcaguccucaacauccuuggagcuuaaguuguaguuuaaaaugggagaugugguggagggacaaggggacaaggagauuugaagcacugaugagaguaaucaaacuuauugucucuaccccugggcugaguuagggaaagaagagggcuaauaaacuagaaaucucagucaaauuugaagacuguuuaguaagaauaagggguagaaggagaagagguuuugauuagaauguacaauuuacaaugucuaagaagcaguuuuagcagacucauuucuggaguacaacccauaugagugguucauuaagauagaaugaaauugaauuccauuagaacagagacagucacggauauuauaugguuuuccccagaaugaauucuagaguugggacagaggggaagauugugagcuagguccaugccaacauucagcgaaugugagagaaaaccuuacagguuuacagaguaaacgugaagauggaagggauuuguuagagcuagaagguggggaucucaacagaggagccagacuuuaucugagaaugaaaggagaguggucuggaagaugcaaauuagagguaggaguaugccaaccugaguccauucaggucgugcuaaaagcaucuauaaaugagaaggguaaauugguacaaccccuuuggaauauuguuuggcauuauccacuaaagcugacuuuauguauauccugugacccaucaauuccacuccaacacaaaugcauacauauguauaaaaauguuuauaguagcauuauucauaauagccccuaacuggaaacaauccagauauccaucauagguagaauggaugaacaaauugucguauauuuauauucucuuuguauauaaugagauugaaugaauaauaacacacaauauagaagacucucacaaauauaaugcuaagugaaagauuccaacauaaaagaguacacauguauaauuccauuuacauaaaauucaaaagcugauaaaauuaauguauaguguuagaaaucaggauaguggugacccuuugaaagaggugauuagugacugguaggagggacugaaagggggccucuggaaugcugguagaguucuguuaacguggauuuguucacuuugcagaaaucccagugagucacacuugggugauuuguauacuauucuguguaugucuguuugguuaccuguugcugcauaacaaaccaccccaaaauuuaguagcuuaaaaucacaauuuauuuauuauuaucucucauagucuguugacugggcucagcuggacaguuuucacuuaggaucucucaugcagcugcaguuagcaucuggggcuggaguuaucuuaagacucagcugggccagaguucaugauugcuucuucacuuacaugucugaugcuucagcacucccauguggccucucuguccacaauaguguccuggaccuacucagcaucuuggggcuccaaggggaaggaaguggaaguuaagggcuaggccugcaacuugcacaguaucacuuccaucacauuaugucaucacauagucaugucauaggguccauccugguucuucccuguuucugggacuccaguaacccuauguuaggccuuugcaauguaucauuuauacuguuaccugcuagucuauauuuucuaaccuuuuuuuccuuuuuucugacucacuccuuggugucaguggacauauccggggaaccuggacuuucagcccuacucagcuauagcaagcccuuucccuauugagugucaguggaggccaauuggggaaucuagucuucugcccuuaccuagcaguaacaagguggugacucccaaaggcauuaaaggcagaaguuuaaggaagauccugagucucguaauaacuaaaagguguaggugucaauugaaaaucauuaggcauaccuggaaccaggaaaaucucaacuuuaaugaaaaauggccaccuguaggugccaacacugagaugacaaugauguuggaauuaucuaagauuuuaaagcagccaucauaaaaacacugaaggaacaauuacaaacaugcuugaaacaaauuaaaauauaguaagucucagcacagaaauaaguagucucaguauagaaguagauauaaaggagaaccagauggaaauuuuagaacagaaaaauauaguaaauaaaauaaaaaauuucaacugcagaaugaggagacagaagaaauuaucagugaauagaagacagagccguagaaauuacccaagcugagcaacagaggaagaaaauuaagaggaaaccuucagcaucuagggcuaaacagaguuccuagacuugauaccaaaagaacaaucuuuaagaacucucaaaacuuaacaacaaaaucuacuuauaaaauggccauguacuacaaauguguauagcagcuuuauucauaauagccaagaaccggaaaaauccagauguucuacagugggcaaaugcuuaaacaaacuguguuacauccaugcccugaaauacuacucagcaaugaaaagaaacagaacuauugauauacauaacaauuuggaugaaucuccagagaauuaggcugaguguaaaaagcuauucccaaaagguuacauacuguaugauuauuccacuuccauuuauauaacauacuugaaaugacaaaauuauaaaaauggagaacagauuaguggcugcuagaaaaauagggggucagagggcugggugauaggcuaugggagggaaauaggugcagccguaaagggcaguaugaaggauccuuaugauaggaauauuauauaucuugacugcaucgaugucaguaguaguauaguuuugcaggacauuacaguuggggugaaauggggaaaaggcauaagggaugaucuuuucuguaugauuucuuacaacucgaagugaacauauaauuaucucauaaaaugucauuaauuuuuuuuuuuugauggaguuucacucuugucgcccaggcuggagugcaauggcacgaucucagcuccauguauccuucaccucccagguucaagugauucuccugucucagccucccgaguaacugggauuauaggcaccugcuaccacacccagcuaauuuuuguauuuuuaguggagacaagguuucaccauguuggccaggcuggucucuuaacuccugaccucaggugucaggccuccucagccucaaggugcugggauuacaggcgggagccaccacacccagccuaaaaauuuuuuaaauauaaauauaucaucuccauuuuaaauuauaccaguaguuacuucauuuuuaaaaaucacccuuuaaccuagauuucucuaguuggguuaagaaguaguuagguuauuuggauuugagguggaucucacagacagugacaaagaugaggaaggcagccagagcagaaguaaacuacuguacauacuaguguucauagaacguagguaacaugugguuucuugccuuuguaaaguucacauucuaacuggaaagaaaguaaauuagcugucaaaccuccuaacuucacuguauucuuuacuuuagguguugcuuuugaacagggcaaaauccuuccuacuccugagacaguuccuuuuagacucaccagagauauuguggauggcaugggcauuacggguguugaaggugucuucagaagguaagugauaugaaguaaaggagggaaauaauuuuugaugucaaaauuacaugggcugggcaugguucuuugcaccuguaaucccagcugcucaagaggcugaagugggaggauuguuugagcccaggaguuugaguccagccuaggcaauacagcaagacccuguaucuaaaaaaauacacacacacaaacacacacacacacacacacacacacacacacacacggguuagagauuuguauagauuauagaauuuagugcuagaaucguauuccagugccuuaucaauacuaaggaaaagacccuggguaaaagcaauaauaguuccucuuccuuccacccaccugggaccuaagcccauguaacauacauacuguuauuccaaaccuccucuggaagcaucccaccuuuacuuuuaacaccucuauccuggcugacuccuucuuaaugauccaaacuacuauugggugcucaucacugugcauauagaagagacuacauuuuuauuuauaggagcuuguguucuaguauaacauugugcuacuaaaaaagcuuugcaguuccuuguaguuuucccagcauaggucuguguacucaacuuggauuggggcagauugcagucaguguaaacuaauaauugccacaauaaucaaagacugagagcugagcccaguggugcaugccuguaaucaauaguguuguguuauucuuguaaaugccaagcuugugaaauagucaaauacauauuuguauucauuucaaacgucuaaugaaagcccacucugccaaguauuaugcuauuuugagauacagauauguagauuauuaagcauaggcucagcauacuacacaugagaguauacagauaaagauacguugacaacauugguguguaacaaaauccguauuuauaauguguuugacucuagaugcugugagaaaaccauggaagugaugagaaacucucaggaaacucuguuaaccauuguagagguaaaguauuuuauaaggaagacuuuauuuuuuuucuuaccagguagacuguguaucucaucaggaagucacugaugugaagagcacugcuucauuuuaacauagggggauguggcugggcagcagaaaggaggagauugugcacuuagccuuuucacacauccaaaaauacugguuuagaaaugccuucagcccccuugaguuucuuggaauguuagagcauuguaaguagucucuaguuuucaauucauaaaucaauucuuugacauuuagauauuccauaugguauuauuauuuucagaaugguuuccauuaggguuuaagaaaaaucagaaauuuauaucuccuuuuucccugcucagguucagaacuaauuagucagacaaauggagaucaaauugucagcaucauuacuagaggaacauggcuuaggaaugagggccagacuaguuuacugcuggugcuaccucaguaccucucugcugucuuaacuuugggacagcucaccugaauaggguuugggccugcagagcaaacacauguaaucaggaucacugccuugucuugauccagggcagaaaaaaggaagucaaacaaauuucagugucugugcuguuaguaccuaugccagucauucaccaaucugguaaggguaugugagacaagaaaucaggaguguggccuccccagggaagcauggcagguagagugcaguaugggcuugccacuuuuccacuacucagcuuuucuuccuuuaaccugauuuauguuggacuggcugcauguuaguauuacuuuuacugcauuuaaaaaacauugaugcugaucaaauucaaaccagguuucuagagauggggcaggaauaugugcauuuuuaaaaaucucuccuacuguucaacuaggauaugagaacugucuuaauucauuggcauuaaccauuaagccuguggucaauaaggguggggcuuuaucccuuggaagaugaguaacaguccaucagggugguccugugugcaccuuuaugaaccgaggcaucuuuauagaucuccuuuggacugcagaugguaauacagauuuugcuacaaggaguuugcugaaauaggucccaauaauacguugguaaaauuaaauccaaggcugugcuauucccaagguuaaaaauacauucuuuuuucuuuuaccgauuucaaauucuguucauacauguugucauuuguuacaguuugccauugguucugcaguaagaauaaaugauaagaaaauaagcaugauguguaacauuuuaaaaaaauaauacaugguaacauggaugccucaauaaugucgaaauuaaacucuaaaguuauauuaucuugcacuuuuucauguaagaaaaagagggcugggcgcgguggcucaugccuguaaucccagcacuuugagaggccgagacagguggaucaccugaggucaggaguucaagaccaguuuggccaacauggugaaaccccgucucuaauaaaaaugcaaaaauuagcugggcgugauggcgggcaccuguaaucccagcuacucaggaggcugaggcaggagaaucgcuugaacccaggagguggagguuguagugagcugaaauugcaccauugcccuccagccugggcgacaagagcaagacucugucugucuuaaaaaaaaaaaaaaaaaaaagcccaaacuuuucaaauuaaagagucaaagcagcuuaacauauucuuuaguauuuuacucuaccuaguuucagucagaagggauuuuuaugcuaagguggauuugggaguuucuuccaguacuuguauccuaccuaacacucaccagaagaagguaguucuuuuagggccucagaaaucuuacuaguuuaaugccaaacugcuuauggacuucacuuuuuagaguaguaggagaucaaaugagagaagugacaguggccagauccuuugccauuguaaggacuuuggauuuccuuugagugaggguuuugagucugaaaagugauuugcaucuccaccuacaauaacugucaccuuuaaacacacccuccgggaggaggagccaagauggccgaauaggaacagcuccgguauacagcucccagcgugagcgaugcagaagacaggugauuucugcauuuccaucugagguaccagguucaucucacuagggagcgccagacagugggcgcaggucagugggugcacgcacugugcgcgaacugaagcagggcaaggcauugccucacuugggaagcgcaagggucagggaguucccuuuccuagucaaagaaaggggugacagacggcaccuggaaaaucgggucacucccacccgaauauugcgcuuuuuggaccggcuuaaaaaacggcgcaccacgagauuauaucccgcagcuggcuuggaggguccuacgcccacggagucucgcugauugcuagcacagcagucugagaucaaacugcaagguggcagcgaggcugggggaggggcgcccgccauugcccaggcuugauuagguaaacaaagcagccgggaagcucgaacuggguggaacccaccacagcucaaggagaccugccugccucuguaggcuccaccucugggggcagggcacagacaaacaaaaagacagcaguaaccucugcagacuuaaaugucccugucugacagcuuugaagagaguagugguucucccagcacgcagcuggagaucggacaacaggcagacugccuccucaaguggguuccugaccccugacccccgagcagccuaacugggaggcaccccccagcaggggcacacugacaccucacacggcaggguacuccaacagaccugcagcugagggucuugucuguuagaaggaaaacuaacaaacagaaaggauauccacaccaaaaacccaucuguacaucaccaucaucaaagaccaaaaguagauaaaaccacaaagauggggaaaaaacagaacagaaaaacuggaaacucuaaaacgcagagcaccucuccuccuccaaaggaacgcaguuccucaccagcaacggaacaaagcuggauggagaaugacuuugacgagcugagagaagaaggcuucagacgaucaaauuacucugagcuacgggaggacauucaaaccaaaggcaaauaaguugacaacuuugaaaaaaauuuagaagaauguauaacuagaauaaccaauacagagaagugcuuaaaggagcugauggagcugaaaaucaaggcucgagaacuaugugaagaaugcagaagccucaggagccgaugcgaucaacuggaagaaaggguaucagcgauggaagaugaaaugaaugaaaugaagcgagaagggaaguucagagaaaaaagaauaaaaagaaaugagcaaagccuccaagaaauaugggacuaugugaaaagaccaaaucuacgucugauugguguaccugaaagugauggggagaauggaaccaaguuggaaaacacucugcaggauauuauccaggagaacuuccccaaucuagcaaggcaggccaacguucagauucaggaaauacagagaaugccacaaagauacucuuugagaagagcaacuccaagacacauaauugucagauucaccaaaguugaaaugaaggaaaaaauguuaagggcagccagagagaaaggucggguuacccucaaagggaagcccaucagacuaacagcagaucucucggcagaaacccuacaagccagaagagagugggggccaauauucaacauucuuaaagaaaagaauuuucaacccagaauuucauauccagccaaacuaagcuucaucagugaaguagaaauaaaauacuuuacagacaagcaaaugcugagagauuuugucaccaccaggccuacccuaaaagagcuccugaaggaagcacuaaacauggaaaggaacaaccgguaccagccacugcaaaaucaugccaaaauguaaagaccaucgagacuaggaagaaacugcaucaacuaacgaacaaaaucaccagcuaacaucauaaugacaggaucaaacucccacauaacaaaauuaacuuuaaauguauauggacuaaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaucaaaagaaacaaagaaggccauuacauaaugguaaagggaucaauucaacaagaagagcuaacuauccuaaauauauaugcacccaauacaggagcacccagauucauaaagcaaguccugagugaccuacaaagagacuuagaaucccacacauuaauaaugggagacuuuaacaccccacugucaacauuagacagaucaacgagauaaaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccccauaguuggaaguaaagcucuccucagcaaauguaaaagaacagagauuauaacaaacuaucucucagaccacagugacaucaaacuagaacucaggauuaagaaucucacucaaaaccgcucaacuacauggaaaccaaacaaccugcuccugaaugacuacuggauacauaaugaaaugaaggcagaaauaaagauguucuuugaaaccaacgagaacaaagacacaacguaccagaaucucugggacacauucaaagcaguguguagagggaaauuuauagcacuaaaugcccacaagagaaagcaggaaagauccaaaacugacacccuaacaucacaauuaaaagagcuagaaaaggaagagcaaacacauucaaaaguuagcagaaggcaagaaauaacuaaaaucagagcagaacugaaggaaauagagacacaaaaaacccuucaaaaaauuaaugaauccaggagcugguuuuuugaaaggaucaacaaaauugauagaccgcuagcaagacuaauaaagaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauaaauuccucgacacauacacucucccaagacuaaaccaggaagaaguugaaucucugaauagaccaguaacaggagcugaaauuguggcaauaaucaauaguuuaccaaacaaaaagaguccaggaccagauggauucacagcugaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaacgaauccagcagcacauccaaaagcuuauccaccaugauccagugggcuucaucccugggauucaaggcugguucaauauaugcaaaucaauaaauguaauccagcauauaaacagaaccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccagagccaauaucauacugaaugggcaaaaacuggaagcauucccuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuugcagaugacaugauuguauaucuagaaaaccccacugucucagcccaaaaucuccuuaagcugauaagcaacuucagcaaagucucaggauacaaaaucaauguacaaaaaucacaagcauucuuuuacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauauugugaaaauggccauacugcccaagguaauuuacagauucaauggcauccccaucaagcuaccaaugacuuucuuuacagaauuggaaaaaacuacuuuaaaguucauauggaaccaaaaaagagcccgcaucggcaagucaauccuaagccaaaagaacaaagcuggaggcaucacacuaccugacuucaaacuauacuacaaggcuacaguaaccaaaacaacaugguacugguaccaaaacagagauauagaucaauggaacagaacagagcccuuagaaauaacgccgcaugucuacaacuaucugaucuuugacaaaccugagaaaaacaagcaauggggaaaggauucccuauuuaauaaauggugcugggaaaacuggcuagccauauggagaaagcugaaacuggaucccuuccuuacaccugauacaaaaauuaacucaagauggauuaaagacuuaaacguuagaccuaauaccauaaaaacccuagaagaaaaccuaggcauuaccauucaggacauaggcaugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggugaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcagucauuaaaaagucaggaaacaacaggugcuggagaggauguggagaaauaggaacccuuuuacacuguuggugggacuguaaacuaguucaaccauuguggaagucaguguggcgauuccucagggaucuagaauuagaaauaccauuugacccagccaucccauuacuggguauauaaccaaaggacuauaaaucaugcugcuauaaagacacaugcacacguauguuuauugcggcauuauucacaauagcaaagacuuggaaccaacccaaauguccaacaaugauagacuggauuaagaaaauguagcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauugaacaaugagaacacauggacacaggaaggggaauaucacacucuggggacuguggugggguggggggcggggggagggauagcauugggagauauaccuaaugcuagaugacgaguuagugggugcagcgcaccagcauggcauauguauacauauguaacuaaccugcacaaugugcacauguacccuaaaacauaaaaguauaauuuaaaaaaaacuaaaaaaacaaacaacaaaacaaacaaacaaaaaaaacacacccuccaaugcuuuguguauuuuacacucaucuaccuaaucuucccuccguaaaucuguccgaauuuccccaaaucauuuggugugauuguuccaaucuucaagaauaauuuucccagugaucuuaccacaguaagacccuuucugccuucagcuuuaggagggugcuucucaauuagcauccugguucccaguccucugggacaucauuucuuuccucucuuggauucauuucuuuucuucucuuagauuucauugaggcacagucacuauuucugaacugaucuccccgcuuccuaagccccuccuucagagcacuuuaaccuggguguauuucccuuuucuuuucaguguauuugucucuccuggccuucaagauuuuauuuucuuccuaauggaccauucucuccucuaagauuuuauguguuaugcuaaggaaauauaucucucccucuaacucagugaugcuuagccaagagcaguuuuguccccuagaggacaguuggcaaugucuggaggcauuuuuauugucacaauuggggaugggagaugaggauaguauuggcaucuacuggguagaggccagggaugcugcugaacaccucagaauguacaaguuagcccccacagcaaagaaauaccccauccaaaaugacaauagugcugagacugagaaacccugcucuagcuuaaucagucuguauuccuuuacuguuuccaaccacuucugucuugucagacugaaacauaauuuuuuacuuauuccaguuccuccuuaauucuaauauuugcaaguaugauuccugacacaagcccuugguuuugaaguaauuuagauuuuucuucuacuucaacccaagaaaaccaucuagucuguauuagaggccuucauuccuuuucauuaguucauuaauaaaauauauuaauauuucccuuuugugggugaaacugguuuggaucucugaaaucuaaagccaugucagugcccaacuugaagucacauaggaaaccuugaacuuaacggacaagcuacauguaaucaagcucaguuucuccacaguauuuaaugguccuggaggacacucaaaacagcauuaaaaaauagagagauuuugguucugcuaaucuaguacguguccugaaacuaaaucugcuaaaggcauuuuauagucccaaccugcagauuuacugagaaacuguauacagauagcagcaaaaaaguguuccaaccuuguaauacuggaaugcccuguagaaucauucuuuauauugucuccacuuauuacuaagauuuguaagcauuugcuaaagccuauuuuuuuuaaaguucuguguuuauaaauaccagagcaguuagcuguucugaacugccaauaucagaaauuccucaugaacucacuuucuaaaauuuacgaccuaaagcuacuugcucuagccaugucaguuguuuugguauccuaauucuacaccuaauauauaucucaagauuccaaacgcagcaccaaaccuuggguuuugaggagguuucaacaaauuauaccuuucuggauccacccagauuuagaacugagagaaaaagagccauaggaauaggguggagaucagaauuucagauuuguuacugauaaaacuauuggagaagacggcuuaggagugagguccaaauaggcuugcuggugcucuccaguucccacaucccaaucuauaccuugagacagccugggcugaggaagaauugggcccuacaaagcaaauacacuaacccaggguuaagaguagagagagaaggaaagaaagugacuaaccuuuuaauagauuaguuucauccagucaggaaacaugggucaagggaugucaccccuaaccauggaggaagaaugaauucagaaugaaaugagaagcuuggagcauuaugcuaggauaguuuccucaaggaaacaugaagugugcaugauguuuguuccccucccccaucaacuaccaugugacuggcuuauuuguaugauacugguucuacuguuucuaaguaugugauuaaaauguacauuguucuuuuaauacauauguucucucuguuuagguccuucuauaugauccacucuuugacuggaccaugaauccuuugaaagcuuuguauuuacagcagaggccggaagaugaaacugagcuucacccuacucugaaugcagaugaccaagaaugcaaacgaaaucucaggugagcaguauuuuaagaagguccuguugucaguuuuucagauuuucuuauucccaaggccuuuaaacuguucaccucacugaaaccuuuguguuuuuguccuuagugauauugaccagaguuucaacaaaguagcugaacgugucuuaaugagacuacaagagaaacugaaaggaguggaagaaggcacugugcucaguguugguggacaagugaauuugcucauacagcaggccauagaccccaaaaaucucagccgacuuuucccaggauggaaagcuugggugugaucuucaguauaugaauuacccuuucauucagccuuuagaaauuauauuuuagccuuuauuuuuaaccugccaacauacuuuaaguagggauuaauauuuaagugaacuauuguggguuuuuuugaauguugguuuuaauacuugauuuaaucaccacucaaaaauguuuugauggucuuaaggaacaucucugcuuucacucuuuagaaauaauggucauucgggcugggcgcagcggcucacgccuguaaucccagcacuuugggaggccgaggugagcggaucacaaggucaggaguucgagaccagccuggccaagagaccagccuggccaguauggugaaacccugucucuacuaaaaauacaaaaauuagccgagcaugguggcgggcaccuguaaucccagcuacucgagaggcugaggcaggagaaucucuugaaccugggaggugaagguugcugugggccaaaaucaugccauugcacuccagccugggugacaagagcgaaacuccaucucaaaaaaaaaaaaaaaaaaacagaaacguauuuggauuuuuccuaguaagaucacucaguguuacuaaauaaugaaguuguuauggagaacaaauuucaaagacacaguuaguguaguuacuauuuuuuuaaguguguauuaaaacuucucauucuauucucuuuaucuuuuaagcccuucuguacuguccauguauguuaucuuucugugauaacuucauagauugccuucuaguucaugaauucucuugucagauguauauaaucucuuuuacccuauccauugggcuucuucuuucagaaauuguuuuucauuucuaauuaugcaucauuuuucagaucucuguuucuugaugucauuuuuaauguuuuuuuaauguuuuuuaugucacuaauuauuuuaaaugucuguacuugauagacacuguaauaguucuauuaaauuuaguuccugcuguuuauaucuguugauuuuuguauuugauaggcuguucauccaguuuugucuuuuugaaaagugaguuuauuuucagcaaggcuuuaucuaugggaaucuugagugucuguuuaugucauauucccagggcuguugcugcacacaagcccauucuuauuuuaauuucuuggcuuuaggguuuccauaccugaaguguagcauaaauacugauaggagauuucccaggccaaggcaaacacacuuccuccucaucuccuugugcuagugggcagaauauuugauugaugccuuuuucacugagaguauaagcuuccaugugucccaccuuuauggcagggguggaaggagguacauuuaauucccacugccugccuuuggcaagcccuggguucuuugcuccccauauagaugucuaagcuaaaagccguggguuaaugagacuggcaaauuguuccaggacagcuacagcaucagcucacauauucaccucucugguuuuucauuccccucauuuuuuucugagacagagucuugcucugucacccaggcuggagugcaguggcaugaucucagcucacugaaaccucugccuccuggguucaagcaauucuccugccucagccucccgaguagcugggacuacaggcgugugccaacacgcccggcuaauuuuuuguauuuuuauuagagacggaguuucaccguguuagccaggauggucucgaucgcuugaccucgugauccacccuccucggccucccaaagugcugggauuacaggugugagccaccgcgcccggccucauuccccucauuuuugaccguaaggauuuccccuuucuuguaaguucugcuauguauuuaaaagaauguuuucuacauuuuauccagcauuucucuguguucuguuggaagggaagggcuuagguaucuaguuugauacauagguagaaguggaacauuucucugucccccagcugucaucauauaagauaaacaucagauaaaaagccaccugaaaguaaaacuacugacucguguauuagugaguauaaucucuucuccauccuuaggaaaauguucaucccagcugcggagauuaacaaaugggugauugagcuuucuccucguauuuggaccuugaagguuauauaaauuuuuuucuuaugaagaguuggcauuucuuuuuauugccaauggcaggcacucauucauauuugaucuccucaccuuccccuccccuaaaaccaaucuccagaacuuuuuggacuauaaauuucuugguuugacuucuggagaacuguucagaauauuacuuugcauuucaaauuacaaacuuaccuugguguaucuuuuucuuacaagcugccuaaaugaauauuugguauauauugguaguuuuauuacuauaguaaaucaaggaaaugcaguaaacuuaaaaugucuuuaagaaagcccugaaaucuucaugggugaaauuagaaauuaucaacuagauaauaguauagauaaaugaauuuguagcuaauucuugcuaguuguugcauccagagagcuuugaauaacaucauuaaucuacucuuuagccuugcaugguaugcuaugaggcuccuguucuguucaaguauucuaaucaauggcuuugaaaaguuuaucaaauuuacauacagaucacaagccuaggagaaauaacuaauucacagaugacagaauuaagauuauaaaagauuuuuuuuuuguaauuuuaguagagacaggguugccauuguauuccagccuuggcgacagagcaagacucugccucaaaaaaaaaaaaaaaaagguuuuggcaagcuggaacucuuucugcaaaugacuaagauagaaaacugccaaggacaaaugaggaguaguuagauuuugaaaauauuaaucauagaauaguuguuguaugcuaagucacugacccauauuauguacagcauuucugaucuuuacuuugcaagauuagugauacuaucccaauacacugcuggagaaaucagaauuuggagaaauaaguuguccaaggcaagaagauaguaaauuauaaguacaaguguaauauggacaguaucuaacuugaaaagauuucaggcgaaaagaaucugggguuugccagucaguugcucaaaaggucaaugaaaaccaaauagugaagcuaucagagaagcuaauaaauuauagacugcuugaacaguuguguccagauuaagggagauaauagcuuucccacccuacuuugugcaggucauaccuccccaaaguguuuaccuaaucaguagguucacaaacucuuggucauuauaguauaugccuaaaauguaugcacuuaggaaugcuaaaaauuuaaauauggucuaaagcaaauaaaagcaaagaggaaaaacuuuggacagcguaaagacuagaauagucuuuuaaaaagaaagccaguauauugguuugaaauauagagaugugucccaauuucaaguauuuuaauugcaccuuaaugaaauuaucuauuuucuauagauuuuaguacuauugaauguauuacuuuacuguuaccugaauuuauuauaaaguguuuuugaauaaauaauucuaaaagcauauacuaagacucauucacuuuauucaaauauuuguguguucugugugccaggcaugggacucguucuaaggagaaagcagugagcaaggcaggcauagucugccuauauaaagcucccaaucugaggaggauaggcaacugaccacgcagugugaaccggggagccuauugcacaaccagucugauaaugcugcaucucagucuaaauauccuag

SEQ ID NO: 15996 - RNA, 68547 nt, Homo sapiens
cagugccgccacuggaaccaggagaugcggcgcaggagcugucgcuguguuugcuuuaaccugagucuuguuccuuauugugguuccugcugugguuuugaucauguuguuacccucggacguagcccggcuuguauuggguaagcgcggacgcgggauggaggguuauuggacccggcuaugcuggacagaaggaccuuugaggccaaagguuuucccuugguagggaagcuuugggguuuugccucccagcuuacgaguugagacuggcggugauucuucgucauucggagguucugggcaguuuaagccucuuuguauguagaugcuccucucuucagaggcugcguggcgaggggaagcccgaggggaagcucgggguggaacaccuggggcggauucggaaggaaagucaggccuccacacuuaauuaggaccccugaaagagcauuugucugcaugacggacggauugcgugugcuucaaccuugggcgcaauuuccuugguucaguguugggaccaaaauagggcaaauagggaguuccccggccccccaucuuuguagagagaccuuccuggcgcccuucuaauaacccgcccuuauaacuacgaauuugggaguaggggugaucuuccuucuccauccuccacgcaauacgucguccaguguagaggugugaaaugccaguugcauauuuuaaaacagcaauuccuguuccuuugaucagcgaaaaauuucagaggguuaauugccuuaaauuaguugaacguuuucuagcccuaguuuuaccuucauuugaggagggauuguuugugggucacuugucugucaggguguauugucugugugagagacggguuuuguuguuguuuguccccugaaagaauaaagaggauuguacuacaggggacgagagccagguaaagcucaaaacccgagccaguaauuuacggacgucguaugcgacgucccuaaaaguaaauggcaagcaucugugaugaaaccucccauaguauucacagccauuacuacuauuauuuuauuguucggaaaacccauuugucuugugccucuuuuaaaugcccagcgcuguccacaaaaauguuauuugcgcagggcucuugauaagcacauuuugcaggaaacguuaaacggaaaugguuccaccauccauuuuugaagaaacuuaaugacaaguuuaauguuuuguuaaugucugauuaaucuuuugcuuaagaauucugaguuuuggcaguuugguaaucuaguugaguuucgguaacuauagucuuaaacaugguuucucagccucaguacuguuaacauuuugggccucauaauucuuuauuguggggagcuauccugugcucaaacauuguaggauguuuagcagcauuccuggcuucuauucacuagauuacaguaggacacccguuccccacccuacccuuacccaguugugaucagugaaaaugucucuagauauugcuaguauguccccuggagggcagaaucaccccuaguuaagaaagcccuaagaaagcaguaucauuuucuaauugaaauaauucacaucgaugugugaguauucuuucuccacaaaccagcuacucugcugacuuccugcuuuucauuuaauggacaaaaaacgccagccaugguuuucuuaucuuaaaaaucuuugucauucacauuccauuuucacugccaccaaucccgcaaugugccugccauuacuucucuuuuggacuucugucauggcuucccagacaguuguccucgcaauucauuuuauuuacuguuguuacaaaucucccugaagcuuucacacuauaccuuuuagucugaaaguugagauaauucuauucuuacuaaaaauuucagaugggcaggaguauacaauacaaaaaagccuccccaugccuaaugcucuuacuuuugucguuuaucauuuuacaucuuaaauagauacauaucguguauaucuuucucauaugagguuuauuauuuacucaugauucuuuuccuaucaguacccccucgccaucuucagcuccucuuguuauuggucccuucauaauguuuuuuuucuagcaaaucuuugggugccuaguauguuccaaacacugugccaauugcugaacauagagaaguuaaguuuucuccccuuaguguucagauaauuagguuuuuuuuaaauucuuaaacauacacacaaaaaaacacuuuucuggaccccacuagacauuagacacccauuaaacagaacauucugucuuauguucugugucacccuuucacaagucaaauuuauucaaagaacaaugaauuccacuuaguugcuguucuucaccuaccuuuuauccuucaggauacugcacucugacuuuugcaucucacuacuccacuuaaguagcccuuauugccuugcugggauuuuacaaaauguugugugggccagaauacaucaaaguguuuguugccucugggccaucaguucaguuuuuaucuauuuauucaaggugcucuguggaacugauccuaccuaccucuccaacuugaucucaacuuccuaacaucuguuuuaugcugcagacaugccaaacgaauugaaguuucuuugaaaauucuuguauguauucuacuucucuuugucuuccuaguacacuucuauucaagguucaggucaugccugaucucugaaacuucauucagcaaguacagucaguacuucuuaaauguugccauagcauuguacuucuguuacaaccuuaucaugucucauuguagauguguguuuacuuuuuuuugauaaaauauacuaacaaaauucaacacuuaaaaauguauaguucuuaaagcccaaaacaaugaguuuguuguuguuguuguuguuguuguuguuuguuuuuaauguacagaucaguaguguuaacuauauugacauuuuucugcaaccaucacuaccaucaguuucuggaacuuuuucaucuucccaauuugaaacuuacuugguuuuuuguuuuauuaguagucuuagucauggaugaauggacaagcuucaagaguucugggaguccccaaaacuaucaucugugaagguuuucuugaauagauuuguuaccuucuguaugagacagcaugcaguaaaaaaaguagaaaccauucugaguauuuaacauggaaagauuuaaugagagaauucguuuacacuggugagagaaaagcuaagacgcccagcagcuuacaacuaaggcaucucagugguuagcaacaguaggaagccacuaugcuaaugagaaggauaaggagagaggaagcaaucaagaggcugguuugacugcggaacguggaagacuugucugaugagggagugguagucuuagaggagacucuacugaggcagaaagggaaugggggaaaaauauggcugcuuccuccugcccuccagccucccaccagugcuuccuauuuacugagcccagccaguagcaggccgacagaagagcuuggggaacauugccuauauagagucaagcuuuaugucauacaguagagagcgacagaagggucaagaacguguuugaggucaaacaggaccaaaacugacacaccccuaacaggucaagagcugcugguucuauucaccuuuauaucaccaaaacauagauauuuaauaaaacauuugcaaaaguauggcucugauuaugacacuccuuuguuuauuuaauaauauauguacucauugcugucuaaaacuuuucaugauccuuacccauuuugucuuuucuguuguaucuccaacuguuacccuucauaaaccuugugcugcauccaaacuggacauguuccccaaauaugauugcauauauacuuucugucagcuucuuugggauucccaaccauccuucaguacucaucugcaccuucaaacaucacauaauuuccaagcuuaguagugguuucuccagccccucccuucccaugaagugagucagcucuauuuucuuaccauuuuugcuuugcauuacaguuauuuguguauauaucuucuaucuccaaguaaauuguaacuuuauagacagaaaccuugucccuguuauuuguggaucuaguaauauaagacaacauaagguacggcuuccuaagaauuauuugcaugcuuaacgaacauuaaauuacuaaucuuucuaggaaauaauaaaauaugugaaggagauguuuucacauagcgugcuuuacuaucucuugcuugcuuuaaaccucucuuuuuaucuuucccucucuacaaguaggaagaaaaaauacccuucauauaguuaggaucuuauccuuucuucucuuuuucgguuguuuccccuucaauucauuuaguuacucauuaccaccuccacuuauaauaaaaguaggcugaagauaauauuauguuaagaaggaaacucaggcauacuuucuuaccuauucggggaccuuugucaguaaguuuacacaaaaaaauacacuucuuuuauucuuaaguuguuuuuaggaauaaaaggaaaaaacaguaauaacuaauauuaguuguagaauaacgauuuguauuauacugauaagagaugauuagugccuaguuuguauuuucuauuuuauuuauuuauuucuugagacagaauugcacucuugucauccaggcugggugcagcagugagaucuuggcuuacugcaaccucugccucccagguucaagugauucuccugccucagccucugaaguagcugggauuacaggcgcucaccaccacgcccggcuaauuuuuguauuuuuaguagagacuggguuucaccauauuggccaggcuguucuggaacuccugaccucaagugauccaugcgccucggccucccaaagugcugggauuauagccaugagccacugugcccagccaguauuuucaucauauuuggauuuucauucaucuaacaccagagauuuagaauuaauuugugccuaaaauuuccuguuaccugacugagaauugguuauagucagauacuuaaugaugauaaauaaacauuuuguaggcagauacuaaucauauauauauaguaaggccuaauuuaauagguucaauagguucuugaaaacugcaacuuuaagcaaaaugauauauaaucaaacuaauuuuaccauaggcuaacugauauauacaagaauuucuucagcauauuuuuggucacaaaaauaucaccacacuuguaaauaaaguccaaaacacuucuaauauuaaacauugaaauacauguaagcuauauauacauuuaagauggauuaauaaaaacaagauaauuacuuacccaguuaguccaguucaagguugcagguagcuagagccuaucccagcagcuuagggugcaaggcaggaacuaacccugggcaggaugucauucuguugaagggagcacucacacgcccacguacacucacucaugcucacacuguaauaauuuagacacaccaguuaacaacgugcacaucuuuggaguuugggaagaaacguguaccuggagaaaacccaugcaggcauggggaaaauguguaaacuccacacauacaguguccucagccagaaauugauuuuuuucucucaucagcaguauaacaaaaacauugaacaaaaugaugguauucgaggacuugcuauauaaugaucagugaacaugagaguagucaacuauuuacuacauuauuuuggaacuuuugggacaaaaguaaaccagaauacaucaaaucuaaucuaaaaugagaacucaagauugccaaaguuggggcauguuguuaagagcagaagauaauguauccuagauauuacuauuuugagauacauuauaacuuaaacacuuauuauagagguaaucuagcuuuuaacagccccaucucaugugugugcuauacagagguauaauguuuuaugaaaugccaugaauuaucuguaaugauuccagguuaugcuagcacaaaugacaauauuuuucugaaaaagguuuacuguguaucacuguauucugucuggggcauuguuucucaaccuuuauuucauuacacaacuuuaaggaaucuucuuaggcuuuuuuuuuuucccugacccuccucuccuccccacacgaaaguuuaauguuuuagugucaugaauauauuguauauguuuauauaucauguguaucugugauuuaugcauaaaaagagggagauuuucuucauuccucccugccccagaaccaauuuucagccucuuagggcaguaugacuccuuuugagaaugcauggucuaggggaaagcaaaucuacuuuaagauagauaaaaaucuacugcaaaucuauaguagauuuuaauaccaccgucuaucagaaguccccaagugacugaaggcaucuagggugauaaguacuugaaacuccaccaugaaaaggaaguauauuugagguguucaaucuaaaucuugaagcauaugaggaaaaagcuccaacuguccuaauuuuaaggugauucuaauagucuguagaaguuuuaaauuuuuguguuuacaaaaagcuaguaacagcuaacucaccuauuccaaauauuauaacggucggaaagccagccaucauaaaaauuacuuuucagccagcuaguuuucacaaaaagagaagaaaacauugcaguguaucuuugaucuaauuaauuucacaucugugguuugauguucaaugauaggaagauugaagucauguuaucugagauaaagcuuucuucagauauccaaaugcuuucuccaaaacacaaugccuuugguuuuugauuuguauauuuguuuguuucuucuuauuaguuagcaagagguuggaaaacagauucaucaacaaguagagaguggugaguugauucccaaaucacagcuagggcauugccuguaacgagaugaccauauccuugcccuuuccuuuuuaaaaccuuaguguauaaugacuuuguaggcaaccuuauuagguuuuucaccuguuggaccugguuaacgauacaguuccaggugaagagaguagaacguuauaaaguuggaagagacguuagacauaauuucuuuuuuuuaucuuuuaaauucagggguacaugugcagguuuguuauauagguaaacuugugucauagggguuuguuguacguauuauuucaucacccagguguuaagccuagaacccauuaguuauuuuuccugauccucuaccuccucccacccuucaccuccaauaggccccaguguguguuguucccuuuaugugcccguguguucucauccuuuagcucccacuuauaauuucaguagcuaacaaauacuuacugacuauuaugccagcacugagauaaguguacuucaaaggaaaauauaagggaauacuuauaaguauuaaguaauaccuauaagggaauauuuaauaguagggaauagggaguaauuauacuaaacugugaagaaugaguugaagauagcuagguuaagaaaagauuagcugcccaagcaaaggaaauagaauaaacaauggccuugaaauauaaucaauguguaucugugggacugaaagaccaguuuggcuggaagcgauggaaugguaaaacauaggcugaagaggaaauuaggguacaaagcaaguagaaccucauacgacacauuaaaaauuugaaaucauaggccgggugcaguggcucacgcguguaaucccagcacuuugggaggccgaggcgggcaaaucaccugaggucaggaguuccagaccagccuggccaacauggcaaaaccccaucucuacuaaaaauauaaaaauuagccaggcaugguggcaggcgucuguaaucccagcuacuugggaggcugaggcaggagaaucgcuugaaccugggaggcagagguugcagugagccgagauugcaucauugcacuccagcacaggugacaagagcgggacuccaucucaaaaaaaaaaaaaaaaaauuggaaucauauuuuuuuauugagauaugaugcacauacuacaaaauguaaacuucguuguuuuucaggguaugaaaauccaggauauuuauggauucauaaugugcagauaucaccaguaauuucaauauuuccaucacuccaaagagaauccuuauacuauuaagucacuuccaauucccccuugccccguccucugccaaccacaaaucuacuuucuguaucuauacaugugccuugccuggacauugcacauaaaugaaauagaauauuucgcuuuuugugucugacuuucacauagcauaauguuuucagccuuauuccauguuguagcagguauuaguacuucauuccuuuuuauagcugaauauuucauuauaugaauaugccauauuuuguuuguccauucauuaauggacacuguuaugaaaaaugcaggccagcuguaauggcucacccuguaaucccaacacuuugggaggccaaggcaggaggauugcuugaagccaggggagcgagaccagccugggcagcauacugagacaccccaucuguaccaauaaguaaguaauuagcugggcauuuauuuggugguacaugccucuaguccuagcuacuggguuggcugaagugggaggaucacuucagcccaggaguucaagguuauagugagcuaugauugagccacucuacuucagccugggugacagagcaagacucugucucugaaaaaaaauaaacugaccauaaaugucuggauuccaugcuucagaguugacuagauaaauaagaaaggucuggauuuuuuauuuuguuccacuaauuucugugucuaaccucaugcccguacaucgucuggauuacuguagcuuuacaguaaguuuugaaauugguaaguguaagugcuucaacuuuuucuucauuuucaagauuauuuuggcuauuccagcccccuuguauuaccuuaggaguuuuaggauguuugucaauuucugcacaaaaggcaguugagauuaugauaggaauuguguugaauguaucggugaauuuugggaguauugaguuuuuaacaauauugaaccuuucaguccaugaacacaguaugucuuugcguggauuuaggucuuuaauuuccuccagugacguuuuccaguuuuuaguaugcaaguccuuuacuuuuguuaaacuuauuccuaaguauuuuauuucuuuugaugcuauuguaacuagcauugcauucuuaauuuuugguaguucauugagauuuauugacuuuuauauauucacuguguauccugcaaccuugucgaagucauuuauuagcucuaauaguuuuuguuuuguuucguuuuguuuuugggacagaguuucgcucuuguugcccaggcuggagugcaauggcgcaaucuuggcucaccacaaccucugccucccggguucaagcgauucuccugccucagccucuggaauagcugggauuacaggcaugcaucaccuugcccagcuaacuuuguauuuuuaguagcaccaggguuucuccauguuggucaggcuggucucgaacucccgaccucaggugauuugcuggccuuggccucccaaagugcuggauuauaggcaugagccaccaugccccgcccagggagguuucuuaacuccuuuuuuuuuuuuuuuuuuuuuuuuuuugagacagagucuugcucuguugcccaggcuggagugcaauggcaccaucucggcucauugcaaccuccaccucccugguucaagugauuccccugccucagccucccuagcagcugggauuaagguggacaccaccaugccuggcucauuuuuuuguauuuuuaguagagacgggguuucaccauguuggccagacuggucucgaacuccugaccucaggcaaucugccugccuuggccucccagagugcugggauuauagguaugagccguggugccuggccucuaauaguuuuuuuguuguuguuguuguuguuuuuuauggcuuccuuaggauuuucuauauaagacaugucaucugcaaauagggguaaucuugauuuuuuccuuuccaaucuggaugcuuuuuuuuuuuuucuuuugagacggagucucucucuguugcccaggcuagagugcaguggcccuaucucagcucacugcaaccuccaccucccggauucaagcaauucuccugccucugccuccugaguaguuggcauuacaggcaugcaccaccacaccuggcuaauuuuuguauuuuuaguagagacgggguuucaccauguugagcaggcuggucuggaacuccugaccucaaaugauccgcccagcucggccucccaaagugcugggauuacaggugugagccacugcacccggccuggaugcuuuuuauuucaaguuuuuuccuaauugcccuggcuagaggauacaugcaauguugaauagaaaugacaagaacagaccuucuuaccuuuucccugaucuuauggggaaagguuugaauuuuaaaccauugaagaugauguuacuuggcuuuuuuuuuuuuuaauagauaacucuaugagguugaggaaauuucuuuuuauuucuaguguuuuuaucaugaaaggguguuggauuuuguuuuuuuugguuucuuugguagaguuuuguuuuguuuuguuuugcuuuugaaacagguucuuacucugucauccaggcuggacugcaguggcaugauuauggcccacugcagccucagccucccagacuaaaacuauccuucuaccucacccucccaaguaacuggaacuauaggcacaugccaccauacccagcuaaauuuuuaauuuuuugcagagaugggggucucacuauauugcccagauugguuggauuuuguucaguucuuuuuccaugauaaugugacuuucgucuuuuacguuagggauauaguauauuacacugauuuauuuuuauucaaccaaccuugcauuacugcauuaaaucccacuuggucauggugcaucacuguuuuuauauguugcuggacuugauuugcuaguauuuuguuaaggauuuuuuuuuuuuuuuuuccugaagacagggucucacucugucaccuauucuggagugcaguggcccaaucauggcucacugcagccuugacuucccaggcucaagugauccucucauuucagccucccaaguagcugggaccacaggugcacaccaccauguccagcuaacuuuuguauuuuuuguagagauggcauuuuugccauuaugcccaggcuggucuggaacuccugagcucaagcaauccuccugccucggccucccacagugcugggauuacaggcgugagccacugugcccacccuguugaggacuuuuauguucacuuuguuucuuuucuuuuuuuuuuuagacggugucucacucuguugccaagcuggaaugcaguggcgcgaucucggcucacugcaaccucugacucccugguucaagcgauucugucccagccucccgaguagcugggauuacaggcacacaccaccaggcgcagcuaauuuuuguauuuguaguagagauggguuuucaccauguuggccaggauggucucaaucuccugaccucaugauccacccaccucggccucccaaaaugcugggauuauaggcaugagccauugacccuggcucccauguccaguuucauaaggauuauuggcguguaguuuugugaugucuuucucuuguuuugguaucagggcaauauuggucuaaaagaauggguugagaaguccucuccuacuauuucaaaaagaguuuguaaaggauugguguuucauucaauguuuuguagaauucaccagugagggcauuugaucccaguugggcuuuuccucgugagagguuucuuuauuacaaauuccauuucuuguuauaggucuguucagauuuucuguuucuucuugagucaguucucauaguuugggucuauuagucuguucuuguguuucuaugaagaaacaccugagaguggguaacuuauaaagaaaagagguuuuaauuggcucacaguucuuuagguuuugcaggaagcauggugcuggcaucugcuugccuucuggaggccuugggaagcuuaacaaucauggcagaaggugaagggggaagcuggccucucacauggcaggagugagagcaagagagaaagaggugucacacacuuuuaaaugaccaggucuugugagaacugacuaucucaaggauagcaccagggcaugaggaaucugccccuguggccaaaacaccucccaccaggccccaccuccaacauuggggauuacaauucaaggugagauuuagcaggagcaacaucuaaacuacaugagggucuuucuaagaauuacucauuucaucuagauucucuaaauuguugagauaacaacuguucauacuguuccuuuacauucccauuuauuucuauaauauugauaguaauauccccucuuacuuuucugaucuaguauaauuugaguauucucuuuuuuuuuucgguuggucuagcuacagaauugucaacauuguugacguuuucagagaacuagcuuuuguuuuuauucauuuuucucuauuuuuguuucauuuauguauacucugcuuauuuccuucugcuuugcucuuuuucuaguuucuuaagguagaugaugugguuauugaauuuuuuuuuuuuuuuuuuuuuuuuugagaugaagucucacucuguuccccaggcuggagugcagcggcaugaucuccgcucacugcaagcucugccucccagguucaugccauucuccugccucagccucccgaggagcugggacuacaggcgacugccaccacacccagcuaauuuuuuguauuuuuaguagaaaggagguuucaccauguuagccaggauggucucgaucuccugaccucgugaucugccugccuuggccucccaaagugcugggauuacaggcgugagccaccgugccuggcccaaugugguaauugauuuuaaauuuuaagguuuuuguuuacuuguuuguuuguuuugagacaagaucucagucuguugcccaugcuagagugcaguggcgcgaucauaguucacuacagccuugaacuccugaacuacugggacuacaggcacgugccagcacaccuaccuaauuuaaagagauguuuuuagacacaggcucuugaauuccucaccucaugguacucuccugccucagccugccaaauaggugggauuauaggcauaugccaccaugcuuggcuuaucuuuuuauuuauuuauuuauuuuauuuaguuauuuauuuuugacauggagucuugcccugucacccaggcuggagugcaguggcauggucuuggcucacugcagccuccgccucucaggaucacgcaguucuccugccucagccuccugaguaucugggauuacaggcgccugccaccauacccaguuaauuuuuuauauuguuaguagagacggaguuuaccauguuggccaggcuggccucaaacucuugaccucaggugaucugccugccucagccucccaacgugcugggauuacaggcgugagccaccaugccuggcaucucuuuuuuaaauacagguguuuauagcuguaaauuuuccacugugcacugcuuuaguugcaucucauaaauuuauugacacuuauuucauguccuaauauauggucggcccuggaaaauguuccauguacacuugagaaaaauguguauuaugcuguuuuugacuggaauguucuauagcuaucugguaggucuaguugcuuuacaguuuaaauuuucuguuuguuuauugaucuucugccuaguuguucuauguauuacugaaagugugguauagaagccuucaacuuuuauuguugaauuaucuguuucuccuuucccuucugugaguuugcuuuauacuuugggcucaguuagguguauuuauguuuauaaguguuauuucucucucucucuuuuuuuuuuuuuaaagacagggucucacccuguugcccaggcucgagugcaguggugcagucaugguucgcugcagccucgaccuccugggcucaagcuauccucccaccuccaccuccagagcagcuggaacuacaggugcacaccaccaagcccagcuaauuucuaaaaaccauagagguggguucucacuagguuucccgggauggucuugaacccuaggcucaagcgauucuaccaccucagccuccccaaagugagcuacuucacccagccauguuaucuuuuuguggauugaccuuuuuugucauuaucuuugucucuaguaacaauauuugucuuaauaccuacuuugagacagguugaguaucccuaaugcaaaaauucagaaugcuccaaaaccaaaacuguuuguauaccaacaugacccucaaaggaaauguucauuggagcauuucagauuuucagauuagcgaugcucaaccaguaaguauaaugcaaauguuccaaaaucugaaagggagaacaaucugaaacacuucuggucccaagcauuucagauaagggauauacucaaccuguauuaacauaacaacuuuaagucuuacuugauuacuggaugguguaauccagucaucuuuccuauccuuuuacuuucacccuguuugugucuuugaaucaguccagcaccuggugccaagacgccggcugcagcacgggagguguggccagggcugugugcuccacagggcagcaggagcugggaacagaugggugcccuguccccuuccaaguuggaugggcaggagcccugcccucccaggugcagcugcagcuguggagcaggcaucccugcacucucgggggccagggaagccccccuuucccugcaggcuuggaagcgccuacucccgcugccuggccucucccugcucccggugcccacuccgauuucaaaguaaaguugaggcugagccugcugcugucgggaccuggcugggugugugcacacuaggggcagcaccaacacaccagccucaugcugccucggucccccucuggacuuugagcucugaugagcacaugagggaggccaagggugaggcugagggcaacucggcaugggccugccccuuggcaugaacagccuaagcaccgugggcaccuuggaugucagguugaugguggcaggaggcagauggucuccuagguggaaaggggcaggccccuggugaagccacaccuucaagccagagacagcuaaagccugggggccagacugcagauccauggcccagagugagaauuuauggugcuuuuucugcacccacccauggcuguccauggacccaucagcacauacuuacucccauuugagguccauaaaaaccccagacucagccagacucacagagauguugggacuaccagcugugagaaggagcuacucacugugggucucaucuccaccgagaacuggucacuuguugggacaaccugccugcagaaaggagcuacccacugcagcucuauucacugagaguuggacacucgucaggaugacuugccugcagaaaggagcuacccacugugggucuccucucuguugagagcuggacacucaucaggaugaccugccugcacagaaaggcacugcagaaaggagcuucccacuguggguauccucuccacugagagcuggauacucguggggacgaccugccuacggaaaggagcuacccacugcaggucuccugagggcuguucugucacucagugaagcuccucuccgccuugagcaccuuccaguugaccgugaaccucauucuuccuggacgcaggauaauaacaugggacccacugaaaggcgggacugaaagaucuguaaaacagggcugaaacaugcccccuugcucaccacguugcagacaaugagaaggaaagaagagcugaggcccuuuggggagcccagaccuaagagcuccccaaaccaggguugugacacccucuuuggggcucugggauucuugaugucuccaagcuucagggugccacuacguuccccaguacccacaguggaagccacugugguaugucugauccagaugcaaccucacagggagccagugccuggauaugcccgcccuacugcauccaacaugccugacuaugcucgguggcugagcucacucauacaccccucacugcuucaugccuggcucaccaccagcaggcaugggauuaggcccaguagcaugagccaaacacagccugcuuggccaagugggcggaacaaacccagcaggcccuagcaaaacucaggcaaaggcaccaccagccacagagguuucgaacuggaaaagcgacacccuaaggauccugugacaacagcauauaguuggaucauguuuuuaaggucauauaaauuacaccuucauacauuauaugcccauauuguuguguacaguuaucuuuuuaagcagaguuggggaagaaaguuuacguacaacaaacacuuauacuauuuuauuuuuauuuauuuauuuauguauuuuugagacagggucucgcucugucacccaggcuggaaugccuuggcaugaucucgccucacugcagccucugccuccccaguucaagagauucucaugucucagcuucccaaguagcugagauuacaggcgagucccaccacaccuagcuaauuuuuuuguauuuuuaguagagaugggguuuugcuguguuggccagguuggucucaaacuccuggccucaagugauccacccgucuaaaccucucaaagugcugggauuacaggcaugagccacugcaccuaaccuauacugcuuuauauuauguuguuaucaaguuacucuccaguaucaucucauuuuagccugaaggagucccccuuuaguauuucuuacagggaaaaucugcuagcaacuaauucuuuuaguuguuuauuugauaacauacaauuuuuaaaguuuuaguuuggagucuuguuagauauagaauucuuccuugaggcuggcugugguggcuuacuccuguaaucccagcacuuugugggggccaaggugggaggaucgcuugaggcuaggaguucaagaccuaucuaggcaacauauagugagacaccaucucuauuaaaaauuuuuucauuuaauuagccaggcauaguugugaguuccugucaucccagcuaccugggagacugaggugggaggaucgauugagccccagcauucaaagcuacagugagcuauaaugguuccucugcucuucagccugggcaacagagugaaacgcugucucaaaaagaaaagaaaauucuugguugaccuuuuuuugcuaucaguuuuuuaucuuuuuucuucaacaaucaaaguaaauaucaagucuuugaauaucaucucacuacuucugguuucuggugagaaaucagcugucagucuuacugagaaacccuuguaugugaugaguuguuucucacugcuuucacgauuuuguuugucuuuguauuuucaguuugauuauggucugucuagguauggaucucuuuuaguuuauccuacuuagagacuguugagcuaccuucauguguagauuaaguuuuuucucaaauuugcacguuucuagacauuauuucuucaaauauucuuucuggcauuucugucguucuaggauuuccauuaugcuuuuguugguaaaauugauggcaucccuuaggucucugagacucuguucacuuuucaucauucuggauuuguuuccauuccucagaucaaaggacuguuacaacucugucuccuucgugccauccacaaggcagcgaaugauagggggauguguuucagcucauuuguguuaacagcucauucaggcccacugccccacucuggcuugcggcuccugggccugcuuggcccugccacugcuuccugucauguggggcggcuguccgcuccuggcagaaggcaggagggcuacaauguuauagccccuuucccaccggcagguucugcagguucggcagguucggcagguuccaggguuuugucccgcaucugagaagaaugagauuacauggacaugagagacugagcaagguggaaaaggauuuuuauugagcaacagaacagcucucaacaugagaggguacccaaaguggauaacccucugugugauaggggucccaaagguagguaaccccacguguugcugaguccaggguuuuuaugggcucagaaugugggagugcauguugaguggucugugggcgggcauuggauuggccuuaggcaucgaggaaguuuucauucuaguuguggacucuguccggaacuggcaugcaguuuucaggcuucaggccaccuuugacuugaauguuggguuucaccauggacccaccccugucugccugggaauuugucucuugcugcuaucaauccucccucugaagaaguacaucuaacugccauuaggauaaggacaaugaccacaauugcugcuuucugcugacggggugcuguuuugcaaaaacagcagucugaucucucucagaggccuaagaguucccaguaaaagggagccaucgucugaggcuccauuugcaugaccauauggaguuuaaugaucucuaauugagaagaaacaaauuuuacaaggagguuaaauauacauggaccaaauauguguauuauacaaagaggagcuagaagggaaaaauguagucccaaagauaacagaaauaaggagcaaaauagacuaaacaugcugaaacaauguuauggcuagagcuguuucacccuagugaaagaaauuaaaucuuguauggggacaguuaaacuuuagaagaaaaauaacuguuuaggggaguauauaaucccuuggggguucaggauuaagggguccuuggcaaagaugccuugugaggaacagaacaagggugagaagagcaagccuaggagagacuauaaagaggauguucaugguagguuaaugacacuuaaccuuuugucauuuagcuugaggucucugauuuuuucacacugguacuucggguacuguuacaggucaacagagauaauuccgucaguuuucccaggccuuuacucgaguaugaugaaucuaagaauauuuuccagugacauuuacugccauaggaguagaaagaaguaugguauaaggucacucccagugccgaccuagagagggagagaggguaggaagugccuuuacccaguacuauguccccuggguugaauagagauggcccuaguucacagaauugggccucugacaguuguuucaguuccuauuggaaaugggccaaagauguuauacauguaaucuaaucagagguuucuuggucuagcaagaaaucauuggugagaaaaggucgucuguacaucauuucaaagggaauuaaacccagcuuugaagggguguuucugacauguaguagggcuaugggaagaaaaguaauacagggcagaugagucucucaagacaguuuucugcgguaccuuuugauaauaucaucugucuuuucucccuuuccugaagauuguggucuccuagcacaaugaagauaguauuguaugccuacugccuuugagacccccgggugacagccuccuugaaguaaggcccauuaucacucuggagguguuuaggaagugcaaaacgaauaauuacaucauuaauuaguacuuuuaucaccucagaggcuuucuguguccaacauggaaaugcuucuacccaguuagugaagauaucuacccacacuaggagguaguggaugccucucgucuucugcauaggggugaaaucuaucugccagucuuccccuggguaaccucccauuauuuggguuccagaagggagaagauguugcuugaggggauuauuucuaaggcaagucucacaagcauuagugaccuuuuugaccauuuuuagcagauuuuuaccugaaaaccacauuugggccaauugauagguuuuaugcuuaccuagguggagggcuugcugaaggauuuuaagaacuuuuaagaacuaccuggcugguagcugguagaugaaguuugcuguccucugauugcagccaucccgagggcugaaaggugugucccugagagguggcccauucuauuuccacaggagaauauugagguuuuauuucucuuggagcccucccagaucagaggggccucaaguggaucagaaaucuggggcccucuugcugccgacuuagcugcuuggucugccaccuuaguucccucagcuauuucaucuguucacuuuugguggccuuuacaauguaauauugccacuucccauggaaggaaaacugaggauaaugauaucuuaauuuccuggugguaugagagaccuauuagcugugaggaagucccuuucuuuccagauaguggcaugggcagggaggacuaggaaaguauacuuagaaucaguauaaauguuaacugcuuucccuuugcuuuauucaagcaccuuugugagggcaguuaccucagcuaguugaucacuugugccugaggagagaggcaugcuaucaauaauaucauuuagggugacuauugcauacccugcuuuauggaucccuuauuccacaaaagaacuuccaucuguaaagagaguccagucuggguucucuaaggagguuucuucaagguccucucugaccgcauagguuugcacuacuaucuguucauagucauguucaagcuccccagcuuucucugggaggaaaguugcuggguuuagggaaggacagauucuuaacugcagaucucucuaauagcacagcuuaauauuugaggagauggucauccacuacccagagccuccccuuagagaacagcaguccugccacauuauguggaguauaaaugguuacguuauaccccauggucaccuuaguggccucugguacugacaagguuacugcugugacugcccggaggcaggcuggccauccuuuagcuaccaaauucagcuccuugcuuagguaaccuacagguuucugggcuggaccuugggccugaguuggaacucccugggccauuccuuuccuuucugauacauaaagauugaaugucuucccuaugggaagacuaagggcuggugccucaagcaaggcuuguuucaguuggucaaagguccuuuuagccucugguucccaaauuagggagugagucuuaguugccugagucuccuuuauuaugugauauaagggacaaacuauuucaccauacccagguauccauaguccuguaauccccaagaauccucucaguugcuugaggguuuuggggagaggaaaagaggagauggacuuaauucuuucuucaccuaguucccugguccccucugacaagacuagaccuagguacuucacugaagucugacagagcugagccuuagauuuugagaccuuauauccucuguuagccagaaaauuaagacaagccuuacuguccuccugagacuuccucaauuggaacgcaaaggagaaugucaucuacauauuguaaaacuuucaccugaggauaaaggaacugcccaaacagcugggggcugucuuagaaucccugcgguaacaccauccagguuagcuuuguggucugguuggauggaucuuugaaugcaaauaaauacuggcaguugggguguaaugguaugcagaaaaagaugucuuuuagguucaggacugugaaccauuuaguucccucaaguauuugaguuaguaggguauagggauugggaaccaccauauggauuggaaccacagccucauuaaugaggcagaggucuuggaccagucuccuuccuuuguuggguuuuuguacauccaauaucagaguauuacaagggcuguugcaggguuuaaggaagcccugcauccuugaguuaucagugauggcuucuagcccuuuccuaacuucugguuuuaggggauauugucucugguuagagaaggaggugggauccuuaagguggaccuagaccaguauggcaguuguggcugcaccaauuuuccuuucaguugcccagacuucuggguuaauuaauauuggucugcacuagggugagacaaagagucuguccuggagccauaaggaugaugggucccguaccagcuaaaauagcccugccuagcagaggaguugggcuuucaggcaugauuuaaaaggcauggguaaacaaaagguccccucaacuauaacuaagggguugggaaaaauaucagauuaaaggcuuuccugagacaucccucacagucacacuaagaaaggaaggggaggccuggccuaauaaguugccucccaagagggaaaaaaaucagucucuuacauagcaaagcucccuguagucauaggacugugcugacuccugacaugauugcgggggcggaaacaacuuaaacgcagguaggggaaguugccugagggaaauaaccucuugcccaaugcaaauggauuccuucaacaggggaaagaaaacucucagucauugcauccuucuugcuucuaagaacagacaaaaaccaaguuguucugaauuacacugcugaugacuaagcaaaaugcucauuccacucaauaauauuaucacugugguuugcagcaacacccuuaacguuguguaugaagaagagauaggagccaggaagagagaaagaaaaugcuauaggaaagacuggaggucuugacugacacccgaacgggcuguuggggauuggggccaguccaggagccuucagguaacacugagguguagccucagccagaugccuucaguugcccgaggaccuuauuccgauccuaugcauuggcuagaccucugugaagggagacuggauugaaacaaagccaacauucccaguacccgagggugauggcagaggcuugacaaaaucuuccccagcaagccuguccuuugcagcugugccauucgcucuuaacuggcugacagaggcccagugcuucauccguuuuuggaaaaaaaaugugaaggcaagaagccucagaaaugaaaguguaagagguccacucuuacccuugcacagaucccagacaagccuccagaaaugacacaggauccauucagugccgcuaugcuguccagcaucucuguggccuguggcgcgccugccugggccucgcucgccucuaggcucauugcugggcccucucugcccacuugacccagcagacugcuucuggcccggauuccaugcccacugcagcucugcauuaagccccgcagcugguccaguugugccaugauugucuuccaccuugggagccggcgucugggugagggugacacagcagcgcccaaaaacuuggagauaccagcaaccacagagccccagcuguugcccagggaguucugaggucugagcccccaaggaccguuacaacucugucuccuucccaccgcccacagcauggcaaacggagguggcaggggagcgcauguuucagcucguuuguguuacagcucauuccgucccucuacccugcuucagucugcuucaguccugggcuggcccagccccacuccugcuuccuguuggguagcugcccagugccagcggagggcugaagggcuacaauguuaagaguuccuuucacacccaccauucagcagguucugagaucuuguccugcguuuaagaagaaugagguuauguggacacuggggagugagcaagguggaagaggguuuucuugagcaacaaaacagcucucgacacgagaggggacccaacgugaguagagcuccaugugagaggggauuccaaaggcagguaguccccaugugugguugagucugagguuuucaugggcucagaauggagguuuuuaugggcucagagugcaggcugauugguccaugggugaaccuggaaaaagcaccauuugauuggcuaaaagacaucuaggaaguucucacucuggucaugggcucuacacagaacuggcaguccaguuuucaggcuucagacugucuuuggcuugaaaguugucggguuucaccggguacccuacccgucugcuugggaguuugucuccugcucuuaucaacuguauuucuuuauucauauuuucuauguugugagagauuauucucauaauuuucuagacguggauuccuuuaguuuuuccaacuuauuuaaaauugcuuauuuaaagucucaagucuaaugucuggauuucccuaggcagauuuuugguuuuuugacucuguaugauccauacuuccuuauuucucugcauaucucauaauauuuuguggaaaauaggauguuuuaaauaauauaaugugacaacucuugagauuagauuuuucuucuuccauguuuguuguugucuuagcuguugcuguuugucuagugaguuugcugaacuaauuuuaugcagucuauauucugugaagaguugauacucugauuggaugaugauuuccuuaacuacugggagcaaauuaauaucccauuguuugccaagggggucugugugugcuuuggggcaugcuuuaguucagccaagcaguugacccacucugccuuagccuuccuucacuaguuaagguugauguucuuguuggaauugauaaugcuuugauucccaaagggcauaaauuaagaauuaagggaguuccugucucaacuuucaugcagaguaggucuucuguucauucuuuuuauaaaucauuuggcaaauaaaugaaguauacaaauacauagcaguguugugagaacauaguuuucugauaacgcaguaagugaauuuauaccaucaacugacuuggucuuuauggaaguuaugcaguagagggacauaguuauuuaucauuaauuuauugguucuccuguaaguacugugaaguaauuauacuuuguuaaacacuuuauuuuacuaguuuagcuagaauuguuucuugugaaagggccaccuguucuaugaacuguacuuuguauugcagcacaaccugguguuucuguucaaggcugccaaacacuagagcauuccaccuaagguuucaauugugacaucaguacaugcuacagcauuuucaauagcaguuuuaaccaaaaguacagaauuuaguauaaguaccuaaacuuuuauuuuuuauuuagguuacuuacagcaagaaaaccucauuucuaccugccagacuuuuauuuuggaaaguucagauuuaaaagaauaugcagaacauuguacagaugaaggguuuauuccagccugcuuacuggugaguuauuuguuccuuaagggaaauauuucaucaacacaagagacuaaaaacauagucauaaaaucagcuuaucagaaaaaaaaaauugaaauuggcagaaauuuggugguuuauauucaugcaugacugguaagacccaaagaagaccagcuuuucuuuuuacaaauuuaugccaaaacuauuaaaugaauuacaacuuugacuccgagaguuaguuucaaaaugacacccucguuucugauuaguuucgcugcugcugucuccaagccuuuuuuuuucuuccugaccuguaucuggcugcuccuuuuagacaaauauaaaacagauauuuugauauauuauugucaucucuuuuguuaaauaucacuagaccaacaaaccaucauuugguacauaguggauaccuuccagaacuacaucauuucacaugguguuugccauuuuauuuuaaucauggcuccuuaaaggcuaucacagauaacaugaaugucugcuuaggaaacugaaaaugaugcaaaacuaaaguuaagcagggucauagaauacagaauauacacaaauccauuauauuccguaugccugcaaugaacaauuggauuuugaaaauacccguuuauaauagcaacaaacaaacaaacaaaaugcuuagagauaaucuaacaaaauaugugugaaauccaaaugcucaaaauugccugagaucuaaggccugaauaaaaggagaauuguauuguguguacaaauugagagacucaauauuguuaagguguuaguuccucccaauuuaauuauagauuuuucacagucaaaaugccugcaagcauuuuuauagauaacacaaagcugaauucuaaguuuuaaauggaaaagaaacuagaauagccuaaacaguuucugaaaaagaacaacuuggaggacucacauuaccagacuucaagacuuacuaaaaaacuaugauaaucgagaugaaggggcauuuuugauaguuuaggcauguggaaccacauacaaguccauguagagacccacacaucugauuuugacaaaggauuaaagacaauucauugcagaaaggauggucuuaucaacaaauguugcuggaacacucagacauccauauguagaaaaagaaccucuacaaauaccucauaccuuaugcaaaaauuaaccaaaauggaucagaauguaaaacacaggaccguaagacuucuaaaugaaaacauaagaaaaaaauugugcaaaguuggauuugacagugaguuuuauauaugacaccaaaagcaugggcuauaaaggcaaaaauuaggcaaauucaacuuuauaaaaaauuaaaaacuugcucuacaagaggcacguuagaagaaauaggcugggccagacccaauggcucaugccuauaaucccagcacuuugggaggcccaggcaagaggauugcuugaacucaggaguucuguaccagccugggcaacauagugagaccucaucucuagaaaacaauuuuuaaaaauuagccagguauaguggugcacuuagucccagcugcuugggaggaugaggcuggaggauugcaugagcccaggaggucagggcuguugugagccacaacugcacggcugcacuucagccugggugacagaguaaaacccugucccaaaaaaaaaaggcugggugaaaauauuuauaucuuacaugucugauaaaggguuuguacccagaacauauguauagaauucuuaaaacuuaacaacaaaaaccaaacaauuuuuuaaguggauaagagaucugaagauacuuuaccaaagaaaauauacagauggcaauaagcauaugaaaagaucuuccauaucauuagucauuaagaaaaugcaaauuaauaccccagugagauacuaauuccuguuagaauggcuaaaauaagaaaacagguuuaaaaacuggcaaguccuucaccacaaauaugcagagcagcaggaacucuuguuucuuacugguaagaauuaaaagucauacaguggcuuuugaaaacaguuugacaugauuaugacaugauuauaugauuaugcauguacuccucaugugaaccaacacucacauuacccaaaucaauuggaaaacuuguucucacagaaaaaccuagacacugguguuugcuuauaguggcuaaaaacugaaaacaggcuaagugugguggcucacaccuguaaucccagcacuuugggaggccaaggcgaguggauagcgaggucaagaguucaagaccauccuggccaagauagugaaaccccaucucuacuaaaaauacaaaaauuagcugggcaugauggcgugcgccuguagucccagcuacucgggaggcugagacaggagaaucgcuugaacccaggagacagagguuuuggugagccgagauugugccacugcacuccagccugggcaacagagcaagacuccaucucaaaaaaaaaaaaaaaauacugaaaacaggccaggcgugauggcucacaccuuuaaucccagcacugugggaggcugagguaggaacauggcuugaagccaggaguucgaggcuauaguaagcugugagcagccacuguacuccagccugugugacagagcaagacccugucucuaaaaaauaaaaauaaauuuuaaaaacuggugacaacgaagaugucuuucaaaaauugacaaacucugauguguucauaacagcaauacuccacuacucagcaauagaaagcaacaugcuauugauucacacaauaacguggaugaauauuaaauaaauccuucugauuucuucuaaauuaacaauucugaacaaauaacaaauuguagauagugggagccagauuucucacugugugaggaagaagauacaaauaaacauaauaaugaaaccagugguguuggguuauagucugagauauugguaugacacuguaguuauuuuaauauauauauauacagcuagaugauacaaaugcuuguguauaugcauuuguacauguauguauagcugucugcugagagggucuggaagcagugauacccaaguagcuauaauguccuagucaaacaggcaagauucuuuagaagcuuggaugcaaacccuaauuucaguggcuauuuucauuuucgauuaccugcuucuuuacccuuuccucaucgcuacucugcagucagaucuuuuauuaaguugaaugguagaaucuuuucuugugagaaauuauugguaguauuauacaauuuugguaauauuugaucuuuuucuuuucaguccuuauuuggaaaaaacuugacaacaauuuuaaaugaguauguagcuaugaaaacaaaagguaagaguucugauuuggaguuuuuuugcugauguauacaauauuuaucuacuugauuuaguuaaaaaugauuucuaaagguuauuaaugucucauaaaagccuugaaaaaacuugucccuguuguaaugagauaaauuuuucugggacacaucuaauuuguuuguggguuuugguuuuuuguuuuguuuuguuuuuuugguuguuguuuuuuguuuuuuugguuuuuuuugagacggaguuucaaucuuguugcccaggcuggagugcaguggcguaaucucagcucacugcaaccuccagcuccuggauucaagcgauucuccucagucagccucccaaguagcugagaauacaggcaugcgccaccaugcccggcuaauuuuguauuuuuaguagagccaggguuucuccauguuggucaggcuggucucgaacucccgaccucaggugauccacccaccucggccucccaaagugcugggauuacaggugugagccacugcccccagccauuuguuuguguuuacauugagugguacauaaauugcaacaaucuuuauguuagcaaaaauaacccaaaaacuaccuuuaaaaaauauguaaaauaaaacucuuaccucuguguuaucuacacugauaaacagacaucacuauguguuaaaaaguuuuaaacugacauuuuaauuuuaauucuauguagucuaagucugaacacagaagccagucauacacuggcuuauaguuacuagaauauaaaauucuacuugccuaaauuaaggauguuuuagagggaaaguuuugacugcuuauucucuaauauugauuauuuucaauagcuuacaacauuaacaaaacaauuagcacuaaagaauucgcauaagaugauaacaaaggaaaagaagcuugacauuuuuugacauugucuguguauaagcauugugcuacgugcuuucauauguuuuuuuucucauuuagucuuuucuuuguuuguuuuuuuuuugagacgggagucucgcucuguugcccaggcuggagugcaauggcgcgaucucggcucaccgcaaccuccgucucccggguucaagcaguucuccugucucagucucccgaguagcugggacuauaggcgcacgccaccaugcccagcuaauauuuguguuuuuaguagagacaggguuucacuauguuggccagguuggucucaaacuccugaccucaugaucugcccaccucagccucccaaagugcugggauuacaggcgugagccaccaugcccggccucucauuuagucuuuagaauaacccagugagagagauuguuuaaagccauuuuuaaauaugagaaaauugaggauuaaauuuccacacuuauaaggaauuugcauaaccuuuaugauaauuauuauaagacagauuacuuuaauucacuuucauaugucacaugauaucagauagaacaaagaucaaaaaauuguuucuccuuuuuuuaauaaaaugaagguguaaaauuauuggccaaaaaaugcuucagagauuuuacagauguccauuucuacucauauuguaucugauacucaguggcuuuagaagagaaagcaaccgcauuauagcuuugcaagcuauuuuacaacauagauuuauuucucauuuuccaacauacugucaauaauugagagacaagguuuuuugugugucuuuguucagaaugaaugaugaaauuucuucagcuggguuuauuaagaaccuuuucuccuaugauuuagaaacaucaaauaaugucccagcaauaaugucaucucuauggaagaaauuggaccauacacuuucucagaucagguaauaagcuauuagaaugugccuaaugauuuuggaaugcaaauacacuuuggguuuaaaucuucuuaagaccuacacaguguacuuauauaacacucauccaguuuugaaauuacucuagagguugcugguacuguggagguuacugacugacauaauuugaaauaaauagcauacuuuuaauaaaauauuuagaaaacuaagauauguaguaguuuaaugacauuuccaaguuuccauagcaauuuaaaggcagauauauuguuagaauacaaaucaccuaaucccaggccacugugaauucccuuaggcaacugucucuuuauuacauauucacagaauugaugcguugaacccaugcccacuugguuucuuaacuuguaaagaaaaaagcuugaagaauaaugcuaauucugaaaucuucuguuaucaauuuuaugaaaaucucauauuugacuauagaauuuguuaugaaaaccauagucucuuaaccuuucuuucagagcuauaagugacuaccccaccuaacuucagcauggguuucauuuucuuccucugcuuaaccugcuaaaauggcuccaaaugcuuucuucuuaacucuggaccacaucuuacuugguagucuuaucuuuauauuucucuuuccugacucgaguuuuguggaucuuguuggagacuuacuugacauauuuuuuaugauaauggcaccgugucugugacuuuaucgaauaaaggggugggccacucuaauucauacuaaaagaauuaacuuguacugugaauuuuuccauguuuguuggcaucuucuuuagagguacaauaaaauaauuucauagucauaaauuuuauaaaagcuggauguccucugacaucaacuuggggauucugaaguauuuauauauggagucaugugaaaucagaauuucucugugggaaggcaucucuauaauugugaaagauaauaaaaaauguauacuuuguauauucuuacucaaaaauguuaauauguagaguuucuaaaguuaaauuaucuucuguucauuuuuuuaagagguagggucucacucuguuacccaagcuggaaugcgguggugugaucauagcucuuguagccuugaacgccugagcucaaaaguuucucccaccucagccucccaaguaccuaggacuacuggcacaugccaccuggcuaauuuuuauuucauuuuauagagacagagucuugcuauguugcucaggcuguucaugaacucucggccucaagugauccucucaccucagccccccagggugcugggauugcaggcaugaaccaccauacccagcccagauugcauucuuaacguaaugucaaggcacucuaaugcauuauuacauuggauagaaacuucuuaaugaaaauuauguguguugugagugugucuacaugccacuauuuuucuccuaaagcaaaucacaguugcuugcccaaaaaauguguguguuugucuuuuuugucugagagagauuuuuugccuuuuaccucauaacuaacuugaggucugacuguaacuaaaucauaguggaugucagcaacaaacauuuuuugauggauaacuacuuuguuuucuuuguuaggagcaugcaaaguuccccaagguuugcuggcagucagagagguugguauccaacuuuaaacaauguucacaauuacuucaaacuuaaacuaucagaugaacauuuuaauucauuguacacaugugcuaaguauauauuuuccuuaaacuacuguuuuucuuucuuuuuuuuuuuuuuuuuuuuuuuuugagacagugucucgcucugucgcccaggcugaagugcaguggcacgaucucagcucacugcaaccuccaccucccggguucaagcgauucuccugccucagacucccaaguagcugggacuacaggcgugugccaccacacccagcuaauuuuuuuuguauuuuuaguagagaugggguuuugccauguuagccagaauggucucaaucuccugaccccaugguccgccugccucagccucccaaagugcugggauuacaggcgugagccaccgcaccuggccaaacuaccguuuuucuaaguacaguuauguuaauuaauauuuucauuuaucauuaaaauauuuuguaaauacucccuacauuucacauugacucauguagaauguuuuaauucucauuucauaaguucagguuucuuguuuuuuguuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccaaguucagguuucuuaauucaugguguuaucaauauuaauuacugcagaacaaauauaaucuuggauuuauaaagcuugauuguauucauuuuaguuucuucugaaagucgcauaaauuuaguugauauauuuaggaaucauucuucaaucuguggauguaacacguuguuauauaauagguugcaucauauugacuucuuacaauucccaaacuacccugacguugaauuuguuuuuuaaaugcuuauauguuucagcccgaacgagaacuggaauugcagaaaucaaacggcagagaaagcuugcaucucaaacagcuccagccagugcagaguugcucacuuuaccuuaccuuucaggacaguuuaccacuccuccuuccacagguacacagguuacucgaccaaguggccaaauuucagauccaucgaggucauauuuuguaguggucaaccacucacagucacaagauacuguaaccaguaaguuuacauuuuguucucuuaaauuuuguuguuaaucaaauuguaugaaugagauaauauacuaaugucuuuauacucauaguguaaaauuauggccccccccauaaaagaugagagagacuaaaaguggaacagacuucuagauuugcuauaagcauauaaaaucuuuaaggcauuuuaaucuaggguucuuccuauuucuacgcuaauugaagucuucaacucucuaauucucaauuuuuggcauuaagagaaaaagaagcuguuguauuugauuuuaaauggaauguacauuauauuuucuacuuccuugccuuuguugaugucagucuguccuccuggaaugaggaaugccuuucuacuucucuaucuuuacauguuagaaauccuacauaugccuggcugaaccuuagaguuaggaauauccuuagagagugugugguauaucuuauuuguugcauacuugaaacuucugaaaacacaugguaguuaagggauaagaagcuaguuaauaacagaguugggauuagaauucaggaguuagcacucucaguucacaaaccaauuaucuuucugugcagcuaaaauuuguugccaucaagaucucccucauuuucaccuuuuccaaauccuuuucuacacccagaaugcuuaguuuauacuucuuagacuuuuuccauucuacuguauuauuuuuuguugagacuauauuguacuuuggauuuuauuguaaaaccuuaaggcauaaagacuguauuuuauuaaucuuagugucuuuuaccaugcuuuacacaugguaggcacucaguacauguuaauugaauuuaauauaaaauaauaaucacuaaugcuuuuuaucccauuacaaguuuagaaaacuauucaguuucuuuggcuuacuguuauguuuucuugaaauacagcuggagaagcuuuaaaugucauuccuggugcucaggaaaagaaagcacaugccaguuuaaugucucccgguagacgcaaaagguaaaugcuuuuuaaaagagacaaguuacccguauccauuaaaaaaaaaaaaaaagaauuacaucaggauacuuacauugugaauaaacuaauaggaccagauuauguucugaucuauauuagaacuauuccaaaauacauugucuuucuucacauuuuaaccugccugaaauuggguugcaucucucaauuaauggcauaucacuguuucaugggaaauauguuuauucuguaaugguauauaaaauaaugguauaucuuacaaaugauguuaucugagauuuuuugcaauccauguuuuuuaacugaauguaaauaauacaguuauguucuaugcuccacacacauuuaaaguccuaagaucaauugauggaauuuuuccaggcacaaucuuugagaaaaguguuuuucccaaaacacuuuugagaaaagugugucuuuguuugaaggauauuuuuugaaagagauaauaguuuuaaaauguuuauucuaguuucuuagcucccaagcccuggguauuuuuguuagaguuuuuacuuuugguugucuuucauucaagacugaccuuaguuagccuccuuuauuggagccuuucucacuucaccauauaaaauaacaaacagcaauauccauuuuuuuauuuuuagagauagggccuugcugucuugaccagguuagaguauagugguacaaucauaacucacugcagccucgaacuugugggcucagaagauccucccaccuuagccuccccaguagccagcagcacaggcacaugccgccacacccagcuaauuuuuuuauuuuuuguagagaugggggucucacuuuguugcccaggcuggucugaaacuccuggcuucaagugaucuucccaccuuggccuccaaaauugcugggauuacagaugugagccaccaugcccagccauaaaagagcaacauuaauauuuaacauuuauaggaacccugacuuuuuaaauaaagucuuuauauauacuuuauuucauuccauucuuuaguaaacccaauaaugcaguuggucauuauaaaguagguuagagagucagagcuugcugugcuucagaccauagguaguaagugguaaagcuagacuucaaacucauuuuuuugaauucaagacuacuaauacuuuuuguacuucccuuuguuccuaacacaaauagagaaaauauaguugaccuugaauaacauggguuucaacugcauggguucauuuauacucaaguuuuuuucaaccgaacacagauuaaaaauuuaguaguaaaaccugccuauaugcagugugcugacuuuuugaauacaugggcuuccuagugcagacuguaggacuugaguacauguggauuuugauauccuuggggguccugaaaccagcccccugcagauacagggacaacuguaucuguucuguuauggugaucuuaaaauuuaugucuguauauguauuuaucuuuaaaucuguuaaauauagugguuaaaagaaaagcuuuuaaaauguguuucagugaaucucagagaaaaaguaccacuuugucuggcccucauucaacaauacggaauuuccaagauccaaacgcuuuugcaguagaaaaaguaagugacucugccaaacuuugcaacuuaaaauauuccugaguuuaaaaauacagauauauacacaaauguauguauguguguauguaucaaauaaagaaacaggaguaaguuuauagauaucuguaaauacauuguuguuguuggaucauuuaauaaaauacuggccaggugcuauggcaaacaccuguaaucccagcacuuugggaagcugaggugggcagauugcuugagcucaggaauucaagaccaaccugggcaacaugguaaaacccccucucuacaaaaaauacaaauauuagcuaggugugguagcacgugccuguaguccuagcugcuugggaggcugagaugggaggacugcuugagccugggaggucaaggcugcagugagccaugaucauaccacuacacucaagccugggugacagagucagacccugucucaaaaaaaaaaacuggccggcgaguaguggcuuguaccuguaaucccagcacuuugagaggccaaagccagcggaucucuugaggccaggaauucaagaccagccuggacaacugucucuacuaaaaauacaaaaauuagcugggugugauggcacacgcccguaaucccagcuacuauucaggaggcuaaggcacaagaauugcuugaacugcgagguggagguugcagugaacugagauugugccacuguacuccaggcugggcuauagagcgacacuguaaaaauagggcauuuacugggguuugaugaugaguguggaacuguauaagaaagaguuggugaaagaucugugaaaacauuugcaaauuaugaaguguuguauucagguauuaauauggagggagccaucacaacuucugaguuuccauuuagguuuauuaaaacuauccagcucuuaucgguuuguucuuuucuuauaaauauuaaauagcagaauacucuuuauuguccuuuugcuaacaguggcuuucuuuuccagcaaaugguuauugaaaaugcacgagaaaaaauacuaagcaacaaaucucuucaagaaaagcuagcagaaaacauaaauaaauuuuuaacuagguaagcuauauauguuuaaaaugccuaauuguuuuugccuaauugcauaacuauaauaaagauuuuucuuucuuuauuaacagugauaacaauauugcccaaguaccuaagcaaacagauaacaacccuacggagccagagacuucaauugaugaauuccuaggacuuccgguaugggugguuggggugugcaugggugcguguguguuacuuauacuuaagauugaugguaauuuugguuucauuucaaaaccauugccaacauaagauguuaugauuugccaucuaauuagauaaaaugauuuacaauaguaagauaaaacuuuucuucauucauugaaugcagucuguuccugaaaaacacauuggaugaugacuuaaaauagaaucuauauugcauccacagucauggauuccuaaguauucaauacuuaaacauuuauuaguggguauauuuguguguaauaaacaguaauacaguguuuauauaaauuacauuucuucuacacugcuacaaauuguauaauaauuuagagaaacaaugaaaugauacaauaaagauauguaauggggccaggcaugguggcucaaugccuguaaucccagcacuuuggcaggccaaggagggcagaucacuuaaggccaggaauucgagaccagcuuggccaacauggugaaaucccaucucuaccaaaaauacaaaaauuauaugggcaucaugacacaugcuuguuaucccagcagcucggguggcugaagcaggagaauccuugaaucugggagggcggagguugcaguaagcggggaucgcaccacugcucuccagccugggugacagagcaagacccugucucaaaaaaauaagaaaaaauauguaaugaauccaaguaauaguuaacaaaauaaaaugaacaagacuuuuuuuuuuuuugagauggagucucacuuugucgcccaggcuggagugcaguggcacaaugucaggucacugcaagcucugccucccagguucaugccauucuucugccucagccuccugaguagcugggacuacaggcgcccaccaccaugcccggcuaauuuuuuuguauuuuuaguagagacgggguuucaccauguuagccaggauggucucccucuccugaccucguuaucugcccgccucggcuucccaaagugcucgauuacaggugugagccaccgugcccggccaauaaaaugagcaagaccuuuuuaaaaagaaagauugcuaaccaaaugacaacuugccugugaggcuuaauacuaagagaagaaagauggggacaauggucacuguugcuauugguaguaaauacaaaagagagugagcuaguaagggaggaauauaacagucuauguuuuaagauuuguucaugugcaacuauccuuuaauuuacuuuuuuuuuuugagacagggucucacuuuguugcccgggcuugagugcaguggcucaaucacggcucacagcagccuugaucucccccagcucaagugauacucccaucucagccuucugaguagcugggacuacaggcacaugccaccaugcucagcuaauuuuugguuuuuguuugguuuuguuuuuugagguggugucucgcugugucacccaggcuggagugcaguggcacgaucuuggcucacugcaacuccugaguucaaacgauucuccugccucagcuucccaaguagcugggauuauaggcaugcaccuccacgccuggcuaauuuuuguauuuuuaguagagacuagguuucaccauguuggccaggauggucuugaacuccuggccucaagugaucugccuaacucggccucccaaagugcugggauuacaggcaugagcuaucucaccugacccaaguacccuuuuugaagagcagcugcaauugugauuuuaggacaucuuuuuacuuggaccauuggacaauagaaauauuuuuauuggcaugcccaugugaguguauuagagcagguuuucuuucaauugaauucugaguaaagccauugagcccuugaauuguuuuucucuaugucaguucuaccaguacuucuuucaaaaaccucucuuaucuuaccacuuaauaaauaugggccaggcacaguggcucauaccuuuaaucccagcacuuugagaggccaaggcaggaggacugcuugagcccagagguucaagaccagccuggacaacauaaugagaccucaucuauacaaaaaaaauuuuuuuuuuaauuagccagguguuauugcauguaccuguugucccaacuacucgggaggcugaaaugggaggaucacuugagccugggugcucaaggcugcugugagcucugauuucaccacuauacuccagccuggacaacagagcaagacacuguuucaaaaccaaaaaacaaauauguaugcucuguucuaaguuuuuguguucuccaacuuuuugcuuauuguuucuuuauaaauacaucaggugcuuaccauaaucaggguacucuguuaaacacugugaaggauuguaagaaaguaaagacacaaccuacuguucuugguuguucauaauacuguauucguagaaaguuaagaauuaagauuuagcugggugugguggcucacgccuguaaucccagcaguuugggaggcugaggcagguggaucaccugaguucagggguuggagaccagccuugcccacauggcgaaaccccaucucuaccaaaaauuagguaggugugguggcaugcaccuauaaucccagcuacacagaaggcugaggcaagagaaucgcuugaacccgggaggcggaguuugcagugaggcgagaucgcgccacugcacuccagcguaggcgacagagugagacuccguuucagaacuaaaaagaaaagauuuaaauaacaguuuuuaagacaguauagggaauuuuguaacacagaaaucccaaaaggcucgagaaguagcaccaggacgucugaaagucccucugaaagcugaggcuacaaacaggauaauaagguguaaaauuccaggggucaugaugcuucagccuacccagggugugcagggagagagcucucacucuucuuugacacuuagaaguccugugucaauaguaccaauucuaugaguggggcugucacauaugcagacuccuuucugacccccauaccaaggaagaugccaaggugacaaggggaaaaagcacacuggccugguagugcugcccuuuaagaaucuggcucagccucagccuggugacccuaaacagcaauggcagggucugggucagcaagacacagcucucucuaugcaaugcuggaaugagugucuccagucucuuauugcugaugggaaccuuguaaaaggaccugcauauccuggacaaacugagacacagguggcagcacaggccccaccccuugaaaagccaucacacuacuugacugaccaugacagcacuauggauaaacuucaagcuuuuuagguuaacuucugucugccacagauucucaggaaaagauaccgucuuucuaagcagaugacaguccaugaccugaauaaccucuuagugaagauuuucagauuuugcuucacaugcugggaagcucaccaaggcuuuagauuuaggaggaggauuuuuuuuuuuuuuauuaugaccucgaugcaggccuccuuuccuuggaugcaaaauuagugugauauaaaggaaaaugaacaacaagcacauugugguacuggugaaagaagugccuaccauuuugaagcccaaaggggaguguuuauuuuuuaauuuuuaauuguaaaaauaaaauauauaauuuacgaucuugacaauuacuaaguguacaguuugguaauguuaauuauauucacauuguugugcaauagauagcuguaaguuuuuuuuguuuuuguuuuuuuugagacagagucucgcucugucacccuggcuggaaugcaguggugugaucucagcuugcugcaaucucugccucccagguucaagcgauucuccugcuucagccucccaaguggcugggacaacaggcaugugccaccacgccucacugauuuuuuguguuuucaguagagacaggguuuugccaugucggccaggcuggucucgaacuccugaccucgggugaucugcccgccucggccucccaaagugcugggauuacaggugugagccaccacacccagccaguuauaggcucauuuaaucauaguuacuucuuuaaaggucuuaucugcaaauacaguccuguugagguugggacuucaacacgugaauuugggagggacacaauuugaucuguaaagcucuuauuuacaacuccugauuuccccuuuuccuauccccugccaaccaccauucuacuuucuguuuugaugaguuugauugcuuuacauaccucacauaaguagaaucauacagcauuuacuuuauguaacuggcuuauuucacuugguauaauauccucaagguucuacauggccugugaugggauuuccuuuguuaaaggcugaauaauauuccauuuaauguauaugccacauuuuguuuauccauucauguaucaauggacauuuagguugcuucucuuggcuaucaugaauaaugcugcaaugaacauggguguacaaauacgucuuugagauccuacuuuuaauucuauuggcauauacccagaagugggauugcuggaccugguaauucuauuuuucauuguuugaggaagcuuucuaauguuucucauagcagcuguaccauuuuacauucccaccaacaguguacaagaauucucacuuaucuacauccucaucaacacgugucauuuuuuguugcuuugauaguggccauccucaugggugucaggugauaucucacugugcuuuugauuugcaauucucuaaugauuagugauguuaagcaucguuucacauguaugccuuuuuuggauaaaugucuguuuaaguuauuuguucauuguucaaucagguuuuuuguuguugaguuauaggaauucuuauauauuaugugacuuacauuauuuuuugagacagggucucgcugcaugcccaggcuggagugauguggugcaaucuuggcucacugcagccugaaccucuuugagcucaggugacccucccaccucagcuucccaaguagcagggacuacaggugugugucaccaugccuggcuaauuuuuguauuuuucacagagacaggguuuugucauguuggccaggcugaucuagaacuccugggcucaagugaucuccccacuucagccucucaaagugcuaggacuauaggugugagccucggugcccaguuggaauucuuuauauauucuugauauuaaccccuuaucagauagaauuugcaaacauuuucucccaucccauagcuugccuuucacuuuguguucuuugauccgcauagguuuuaacauuggauguaguccuauuugucuauuuuugcuuuuguugcuugagcuuuuagugucaauccaagaaaucaugggcuguuuaaccucaugaagcuuuucccuuaugauuucuuuuuauuuuauuuuauuuauuuauuucuauuuauagaggugaggucucccuauguugcccaggcuggucuugaacuccuggacucaagccauccuccugccuuggccucccaaaauguugggauuauuggugugaaccaccaugccuggccucccuuaugauuucuuuuuuccccuuuucaaacgaggauaagccacccuuccuuaugauuuuauacuuuuaggucuaacucauaauaaauggaagauuuaaauguaaggcuucaaaguauaauaugaguccgggcgugguggcucacgccuguaaucccagcacuuugggaggcugaagcgggagggucacuugaggucagggguucgagacuagccaguuugagaccaaaauuagcuggguguggugucacaugucuuuaaucccagcuacuugggaggcugaggcaggagauucacaugaaccugggaaguggagguuguggugagaugagauugcgccauugcacucuagccugggcaacgagaacacuccaucaaaaaaaaaguauaauaugaaauuuauaagaugaaaauuagcucaaaaugaauggaauauuuaaauguaaauuuucauauaugguguaagguaaggauccaacuucauuauuucgcauguaaguauucaauuuucccaacucuauaucuugaagacacuguccuuucugcauuguaugaucuugguccucuuguugaagaccauucgacuacauuuuccugaguuuauuucugaucucuguauucuguuuuauuggucuacauguuugccuuuaugccaguaccauaccguguugguuacuaucaauuuauaauuaguuuugaaaucagaaacugugagaucuccaaauuuguucuucuguuucaagauuguuuuggcuauuuugcuuuucucugagauuccauaggaauuuuguuuuuguuuuuuugagauagucucacucaacucacaguugcccaggcuggagugcacuggcaccaucuugguucauugcaaccuuagccucccagguuuaagugauuccccugccuuagccucccaaguagcugggauuacaggcaugcgccaccacacccagcuaauuuuuguauuuuuaguagaggugggguuucaccauguuggccaggcgggucucgaacuccugaccucaagugauccaccugccuuggccucccaaagugcugggauuacagaugugagccacugcacugggcccagauuccauaggaauuuuaagguaguuuuuccuguuucuauaaaaugcuauugaaauuuugauagggauugcauuuaaucuauagguuuuaaauaguaugggaaucuuagcaauauuaaaucuugaaauucaugaacacacacacacacacaaaaauaauaauaaggugcaaaauuaaggaaggaguuaaacuguaucuacucccuauuucucauacucccccagaaacacuguugucagucaugagcccucccagcaagaaaucuaacucaaaagaacuaaaaauacaaaugguucuacaacauaauuccauagcuuagcuuguaguugacaagcucaccuccaccauugguacagggcuuuugagguagguuuuggcauguuacuuuuaaagcugaauagauaaggauuggcagcauuuaaggaaagcauuuuacaugaagaacccagagcagacagauaaaagggauaaaauagauuuauauugaaggaccuauaaagcagucuacaauagaguaauguaaagaaaguagauuauagaacuuuauaguaugggccaggcacaguaacucaugccuguagucccagcaguuuaggaggccgaggugggcggaucgcaugagcccaggaguucaagaccagccugggcaacauggcaaaaccccaucucuacuaaaaauauaaaaacuagcuggaugugguggcacacauguguaguuucagcuacucagaaggcugaggugagaggaucaccugagcucgggaggucaaggcugcagugaacugugauugcgccacugcauuccacuccagcuugggugacagagugacacccugucucaaaacaaaaaaaaagggaacuuuauaguaugauuuuauuuccauuuauauacguauauucauuuuauaucauuuuaauguuuaggaauauauucaccaaaguucuuaccucuaagaaguaggauuaggaaacaccuaucuaguuuuguuuuaauuuguuuuaaaugagcaugucauuggaaauuuucuuggagugggggaaugcuacuacauaaaaagucagaaauagucgagugucugcuaauuauuuugcugguauuaaaucauauuauucacgcugaguacaguggcccacaucuauaaucccagugcucugggaggcugaggcaagaagaucacuugagcccaagaguucuggacuacccugggcaagguagcaaccccaucucuaucaaaaauaauaauaauaauaaaauaagcugggcauaguggugcacuuguagucccagcuacucaagaggcugaggcaggagcaucaguugagcccaggaauuucagguuauagugagcuacagugacucuaccacuguaccacuacacuccagccugagcaaaagagugagacccugucuuauauauauauaauauguaaauauauauaaauucaguuagaaucaugccuucacgccacuccuuucuugcagagugaaauucacaugucugaagaagcuauacaggacauauuggaacagacagaaucagacccagcauuucaggcacucuuugaucucuuugacuaugguaaggagacuauuuauuucaagacagaaaaaaaaggcuucuacaauuucuuugguaacuuaaccagagugaaucaacauuccccagaguaucuaaaaaaguucuuguuuucauuucaucaaacauuauauggauauguuaaaggaguguuuguuguuuuguuuuuagcugagaaacuuuagcuguuaaaguggagaguaguuuuguuuuuuauuuuuguggcauuuuugccagucaucagggaauguguugaugucuaccacuauacaaauguguuaaacacaauugaaucguacaaagggaauacaaaaaauuggccauuguccucaaucuuaugauuuagugcaguaguucucaaaguauagucccccaaaccaacaaucucagcauuaucugagaacucguuagaaaaugcaaauuacugggcuaaaguuuaagaaacaccugucuagugggaaaaucuuuguacuuguaaaugauauuaaaagcaacauuuuuuaaacauccauaaaacccuaaaucgaaguuuaacauuugcguaaucaccaacaagcuguauucauugauguuuauuuuuuguuuuggucauuuaauuauuuccauauucccuuuuuaacaggcaaaacaaagaauaauaaaaauauaucacaaaguauuuccagucaaccuauggaauccaaucccaguauagucuuagcagaugaaacuaaucuagcaguuaaagguucuuuugaaacagaagaaucugguaagaauuuaauuuuguuaauaucaucaauccaaaucuuaauauuagucucaaaauucaaaggcagaaaauauuaauuuggaaguagaaguuguucagauuguuauaggucauuuuuguauuuuucucucuguuaaaaacaauuauaaaucuuugguaguuugauuaaaagaaaauuuacaguauucauucuuuuacuauaagcuuuuuuuguugguguguguuuguuuuuugagacaaggucucccucuugucauccaggcuggagugcaguggcacaaucauagcucacugcaugcagccucaaacgaugcucccagcacuuugggaagcagagguagcauuacaggugugagccaccacacucaaccucauuccuuuauaauucaauucuugacauguacaauuuaguauuaauguuguucaguugcucaaaagucuguaacauuuauuuuuauuaaggcacauguuuuuugugcaccuguuuuuaaauguuaucaccugcucccaccaguaaaaaaucugauggcuuccaguguucauucacauccuguccuuggagaaucucagacugugugccuccuuuaauuccucugccaacaaucaaguccaauucuccauuucuucuuaggcugaauuauaguggguuguguuuuuugcaguauauauuaugucuagaagauuguguuucacuuaaguucuucccuguacaaagugaaacuugaaauuccguuuucugagaaagucauccuacuucacugaggaacuacuuauccugaauuuauguggccucuauacaauuucuacuguuuuccccacaauaaggauucagaugugcucuguacucagcagcaagugucacauuuaacagaauuagaguaguccccccuuaucuaugggggauauauuccaagccccccagugggugccugaaauugggugguaccaaagccuauauaguauuuacuguuuuuuccuuuucaggcauaccuaugguaaaguuuaauuuaaaguuaggcacaguaagaaauuaacaauagcuaauaauaaaaugggacaguuauaacaauauacuguaauaaaaguuaugugaauguagucuuccucaaaauaucuuauuguacuguacucaccuauuuuuaggcugguugacuguagguaacugaaaccacagaaagcaaaacuacagauaaugggagacugcuguauaugcuaguugacauaaauguucugguuuuuaaaaaauauuuuucauacugauucaaguuaauguuuucuguccuaaauugugaaugcuguauuguuguuuucugaaacacuuuuuccaggccaggcacaguggcuuaugccuguaaucccagcaauuugggaggccagggagggcagauuacuugaggucaggaguucaggaccagccuagccaacacggugaaaccgcgccucuacuaaaaauacaaaagcuagccaggugugguggcuggcgcgcaccugugaucccagauacucaagaggcugaggcaggagaaucacaugaacccgggaggcagaggcugcagugagcugagaaucgcaccgcugcacuccagccugggcgacagagcaagacucugucucaaaaaaaaaaaaaaaaggaaauacucuuuccuuacucauaucauacucuuuuuuuuuuuuuuuuuuuaagaucuucucauacagugccuccuuuauaauuuuuucucaugguaccuuuuguuccuaugcuguuacaguuuuuaccaugcuuucuuaugacuuucuguucuauaguugguuccuugacuaaccucuccaagauuagagauuggaucauucaucuuuguaucccaguaaccaaguaugguuggucuucaguaaauauguguuuaauguuaaacaguacacaaugagaucaagugucaaucaugcaaaauguacuuggccccaucucaccuuuaagaauaugucagauaaguugggugugguggcucaugccugugaucccagcacuuugggaggccgagacaguagauaaauuaaagucagaagaaauguuagaaguugaaaaguuaguguuucaaaauaaacuucauuuuuggagccaguauguuuuuuaccuauugaaauauuaaaccucuuuacuuuuuccuucuuuguaucaucugucuuccaagcuuggaaaacaaauugacacuuguguaaaaagucaucaguaacuagaaaguaccuguaaauuuuuugauacucaguaaaugggaaacacagcguaucagacuuccacuuacugguaugcaaagaugaguuauuuucuuggcaaaauaaguuuuauggcaaaaaugacuaccucagaagcugaacauauuuaccauaucugucuaccugccugauacuuugcagauggucagucuggucagcccgcuuuuuguacauccuaucagaaugaugacccauuaaaugcuuugaagaauagcaacaaccaugaugugcuuagacaagaagaccaggaaaauuuuucccaaauaaguaccagcauacagaaaaaggccuuuaaaacagcuguacccacugaacagaagugugacauugacauuaccuuugaguccgugccuaauuugaaugacuuuaaccaaagagggaauucuaaugcugaauguaauccacauugugcugaauuauacaccaaucagauguccacugaaacugaaauggcuauagggauugaaaagaacucuuugucuucaaauguaccgagugaaucucaguuacagccugaucagccugauauaccaauaacuucauuuguuucacuugguugugaagcuaacaaugaaaacuuaauucucucugggaagaguucucaacuuuuaucccaagauacuucauuaacuggaaagccaucuaaaaaaagucaauuuugugaaaauucuaaugauacaguaaaacuuaaaauuaauuuucaugguuccaagucaucagauucuagugaaguucacaagaguaaaauagaaauuaauguguuagaaccaguuaugucacagcuaucaaauugccaagauaauucuugucuucaaagugaaauacuaccugugucuguugaaaguucacauuuaaauguaucuggacaaguagaaauucaucuuggagauucgcugucuucuacuaaacaaccaucuaaugauucagcaucuguugaguuaaaucauacagaaaaugaagcucaggcauccaagucugagaauucacaggagccuucaucuucuguaaaagaagagaauacuauuuuucucucuuuagguggaaaugcuaacugugagaaaguugcacugacgccuccagaaggcacuccuguagaaaacagucacucucuuccuccagaaucuguguguucuucagugggagauucucacccugagucccaaaauacugaugauaaaccuucuagcaacaacucagcagagauagaugcaucaaauaucgucucucucaaaguuaucauuagugaugauccauuuguuuccucagauacugaacuuaccagugcuguuucuaguauuaauggagaaaaccugccaacuauaaucuugucuucuccuacuaaaucaccuacuaaaaaugcagaacuaguuaaaugccuaucuucagaagaaacuguaggugcuguuguauaugccgaaguaggggauucagccucaauggaacagagucuuuuaacauucaaaucugaagacucugcaguaaacaauacucagaaugaagauggcauugcuuuuucagcuaauguuacaccauguguuuccaaggauggaggauauauacaguugaugccagccacaagcacagcuuuuggcaauucaaauaacauucugauagcuaccugugugacugauccaacagcguuaggaacaucuguaagucagucuaauguagugguguugccuggaaauucugcaccuaugacugcucaaccucuaccaccucaguuacagacaccaccaaggucaaacaguguauuugcugucaaccaagcugugucaccaaacuuuucacaagguaacuuuaauaacauaauugaaauuuguuucucuggguugggaucuaauuucuuuuguaugugauguuauugacugcgaaguaauaacuaaugaguagaugguaugagaaaagauucugaaauuugugauuacgcugcuucuuuaugcuagcuaauucaaaccuuuuuuauuuuucuuaaucugcuaguaagcuaugggcuuuagugguuuuucuuuuuucuuuucacaaauacuucucaaucuaugugcuaguaaguuacaauaaacagaaaagacagacuaauucaucacauaguuguauaaaacccaauguugugggggaguuuuuaaaaauagcucuuauagucauggucuucagggaauucaucaucuuuuuggagaaauuuucaagaaaaacuugaauuucagccgguuaugguggcucacgccuguaaucccagcacuuugggaggccgaggugggccgaucgaucaccugaggucaggaguuugagaccagccucgagaacauggugaaaccucauuucuacuaaaaauacaaaaaaaugagccaggcaugguggcaggugccuguaauuacagcuacuugggaggcugaggcaggagaaucucgugaacccaggagacagagguuucagugagccaagaucaugccauugcacuucagccugggcaacaagagcgagacucugucucaaaaaaaaaaaaaaacuugaauuucuuccuuuauaaaauccuuucuaauugaucucugucuuuaaaauccuuuguuuauggcugggcucaguggcucaugacuguaaucccagcacuuugggaggccgaggcgggcagaucacccgaggucaggaguucaagaccagccuggccaacauggugaaaccccguaucuacuaaaaauacaaaaauuggcaugguggugggcaccuguaaucccagcugcuugggaggcugagacagaagaaucuaaagcugggaggcagagguugcagugagccaagaucgcaccacugcacuucagccugggugacagaguaagacucugucuccaaaaaaaaaaaaaaaaaaaaaaauccuuuuuucauaggggcucuuguggcauuuauugcgugcuguguuauauguaguuagugauugauaugccuaucauauugauaauuuuuuauuguauguuccucagagauagugcucauggcacauuuauuuacauuuccuuauguguugguucccaagcuucccucuuuucccuuuuuguuacauuauagacauacaauaaaauuucauuaaauaucaacaauuaguauuaaaccuaaugggucuguuuuacgugcuguuacaaauuacauaaaggagaggucagaauuaauagagaauguggggcuugagcuaaagcuuaaagaaugaagguaggauuuggaguuaaagcaaggaaguuuuuauaacuuauaaaaucuguaaguuauaaagagaagcagcaccagcauagacagagagaccguaguagguugcaugaaaaugaggggaucaaccugacaguaguguauuaggcaaaaguuuguuuauggacaggacuaaauuacaguagccacaaacuauguuguugacuucugaggaccauguagacauuguaauuuucccuccauaguuuugaccaguuacgugcuuaccuuacccccuuuugaucaauaccauugagauauguaauagguugggguuacaaguguaguccuggguauaaauauucaguugggguuguaauuuucugguguaagguucagacuugaaacauucaccacucauuuucuaacuaguuucauuauuucuagaggaauccagauaugauuguaauaugaugucuuggcuguagagucuuaugcuugaucagcaugguucacugacugaauaacauuaagaccaccuuaauauuuggauugacuuuuucuuaauuuguuagccuugcuguuuuuccuaaaacuguuucaguuucguuuuuuuuguuuuguuuuguuuuguuuuuggagaguggaucguaaggaagagggauuguucauagaauuuauuucaaagcaguaauuaauuugugccaaacauuuguuuguuuugugccaaaacauuucagagaaaaucuuuuuuuaacaagaauuguuuuuuuaggaucugccauaauaauugccucuccaguccagccuguacuccaaggaaugguagggaugaucccaguaucugugguuggacagaauggaaauaacuuuucuacuccuccucggcagguaagauuuaugaacugaaaaugguguggugaugcuuuucaagcuuaguguaauuaauggcuuuuucucuuccagguucuucauaugccuuugacagcaccuguaugcaauagaaguaucccucaauuccccgucccuccaaaaucucagaaggcucagggacuaagaaacaagccuuguauagguaccauuuuuaauuucauuaauguuaacuuuauguuuguauguucauuuguuugcagcaacaccuaaauguuuucuuucugaauaccuaaaccauuuuaaaacaagugaucacccuacauuugcuaguaacagaugucauaaugcagccaacuguuacugaacagcuuugguucugagaaaauugucuccuuuguugaaucuguuagcuuuugcccaguaguccuugguuuguucuuugcagcuucccuaaauuaaguauagucccuauuuuucccaacagcuuucaaguguuuaaugaaugccucguauaauuguaugagacuuuagagcaguucuucuuguaguuuaguguguauaugaacuauuuggggauuuuguuaaaugcagguacugaauugauaggucugguacagcaccugaaauuccucauuucuaacagcuucuaagcaaugccagugcugcugguacuggaccacacuugaagcaaggcuuuaaaguuugcaaauuaccuuccuguguucccuguuuuagccauugucccaaccaucuguuuacuugugaaaaaccugguagucacucuuaaaacacauuuuccucuccuucuuaguucaaguauuugucauuuuucaucuaaguuguaucaauagugucauguagucucccuucuuuuagucucuguuguuucaguucaccucauaucugcuggcugagugacuuuuuuucccuaaaauacaaaucugaauauguugcuuuccugccuaaaaacuuucagcaacuccccuuugcccaaaggauaaaauugaaauuucucagggugacauaugugcauacauuugucaucuagucacucucgaccucuccaucucaucucuuaccacuucccagcauggacccuuuguacaaacuauaguugcugcucaccuuauacuuggugaucuuucuugucccuguaccuuuuaccaaugcuaucucuucuaccuagaauucccccuucuuacccaacucuuacccucaaucugguucuuauuuauccuucgaaauuaacuuaaauguuccuaggaagcauuuuuaaccagcgguggcugagguggauauuccgguuuuauuuuuuucuuuaauucuuagugauaccuaugcuacagcacuuaacacauuacauuguauuucuucucaguagucugaguaucuuaaaugcacucauuauacagagaacucaacuaacugcuaucaaaucagccuuuccuuaaacuaaacaguauacaucuauugauguaggcuuaaguugcauuuugacuuauugaggcacccucuuagacuuauguccuguuauagcuacucuauauuauuuuuauguucuuucuuauaacuaguucauuccuuuuaauggccauuugauaucuaucacuugcauaaauguauuuuauauauguccuaucaguggacuuuucagauguuuucgaugugacaugcaaugauaugaggaacaucuuuguaaaugccucugugugaacccauaugagaguuucuuugggggcuuauucccagaaaucuuuggguauacuggguauaauagagaagaaguauaucuucucuaugacccagaauuucugagucauagagaagaaaauuuauacuucuaccauuauuuucccugcuucccucacaacacuaccaauauuugauaccaugugauauuuuaacuuuugccacuaugauggauuuaaagugguaguaucucauaucauucuuuuacuuuauucugauuacuaauaaaguuuggaaucuucucuuauaacuauaaauaauauuuucccuucugugaauugcuuauucauauccuuuuccuacuucucuauuaaauuuccugucuguugagguguuauacuuuuauuaguaacauaucacagaugucuucacagucugacacuuguuuuuaucccuuacaaaguugauaccagaaaaaaacauuggugagguuaagcauccauuuaugauaaaagcucuuaaaggcuaucuauaguaaacaucauggguucccuuuaaagcugugaauaacacaaagauacucauucccacccuguauguaauaagccaguguuuccaacaccaguaaauuaauuauuaaguaaucaguuuuuugccccacugacaucugauuauacuuccaccauaaacaaggucccauacauccauacauaugugguuccagacaauacaguaagaaaauggagcugggcaugguggcucauccccauaaucccagcaccuugggaggcugaggcaggaggauuguuugagucuaggaguuugagaccagccugggcaauauagugagaccacaucucuagaaaauaaauuuuuuaaaaguagccagcugugguggcagauaguagucccaacuauucgggagggugaggcagaaggauugcuuaaguccaggagguugaggcuguaaguaagccaugaucaugccacugcauuccagucugggcaacagugagacccugucucagaaaagaaaagagauagguguaaagauuugaagagagggaauuaaacuguuauggaaaaugaugugauuuuuacacaauaaagccacagggaguuaauagaaaaauuaauagaacuaauaauucaguaaaguugccagguaugguuaauuaaaauuguguuuuaggugccaacaauaaacaccuauuaaguguuauacaaaauaagauacuguuuauaaugaccacaaaaaugauaaaguauaaaggaaguaaccuaaccaaaaauguuagaaauggagaauauuugaaaucuuucauaaaggauguauaaauagaagagaaccauguucauagauuugaaaauuuaacaguguaaagauugcaauuauuccaaguugaaucaaaaauucaauguaauuuuccuuaaaaaucccaguagaauauuuugggagaugggaaaaacuauaaaaucuaugagaaagaauaaaaguccaugacuagccaagauagaagagcagaggacagacucauucuaccaaaugguaaaauauugcagagccacaguaauuaaaacaaaaagacaaauggaacaagauaguuuagaaagagaccuuguacaugguaauguuaacaucagaagucagagcaagauggaugguauaauauaugaaauguauugaucauuaaauauacaauauauagagaagaaaguagaucccuuccucauacaaagaugaaguccaagaugauuaaagaccuaaaaguaaaaagucaaacaauuaaaugauagaagaauguauaagagaauauuuuuaugacauuaggauaaaggauuuauuuauuuuuuuauuuuuuuuuagaugggagucuugcucugucacucagacuggaaugcaguggcaugaucucagcucacugcuaccuucgccucccggguucaagcgauucuucugucucagccucccuuguagcugggauuacaggugcaugccacaacacucagcuaauuuuuguauuuuuaguagagacaggguuucacuaucuuggccaagcuggucuugaacuccugaccucuuaauccccccaccucggccucccaaagugcugggauuacaggcgugagccaccacgccuggccugggauuucuuuuuuuaaaaugagaagacuuugggcacaauggcuccacuccuauaauuccagcacuuugggaggccaagacagguggaucacugagcccaggaguuugagaucagccuaugcaacauaaugagacucugucuuuacagaauuuuuuuuuaaaaaauuagccagguaugggcugggcgugguggcucacgccuguaaucccagcacuuugggaggccgaggcaggcggaucacaaggucaggagaucgggaccauccuggcugauacggugaaaccccgucucuacuaaaaauacaaaaaauuagccaggcgugguggugggugccuguagucccagcuauucgggagacuaaagcaggaggagaguggugugaaccugggaggcggagcuugcagugagacaagaucgugccacugcacuccagccugggcgacagagugagacuccgucucaaaaaaaaaaaaaaauauuagccaggugugguggugugcaccuguagucucagcuacuugagaugcugaggugggaggaucacuugagcccaggagguugagagugcagugggcuguccucaugccacuacacuccagccugggcaauagagcaagacccuaucacaaaaaaaaaauauauauauauauauauauaaauacauauguguguguauauauuaauagaagaaaauaaaagaaacugggugcaguggcauguaccugcaauccuagcaacuugggaggcugaggcaggaggaaugcgagcccaggaguuugagaccagccugggcaacauagaccugucucaaaauaaauaaaauuuaaaaaugagaaauacauaacuuauaaauggaaaaaauugauagagugaacuacucuagaauuuaaaguuucuguucaacaaaagacaccauacacaaaauaacaccagauuuuuacucagaaccuugaugacuguguuaccugguucucagacuucucucccuacauuuuuucaucauugugaaugacaaaaugcccauguuguaaaucuacccaccacccuaacccucagaguuuauccuuuccacuccuuauuuauuuauuuauuuuauuuuugagacagagucuuacucuugucgcccaggcuggaaugcaguggcagucucagcucucugcaaccuccaccuccuggguucaagcaauucuucugccucagccucccgaguagcuggggcuacaggcacgcaucaccaugcccagcuauuuuuuguauuuuuaguagagacgggguucuccguguuggccaggcuggucucgaacuccugaccucaggugaucugccugccucggccucccaaagugcugggauuacaggcaugagccacugcgcccggccuagauccuuuccacuacuaagacuuauuuuuacuucagccaaccucuccuauagccacaccuugaauuuuucaccuuuuuauuagacuuacaagauuuuuaaaggccagugaugugucucaaaacacacuuguuuccauauacccauugaauuccucuucaaccagugauagcuuuucuuacuugaauccucaccuuuuaccugaacuugugucuucuuuccggauucacuuccuuuacuaaacagccuagagcccacaagccaccacaucagccacuuuggccaguuuucuuaauaaccuacauauccacauucuucuacauagccacuagcuacucuauagcccuugaucuguccagccagccaucucaacuuuuacaccugggcuucuuagcauugccuuagaagugcuaccauucccuaccacuuaaaaaaaauguauuucucacccaccuuccacuuggcaaucauuuuaaauaucugcgugucugcuuucucuucuguuccuccuucaaacuauuccagucuugcacaacacgucucaaaucuaguccugcuccuccucacucuuagcuagugguuuuauuuuccaucuuaccaguauuaaacuucacuuucugaucaucacuuucauucaguacauaaccuauucugcuuccaaaaucauccuucuuucuuaaagaaauaacuguccuucauucuuucuaagguuaaugcagucuacaugugcuccaguuucuuaucuucuauauauguuucaacuuuuccuguuuggcuucucucccuggcuauaaacauagguuugucccaccugcugacuuuuuauguuaaucucuuaaccucucuuaaucuuccauuucuucauucaaauuacugucuuuucucaugcaucuacugaaacugucuacacuagagucaccaguggccuccuaauauugcauuaugcauugaaacuuuuccauucuuaccuuacuuugcuuucucuauaacuguugauacuaugguggcuucuggagccauaacuaaacuauucuccacccuugcuaauuuuguguaacucaaggccuucaaacuacauauuucucaccucucuuccucaaagacuucuucugccuaguguuuuuccccuugguuaaugucacaauuuauuuuuuuccuuuacuuuuggaaauguacaugcccauuauugucucucagacccucaucaucucuuaccuggaauauagccaucuacauagaguuucuacuuccaguuuucugucuucucaguuccaucuuccacauuauugccagaucuuccaaagacauaaaccuauucaugcaucuucccuauuuaacacccuuaaaggggccgggcaugguggcucacuccuguaaucccagcacuuugggaagccgaggaggguagaucaccugaggucaagaguuuugagacuggccuggcugacguagugaaaccccuucucuacuaaaaauacaaaaauuagccaggcguggcagcgugcaccuguaaucccagcuacucgggaggcugaggcacuagaauugcuugaacccaggagguggagguugcagugagccaagaucaugccauugcacuccagccugggcaauagagcgagacuccgucucaaaaauaaauaaauaaauaaauaaauaaauaaauaaaucucuuaaaggauugccucugaaaccuuuugcauaauauguaaguuucuucauaaucucaucuuugcucuucuuucuaguuuugauaucuugcugcucucccacauaaaugcugaagcucguggaaauuaaaauauggcuauuagaacuccagagcaugugcucugagugacauaggcuuguaaacaugauagguaccgggacagaauuuuaaaauagauauaaucuguuguuuucuuuaagugacuaccuggauguaaguaguacauuaugugcuauauugagcauuguaauuuguagauccaaagacuggauuuauaauauuugccugaaccgggcgcggugguucacgccuauaauccagccuuuugggaggcccaggugggcagaucacuugaggccaggaguuugaaacuagccuggccaacauggcgaaaccccaucucuacuaaaaauacaaaaaauuagcugagcaugguugggggcgccuguaaucccagcuacucgggaggcugaggcaggagaauugcuugaaccuaggaggcagagguugcagugagccgagaucaugccacugcgcuccagccugggugauagagcaugacucugucucagaaaaacagacaaacauaauauuugccugaaguugaugcaugucauuuauuccauaucuggauuuccucuguagcaguggggaaauagccaucuuguacuuauuucaaagcugcuuuuuaaaagcugcuuugucaacguguucuauuuguguguacauuagcuaccauuuaaaauuuuuucucaugauaugugauaauugucaucuguucuauccucuuucagaggaguauauucuuuuucucaggaauguucauuuauaauuucaggaaaacaaguaaauaauuugguggauucgucaggucauucaguuggaugucaugcacaaaagugaguauaaaguaguuucuaucauagauuguuugaaugcucagauuuaaaacauaaaggauuucuuuaugcugcuagaaauaguuuuguuuuguuuuguuuuagaacugaaguuucugacaaaaguauugccacagaucuugggaaaaaaucagaagaaaccacaguucccuucccagaagagaguauaguuccagcugcuaaaccaugccacagacguguacucuguuucgacagcacuacugcuccuguggcaaauacgcaggggccaaaccauaagauggugucccaaaacaaagaaaggaaugcagucucuuuuccuaaucuugacucacccaauguguccuccaccuuaaaacccccuucuaauaaugcuaucaaaagagagaaagagaagccuccucugccuaagauuuuaucuaaaucggaaagugccauuagccggcauaccaccauaagagaaacucaaucagaaaagaaaguuucaccaacagaaauugugcuugaaucuuuccauaaagcaacagcuaauaaggagaaugaauuaugcagcgauguagaaagacagaaaaauccagaaaauucaaaacuaucuauugggcagcaaaauggggguuugcgaagugagaaaucuauagcuucacugcaagaaaugaccaaaaaacaaggcacaucuucaaacaauaaaaauguacuuucaguagguacagcugugaaggaucuaaaacaagaacaaacuaaauccgccaguucuuugauuaccacagaaauguuacaggauauacagaggcacagcucaguaaguaggcuugcugauaguagugauuuaccugugccccggacaccuggcucaggggcaggggaaaaacauaaagaagaaccuauagauauuaucaaggcccccucuaguaggcguuucagugaagacaguaguacaucaaaaguaauggucccuccugucaccccagacuugccugccugcagcccugccagugaaacaggaagugaaaacaguguaaauauggcugcccacacauuaaugauucucuccagggcagccauuucuaggacuacuucagcaacuccucugaaagauaacacacaacaguuuagagcaucuucaaggagcaccacaaaaaagcggaaaauugaggaauuagaugaacgugagcgaaacucucguccuucuaguaaaaaucuuacaaauucaucaauaccaaugaaaaagaagaaaauuaaggcaaguuugaaaguuuuaauuucaaaaccacaccuuuuuuuuccgcuuuagugauuagcgaauucagcaguucuugccacaacaacuugacugaacguuauggcuaagacagcuuuuaguuuucauugacaaaauacauaaccaugaucacaggaccaauaagcaguagaugcaggauucaaacucagacuuguagggcaacaaagcaguccagcaguguuaguguaguacgcacaaggugucuaggugaaacagcauuuucaggaaaaacugcugaggcauuuguuuauaaacaucuuuccgggggaaaagaaaaaguuuuucuuucuuucuugguagaacucaaguuuuuucaugagcgugacauagucaugaaagauugggaaacaauauuaaacacuauuguguagaacuaccaaguaauaaaugacuuuguucuuagauguucaguuuuuuuuuucccccacgucuuguaaucucuuccauaggcccuuaaaaauguuagcauauuagagcaguggaaaaaucaaauuuacguauguuuuuccauuuuuuugagagaggguuucacucucguugcccaggcuggagugcaaugguacgaucuuggcucacugcagccuccgccuuccaggcugaagugauucuccuaccucagcuucccaaguagcugggacuacaggcaugcgccacugcaucuggcuaauauuuuuuccuuuuuuuuuuuuuuuugagacagagucuugcgcuguuacccacuagaguacgguggcgugaucuugccucacugcaacuuccgccuccugaguucaagcaauucccugccucagcccccugaguagcugggauuacaggugucugccaccacacccagcuaauuuuuguauguuuaguagagaugggguuucaccguguuggccaggcuagucuugaacuccugaccuugugauccacccaccucggacucccagaaugcugggauuacaggcaugagccaccacgccuggucauuuuuucugguuuuuuuuuuuuauagagacagucuuuugccauguugcccaggcuggucuugaaguccugagcucaagugaucugcgcaccuuggccucccaaagugcugggauuacaagcaugagccacugcgccuggccuuauguuuuuuauuuaagcaugguugucucuaggaaggcagugcagggauagcauugauaaaugaaauccauuuauuuucgauuugguuagcuguuuaguaaguggauugaauagaaagaaagugcuuaaaauaucauagaggaaguaugguaucagggaaauaauuuaggcuuuguugcccuacaagucuggguuugaauccugcaucuacugcuuauugguccugugaucaugguuaagucuguagccuuucugagucucagccucaucacuugacaugauauuaccagguaucuuagguugugaagucuaaauguaguauacauaaaguaucuaguguauauuaaguuuuggaacugauaaguaccuguaacccuaaacaucuguuaguaaagcuuucuaagcaguaauaaccaccuaacauagaaagcauguucuaucuugucucauucaacauucagacacucuggauuuguaucaugucuuuugccauaaacuaacauucaggugccauugaaguauauuuaaguaacuuuggguuuauaaaacuugucucuacuucucuauagaaguaaaauucuaauagacuaaaaaaguuugacaauuuuaguaguaugugaaagaacccaauauacuguuuuaggugacuuacuaagaaagcauuuuggccuuguuuugaguuuauuuuuucuuucucuuuuucaacagaaaaagaagcuucccaguucauuuccagcaggaauggauguagacaaauuuuuguuaucauugcauuaugaugaguaaacauucuggacacauaagaacaguagguguuaaaaacucauaucccuuaaacugaguguagggaaugggauauugacagaaucugaaagcaugaccugcacuuucauuguacugaaacuucacuuuauaucuaaaucaugcuguuucugaaacagcuuccuaguuuguaaauagacuuacuugguauauuuuuauuuugggaaaaacguuugcagaaauguaaguaaagccaaucugcaaaacuguauagcuuugacaauuccauauuguaaauacuguguaaaucuuguugaaauagagguuaaaucaaccuaauguucuuacacuguguuuuuugacuucuuaugaucccuaauucugagacuuacucaucuggaauaguuucucacuuguuuuggaggaaaaugaugcuuauucuuauaaauuaccuucaguaacuauucaauaagacauuuaaauacacaaucacuaaguacuacaaaauaauaaccaccucaacugauagcaaaauaucuaauuagaaaucaacaguuugaugaguuuuuuuccuagagugaauacuaccccuuucuuauaauugcuguaaguauuauauuucuggaauuucacacuuuaccuacucugaucacucuguucucuuuguuuuaaagagagaauuuuguaaaccauuuauugaauguucugaucuuucauuuauaacuuaagauuuuuuacagaacuuuaagugguuagacuauugagccauaaaauuuugguuuguaguagagauuucucgguauguacuuuuccccuaaaugcuggggauuuaaagaauugcacuaauucauagaacucuuuacauuguagugaccaaugcacauauaauuuaaaucuuguguucuaugugagaguuuauguggaggauuaucuucugguguuguguccaucauaagauguaaaaagagaaaucauaguuuuauauuuuaguuucuccuacaauggguauguuaaauaacuauaucuauacuuagauauagugcauugucugugucccuuaaaguguuacaaagaguuucucucaaaagguccuuaaggagagugagagaugagagaggugccuucucuguauuagacucacacacaucaguccaguugaagaauugguuuaaacuuuuaaaugagaacagaaauuauaauuaguaccugaccaauugugccuagauauuaaaguauguucucuuuaguacuuuccguucaauuaaauaucaguauauuagggauuuuuuucuacagguguauauuuuguugaagagucacuuuccucaaccauuuuuuuguacugggccuuuaaaaaaauaaauccauccaacuuuaacacaacauuucucaguguagaaaucaugucuucuuaauugcugaaccuuacugcaaaaacuugugauguaagaaauuuguaugguguggcaguggucuauuccuaaggaacuaaauaucauauaguuaauguuuauuuaacucagcuugagacuguacuacaguuagguuugaauaaauauuuucauuaacuucaaaaguuugaauuacuuuacauuggcagucuuguuuagaaacugauuaaauuccuuugcaagucaguucuuuuugggaguuuguacaaugcugaaaaucacaguuuucuucuuauucaauucauaguuguauguacuaagcacugaaaauucauauacaaauaaaauaaguuuacuuucuucaagauucauaguuaacuaaccaggaacugcuaaguaaaguugaaagauaacuuguacuuggagcuuuuauguucaagagcaaaaucauauccccauuuuaccuuaaaaguccacagguccugaacuuaauuauacuauuguaccugguaaccuauuugaauacuuaaaugcccagugacugcauuucaggguugauguauacuacaacaauccauggcuguuuuuauaauuacauaugaggauccagucuguuguuuggauauuacuuagagguuaaugcagucaguguaugccaaaucugagaaguguuguuaaguaaaaucuuguuacagauuuagcccuggauauauuagaacuauaguguguugaaauugcgcauaagaaaagcauccaucagcauucaugcaaaggcuacaugucaugacuauuaggaguaauuucaaaagcauauuacuauauauucugcauucauccuuucucuggucaucaucuuuuaggcucaggcccagcuuucugaaauuacauaaguuuugacuuuauuauuaguuauuuugcugcuuccuuuaagcaauggacucauuguguacuuuuuucuuuuuauaaauguuaucauuuugucauacuuuugucuuuuuuucguaaauuuguaucuacauuguugaacacaugguacauauagcuuccuaaugcuuuuuguuuuguuuuuuuuuuuuuuuuuugagagagggucucacucuguugcaggcugaaguacaguggcacaaucauggcucacugcagccucgaucucccaggcucaagugauccuccuaccucagccucccgaguagcugggaccacagacauaucccaucgcacccaguuuuuuggguuuuuuugguuuuuuuguuuuuuguuuuuuguuuuugucuuucagagagauggggucucacuauguugcccaggaugauaucaaacucuuggacucaagcaguccuccugccucggccucccagguguugggauuacaggcaugugagccaccucauccagcugcugcuuuuacuuccaauaauauaaagcuuuuuccuuuuuuuagcuauuacaaacaaaaacagcagugagcauuuuuauaaacauuuguuuauguuaacuauuuccuuagaaauuuuagagaguagaauuaccaaaucaagaaguuaguguaccuuuuuuuaaggaucucaguacauuuugccauaugcugcuauuaaacuugcgucaauuuacauuucuaccagcaaauugucauuuuuuugcauagcauaugcuuauccauuuccagaggcauauucaccuauaucaucaccuguuucuagguuuguguuuccugauuugguaaaauuaggaguuagcuccuaauccauuuguuacuuguuuugguaccugauaugaaaaaagggucaauguacauuuuuucccuaaauauuuaacugcuugacaauuuguucacuugacaauuuaaccacugcacaguuuguucagauaagcuuuccuuuccccugcucauuuauuuaagaugucugucuuauccuacacugauuaacaaucucuuauucacaauucuaaaacccaaaagguuccggcaaccaauuuuuuuccccuagauuuaacaucagaacucauucuguggcaaaccugaccugaaaugacacgaggcuacuuaacagucuuuaucucauuuauaguaauguugauuagucugcuguuccagacucaacuggggggcauauggugcauacauuugaguuauuuuuuagaaauccaaaauauucugauuuaugaaccccagcuaaccccaaagguguguaugaucaaagauuuuggacuuguauuaaauguacacacauauauacacacuauaugguauguguaucgucuauucugugccacugauuaaaucauuauaacuuuuguguccacuguuacuguuuuuguuuuuucaaguauucacccuuuuaugcuuccuggugaacuuuagaaucacuugaauuauuucagguuaaauuucuauuggaauauuugaacuacauuaaugucauaagcuaauucauaaagaagcaaaggguaacgaucauaugguauguaucaaaguguuauaguuaucccuaucagaaauuucuugcuaaacuggauguuuuuguuuguuacuauuuuuagaaagcucuucauuucauaguuuuaacugguuauugcuguuauguagggauggucuugcuuuauuaauauaaaauuuuuauggagacacauaaagagaaaagugcaccacuauaaauucaugcccuucagugaauuuucuuuaaguaaauacauccacauaaucacuuugaacauuaccaguacccuagaguagucauuauugugacuucuggcaccagagauuuagcuuuguuuuccuuaacgauaucaguggauacauggaguauauaaucugugagaaacacucguuuuguauaauucagcucagucaugcucaaugcuguguauauauucauuguauuauauuacaguuaauccauuuuauagaugguaaaaggugcuuauugugaacagacugugcugugaacauucuugcacauuuuuuuaugaaugcauuacacuucucaguuggauaaauacuuaggaauaggguugcuggaacacaguugcauauauucagacauucagauuuuuucauuuuccagaaugguuguaacaacuuaugcugcacucaacaguauaauaaguucucgauacucuguguuauuucugauguuagauauuuucauuuagccauuuuagugguguguauugguauauguuuugguuuuaauuugguguugguuuuuuggguuuuguuuuuuuuuuaaugaaguugaaaaccuuuucaaauacuauuuggguuaucuuuuguggacaguccaagguuuuugcccauuuuaguauugggugucugccuuuuucuuacugauuuuuacguguucuuucuguauucuggauacagguccuuuuucggauggauguuaggugucugaguauucucccuuguuauucuucugaaagcguuaugguucaaccuauuucauuuugauuugaccaucuaucuggaauugauuuuccac

SEQ ID NO: 15997 - RNA, 3568 nt, Homo sapiens
uccacgaggccacacaggguacaggccacggagccgcagccccagcaggugcgcacacacugcccgcacagggcucgcucacacugaccgcagaccgccuucccauccacggcucgcacgcaugaggaacaggcaauggacgcuaccccagaugggucugugaggaagaaacgccaagccgucaggcugcaaggagacuggaguuuccgggacugccgggcuaccugccuccaugcauaccugagggcagagggcucugaccugccuaccccauccccaccuacacuggauccuucugacaacccgugagccugguacagugcacaggacccccguuuuacuacagagauccaaggugagauaugccuguaguugacuccaaguucagugcucuuucccuuaccaggucccucugcuaccuggaggcuagugcuggaaggaccauucuuccccuguugcuugucagaacuccaugugucccaucugggucucaguguggcccacugccuuacugguuaacaaagaggugccugggcuccuccuagacacaccaaccagacuugagguagagucggggauugcauuucuaaccagcaacacaggugaugcucugagaccccacacugcauagggaugggacuggcauguuuccagccuugugggacuaucugagggggcugcaggcggaaagcagacgggauacccggggagucucugcugcuuuuuuggcccaguacuuagaagcuguuuaacaacuuccagucuugaaugugagaccuccugauaacaggagccuucugagccagaaggccaagcucugggucagaguccugcuuacccagggaggaaaagccugaccuugcaaaucaagaaaaaugcucgugccaccaccugcccucagugccacagccacaaagggcugcuggugccacucaccagcuucggaggccugcccaaggcuccugaucaggcggccgucugguccaaucagcaucugcccacgugcagcccucggggccccuguagggccaggcuuuggggacucuggcaggugaacgacggcacagccuucaucccacacgugguccagguaggccugggccccgaggaacaggagucgcuuggucuucucugggggaagauaaaucauucucacguccuucacuguguaccaacgaagccccugcauggccauugagucuuucuagccucacaugaaccccaucguccuccugugugcccucugucucccaguaaccccagccuguguugugcccuggcgagcuggguccugcucugccucuaugcugagaaugcuugugcguccuuuccuuaccuggcuuagcugucaucuccuccaggaaggcucuggcccugcagccccaccugugucugaugcaaggguucccucuccuaucacucggcucauuuucugcaauucacggcuggccucgccucacuaagcuuguccccuuucucccuuuucugcuuccccagcacuccccaccuggaaaccaggcucuguggaaugcacagagggagcucugcacuguggagcacuaauucacaaaacucguccccugccaaggaagcagccagaggcuuggagcugggccuacagccucuggccagagcacacccccuucaccugcuacagaguugcuggcaagacaagcaucccagaaccuuccagaccucuuguucuagaacacccacccaucccugggagcagugguuuuccaucaggccacaguucagucaccuggggagcuuugaaaaaucagaugcccagggccagacccagaaaugcuuuguuuuuuguuuugcaccucaccauaacacaguaaaggcagagaucccagaaacucuauguggcucuacaugaagugggcagcaauaauagugacaggguaacucacauggaguagcugaugccagcccacaacacccugcaccuuccuccuggccccccacaccuucccccaucuauaaggggaaaggaaugggacagacacguggugaggcuaauccuuguccucaaggccuuguggacaauucgagguuaagagaucaggguaacagcuguggccuggaauuuggaaacugucacacaguucaaaguagguguccugcauuuaccauggaaggcccacugcacccagcagaccucccugaccugacccggugaguggcacacaccugccaacgcccaggucaggacacucgggaagaauaaagggccauacugagccaggccccauuuccaucuuccucuucuugccugcacaguguuugaauuuuucaacuguccugagagggcacacgauugcgguccugccacaguucccacggcaucauuccccuuaccuccccauggcccagaauagcacucgcuuucacagcccuagcacacuggagacaccgcacagaggaaccucgggaggcagagucuuucccucauucccaaggcacaagcggcaccagguaaaucacacaccccgggucauccucuaacugcucuacaggugcagacuuugugucccaaucacuaggcaagguaagcuccacuuuuuaccugccccaggguauuaaucaccccagucagagugaugaucaauaagaucaacacgccugaaauccacaggagaaagccagagaaggccugggagcucacugcccucacaucccacccagaacuggacacugcagccacacggaguccuauuucgcucuccugcugccuggcuucugccucgcccucuuccuucccuuccucugccuggcuaacuccuacucgcccccacaggauuccgcucagacuguucuuccaagaagccuuccgugccaucccugcaggugcgccugcacaaaccugugccugccccgaccaccuguggcgacuccuccugcuggucuccccaacuaggcuggggagcucccgggagacggggcacaucugucuugccugccuuuggucucccgagaaagccgccgugccuggcagggccgcgcgcuccaugaauaccucuugggacaggaggggcacucuucggguugacuccaugcaggacgccccgcuccccaaccucucccaggacauccugcacgggacaguccugagaaagcaccaggcgggugccgcucacugcagggcggcgacuaaccgggaucguggaagagggcgcgggggcuaggggcagggacccuuuucuuucaggcuguuggacagggugggcgaacgcugggguccucacaucccccucacugaccccagcccugggcguggccagcuuguguccccgcggccucccagcuuccgggaacgcggggccagaaagcagggcccuccagccccccgcucaggccucagaggggacgcugaggcccggcccguuccaggccccgacgcagcggacccucggcagcccgcccgacacucaccgaagaccuccugcgaguagcgcucggcgcacacgccgcggcucaacucccucuggcucacgcggaccuugagcuguagcggggccacguccgcgaaggggcagcuccgcuugggcauggccgcggg

SEQ ID NO: 15998 - RNA, 856 nt, Homo sapiens
gcgcccugcgucggagcccuuggacuugccucgcgcggcgagguugugcuggucugcaaggccgagccccuucccuagggugaggccaaguuuguaaaauuacuaggugaaaaagagcuucaacucgcgcaggaaaggagagguuccgaguguuccgacuuaugggguugccaggguucgaguccaacuccuccgcucagagaccuuggacgagaccuguguuuguuuucucacuaggaagaugagggaaggggggcggggaauaagggaaggggagcggggaauaagggaagggagcggggaauaagggaagggggcgggguggggggagaugacaguuggacuguuguggaaaguaguaagacaaggcgugugcgggaccgagcgcugggccuggcaccuagugacgaaguaaacacacaggcagguaaugcuaacuccggcuguuugagucuucugccagcgagggcagggcagguggggcaagcgguggugaagcggguuccgggggcucggugagucugaacacuggcucgccuggaagguuggagccacccugccaaucaagcagccgugcuauuucgcgcccucgacuagaggggccagaauuaauuuuaaaagcuuuucuuuguugaugggauuaaacacagagugcuaaacuuccguaacaccauccuuuaugaaaggaaaaaaaaaagcauuuguaaaccuauuuacuaauuaagagcccaaacgaggggggaaaugcacggagcaccgaggccuuuuuuguuguuguuaauucuugguuaucuauaugcucuuauugccucccuauuauaggcuccuacacucacaaagccucaagcuggguucu

SEQ ID NO: 15999 - RNA, 1287 nt, Homo sapiens
gcugugucagcguguuaugaugccgucccauaccaaccuggcuacuggaauccccaguaguaaagugaaauauucaaggcucuccagcacagacgauggcuacauugaccuucaguuuaagaaaaccccucuaagaucccuuauaaggccaucucacuugccacugugcuguuuuugauuggcaccuuucucauuauuauaggcucccucaugcugucaggcuacaucagcaaaggcggggcagaccgggccguuccaguccugaucauuggcauucugguauuccuacccguauuuuaccaccugcgcaucccuuacuaugcauccaaaggcuaccgugguuacuccuaugaugacauuccagacuuugaugacuagcacccaccccauagcugaggagaagagucacaguggaacugucccagcuuuaagauaucuagcagaaacuauagcugaggacuaaggaauucugcagcuugcagauguuuaagaaaauaauagccagauuuuuuggguccuucccaaagauguuaagugaaccuacaguuagcuaauuaggacaugcucuguuuuucaucccuuggcccugacaaguuuuuccgcaggaauauguaucaugguagaauagagguuauucuguaauggaaaaguguugccugccaccacccucugcagagcugagcauuucuuuuaaauagucuucauugccaauuuguucuuguagcaaauggaagaauguaguauggcuaauuucuuauuauuaaguaauuuauuuuaaaaauaucagaguauauuauccuguacacuuaucucuaccuucauguuccaguggaagaccuuaguaaaaucaaagaucagugaguucaucuguaauauuuuuuuacuugcuuucuuacugacagcaaccaggaauuuuuuuauccugcagagcaaguuuucaaaauguaaauacuuucuguguuuaacagcccuuggcccauucugauccaguucaccaguagguuggacagcauauaauuugcaucauuuugucccuuguaaaucaagauguucugcagauuauuccuuuaacggccggacuuuuggcuauuuccuaaugaaacauguacauuagugguuauuauuuagaguuuauagcccuauugcuagcaccuuguaguaugucaucauucugcucaugauuccaaggaucagccuggaugccuagaggacuagaucgccuuaguuugauucuauuuuuuagcuugcaaaaagugacuuauauuccaaagaaauuaaaauguugaa

SEQ ID NO: 16000 - RNA, 19394 nt, Homo sapiens
cuucgauagcucaucuuugcgcgucgcagucgcgcggagcccggcuuccgacgugcagccuggcagugcaguggugaguuggagcgcagggccguuggggauuggggucauuagggccguugacaguccaggccagagggcgagugagcgagguugggcccgaggcugccuguaagcagguccguucagggaugcuccaggcccuggggccugaggguggcuuccauggcuccauuugcccuggcuguuccucgguguacggggccugaggggagugggggaggcccguggguggccuccuuuugcguccugagaauguucugggcaguaucgagauuagggcugguuucucugcggaggagaucauuuauccguagcugggagggcuguauuaaccgaaguuuuccaguagugggccacgcugucuuagguagcgugcuggacagauacagacaucacuggacggguacagacagaggcuggguucgcuuuacgccaaguaccgugcaauacugugggcuguugacuugccugaguaguuucauagaggcaucuguaguguuccuuggaaacacugagucagugaugaauucugccuaggaaauuuagggaaaaguuucccaaagagagaagauggcaagagagggcuaaggucuaaagucucuuagcucugaccuucauaagacccugaaguaagagguaguguaucuugguagccuauacuauagcuuguauccaccuuuuagugucccuuggggaagcuuccuuaaccgcuucuaagccucccuuuucuuacuagaaaaguggaacugauaauaaaaaaauaguaguuccccccuuaucugcgggguguacguuccaguggaugucugaaaucuuggauagugaaggacccugacugacuuaccgugguuugacuuacaauuuuucaacuuuacauagguuuauugggaaguaaccccauuguaaguugaggagcaucuauacuguguuuuuucucauacagauuacacauacauaccugugauuacuuaguuuaauucguaaauuaggcacaauaagagaauaacaacaauaauaauaaaauagaauuauaacaguguaauaaaauguaugugaauguggucucucucaaaauaucuuacugcacucuacucaccuauuuuuggacuacgguugaccucuggaacuguggaaaucaaaaccucagcuaaagaacuacuguaccuaguaagcgggguuaugagguuucagugagcuaaaucuuuguguauuacuuaaaauaggaccggauucauuguacauccucaaaugugcacucauugauagaaucacacccuugucuuuuggagcccggguuuuuggaagcuggcuuaccgcaagccuuccuccuuuuuuuguuucuauccauugccaaaugugaggcccagaaugacagggaagaggacaagccugugcuucagcaggcagaaggcugugcugaagcagagguugaauaccauucccauuagccaaacuggcuugagcacuuuccugucuuuccuacccugggcagaaagaacccuguucaugggucacaaaugaauaaaacacuaccaaccugucuguaaucccagcacuuuggaaggccaagacaagaggaucguuugaggccaggaguuugauaccagccugggcaacauaaugagaacuugucuuuacaaaaccaaaacaaaacacuaccaauuugagaucuucauaggcaaggauuaguuauaaauuguuuguuuguuugauuuccuguuauuggaaaaccuucggcagcuuuuuaggcuggcagauuuaaagaaaguaaccugaaccuggaugccuuaacuguguggucccuuaaacugccaauggguagaauugcgagggccgugaacuuggcugagaggaaaaauugcaucuuuauguuuccuaaccuccaacugaaauuuagcauuuucuuccacugugaauguaggcaacaaaucacauuauuagcagugugacuuuguuaugaauauaaauuauagauauuuucauaucaugauauuguguaagcucauugcaacuucgaaauuaugguaguuauuaaauuugcuucuagaucacauauauaaugugucaguaaagaagcacauauguuuuuguauuuugauaaaauuuuagcauacagucuauccucauuauuuguggauucuguauuuaugaauucaccuacuuacuaaaauuugucuguagcccucaaauuaauacuuacaaugcuuuuguggucuuuggaagacaugacauuuuuucacgugaaaaauuuuaguugccugaugcacauguucucaacugaagucaaacaaggugacacugccuucuugucaacucucauauuguaagcaaaugucauuuuugcagucuuuggugcuacauuuuucucaucuuugugcuuuuugucggugauuccacuguuugagauagcccccaagcauagugcugaggugcuucuaaaugcaagaagauugugauuugucuuauggagaaaauauguguguuagauaagcuuuguuuaggcaugaguucaguauuaaugaauuacuaauguauauucaguaagugccuuuaaacauaaacacacauaaaacaugauuauguauugauugguugacaagaaugugcccagaggcuuucaggaaccuguuuccccaaggaacagugguucuguguuggauaauuuagugucuguagcgacuucauagaacauaauuguugugaauaaugagaaccuacuguaauugguuucauuucuaaaccuguguauuuucuguaaagacauccugagccugagucugguggcucauaccuguaaucccagcacuuugggaggccaagacaggaggauugcuugagcccaggaguucaagaccagccuaggcaacauagggagaccccaucucuacaaaaaauuaaaauauccagacauguuggcacgcaccuguagucccagccacucgggcugaggugggagcaagacuuggccugggagguugaagcugcauugaccaugauugugccacugcacuccagucugggugauggagcaagacccuaucucgaaaaaaaaaaguccgccaaagggggucuuuggcacacacaaagaaauaagaaccauuagcccuuaauguagccugagaaauuagaucuauccuuuuuuuuuuauuuuuuauuuuuauuuuuuaagauggagucucgcucugucacccaggcuggaguucaguggcacaauuucagcucacugcaaccuccgcugccuagguucaagugauucuccugccucagccuccugaguagcugggauuacaggugugcgccacuacacccagcuaauuuuuguauuuuuauuagagacgugguuucaccaugucagccaggauguucucaaucucuugacacgugucucccuccagcuucugcccuuauuuaccugccuguuggcucuuaaaggcauuuuugguugagacuuuugcauguaaaauaagaacuuugccaucuuuggauucccccauguuuguuuguuuguuuuuaauaaauaauauuuaauauuaaaaggagcugugguuuuuuucucucuaaagagcaggaaaggacagagacuggucgcucucugcagucacacuugaggugaagaaaccaugggauagaauuagcuguuaguugagucccuagguucagaggaagaaagaagaccauaccaccugguagggagugcgaaggagguuccagggacugauccauagaagggugucagaacaacuucauaauaaagaguugccuuauuuucuuggucaaggggaacuuccugugugccuucuauccugaugacacccccucacugaaauccugguguuguuuccacagagcugucuggccuuuuguccuugauccuugguuaaggaaaugaccaaccagguaagaccuguguugaagggaaaaacaucaauuggucucuuugccaaguucaaguccaguagguuuucuggauguguagucaagaaacuagcaucucauucuugccuggcuccuaaagagcugggugacccuggguaccuagucaccacaguguuaggugggacuagugaaaugcaaauacugagaggaggauugguucauccaagucuuuaccacaauuuagugaguaauagaagaagcuuaaaagauguuguacaaaaaaaaaaaaaaaaagaucagaauaggagauagaacaggagaaacauaucuuuguaauaagauuagggacaaaguuaauagacgguuaggcaggcuguguguucuuauugcagcugcaaaauuuaagcuacaaacuggacuuugagcuuccuuggugaucagaacagaaaaagaaaacauaauuuauuggucucuuguugagugaguuuggguaguaggaaggaggggagaaugucaguuucuuuaagaauuuuuuucugauaugacuguacaaaucuugcaugaaugggaaucaaggagcuugcgggauggccagguugacagcagaggaaguaacuaacacuguggugacucugucuacucggggaggagugcuuucuggaggcaaugugagacaucugaaaucugaccauggguuuaauguggcuucuguucuuuuuuaguacgguauucucuucaaacaagagcaagguaaguagccugccuguuuaagcaauucaucugugaaaaaaacuguguugucccugguuuaagacuuuugucaugcugaccagacaugcaguuuucaaguauacucacuuugcagaagaauuggcagcugaaaacaaauacucuuaaaaaacagacaacaacaacaacaacaacaaaaaccugaacaaccagcuaaaaaaaaaaagcagucaucaugauagguuggggaauucuaggcugaggaaaauuuuuccaccugaggaagacaugauggagcuucccagcugcugagguggaagaaggaaaugcuuugaggcucaaaacucuguuaaugccggcucaucuggggaggugaacgugagccuuuuucugaacucagaacuugcuuuggcccuuaaugaaagugaagccuauaauagugaaaugaguuucucuugaggccaccgagugcauggggagggcugggagcugugcagcaguggcaguggcagggaugggagagcagguggcaggucagagugggcugggauuguaacugaccagugguacagagcuuuguacccaaaaaggagccauguuugugcaugggcuacucacccaucucauuucuucacuauagccucgaugaguuugagaaggccuaaggaauuuguggaaugccuaauaaaagcucuugcucucuaaguaggugacauggagguaguuugacguuuaagccaaaagcaucauucagguuagcuaguguaaguaacuaguaggcuaauugggcaugccagucaacuaccuuauauguagcuauugucauccagguggcaaguuagcaggcuugaguuaggugagguuugaaauggaagccacaacgcugucuguggugcacagcuguuuuaaguuuaaugccuuuauauucauauuuugggaagguaucgcuggagaauuguugccaggcagggguaaagccuccaugugcacuugucacguuuuuacauccacacugggucugcacauacaacagcauggccuaccaaauaugcagcuuacagacuuagacuuaagguagacuuuaauuaauagagauuggauuugaauccuagcaccucucauuccuugucuauaaaaugaggauauuaauaguacccacuucauaggauuguuguaauguaauaauuggcccauuaaccauaauaaagauacuuguggggaaaggcaacuuaauauauggaggcuauaguagguauuuucuuuuagaucuauacuguuuagaauugaacugccugcuuguuucgaaagaucuuuucggaguaucuguuaccggguuuaggccuuuucuugguaggagggggucuuccccacugguuuuacuuguuuuuagccaagugauagccauuguagacuccuauauaccagauagcaugcuaaaagaaaggacacuggauuuagaguccgaaguacuaccuugucgccugguaaacaugagauuuagggcaaguagcuucuucagaaccuccaauuuucauauguggccccaaaauuucaauaaaagcuguauaggaaagcacuuuguaaaauaguaaagcaaauacaaauaaauguuaccucacaauuguugaacaguaucucggcuucauuaagucguaugcaagaagacuuuauaaaugaagcacuuuccauucuagcccaugaugaugccauuuggucaguugcuugggggacaaacaagaaggaaaacucugagacaguggucacaggcucccuagaugaccuggugaaggucuggaaauggugagugccucuccccuaacauacagccuuggaaaauugggggcugagguuuugcuucugaacucuccaguugcaguccgggaaauacuuuuuucuaggcaagaaagcaauagcaauauggugguauaaaacagcagcuuauuuuucccacuuguuuuccuguuacucuguauuaaagcccuaaaguuaaaaaaaaaaaaucuuaaaguccuacauuuaaaaccuggcagcauuugguguucuguagcucauuaacucuucucugauucuguauuucauagaccauugguauugcauagucacagggacccagaauuucagaugccagguaaaguguguucuuugugaagaaauccauuucucuguccccuguugaaggcgugaugagaggcuggaccuacaguggagucuggagggacaucagcugggaguggugucuguggacaucagccacacccugcccauugcugcauccagcucucuugaugcucauauucgucuuugggacuuggaaaauggcaaacagauaaaguccauagaugcaggaccugguaagaguuuuacuuguaggggagauaauagagguucaugauuucuuuuccaaaaucuuuagggauagaauguguuuuacagcucagaauuuuuuggauuugagaggggugauaaugugugcaugaacuguauuucacauaauacccucaguggggcuggaaacagcacuguaaugaaagacuaauaccucugcaaguaaacaugaauguuuacacuaagggagauaaauaaaggcuauaaauagccuuaugucaauucagguuagauuuugcugccaaaugaauuuugguaguaaaccuguagaaaaagcuuguaguuuccagagcuuuuuggauuucaaaacugcugguuuggcguugaccuguauuuugcauuuuccagagguucuuuauuugccauauucugaacugauucauucacugccuuacggaaaccuagaauguaaagcaugggguccuuauagaucuguaucauggucaucucuacuaauuuugauuaaagggugugauucuugguaugugauacauaugaaacuuuuaagaaacaucaauuuuuuuuguuuuaaguacuguagaacagcauaaucuuguccaucagccucaguaaacaucaucugagaugacagaaauuaaugaugucauaggcugacuaauguggagcagcagaggacauuucaggauucuuuugaacuucacauuuacuuauaaauggcugcacaacauuccccagcagaaccugcucugccagaaugggugguaacugcuagagggugcagauagccuggcauuucucuggcacaccccuuuuuggguugaugauagaagagcugcuuagguguuccaugaacacaguucccuugauuggugcccuggauggauucgccucccgccaguuaugcucaguagccacucuaggcuguuccuguauuggaaagaaugauggucccagaguuuuuaaagaggcuggguugucuggaaacugagugcauuuucccucagaagcaauauuucuugucuguaauucuuaccacuggagcucuuuuaagaauaugccugcccaguccauauuuuggauccacugaaucauaguguucagaguacguggggugggauauguauuuggaaaaagcuacccagacgcacccugacuccccugaugguugucuuuacauguacccuuacccugcuuacauuacuuacagaggacuuggguccccaaacuauccugcaaagucuauuaagacuccaauauauaagcauggucuuaagaaaagaggaagagacagaacuguuucuaccuuuucaucuugggcgccuaagcuuucccugggcucauaaugcugguguuauuccaugcugguuguagcccugggcacaaggcagcugaagaaaucagugcuggauugguuccaaguaaaaggauggcguauguaucuagcucacuuucucugauaaacaguaccuuuuacuggauauucuccaaguguggcaaaguuuuaaagguuacuguuaugaaagaaaaagaagaggccaggugugguggcucacaccuguaaucccaacacuuuguggggcugaggcggguggauuacuugaggucaggaauucaagaucagccugaccaauauggugaaacccugucucuacuaaaaaauacaaaaaauuagcuggacaugguugugugcaccuguagucccagcuacucaggaagcugaggcaagagaauagcuugaacucgagauuaugccaccguacuccagccuaggugacagagcaagacucaaucucaaaaaaaaaaaggaagaauggggucugagaguuggauuuauuuucuuuuuggauaggacucugcauaaaacuagaccaggccauuaaacagccaacaguuauuugguccaguaacaaaagcaagcauugcuauugacagcuaaagagcagcuaaauucaucugaagguaaaacuccuuggaugaauuugggucuaaugaauguagggaaaauagacacuuaguuucuaccuaucuugaaaauaugcauggagaaucugaaccaccacacaggaagagaaaaagagaagagagacaauccccagucguggagaaguaaggaaguaggaggaagcgaagaccaugaguguaccagucuuuguguggacauauguuuucauuaggaguagaauugcugaguaucaugguaaguguuuguuuucacuuaagaaacugucaaacugguuuucaaaguggcugugccguuuuacauucccaccaguguaugaaggcucugguuucuccacauccuugcuaacacuugauauuguccuauuuuaauuaaaaauuuaagaaacccuuaaacuaaauuuaaacuugauaaagaauuagcaucuuuacaacauaauuuucugaaucaggacacugcuacuccgauuuaaaaagauguauccuuugguaaaacuuuaguuuuuaaaauuaaggccaagucuuuucacacuguauuuuuguccuucuuuuuucuguucaguggaugccuggacuuuggccuuuucuccugauucccaguaucuggccacaggaacucaugucgggaaagugaacauuuuugguguggaaagugggaaaaaggaauauucuuuggacacgagaggaaaauucauucuuaguauugcauauguaaggaaacauugcucucuguucuccuucugauucuuucaguuuacccuuccagccuguugcaguccuugccacagauucugucuuggucuggucaggcagcugcugucucacuggugugguuugccaaguagccaguuagaccuguagauagcaggagguuugcuuguguuugguagggacagcuuaacaacacggagucugaaagugcuaauuucuccauauguucucugaacagaguccugaugggaaauaccuagccaguggagccauagauggaaucaucaauauuuuugauauugcaacuggaaaacuucugcauacccuggaagguauauaucaucaucuuauuuugacaaacuggguuaucaaaucacaaaggaagaauuauucuuucauugaaaugccauuaaauggcaaaugggcauuagauuuacaaaauaucaaucucaauuggaaaacugaaaugccuccagguuuuagucuugucacuauaguuuuuuuuguuuuuuuguuuuuuuguuuguuuguuuguuuucuuuuagagacagggucucgcucccaggcuggagugcaguggugugaucauagcucacuguaaccuugaacuccugggcucaagggaucgucccaccucagccuccuggguagcugggacuacaggugcacaccacgaugucuggcuaguuuuuaaaauuuuugaggagauggggucuugcuguuucccagacuggucucuaacuccuggcuucaagauuucuuccugcuuuggccucccaaagugcugggauuacagacaugagccaccauaccuggccugucacuauagauuuaaccuagacauacuaguucuuguaacaguguuaagugcuuguuugggugaacagacuuacuuuuuauuuauuauaucguaaucuaucacauuauguauguguguguuaauauauauuugcuauaugaaugucucauuucuguuauuuuggauucugaugaacuuugugauuggaaacaacuuuuuguugauaauuugaagguggaugaaaguauugugcccacuguccacaccgguggccucuggaaaggaggacuggguagcuaaagaacagggguagguuggagggagacuuuauuaugcguacuguugugcuguuuugaauucuaaucaagugaauuuauuacguccucacauugcuauaguuuauccuuuauacuauaauaaaggauuugauagggaaauaauaccuuaauuuguucaaccuuacaaaucaggagcaauguauauauccuuguguggccauauuuguaguagaaaaguuauuuaaagcaauguaugcugagggcagggaagggaacuaaggagaaauggcucugggaggagauacugggguuauguggauguuuugagaacauuaagaggaaaggcccaaucagaacucuugcuuuucugccugaagcaccugagcauuucaacucaguggcucauaaucauuaaaaggggcauugucagugggaagcugagugaggaggcagugguucaccagauuaacaagggccuuuaugaauuucaggccaugccaugcccauucgcuccuugaccuuuuccccggacucccagcuccuugucacugcuucagaugauggcuacaucaagaucuaugauguguaaguuaccuuaaaggcaucucccuuacuacugaugcccaucuugucccuuuauuguuacaaggagcccuagggaggagcccuaguaaagaccugugcucaagucacaucagacaccuugacuccccaggcgguccucccccguucagcgcccauuuuuaguguguguccucaagggcugcuuggaggaggaugugcauggguucccugguaggaucagauacuugcuacuuuuucucaggcagccugauuuuugugagcuuacugauuucaaauucuuugggauagguaaguaauauacagaugaggaaauggagccaugggcuguagcuggccccuggggacaggaagaaauuagagcauccauuuucaaggguagggcuguucuagcagacaugccucugcccuaguuagggagcagucaguuuauaagccgcccugcuacaggccuagaugggagcguuuuugguuuuggcccuugacugcgaguauagaagcaaguuaaucauccucuuucauucacagccgucauuguaaaucugugcggaccccuaugucuucuucuuuucccccaucauuuuuaguccugacuccuauuccccacugagguauccccuguaauguguuggaucuguguucuugauacuaugacucggugcuauggucagcucucacugccaggcaugccucuggcucauugcucccgaacauggcauucuaauccacugcauguacauaucacacuccaaccuuagccaugggugccaagaccuccuccaccugcauguacugcaacccugaccauccauguguguccuuucaggggccugugauaguugcuugggaguuuaaaccucacaguagaaacacugcuccuucuagcccacuucugguuaaaaugcaguuuuuucuggcaaaagguuaucagcuagacauagaauucuaacugcaguuuuuaacuguaacugagugagggugcuguagcccagaggggaagaugucucuauagaguuauacuugccuguuaguggcagaggcaguauaaaugcagcaguuccuuacauuugugacuuuaugauuucuauugccacuguuuuauugauccucccagcaaccaaugagguagcagcacagauuaguguccccauuuugcacaugagaaacccaagcugaggugguugauuugcccaaggaggugguacugaaugaagacccaagaauguuuuuuucacccaauauugaugcauuauuauuaauuaaagucuguaguuuacauuaggguuuacucuuuguguuguacauucuaugaguuuugacaaaauuauguguagccaccccuaacuacagugucacgcagaauaguuucacugcccuaaaaauccccugcucuaccaaaucaucccuuccuccugccuugagccccuaucaacuacugaucuuuuuacuaaggcccaggacuuuuuacccucccauggucccacuguaucccaccugcccccuagccccuaacugaggucugcuccacucugcugaggucuguguuuagggguaaaauugcugaccucaguuaggucuuauggugguucuccugccagaggugguuggguuucauuuuuauuaaaaaagugaaaauagcuguuguaauuagaccugucuuguucuugauuagguuuaaacuggucucuccaagcugcaucugucauaaugaauacaucuugacacuuuccuuggacugggagcacuggccccauacggaaaggcugcuggugcaggcaggagucugaaccugcccuucuccucagauggcuuccuugccccguugguucucaauuuccucaucugagggguuggcuugcgaagccucuguagugugguucuuuguucauuuugagcuucagcucuuugcuugugaaggauuuuauucuuggcuuuugguggugucaacacauuauggguuaaugcuacuauuaaaauuugucucuaaugcaugaagcuacuucauugaaagaggaauuuuugauauaguauucauggucauuauaaggauagcagauuugguccagcuuauuggcagaguuaauaauauacuuuccacuucagugauuauacuguagaaauuaacaucucaauuuuguuugaaacuuucccauuucagacaacaugccaauuuggcuggcacgcugagcggccaugccuccugggugcugaacguugcauucuguccugaugacacucacuuuguuuccagguacuuaaugauucuuagcaguuucuaaaaugcuggggagaugagagcagucuucuuguauagauugccuuaacauuuaaagauguuugacccuuuuuuauucaguuagccuuucuuuucugcaguucuuaaaauuuuuauuuagugauguuaguugaccuuagcuggaacaaaagucaacaaguaauccuuuuaaacaguaaaacucuuaguuuuuucauuauaaauugaggcuucuaccaaagugacucuaagguagacuuguguuccaaugguaacuuaaaauauguaaauguuuguaaaauguuguuuauagaucccaguguuggucaggccugggauggccaagacaguuggaaagcaggagauggacaacuugaaggcauugcacagugcuuuagaggccuccugcgagccuugguuuugaagcuuuaacaggccucccucccaucuggaaauagguagcugugucugagacuccuggagaacaauuaauaugagggccaggcagaucacaauuucaggaaaauggcuacccugugaggagagaaagccacccaaugaugcugauaccuggccauuuccuguaccgaggcaugggguuggggggucugaaguuagaagaauguaagucaucaaaggauuuuuggucgaaguccuuccaacuucaaaccgauacuaauguucacuuuuuaaaauaguucgucugacaaaaguguaaaaguuugggauguuggaacgaggacuuguguucacaccuucuuugaucaccaggaucagguauggcauuauuauuucaucuuuagauagucgggguuguuugaccauuguaccaaagagauuuucuuuuccugaccuuguugcuugagcuguggauaccaguagaugccugggccugagcugcucuaucugcucagucauccauguagccagaguuccugugcagagucuggggugcagaggcugggaugugcugucagccuagcaacucacgaggcauauccccacauaggcuggaaaacaugguguuagccccacagccuuuaaaugccgucuuuggaaauugcugcagcuggugucuggggcccucuccugggggcugcugcgccauggcaggcucaccaaggaccuuccucuucaggagauuccauugcuuaaacacaaucaucgcuugucauuuuugggacuguccaaagaagagaugugauuuuuuuuuuuuuaauauaguagaagcuggaaauucauacaaguuuuuuggcuuuaguguuauugauaacuuuucagucuuuaaaaggaaacuguucucacaagcaacuuuaucuuugccaaggugaauaugugaaauagcaaagguguucuagugcaauacugcugagucuuucaugugugcucguauccccugggaaccuggugaaaaugcagaugcugcuucacuaggucuggcagagggccugggauucugcauuucuaacaggcuuccaggugaggccaaggcugcugguccuaaccacacuguaaggucuuggggaacugagcauaaaaaauaaaauguccauggcaauauaauauuggcuuuuaauauauuuuaaauauuuuuagaugguccuauagauuucuccucuuugaaauggaacuuaaaguuaacuaacauuguucaugcuuauuuuucaacuuaaauugucccaacaaaauugaggggguucuaucuugauauuccacuucuggauuuaagcaucuuacucagggaguaaguccuggcuagcuguguuuccuuguauguauggaucauugcggugcugugucagaggcuggagugaaaggccaucaugcagcccaaucccaacacuaaaaucagaguagggugacaggcuuaccacccagaaucaccuccuaauaaucaggaaguuauuuaugauuagagaaacuccaaccacaucaauucugucugggaaggaggugugaaucaguuaauuuaacacauagcaaauaaaaaucuaugguccacaauaucauguugucuagcuccuggggacaggcaggcuccauaggccacuaauaacagagugagaauuacugacuguggggggcggacacaaggggucagcugaggagcgcaguuugugacuuucccuauaggcagugaccucgggguaguuguggggcucuuucuuccuggaagcauaaauguuggucucuuauggcuuccgucuuccuggcauuagguuacacuucaggauucugacucuuugaaaggguuguagauagucuugauuaguacuguauuuaaaaaugauuuuuuuuuuuuuuuuuggaguaugggaaggggcaggaauucuaauuaaauagcaauaauggaaggugcucgguuaaagccuccauucucacugauuuagaaaguacaagaacauccucaucucaguuuugguagauucagaauaacgagaaaauaaggauguucauuucauaaauauuauaaagaauaaaggcauuuguagaacuaucuuuuuuuaaauuuacaggucuggggaguaaaauacaauggaaaugguucaaaaauugugucuguuggagaugaccaggaaauucacaucuaugauuguccaauuuaaacaucaaagucuccaggcuuaugcugcaaagagaauguacggauugaucaugacauuccuuaccuucuuaggcuuguuuaaaagaaauauagcauuuauuguagcaaagacuuaaauuuuguagauacaauaugaaucuuuucauguuuuauuggaaaugcuguucauacuuuaacauaaagcuuucuuaaugcaaacacugguguccuugaacaugcuucuuuuuucaguuacccuauuaccagugaaacagugagagggauuggcauuaagagcaaaucucugccuuagccaucaagagauccagguauuucuuuaacuuuccagcuuagaaauacaggcugacucuuccagggaguugacuuaugcagugagauacagcagcgagcuccccggagcugugauaaagaagcuaaucuauuuuagaauggaguccugaaggaaagaguauauuugacugcauaggaacauuauguacuccugucuaucugggcauccuuccacuugauguauuaaagauguccccugccaagcccuccuuccccuuauuaauuucagagaggucucuaacucgcuagguggguaucggaaggcaggcugcuauucuugcugccuuaacaaugccuaggcugaagccugugccucaugcuguagaacuguagcccugccuuaguuauuucagaguaucuguaccucagaguuuccucuucaucagcccccuugagacucauguuaaugagaaagauguaaguagcugaacacuuggaagcguguuuuuuauugaucauuacuucauaugcuuaugagucaggucaugugcuuuuccucaaaccacucacugcccucagaauaaagcucacacucuuuaucauagccccccacuucucccuccugcuugccuugcucacccuccuguaaccacaucauccuugccauuccucugccuggaauguuuucccuccagaccuucggacaucugcuccccagcugcauccaggauucugcccagaugccagcuccugguagaggccuucuucccauucccuucuacucauucccauuccucuuguucuucauagcaguuaccacuuuuuguuugcauucacccccacccccaaaauaaagcuccaugaggguggaaacuucauuccauuaugucaaccaaugagaggcaagcuggcaggcaccuaacacuguuuaugugagcucucaaaaaaaggaaaaagcaaagccacuuaucucucauaccagcucaauuuuaauuuuaaagugacaaauguacagguggaauaaaauuuuaagcgacacccuccaaauuccuuuuauaugacaagaaggagcugaauguaauuuuacaccauuaccaacuaaacaguaguucuuuagcaauaauuaggaagucacagcacaaaaacgacaccccagaguugugguccauuuauaaauagauuuucaccuaggcuucguuggaagaagugauuuuauaucuauccucaccaauggucaaagugggcacaggugggcuguuucuauacuuugagcaaauuaugccucacuagcuggcaauguuuugcgggaaccugguccgugcagcugguucaccuuaccugcauggucugaucugcacuuugacccuccuaaggaagaucccuggucugagugaaacucucaggugccauguaaccaaauaaggguaggguagaucugacagguggccucugcuuuaacccagcagcuuacaaguuuuuugugacuuggggaaaagaaauaagcaguaauggcuaaagacugagguaacccuaaguucgaauuguagucuaccugucaugaauaaaauaaugacuaauaucccuccaaacaagcuauaauuuacaguaguaguccauacaaacuguaauccacaguggaacucagcgaaguucuuaccaaaacaucacuugagcaggaaacccuuuguaauauggcugugcaaugagaggaacgauccuuuggaagggagcucaaucugggagaaugagguggaaaacacuggggaguucuaugccuuugcagacccucaagucaccccggauuacuggucagagaagcuggcugugccaugggccaaaccagcagcauucucccuuggcuucuguugcugcacugaggcugccggggacacagaaggauuuaguuuucuuuacaaguaagcacuuuggugggaaagcauugcaaaaguugucaacagaaaaucauuaaaacccugaagaacaaggugugagggucacaggcaaacaguuaucagcauaugauucaaacacugguuuguccucaccacagagcuuggaagguucagaaaacuuccaagagagaugaucagacacucacguuccauccacugaagggcacagaacaguaggaacuaaguuggcccuguuaagcaggcacaugcagccauguccgauccacggaugugcuuuuauucuuuaagaggaucaucuagaauccucagaaauguuaucuuagcagcccugagaucaugcccucaauaacucugccaagggaagaggggagaaaccacagaccuagagaugagucaggaugcccacuuugugccuugggguuugcuaggggggcuaagcugcuaacugggcugugccuuauuggugacacugaauuauggcaaagccacuagaagcacaaaguauuggugcaaucacugacaucucaaaaguauauccugaaaauagaaaugaacagauuccauaugcagacuagaggugauuuauacuuaaaacauuuaaauauaaauuaagcuauaacuuaaguuacaaccaaaagaaaagccaaaaagacacucagcaauuaagaaugcugaacacauacacaggacaucccaaacacaaggccauuaaagcgaugucauuuucauugugccaacuuuacauucaucaugugcuaguccgguggggccacgcugccccgcaccacgucaugccgucuggcacugcacuccagccuggggcccgucuucguccuccucguaggccucccugugcugacgccaguucugcucauugggacaaaacuccuucagcuccaccugauccaugucaucuguaauccucacuuucugucgaggagggaguaaagcuuccagcugaggaagcuuuuccagagaaagccaguguuuuucaggaaagauuaccugu

SEQ ID NO: 16001 - RNA, 8429 nt, Homo sapiens
ucauuguucuuguucaauuuuauuggcauugcguucaucucuuuacagaagaacucagcccacacccuagaauguagaccuuuggaaaaaggagaagugcuccguuaagcaagcuacaaugcaggggcagauccuaggaagggagcagaacugccaggguuccaaccaaagaaagagguuaauuaauaaugggcaauauuggggagauggguggggaaaagaggaaaaagcuccgcuaaccuaagaauaccacaacccugaaaggagcgccuucuagaacaaagguaaaaucacuaggacagaucuguuaggguuuuccuuucacucuuguaguagaaugcugaucuaacgggaguuuugaaguguggagcaggggggaaaaaaaagaaagaaaaugagaauuuuaauuuuugaaauaacggcaauuuauccauugcacauaccacuguauuaugcaaaucaacguuuuggaaaauuuagacacagaagggaacuagacaguuuucccccuggagagaugaaaagcuuuuuggcucuuaagucuuugauaaaaggcguacauaauucuugugucuacuguacagaauacugccgcuagcuggauuucccaauucugaguaacacucugcaauccaaacaggguucaacccuccaccuuacaggccugcauuacaggacuuaaacacauaauccaagaauuucuuacacuaauuuauacauuuuaauugguugcauauauuaacauguacuauaagauucuuuucuaagaagcauuacauaauaaauggauacuguaaaaagaucugauuaguuaaaaguaacaagcauuaacagauagauacauacaaaacucagccugaucagacugggugugagccuguaauggggcauggggcaccagccuucccaagggguagccuucaaggagggaggggaaaggggggguaaaaagaccacaagaccaauaaaaaaaaucagauaauuagacacagauuaacuguaaacaguucucucucucuccagugaacaaaaagaauaagcuuccaaugccaacuccauaucagaaugacuuccaccgcuggcuuguccugcugccauacucgcgggcucaugugggugggcaggcagaccccaaggagccaucacgggcaagggcuggaguuugauuacgucagaucugugugugugugugugcgugugugugugugugugagagauaugugggguguaacuguguuugaugggguuuucuuuuggcagcuggaugugagagaucaauguauguuuuguuuggaagaggagaggggaauuguguugaaggccuacguguguucuugguuugugaaggacucugugcucaacucucacugcccccucagcaacugcagcuuucugccgaggccuuggcccggucauucuuguccaguuugauagguucaggaaauucguuguacagcuccaccuccguuuccuggacaaggaaacagagaaagguugguuacucagggaauagaaacauuucagcccucauugcgggcacuuucugcccaggaggggcucacuucugcuugggcagagugggcggggagcugugaagcagagccugcccacacaguuaagggagcgcucuggcagaaggugccaugcucaggggaguagcaagagaaaaacagauuuugugacaacuccaggucaaugugaagagaggagucuugccagaagaagcagcagucugcacugagcaaucaggacagaaguucauggacauucucaaucagaucaugaucugggagcucuaccacauccaguucagaugcuuucuguauguucccuauaguugccaaugguuaacaauggucuggauuucuagcuuuucucaaacaucuggcaacccucagccagugugugcacgaggugaaguggcuggagcugagugugagcugcccucucagccuguaacauuccuucuaccucccuaucuuccauccacuuuucgggaccaauggccucuggucucuuuuuucuuccaaagguuuagcagaguuuugucucccaaaugcugcaggccuagaaaggaagcugugaaugaauuuuaucaccaucugugacaagugaucagagcacauggacuauggucauuuuaguggcacuuugcuaaaguaacaugcuuccaaugaggagcagcauucuacuuuugggugcaggaaaacaaugucacuuaaacacugagcacuugugugccagugacuguucuagaauuuggagauaaagcaggaacuguuucuauucauuaaaaguuaucuaggaaaaaaaucauuccauucacaauaacuauaaaaguauaaaacaucuaggaauacauacuuaaaaaaauaacagcuuuggcugagcaugguggcucacgccuguaaucccagcacuuugggaggcugaagcaggucgaccaccugaagucaggaguucaagaccagccuggcgaacauggugaaaccccgucucuacuaaaaauacagaaauuagccaggcauggugacaagcaccuauaaucccagcuacucaggaggcugaggcaggagaauugcuugaacccgggaggucaagguugcagugagccaagauggugccauugcacuccuaauagcuuugcuggguuuuaacucacaugccaugaaguguacaauucaaugguuuuuaguauauucagaaaguugggcagccaucaacauuaaguuuaaaauacucucaucaccccccaaaaaacccuaugcccauuaguaguuccuucccacccccauucuauaccauccuggacccagcaaccacucaucuacuuucugucucaauagaguugccuauuauucuggacacuuaauuuuuaaacauuauuuauuuauuuuaauuuuccccauuucuucuaguggacugugauuucuuucuuuuuuuuuuuuugaggcagagucuugcucugucgcccaggcuggagugcaauggcaugaucacagcucacugcagccucuaacuccugggcucacacaauccuccagucucagccucccaaguagcuggaacuauaagcucaugccaccacaccuagcuaauuuuuaauuuuuaguagagaugaggccuugcuauguugcccaagauggucucaaacuccugguuucaagugauccuccggccucagccucccaaagugcugugauuuuaggcaugagccacugcauccgggcuggacauuucacugaaauggaaucguacaacauauggucuuuuugcaacuggcuuccuucacuuagcacccauguggcagcaugugucacuacuucauuccuucuuauagcugaauaauauuagaaugcauggauaagcugcccuguuuauucacuuaccaguugauggacauuugaguuguucuuacuuuuuggcuauuacaaauagugacauuuuauauucccaccaguaccuaggaauauguuuacugugaaaggcaaaggaucauauuauaaaucaauuauagcaugggugugccuguaguccuaccuacuuaggaggcuauggugggaagacugcuggagcccagaaguuggagguuauagcgagugaugauugcaccacugcguaucagccugacugacagagcaagacccugucucuaaaaaaaaaaagaaucaaucaaucuuacugaaggaacagaaacaagaccuaaaauaguaucauggguggaauguuuuguuuuuuuuuuugagauggaguuucgcucuuguugcccaggcuggagugcaauggugcaaucucggcucacugcaaccuccaccucccagguucaagcaauucuccugccucagcauccuaaguagcugggauuacaggugcccaccaccacgccagcuaauuuuuuguauuuuuaguagagaugggguuucacaauguuggccaggcuggucuugaacuccugaccuaaggugauccacccgccucagccucccgaagugcugggauuacaggcaugagccaccgcacucggcugggcagaauguuuguguuccuccaaaauuccuguguugaagcacuaacccuucagguggcuguauuuggaguaaggaaggaaugaagguuaaaugagguugcaggauggggaccugaucugagaauucguguccuuauaagaagaggugacaccagagacaccuugcucauguguccucucucugugcacacagcagaaagggcaugggagggacacagugagaagauagcccagaaaagcacccucaccagaaacaugugccagcaccuugcucauggacuuccagccuccagaacugugagaaaacaaaaugucuguuguuggacccucccaggcugugggguuuuguuaacgcagccugagcagacuaaugcaacagccacaacaaaacugcaaucaaugaggaaaaaacagugggcuugaagaaaaaaauuccaaucaaaaucucaacagaguuuuauuugggguguggaagguaagagaggaaaaugguggaaacaaaauuauuaaaaaagaaauguggcaggccgggugcgguggcucaugccuguaaccccagcacuuugggaggcugaggcgggcgguucacaaugugaguuccagaccagccuggccaacauggugaaacccuaucuuuacuaaaaaauuaccaaaauuagcugggcaugguggcggaugccuguaaucccagcuacucaggaggcugaggcaggagaaccgcuugaaccugggaggcggagguugcagugagccgagaucacgccauugcauuccagccuggggaacagagcaagacuccgucucaaaaaaaaaaaaaaaaaaaaaaaaaaaaaagacuguggcaagaggaaacuugccucaucaggcagucaaaucaacacaguccagauaagggaacauggcauggacaucaccagaacagacuggagagaccagaaacagaucccagcacauacgagcauuuagcacaggccacggucuauucagggagggaaacggcuuguguaacauagcugaaugauuucaaacaacuggcugagcucucuugagaggaaaggcaagucucucuuuucugccauaagccaaaacaaauuccagcugaauuacagaaaaaucugagguagacacaggaaacauagaaacuuaaaaugacauaaccaaauaaaaaauuacuuuuucccuauguucaaaggacuuaaaaagaccacagaguuggaaaagucacuuaagaugcaaguagaguuaacuucaauucaccaacagcucaugagaacugagagaggcccaaccaugugcugugugccggcugugugcagcagagaaaauccaaauggcuaagccccagggaggggaacucagagggaccaguagucacgaugguggcaauuuacacacccaaagaucggcaaugucagcagugacaggugacaccuauugcuugcuggcaaggagguagaagaaagcaagcccacauugcugaaauguuauuccccuuggggaaagcaaccuggcacccugacuuacaauaagauacacccuccgauuuaacaaucuaacuucuuaagggcuagcucuaaaaauaaaagcauaaagacaacagggacaguagugauggaagagaaaaacucagacagugaugccaggcaacagggaacaggugggaaacacuuuccuacacauauuuggauuuccauucccuuauaugaacauuaagaaaaacacaaacauuauuauuuggggguaagcguggccaagucugcaucuuggucugcuccuuaccacuugagggcucuccuggcauucuggguggaacaauuuccucauugaguagaucugucccuuucauucuggaacacuuagugcagaccccacccaugccagaauuucccugguccuuggagcaaccauuacaaacaacucuuuguccugcugaaagccauuaccuucauucagccggcuuccuggagucagcagaaucugccuugcccuucacagccaccaugugcuucaaguguucuaugcauccucccaaaccugccacaccucugaccacccccagacacugucugaugaggccucgugaccugccuuaaucaccacugccccuaacagagcuguacaucaaaacagacuuucaacucgcaugagugguuguaucuaaucacagaaacaguaaauaagaaauucuagguauuauauuccuugaauaguuuuccuacaucuucuuccuucuuuguguuguuuacuuaacuguuccuaaggaaaaaaguuaccagucaguaugugagagcuggaagagucugucucauuuaaucuucauaaucacccugcaaaagcagguauucccauuuuucaggugaggggguagaaguucagauauaauuuuuuuuauuuuaauuuuuaauuuuuuuuagacagagucccacucugucacccaggauggaguacaguggcacgaucuuggcucacugcaaccucugccgccuggguucaagcaauucuccugccucagccucccgaguagcugggauuacuggcgaccaccaccaggucuggcuaauuuuuuuguauuuuuuaguggagaggggguuucaccauguuggccaggcuggucucgaacuccugaccucaagugaucagcccgccuuggccucccaaagugcuaggauuacaggcaugagccacagugcccggccauaauuuuuuuuuaagcccaaacuagauauaacgauugguacgcagcagagcugggauucauauucaaguuuauuuccuccuuaaauagaagcagcaaucuguucggggucucccagugaccugaucuccuaaucacagcaaagaaaauaagaacaagccuaguaaaagaagggcagccucagacuucacagccucugcaucuuuuauauuauuccccccaaagugggauuucuggaagcuuaagcagaacaugucauaaccuucccagaugaacacauaggguauucuggcuauacagaaaagaguggguuagggaagaagauuaagggcaggaggccaggcagggacugggucaguggucaggcaucaccagagugggcuggucagcugugggagacccaccugcuuaagugcauuccgugcaaucgucuggaacgccugcuccacguugauggccuccuuggcacuggucucaaaguagggaauguuguuuuugcuguagcaccaggccugugcccgcuuuguggccaccugaaagaagaagcagggugcacauaggcucaugacagaagcagccagcacugacuccauccuccccaggaagugucauggccccucgucuacagguaguacaggugaggacacagacauggggaaagaggguguuggaggagaccugcagacccguccaaacuuguccugcuagcuaugcucaggauagcuaggauucagcuagagagcucaaagccugucucggucuacagcucauaccuucugacccucaguuauacuuaaaagccauuugugaauggaguaagaagccaguccgggaagaaaugaagaguguuuacugggaccucagagaucccaggacaggaaaugcccagcagcuuggucuuaagguuuauagucccuucaccauuacugcuagugugaugucaccuaugccacucacacauucucauuccuuccccaaccccuagcccauuuucagccaagagauaaggacuaagucacuuaagaaaagaucuguggucagaaauaaaccuaguuguaauuaaucaaagagucuauguuuccaacagaaaugguauuugaaacuacaguacagcaauuuuacucaaagcccaaagcaauauucugcacacauggagauccaggcauggccuggagguacugggagggcacuacugagaaugacaaaaccgaauucccuccuucaaagugcagaaagggaagugaagcugagacagccaagacaauggcccaaagucacagccagcugggggcaggauggggacuuaacccaggucaccugggucccgguccuuaaaggcaguuggccugaagggcuggcauaugguaaugaagacucccaccagcaccuccuagagccaugugagcuuagcagagaacccuccaaauucacaaggccccuggggagcaggugucugugacaauaucuaucaucguugguacuuacuugucuguuuucgaggucaaucuuguuucccaacacaacaaaugggaaguuuucaggaucucggggacuggccuggaugagaaacucaucucuccagcuaucuaggguuuugaauguguugggggcagucacaucaaauaccagaacgcagcagucugcaccucuguagaaggccacaccgagagacuggaaccguuccuguccugcugugucccauaucug

SEQ ID NO: 16002 - RNA, 8429 nt, Homo sapiens
cagauaugggacacagcaggacaggaacgguuccagucucucgguguggccuucuacagaggugcagacugcugcguucugguauuugaugugacugcccccaacacauucaaaacccuagauagcuggagagaugaguuucucauccaggccaguccccgagauccugaaaacuucccauuuguuguguugggaaacaagauugaccucgaaaacagacaaguaaguaccaacgaugauagauauugucacagacaccugcuccccaggggccuugugaauuuggaggguucucugcuaagcucacauggcucuaggaggugcuggugggagucuucauuaccauaugccagcccuucaggccaacugccuuuaaggaccgggacccaggugaccuggguuaaguccccauccugcccccagcuggcugugacuuugggccauugucuuggcugucucagcuucacuucccuuucugcacuuugaaggagggaauucgguuuugucauucucaguagugcccucccaguaccuccaggccaugccuggaucuccaugugugcagaauauugcuuugggcuuugaguaaaauugcuguacuguaguuucaaauaccauuucuguuggaaacauagacucuuugauuaauuacaacuagguuuauuucugaccacagaucuuuucuuaagugacuuaguccuuaucucuuggcugaaaaugggcuagggguuggggaaggaaugagaaugugugaguggcauaggugacaucacacuagcaguaauggugaagggacuauaaaccuuaagaccaagcugcugggcauuuccuguccugggaucucugaggucccaguaaacacucuucauuucuucccggacuggcuucuuacuccauucacaaauggcuuuuaaguauaacugagggucagaagguaugagcuguagaccgagacaggcuuugagcucucuagcugaauccuagcuauccugagcauagcuagcaggacaaguuuggacgggucugcaggucuccuccaacacccucuuuccccaugucuguguccucaccuguacuaccuguagacgaggggccaugacacuuccuggggaggauggagucagugcuggcugcuucugucaugagccuaugugcacccugcuucuucuuucagguggccacaaagcgggcacaggccuggugcuacagcaaaaacaacauucccuacuuugagaccagugccaaggaggccaucaacguggagcaggcguuccagacgauugcacggaaugcacuuaagcaggugggucucccacagcugaccagcccacucuggugaugccugaccacugacccagucccugccuggccuccugcccuuaaucuucuucccuaacccacucuuuucuguauagccagaauacccuauguguucaucugggaagguuaugacauguucugcuuaagcuuccagaaaucccacuuuggggggaauaauauaaaagaugcagaggcugugaagucugaggcugcccuucuuuuacuaggcuuguucuuauuuucuuugcugugauuaggagaucaggucacugggagaccccgaacagauugcugcuucuauuuaaggaggaaauaaacuugaauaugaaucccagcucugcugcguaccaaucguuauaucuaguuugggcuuaaaaaaaaauuauggccgggcacuguggcucaugccuguaauccuagcacuuugggaggccaaggcgggcugaucacuugaggucaggaguucgagaccagccuggccaacauggugaaacccccucuccacuaaaaaauacaaaaaaauuagccagaccuggugguggucgccaguaaucccagcuacucgggaggcugaggcaggagaauugcuugaacccaggcggcagagguugcagugagccaagaucgugccacuguacuccauccugggugacagagugggacucugucuaaaaaaaauuaaaaauuaaaauaaaaaaaauuauaucugaacuucuacccccucaccugaaaaaugggaauaccugcuuuugcagggugauuaugaagauuaaaugagacagacucuuccagcucucacauacugacugguaacuuuuuuccuuaggaacaguuaaguaaacaacacaaagaaggaagaagauguaggaaaacuauucaaggaauauaauaccuagaauuucuuauuuacuguuucugugauuagauacaaccacucaugcgaguugaaagucuguuuugauguacagcucuguuaggggcaguggugauuaaggcaggucacgaggccucaucagacagugucuggggguggucagagguguggcagguuugggaggaugcauagaacacuugaagcacaugguggcugugaagggcaaggcagauucugcugacuccaggaagccggcugaaugaagguaauggcuuucagcaggacaaagaguuguuuguaaugguugcuccaaggaccagggaaauucuggcauggguggggucugcacuaaguguuccagaaugaaagggacagaucuacucaaugaggaaauuguuccacccagaaugccaggagagcccucaagugguaaggagcagaccaagaugcagacuuggccacgcuuacccccaaauaauaauguuuguguuuuucuuaauguucauauaagggaauggaaauccaaauauguguaggaaaguguuucccaccuguucccuguugccuggcaucacugucugaguuuuucucuuccaucacuacugucccuguugucuuuaugcuuuuauuuuuagagcuagcccuuaagaaguuagauuguuaaaucggaggguguaucuuauuguaagucagggugccagguugcuuuccccaaggggaauaacauuucagcaaugugggcuugcuuucuucuaccuccuugccagcaagcaauaggugucaccugucacugcugacauugccgaucuuuggguguguaaauugccaccaucgugacuacuggucccucugaguuccccucccuggggcuuagccauuuggauuuucucugcugcacacagccggcacacagcacaugguugggccucucucaguucucaugagcuguuggugaauugaaguuaacucuacuugcaucuuaagugacuuuuccaacucuguggucuuuuuaaguccuuugaacauagggaaaaaguaauuuuuuauuugguuaugucauuuuaaguuucuauguuuccugugucuaccucagauuuuucuguaauucagcuggaauuuguuuuggcuuauggcagaaaagagagacuugccuuuccucucaagagagcucagccaguuguuugaaaucauucagcuauguuacacaagccguuucccucccugaauagaccguggccugugcuaaaugcucguaugugcugggaucuguuucuggucucuccagucuguucuggugauguccaugccauguucccuuaucuggacuguguugauuugacugccugaugaggcaaguuuccucuugccacagucuuuuuuuuuuuuuuuuuuuuuuuuuuuuuugagacggagucuugcucuguuccccaggcuggaaugcaauggcgugaucucggcucacugcaaccuccgccucccagguucaagcgguucuccugccucagccuccugaguagcugggauuacaggcauccgccaccaugcccagcuaauuuugguaauuuuuuaguaaagauaggguuucaccauguuggccaggcuggucuggaacucacauugugaaccgcccgccucagccucccaaagugcugggguuacaggcaugagccaccgcacccggccugccacauuucuuuuuuaauaauuuuguuuccaccauuuuccucucuuaccuuccacaccccaaauaaaacucuguugagauuuugauuggaauuuuuuucuucaagcccacuguuuuuuccucauugauugcaguuuuguuguggcuguugcauuagucugcucaggcugcguuaacaaaaccccacagccugggaggguccaacaacagacauuuuguuuucucacaguucuggaggcuggaaguccaugagcaaggugcuggcacauguuucuggugagggugcuuuucugggcuaucuucucacugugucccucccaugcccuuucugcugugugcacagagagaggacacaugagcaaggugucucuggugucaccucuucuuauaaggacacgaauucucagaucagguccccauccugcaaccucauuuaaccuucauuccuuccuuacuccaaauacagccaccugaaggguuagugcuucaacacaggaauuuuggaggaacacaaacauucugcccagccgagugcgguggcucaugccuguaaucccagcacuucgggaggcugaggcggguggaucaccuuaggucaggaguucaagaccagccuggccaacauugugaaaccccaucucuacuaaaaauacaaaaaauuagcuggcgugguggugggcaccuguaaucccagcuacuuaggaugcugaggcaggagaauugcuugaaccugggagguggagguugcagugagccgagauugcaccauugcacuccagccugggcaacaagagcgaaacuccaucucaaaaaaaaaaacaaaacauuccacccaugauacuauuuuaggucuuguuucuguuccuucaguaagauugauugauucuuuuuuuuuuuagagacagggucuugcucugucagucaggcugauacgcaguggugcaaucaucacucgcuauaaccuccaacuucugggcuccagcagucuucccaccauagccuccuaaguagguaggacuacaggcacacccaugcuauaauugauuuauaauaugauccuuugccuuucacaguaaacauauuccuagguacuggugggaauauaaaaugucacuauuuguaauagccaaaaaguaagaacaacucaaauguccaucaacugguaagugaauaaacagggcagcuuauccaugcauucuaauauuauucagcuauaagaaggaaugaaguagugacacaugcugccacaugggugcuaagugaaggaagccaguugcaaaaagaccauauguuguacgauuccauuucagugaaauguccagcccggaugcaguggcucaugccuaaaaucacagcacuuugggaggcugaggccggaggaucacuugaaaccaggaguuugagaccaucuugggcaacauagcaaggccucaucucuacuaaaaauuaaaaauuagcuaggugugguggcaugagcuuauaguuccagcuacuugggaggcugagacuggaggauugugugagcccaggaguuagaggcugcagugagcugugaucaugccauugcacuccagccugggcgacagagcaagacucugccucaaaaaaaaaaaaagaaagaaaucacaguccacuagaagaaauggggaaaauuaaaauaaauaaauaauguuuaaaaauuaaguguccagaauaauaggcaacucuauugagacagaaaguagaugagugguugcuggguccaggaugguauagaaugggggugggaaggaacuacuaaugggcauaggguuuuuuggggggugaugagaguauuuuaaacuuaauguugauggcugcccaacuuucugaauauacuaaaaaccauugaauuguacacuucauggcaugugaguuaaaacccagcaaagcuauuaggagugcaauggcaccaucuuggcucacugcaaccuugaccucccggguucaagcaauucuccugccucagccuccugaguagcugggauuauaggugcuugucaccaugccuggcuaauuucuguauuuuuaguagagacgggguuucaccauguucgccaggcuggucuugaacuccugacuucagguggucgaccugcuucagccucccaaagugcugggauuacaggcgugagccaccaugcucagccaaagcuguuauuuuuuuaaguauguauuccuagauguuuuauacuuuuauaguuauugugaauggaaugauuuuuuuccuagauaacuuuuaaugaauagaaacaguuccugcuuuaucuccaaauucuagaacagucacuggcacacaagugcucaguguuuaagugacauuguuuuccugcacccaaaaguagaaugcugcuccucauuggaagcauguuacuuuagcaaagugccacuaaaaugaccauaguccaugugcucugaucacuugucacagauggugauaaaauucauucacagcuuccuuucuaggccugcagcauuugggagacaaaacucugcuaaaccuuuggaagaaaaaagagaccagaggccauuggucccgaaaaguggauggaagauagggagguagaaggaauguuacaggcugagagggcagcucacacucagcuccagccacuucaccucgugcacacacuggcugaggguugccagauguuugagaaaagcuagaaauccagaccauuguuaaccauuggcaacuauagggaacauacagaaagcaucugaacuggaugugguagagcucccagaucaugaucugauugagaauguccaugaacuucuguccugauugcucagugcagacugcugcuucuucuggcaagacuccucucuucacauugaccuggaguugucacaaaaucuguuuuucucuugcuacuccccugagcauggcaccuucugccagagcgcucccuuaacugugugggcaggcucugcuucacagcuccccgcccacucugcccaagcagaagugagccccuccugggcagaaagugcccgcaaugagggcugaaauguuucuauucccugaguaaccaaccuuucucuguuuccuuguccaggaaacggagguggagcuguacaacgaauuuccugaaccuaucaaacuggacaagaaugaccgggccaaggccucggcagaaagcugcaguugcugagggggcagugagaguugagcacagaguccuucacaaaccaagaacacacguaggccuucaacacaauuccccucuccucuuccaaacaaaacauacauugaucucucacauccagcugccaaaagaaaaccccaucaaacacaguuacaccccacauaucucucacacacacacacacacgcacacacacacacacagaucugacguaaucaaacuccagcccuugcccgugauggcuccuuggggucugccugcccacccacaugagcccgcgaguauggcagcaggacaagccagcgguggaagucauucugauauggaguuggcauuggaagcuuauucuuuuuguucacuggagagagagagaacuguuuacaguuaaucugugucuaauuaucugauuuuuuuuauuggucuuguggucuuuuuacccccccuuuccccucccuccuugaaggcuaccccuugggaaggcuggugccccaugccccauuacaggcucacacccagucugaucaggcugaguuuuguauguaucuaucuguuaaugcuuguuacuuuuaacuaaucagaucuuuuuacaguauccauuuauuauguaaugcuucuuagaaaagaaucuuauaguacauguuaauauaugcaaccaauuaaaauguauaaauuaguguaagaaauucuuggauuauguguuuaaguccuguaaugcaggccuguaagguggaggguugaacccuguuuggauugcagaguguuacucagaauugggaaauccagcuagcggcaguauucuguacaguagacacaagaauuauguacgccuuuuaucaaagacuuaagagccaaaaagcuuuucaucucuccagggggaaaacugucuaguucccuucugugucuaaauuuuccaaaacguugauuugcauaauacagugguaugugcaauggauaaauugccguuauuucaaaaauuaaaauucucauuuucuuucuuuuuuuuccccccugcuccacacuucaaaacucccguuagaucagcauucuacuacaagagugaaaggaaaacccuaacagaucuguccuagugauuuuaccuuuguucuagaaggcgcuccuuucaggguugugguauucuuagguuagcggagcuuuuuccucuuuuccccacccaucuccccaauauugcccauuauuaauuaaccucuuucuuugguuggaacccuggcaguucugcucccuuccuaggaucugccccugcauuguagcuugcuuaacggagcacuucuccuuuuuccaaaggucuacauucuagggugugggcugaguucuucuguaaagagaugaacgcaaugccaauaaaauugaacaagaacaauga

SEQ ID NO: 16003 - RNA, 57651 nt, Homo sapiens
cgccuccugccgcuggagucgguuacaaaggaagcgccacccaggccgccacacgccgaggcuuccgcgccccucgccauuuuccagcagcgcucgacgaggcggagccgcgagagcgcggcccaggccggccccgcggggcggucgcggccgugacggcggcuccgggcccggcuccccuuccgcgcccggcuccccuuccgcgccccucccgccggagaugaggggaagauguccgugucagggcucaaggccgagcugaaguuccuggcguccaucuucgacaagaaccacgagcgauuccgcaucgucaguuggaagcuggacgagcugcacugccaguuccuggugccgcagcagggcagcccgcacucgcugccgccgccacucacgcuccacugcaacaucacggugaggcgcccggccgcggccccgcggggcagggcgaggacggagagggggcgcuucgagucccgggacaaaggggagccugccccggagaggcuccggcuccccgggcggggcaggcccgccccuuucccccgcgacuugcccaucccaggccgggcugggacugcgcgaggcuugggugggaggaggcggagggcgcgucuuuccggcuucucgccaggggcuggcuugggggcuucuggcccaucucgguccccgucuccuagccccgaggggggaguccgcggcggcccaagcccuugugggguccauggccgcccucagccggccugcucccgggaccggggcggggcggggcggggcggcgcagcuccggcuguuguuugagcccaggccggcaaggggaacggcccuuaaguuuuaacgccucauuuuucagucggauuuuccuucuucccgcuuguucagccaauuguuuuuaaguuugcguuuaaggagaaacugacaaugagaauggacucguugacggaggaaaaguuggaaugcagacucuggugcuguuugagcgaccccucucccccgggccuggcugcgcgcugcuguguucuggaaaggagcauaguaccgucguugcggcaggugguguugaguguguauucguguggccccucccuuguguguaagccucgaaaauggauaggugaaaggagauacgcgccagggcugcuccccggaaagaucacguaugucacaaagccgaaaagacacuuuuaaaaacucacucauuaagcggaaaucucauuagaaacccaaggcuugguaaaggaauugaaguauuaaguuucuccauaaaaguguaucgugaagcuauucgucgugaaauugauguaggauauugguccaaacugcagaauauucucuugguuauaauaggcgucaaggugguggcuucgggcuccuuuucaaacauggcuaaaaccaagucuuguuuuuaacucccuuugguugagucaguggguacucaagugccugcaggguggcuggcguuugcaaaaaccuugauguuauaauugaccuuaaaaugguuaccagacuaucugggcagaagguguguuaauuucaaaaaaaaaaagacaagugcuguacugaggagauaauucauuuauugaaugaauacgucugaguguucugggcacuaguguugcagaauugagugaagucguccucgcucucagaacucagucuucuugggggaagaguucaauaaggugacagcuccugugguaucaucaggaaagccaaagcaacuaauuuugacuugggggaggugcgcuucagggaaggcuuugaugagaggcugagacaguuagagaugagcuuccacaggugacuacaauuuuggaaggcuggcggaagggcauuuuagacugaggaaacuccacccaaagaagacacggagauuugagaaagugugguuuccuuagaaguagaaaauuuaugcuaagacuugagaagcccacgauacaggcuggagaaggggaggauuuuccaagaguggaaaacagaaaguguaguaguugucaugaagcagguguuuuaaggagacgggccugaauggcuucgagggugauuacucugguagaaguuggggcauggccacgaaaagguagggcugguuugaaugauaggagacugaauuuguaggcuguggggagcuacuaaguuuacucagguaaguugggagaauguaucuuucauccaggauuagaaaugguucucuacaguggguggcauuaggaaaugugguuaucccagugggggugggguggucuuauugcugugccggcauuuagugcuaggaguacagggauaccaaauguuuugcaacguucaggcagucugccacagcaaagaauuaucccaccuaaagugccacuggugccccaucgagaaccauauugaaggcugguaagagucugcugcagauaaaaauaaggagugaugaccuggauuaggcaguggcaacagaaauggagcaagaagugaaugagacacuuucaguacaaggaggauuuagugaggacuaguguaauggcacccaccgcuagguagaaacuauuaaaauugacuugcuagugaaauaugacagacuaucaggagauaauuaucauggcagcugcucaguacaaaugucugcuaacuuuuuauuauggaaaaucaucaaauguacaaaaguugaacaguguaauguagccagccucaacaaugauaaacuuuuggcuaaucuucaucuguacuccacuuuagauuauuuugaagcagauuccagacagaucacuucaucuguaaauauuucugcuuguaucuuuugaagguaaaagacucuuuuauuuuuuauuauuauuuuuugagacggagucucgcugugucgucccagcuggagugcaguggugugaccugggcccacugcaaccuccgccucccagguucaagcaauucugcugccaccgccucccgaguagcugggauuacagguuuccgccgccacacccggcuaauuuuuguguuuuuaguagagacgggguuucaccauguuggccaggcuggucuugaacuccaccucaagcucccaaagugcugggauuacaggagugagccaccguuccuggccguaaagacucuuuuaaacauggaugacuguuuugauaaaaugacauggcuuguucaugucgauaccauuugcuuagaagggaaagaucaagggaaaaaugggguuggauuucaaaugauuugguuugaucgaugauuuguuauucucuaaaguuguaacucuggaaaagguaaugaguuugacuuauucuuuaacuuuuccucuuuagacaguucaaauauuugaauucuacaugcuaggacuuguuuucuuuauacuuaccaagaaacauccuuaugcaguuucucuaauguuugagaaacuaaguuguuuuuuacacacgugcaugcuaguuccugaagaguccuguacaggugcucugcuggcuuuuccuuucagguuucuguaucagcuguauuucucccuguagaaugugccccugaccuccaccccuuaaccuuaccccauuugucuuuauaugccugaccauccgucaaggcucuucugggucauauuuaguucaugcuguuauuuccccuuccucccuucuuuaguccuuacuauuuuugcuuuggucauguuuucuuaugcuguauucuguaagccuuuaaauuuuucuuuuuaugguggcaggggagaauauuuuauaauuaugcuuugugcuuuuuaucuuccacucaauaaaugcuucauaaauauuugaguauauagcgcuauucuagcuguauuguauuugaacaaaaaucuuaacugccuuguaaguuaacugcuaagaauuugucaaaagugcagagauaacaucaauaacuugucauggauaguacaaaaaggucucuaagggcuugauggaagucuguaaauugacuucauaugagaguguaagaagugaaaaagaccaaaacagaguagauguuuuacucuguaggccaagggaauugagcuaauucuuuuccuguuuuauaaauuuguccugaucuuaaauaaugaagggaaaagagugcucuuuuucaaccucgaguccuuuuuauucuuuucugugaagccaugauaugaaagauugccuguuauacaaacuuaaguauaguuuuuccaucuucaguaaacuaaccugauugccgucuaauuaguuguuacaaucacaccgaaaugcaaagcagcuuguuuuaagcagccuuauugggagcuaguauauggcuuuagucguuuugaaguauuuaacauaacuuggcaacuccauuacuccuuuuauggacuuuuuggcaucugggcauucuugguaggaaaucacuguuuuagaaugaaaaaucucccccaggaaguaaauuagcuaguaaacaaaugaaacuucauuuuuuauauuacuuguagagcauaaaugauuacccuuucugcguauaaguggcuguuugcuaggcugcuuuuagugggacuuuguuuuugauugguuaauuaaauuucuauucauuauugccaaaaagugccuacccccaacagcaagauacuaaauuuuaaaaauguuggagcugugaaucuaggaggaagugagaaguuuagcuuuuauuuaguaguuaggagcuuaaguaagucacuucuuuuacuguguuucuguguacuauagauaauauuuuuuugcacugcaagagagcauauagaggaaagcucuuuggcaaugauauuauguucuacaaauauaaaagcgauggugucauuuguggcugaauaacacuuuauuuugaaaaugcuuuauaacagguuuuugugggaaauaaagcaaugcuguuaacuucaucuugcauuuuucuagucuuuacuaugauuaaaaaguaguccagucaaaguuguacaaaggaaauaaaccuggacuaaggagccuaagacuuuucucuuugguuugcccuccugggacagauuaccuuuccaaauugaauucauggaagagcauuuggaaauaucagaacugucauguuaagcaccuaagugguacuuucauuccagaagaaucauuguuuucguuuaucugaccaauuuauaauauagggucaaauuccuggugguuauuuaugcucccucauccccauuuuuauaccuguccuugaaaggaacagauauaugaagagaagacuuagguuucccuuuugugaauaguauaucccuuaguaucuugauuuuuuuuuuuuaauuugguuaaacauauuuagaccuggaaaaggguaguauuugauaaaugucagcuaguugagggguggggaauugaguugaauggagauagucacugccaaaugucaagcaugacuggagagccagagugauaaagcaggggucccuuuuuccagauccuuuguaacaguguuaugugaucucuucuagaagauucugaaagauaaucccaacuuggaaccuaggaaaccacccaguggguuucugcagcuuaggugguucagauccucaucagcaccuuuuucugugccucaguuugcuuacaaugauguucucaguagcuguaauuugcugcuuguguuugaauacuuaagcauuuucuuuuuaucauggguauaugaacauuuuuauuucaacaaguguuagaauuuuuacucugcuuuugugggcucuagguuagcuacuugguuguuuauuuguaaaaugauuagcagggaaccauguguaugcauuuuaaguaucuuuuguugucagagcaguuagaauuuuauuaagguacuauaugcuaauucugucaauuuacuucguucuccaccccacauuuauugaacagcaaacuaugaaaguaaugugucccauaacuggccuucagaagaauuacaacugcuguuaucucugaaccuuccagaaguuugugcaucaguuuuaaaaaaaugaugaaaucccugaagauagcuguguccuacauuuggaaagauacaaaaacugaccauucuggucaaccaguuuugguugcuggugcuugagauagagccacacaauggucucaguggauuuauggagaaaaauagauacagaaaguuacuucuaaauaagacaaaaaaaucuuuuucuugagcagugacagguaaagagguugguuugguuaaucuugaguuguguuucccuccauuaagacaguuuuaugguggggaugguaguggugaugaacuuguuugaaauuuguccacuuacaguaauguuuaugguagcuucacagacaacuucauucucacaggccuuagaauuacuauaaaacuaauagaauggaugaggaacaaaggaccugaguaauuagaugcuuagauaauuguucuguguuuucauaacuguggugaaaaagaguggugcuagaagcacuuaaacauucuauguacgggaaaacugccugaauuuguauugggauuuuugagcaccauucacuguuuaaaaacugauauaccauaggucauauuuauuuuaaagagaaauaguaggcaaacuuaucuuuucaagauagauauaaagcuuaguuaaccuuaucaaaauuacaaaacuuaaagcaugugaaagauugaaaauauuaauacauagguuuaaauauuggucauuauuuuagaugucuuucaaaguagauucucucuuaaauguuaaacugaacaaaccuugaacaugauguagaguuugugcugaagguuaaguuuccuggcgugguggauauuuuauaauauggaaaacaaaaccuucuuauuguaagacauuaaaagaaauuuagucaaaacuaggagauaugauucuaccacucagaauauaccacuaucagaauuuuguaucuuuccaguuaucugcucaucucuuuucuccgaugcuuauguguguucccucucccuuaaaaaaucagauuuuuuuguaaucugcuuuuucacucaacaauauuguagauccguguuauaacuuacuccuuacguguaggcaagaugaauucugaccaccccaagguggccauccuugucccugugauuccagaucucccagaacuagaggucuagcuucagggaaaacccagauuuucuuggcuuagcccaccugacagcuaaucacuggaaauggggugggcugguagaguccuuuggucagguuuugugucaagagagggaggaggaaagaugggagggagguagcaaaacuggucucaauggaacuauguaaguuaauauagaauggcaaagggauguuucuuccaaggaaagaauucuaaggaaggaaggaaaguggaggggaaggcagcaguucucaaaguuuuggggucaggacuccuuuacacucuugaaaauauauucagcacuuaagggcuuugguuuauguaaguuacgucuauugguauuuaucacuacaaguuaaaucagaaauauuuaaaacauuaacucuuuaaaaacucaucacauauuauuauaaaugugcuuuuacgaaacaaaauuuucuaagccaaaaaauagaauaguagcacagucuuaaauuuuuugcaaauuucauugauguuugcucugucauuugcuuuugcauuuaauuuguuguaugcuauuugcuugaaauaauguaaacaaaauccaaccuuauacagauaccugguuggaaaaauugugaauauuuuaauggccauuuuagauaauccuggauauucuucuuuuuuuuuuuuuugagauggggguucacuguguugcccaggcuggagugcaguggugugaucacagcucacugcacccucagucuccugggacucagguguaggccaucuuacuggcuaauuuuuuguauuuuuuuguagagacaggguuuugccauguugccuaggcuucuuuuuugaugcucuaucaaaacuuggucuuucuugaacuuuggaucuuuuacccuuguaugauauuauaacaucaugcauuggucauuuagaaaauagugguucaccgagaucuucuaaauguugauacauuugauuuuacaguaucaaaauacauucaucaauauugccaucaauguuaucaggauauucuuggaaaacggugguggauacaaguuuucaaaaauucuaauuuuuuguucaaaaacuugcauuuuauuauuagcaguuuuauuauugaaauuuauuauggccugucuguuguuuuccuugaaaugacagaaucucauuuuuugaggaaaaugacugccaaaaacccaaguugaaauaacaucgucaguuauccuuucaaguaaaaaugguauuccauuuaagugguuaauucacuucaugacuuagucacacaaggguuuuuucucaggcagucuguaggaaugcucauguauacuucccguuucaucacuugaaauauuaaaaagacauauucaaggauucagauguaguaaaauuuucacugcuucaucauagacauucuuuuuauuuuugagacagggccuuguucugucacccaggcuggagugcaguagcgugaucacagcucaguggagacucgaccuucugggcucaaucaauccuucugccucagccucccuaguagcugggacuacaggcgugcaaccaccaugcuuagcuaauuuuuuuauuuuuuuuuguagagaugggguuucacccuguuggccaggcuggucuugaacuccugggcucaagugauccuccugccucggccucccaaagugcugggauuacaggcaugagccaccauucccagccuuaucguagacauucuuaaaugaaacugaccuuuuguugcccuuccuuuuuaagccuuuccugugcauagugaagaauaccaugacuacuaguaguuugguguuaccgccuuuauuugugcuaaagugccagcguuuuuacccaccauuguaucugcacccuuacagcauaugucaacauguuaguauucuuguaaaaauaguuuggaccugggggucugagguccccacuuugggaaccauugaaauagguacuuagaucuacaguguaucauaucuuuucaucuacaagauuaaaaacaugauuucaguuaauuguuuuuguaauuuucuuaauaugguuuugagggguuucaguccagagugaagacauguauguuucuuggcuuaugcugaaguuuacuagacaaauacuaaccuaauaaugagauccuaaguguaguugcaguuucuuuagccuaagggaaaagaaaccuaaaaacuaaaacaguaaaaaugguccagaugguguauucccaaugugugcugaagaauuugaagaagaaaaugcaguacucaauaagugguguuaagaacaggauuaauucuggagaguuucucauuuagccuguaaagagauuuggggcacaguaagaguuagaggaaugaaaauaguaaauaacccauuauugaccagguauacuauuaaugauguccuccaucaauacaacuuauucuuaaaagaacauuugguaaaaugcuuuaaaaauauucaguuucuguggcuucagcuauaaaucagauuauaguucucaaagcaguguuuccuaaaaucguuucugugaaauuguuuuccaugacuugaaccuaguuguucugaagcuaauauacgauaauaauggcuuuuccccaauuuauaauagaaaaucauacaaaguaacagaguaaaugucuguuagugggugaaagcacauaaugcuuaguucauuagcuuuuuaaagaaaucacauguaauuguguuuuaaaaaagauaugggccuggcuuaguggcucacgccuguaaucccagcacuuugggaggcugaggugggcugaucacgagaucaggaguucaagaccagccuggccagcauggugaaaccccgucucuaauaaaaauacaaaaaauuagcuuggcgugguggcaugugcuuguuaucccagcuacucgggaggcugaggcaggagaaucgcuugaaccuaggaggcggagguugcagugagccgagauugugccaugcacuccgccugggccacagagcaagacucugucucgaggaaaaaaagaaaaaaaaauuauauauauauauauauguauguauguauguauguguguauauauauguaguaauggcauuucuugguaguacuugguuugugugauagauuaaaacauuagaauuuuaugguauuugaauuacuuuucuauugcucuguaacaaauuuaucagcuuaaagcaacaaacauuaucucaccauuucugugggucaggauuuugugcaauuuaccuuggguucacuggcuuggccucucaccaggcagcgaaguuguugguggcagcugugaucauccuaaggcaggauagggagagaaucagucuccaagcucacuuauguagauguuggcaggauucaucucacaggcugugggacugggccuccguuucuggauggcuguuggucugaggccuuuuauaauaccucgccauguaggucucuccauagggcaccucaucacauggcaacugguuuccaucagagggagcaauggaaagagcaggagaaggaugggcaaggcagacaucauagucucuuuguagccuaaucucagaagugauguuauuacuuuugcuguauucucuuuguuagaagugagucacuagguccaggggcgggaauuuuacaagggugugaaugccaggaggugauggugaucggggccauuuuagaggcugccuaccaguguugaagaaaaucauugacuucuaugagcuguagcaacagacagugcuaugcaaggagaaugguugucucaaaaguccagcuccucacaagguuuuuaauauguugccuuuuccccccauacauuuuguuuaaauccauggucaucuugccguuuaguggugugguuuaauugcauauuuggguuagucuguauguaaauguuuaacaugugucucuguguuaaacaggaauccuauccaucuucuucaccgauaugguuuguggauucugaagacccaaaucugacaucaguucuggaacgucuagaagauacuaagaacaacaauuugguaagaaaauaagccaagcuauuuucucuuuuccucaugaacauuacauauagaaauuaaauguuaagagauaauaugauauaaaagcaugauuaaugauuauaaucuuguaggaauuaaagacuaguuuguuuguuuuuuuuccuucaaauucuauuuacuaccuggucucucuuuuauuucccacauguauaaccuuaauuuagauuacaaauuagggaucucuuuuucccugaauucuaaccauuaagccaaacaagcauuuuggguagagaccacuagccaaggugggaagcagaaaaaagaccaagguaggagugaagggagagauggggagaaugacaccagaacuaguaugagggaauugccuuuucuuucaagggucuguaagucugcaguaaaagaauagaaaguuuuauuuuuguuuuuaguauauaaagaaauauaacuuuccauguugaaaaaguuuuuaaugcuuuuuuucuugauuauaaaacucaugagcaagcauuauugagaaaauuaguaaaauauagacaggaaaaaaaauuaaaaucucccauaauuucucuaccuaauauaaccacuguugacaugaugguuauuuucuaccaguauauauuuuuccuuugcuaguaaaauacauauaccuuuauacauguguuuaaauaguugaggucauggucuauauaguuuuacaucauuuuaaaaaacauuuacuggccaggugugguggcucacgccuguaaucucagcacuuuaggaagcugaggcgggcggaucacuugaggccaggaguucgagaucagccuggccaacauggugaaacccugucucugcuaaacauauaaaaauuaacugggcaugguggcgcaugcuuguaaucccagcuacuugggaggcugaggcaggagaauugcuugaaucugggagacagagguuguggugagccgagaucacgcuauuauacuccagccuggguaacagagugauacuccaucucaaaaaaaaaaaaaaauuacuguauuuucccaugaugucauacagucuuuauagaaaaauaaucaucauuauuuucagcugacaugauuguuuaccugaaaauauucagaggaaccaacugaaaaaaagaguuuuuaagauuacugguugaaagcucuguuacauaaaagucaauagcuuuccacaauuuuagcuauaaucacauugaagguauagugauaaaguauuuuuuuaaguauuucaacaaaaauuaaauaccuaagaaucaacuuagaugugcacgacuuuuaucaagaacaugacaauuuugcugaguggaaggaaagauuugcauucuguguuccuggaugagcagauuucauguuauaaauaugucacuuaucgccaugucuucauauucguaaauguaauuucugcuggguguguaguggcucaugccuguaauuccagaacuuugggauguugaagcaggcagguugcuugagcucaugaguuuaagaccagccuaggcaacauggugaaaccugucucuacaaaaaauacaaaaauuagcaggguguaguggcacacacuuguagucccaacuacugaggaggcugaggugggaggauugcuugagcuugggagguggagauugcaguaagccuagauugugccucugaacucuagccuaggugacggagugagaccccgucucaaaaaaaaauguauauauauauguguguguuuauacauguauguguauauguguauauacguguguguguguguguguguguguauauauauauauauauauauauaaugaauuucaguacaaaucccagcagauuuauuuuuggaaguugacaaaaugacucuaacauuuguuuaaaaggguaaaugauaaaaaaauaaagaauagacuuguucaaccagauguucaauaaaauguuguauacuaacucuguuccagacagauaaaggcaauggaaauuuagaaccagagucaugcaaaugagaauuuaguauaagguaaaggugguauucuaacuuaauaaggaaaggcuagauuauucuguaaacagucuuaggaaaacuauuugaggaaguuugagucucaacucugauuuuugucaaaauaaguuauaguuguauaguugguuuaaacacaucuauucuuaagaacagaaggcugggcaugauggcucacgccuguaaucccagaacuuuaggaggcccaggcaggcggaucaguugagguggggaguucaagaccagccuggccaacauggcgaaaccccaucucuacuaaaaauacaaaauuuagccgggugugguggcauguaccugugaucccagcuacuuggaggcugaggcaggagaagugcuucaaccugggaggcagguugcagugagccgagauugugccaccguacucuagccugggcgacagagcaagacucugucuccaaaaaaaaaaaaaagauauuuuaagaguuaaggcugaggcuuggcacagugguucaugccuguaaucccagcacuuugggaggcugaggugggaggauugcuugagcccaggaguuugagauuagcuuuggcaacauagcaagacccucuuucucucucucucuguacacacacaugcacacguacguacguauguuaagguuuguauggagagccaugaagguaagagguaaaaauuaaaagcuagauggacacauguuuacauccccagcaaggggguugaugggaaagagugguagacauaguucuguuacugcuaccuccuuuuaggaaguugcuucugaagaucuaaagauaacgguuuuguaauagcaaaaaugaguuauuuuucaguaucuaaaauauuacauaaacauguucauaagguuaaaugaaauaggauauaaaauugggccuaguuuuuuaaaagugaauauauuuacaugaaggagaaaacaacucaccucccacucuugcagccucugccaguuuaucaaaaccuaguuucuugagagaauaagcuacaugucuucaccuuuuuucgcugaaguuauuauaaucuggauucugccuucaucauugcacuaaaauuuaucuccuaguugccaaaacuagcggcuccucucuuaguccccaaauugaccccucugcaguauuuugauacuguugauuguucccuuguugaaacauuccugcauucuuaauguccaccaauaaagaguugguuaaauaaaaaucauaguguauaguuuuauaauagaauauucuguuguaggcaaaaaaaaaaaaaaugcagccauuuuuuccauaagagcaugugcagauuucuaagauauauuaaaugaaaaagcaaggcauaaaauauuguguauaauuggccccuuuaguauauaauguaaaaaaaaucuauaugcuuguuuauacuuuuuucuuuccugguggguacaggaaacugucaauaguagaacacaauuaagaaaaauuggcuucugugucaggcucugugauaauugaguauaaaagacaaggcaugucccuguccucugggaacugauaaucuaauggaacuuccaucugauuacugucuuguuuugaucuuaucacccugccuuggucuccucugaucucuucucccuuggccuacuucuucucuucucauucugugcuuucucugaguaauauuuuacucccauuacuuuagucaugaucucuguucuagggauuccuaaaucuguauucaucuccagaguuucaaacccauauaucugucuguaaaucauauauguuagggaaucucacuuacagugccauggauauucaaaaugaugacguuuaaauuugcguuuacccaccuccuagcacucuaucagccccguguuuuuucucaguaauucuugugauugugagugggacaaaaugaaauaaucaaacuagucacccauacccaaaccugggaacugucuuagcguucuuuuauauacuacuguucucugacccccgccccccgcaaacuaguaauuuucuaagaccuguccuucugaaugucucuuacuauuuucccugugaucucaguuucuuccucccaucccucaaaugcuuuuuuggugugugggggaagggaggaaaauugaaauucguggagaguguacuacccugucuuucuuguugcuugguaugacuccacuacccugcugccucucuccccagcacuccuggagccccuuccgugccagaggccagagugucuaggucuguguccggauugcucugccucaucuucauuaugcacuuagcacgcaauagaguguauuggguggauaucaaauccacacuggagcuugguuuccguuuaagcaugaagauuuuuguuggaucguaauuuaccguucaaccuuccucauuuucauuugcuccguuguccacuuugggaaagcuuauucuuugcuucguuaacccauucuaauccuaugucuucuuucuuuguccuuuguaaaccugcuucuuucucuucaucucuuuucuuggucagagccaccuaggaaacuguuccugaccgaguuaagugaguugccuuauuagaucccauuugagucacguuauacauugaaaaacauuuuaaacaaugaacaccauacuugugcacaugauuuaccuugcuuacuuguugaaagcaaauaugcuuagaaaacaaucuggacuuaaacauggaaauuuacaguuauucuuugcaguuuuccuagugaauuauuguuauuuuuuauacagacacuuaagagccuacuaaauaucaaguguuacagguuucauuuaaucuuuaccauucugggaaaguuuucauuucuuuguuuuacagauggguagacucauacucagggaauuagauaggauauccaaggucaucuagauugccaggcucugucuacuagauauuugcuucuguauuuuuaaaugaauaugacuggaauauauaauuuuguaauccaucuguaacaacacugccugugugugucuggguuauuuuuucuguuauuuuuuguuuuuauuuuuuugguagccucauuaaugcauuaauguucucuugucugaaguuguaaguuucucagaaaacggguuagcagugagaaauuggacaaugucuggaacuuccuuccucugcccuuauuguugucauucugcuagguaucaguuguagugauuauaccccaagccauaguaacuuucuuacacuagaggguccugaaaauauuuuaaagacuauuuuuuaaaucuguaagcugcaguugagcaguaacaaacuuuuucauuuccuacuggauugauuacaguagucauaacauuauugaugucuucuaagggcucuuuaacauaaugcuuauuuacugaaauguguuuuguagcuucgucagcaauugaagugguugauaugugaacucugcaguuuauauaaccuuccuaagcaccuggauguugagaugcuagaucaaccacuacccacgggucagguaaaguaaaaauucucuaguguucaagagcuaaauaaauugucucaagcaaaagucaaacuaggaugauuuuucuuuuuauuguucaacuuauuuagaaguuaguuucauuuuuguuccuauugaauuguuuuguuuguucuguuuuagguacuaaaaauaaacuuuucauucuuuggagcugcugguauuuacuauacaggcaaacaauugcccuucucucuaccaccaccuuuuuguuaauauugcugguuuccguaaaugcucuugcuucuuucauaguuugucuuugguuauucaauuaccuucaccuagcaaugucaucuccuuaagucugucugugcuuuuuaaagacuaaaccaaauguuaucuccugcaagcaacagaaauuuccacuagcucaccaccaucacuaauuucauucuggauuuaccuauuuaggcaucuaaauauuuauuaccuauuuauuuuuuuuuuacuauaauacaugauaauuuagcucuuauaccacccacuuaccacucaccuccccuuccucaaauauuaucuuuagucauauaaguaaucacuaauuaucauuaggacuuuguagaguaaagccaaguuuucuagaauauuuaagauaggauauuuccuuucuuggugcagcuuuuuguuuugcagugucuuccucauaauaguaauuuuuaauuuaaaaaauucuguuguagcccuuucugugagguuucccuuucuucugaagccuuugguuccucugugcccaucuuggcagguuguucuuuggguuggcugugcagaugccaucuugagguuuuucucaucugcucuccuacaguagauccauuguuucuuggaucccaugccaucuuucuuggcugacccuuucucauuuugccugacuauauucucagguaaaacccuaagaaagcauggaggaguacauuuucugagcucuagcuucugaaaaauacuguccaguguuugguuuuuggagccagaccgugauagguuugaaucuuuguucugcuacuuacuggcuguaugcccuugggcugauucccuaauugcucuaugcaucaauuuuccauuggcaaaaugggggaaccaguaauaauauuaguaccuauguuuugggggaacuaugaggauuaaaugaguucguacaaguaaaccauuuagaacagugccuggugcauagcacauccccaucaacguugacuucuguuauauucuacccucccucacacuugauugguaguuugguugauuauauauuucuagguugaagauaauuuuaccuuagaauuucaaagucuaugcuguugucuucuaaccagucgugguggugaagccucauggcauucugaguuucagucauuuauguauggcuuucucucuggaagcuuuuaggaguuugucuuuuccuuggugugcugaaacagcacaacaguauacuuagugugggucuuuuuucacucauugugcucaguacaccaaauggauaggccuauggauaggcucuuucaaauuuggaaucuugaaucuucucauaauuuuguuaacuuucuccuuuccauuuuauuuguucauuuugaaguguccguuaaugggauuuuagaccucuugucuugagucuuguaucucauauuauuucuaaauuauuuuucuuuaauuuuaaaaucugaaauauuuuucuuucaacuuuuggaaauguuauuuggacagucauagcuuuaaguuuuauuuauuguugcuuaaccaauuaucccaaaacuuaauggcauaaaacaacaaauuugccuaucuaucacuauuguauggcuuaacuggggcuaguuggacagguuuucugcuggucucauuuggcagcucucacuaugugguuuagacgguggcagggacuggucaucuggaugcucagcugcaguggaaugucugagacgacuucuucacccacaggucugcugccuugguguuucuucaucuggccuuucucucugcauagcgucucauccucucgggccucuucauguggcuucucuuucuccaagaggauagucaguuccuauuuuuggcuuccagaagcacagaaguggagcugccagguguucuuaaggcuuagaucuggaacagguccaauauaauuucuaccaaauucuguagguuaaagugagucucagggccaacccagacucacugugggaugggcccauccaaggacgugaugacaggaggugugguucauugaggaccaacucccaagaugagcccugaguucuaagaaccuuuucuucgcugguuauuuuuuauucauauucuauuuuuguuccaugguuguauucauaagugucuuuaaggagcuauuuugauacucuuuggcccucucccuagcaucucuuuuuucuuuaauaaauuuuuuucuuaguuuauuuuggucuuuuuuuuuuuuuaaaccuuuccucagguaucuauucuauguugcucaucauuuguagucuuuuaauucccuuuuuuguucauauuugagagagguacuaaaagacugauugggaggcugggugugguggcucacacguauaaucugagugcuuugggaggcugaggugggaggaucacuugagcccaagaguuaagaccagccugggcaacauauugagaccccaucuuuacaaaaaauaaaaaauuagguggguaugguggcaccugccuguagucccagcuacucaagaggcuaaggcaggaggaucaguugagccuaugagguuaaggcugcagugggcugugaucaugccaguguacuccagccugggugacagaauggaacccuaucucaaaaaaaaaaaaaaaaaaaaaaaaaggacugaaagacugauugggaguucuuuguggccaagacugguagcuuuuagugggaauuuaggcugauucccaauuguuauucccuaccccucuaucuuaucuccuggugcaaucauaaaugauggcuggaacuacuccauuccucuggagaugaaaucuguguucuuuugccugagguagauguauguuugcuuagguucugcuuaaggagaugugggagaacaguguguuucagggccuggaaaauguguucuguauauaggcuuuuguuaaucuguuuacagucuugccuaucugucccacuuucugggguaccuagugucugagucuagagccucuucagggcgcugugagauaaauuugccuucuugcugucaauaucccccuaaccuccaccuuuguuggcuuugcuccauuaauuaacuauuuuccauuuacugucauugucuaguggaggugaguucuggucugccgguaaccccauuccuuuuuuguaauuguguguuuauucuucaccguaauucuaguggagccucaggacaaagagcagaugggagaaauauguguucaguauucacuuuuccuucuguuuuuuuuguuuguuuguuuuucuuuuuuuuuuuugacggagucucucugucgcccaggguggagugcaguggcgcgaucucaacucacugcaaccucugccucccggguucaagugauucuccugccucucagccuuccaaguagcugggauuacaggcacaugucacuacggccagcugauauuuuauaaacaucuaugaucaccuggccagucuuuuuuuuuuuuucugaguuggagucucgccugucgcccaggauggagugcaauggugcgaucuuggcucacugcagccuccgcuucguggguucaagcgauucuccugccucagucuccccaguagcugggauuacaggugugcaccaccacgcucggcuaauuuuuuguauuuuuuaguagagggguuucaccauguuggccaggcuggucucgaacuccugaccuugugaucugcccaccucggccucccagagugcugggauuacaggggugagccacugcaccuggccccucacuuuuccuucuguaagacaucugcagcuuguguuuuucacugaauaucacauggacuuaaugcauagagagcugccugguuuuucaugauugugcccacgauucuguauagggauauaauuuaugaauuccuaauuuugaaucauccuugcauuucuauaguaaacaccguuagaauggauaugguaauacuuuauuuuuggauuuuuacuucuauauuaaguaagguuauacuuuguuuccuuuuaggcucuuauuucaguaucaaggguaugcaggggugacuuggaaagcuuuacaucuuuuuuccuaagaucuaggguguagaucuaguuuacacaguaauuuucaacuggaggagauuuuugccucccgugggacauuuggaaauaucuggagccauuucugguuuucacaacuggucaugguaggggugcuguuggcauuucuuagguagaggggaugucacuaaacauccuacaacacacaggagaacccuccacaaagaauugucuggcccaauacgucaauauugcugagguugagaaaccaugguuuaaauaaaacuccaaucuggaggaugagucuuugacugucuuuuuccuuuuucuauguaucggucuccagauuuuccacuucuucaguuuuaguaacuguagauucuaaaaaaaaaaaaaaaaaggaucgcuucauguauacuucuaagcuguugcaucauauucacauguggcuauaugccguuuucacuucaaaaguuuucuuuaucuugauuacuuaucagaggcuuggcuguuuuauuagucuugugaaagaauccucuuuuaguuuuauuuuuuaaaucuaguguuuucuuuuucauuuuuugcuuaugucuuaauuauuuccccuuuuuauuuugcuuuuucuaguuuaguggauuaauguaauuuaaauugcuuuuuaaacaaacauguaaggguauacauuuucuuugggugcuguuugaguuuauugcacaaguuuuaaaaucuguuuucuaaguaaguuuauuccaucauuuguucacauugccauacuauuaaaacuuuuuauugugagagaugacauguauuaaaaauauguaaaacauaagcuuaguguaacucauaauuagagugaauacuugggagccaacaccuagccagcacccaggugaagagaaggaacauugcucgcacuacagaaaccuucugcaggcuucuuccugaucacuguuccucugugcacucaucuuuccuuacauuucucuaguguuaccacuuauguaugcauccuugaacaauacaguguaguguugccuauugcugaacuuuugaaaaucauacuguauguauuuuuucguaccuuuguugugcuuaacauugugugugaaauuuguuccuauuguguguagcuauaguucuuuugcauugcuguauuuauuccauuguuugaauacacccuaccauuuauccccuugacuggauacagacauguggguuguuuccaguguuaggaacagcgaaugcugcugugaucauucuugcuuguauuucaugguaccccugugccagcauuucucuggggcacauacuuaggggcaugaggaucaauuucuucuuuuacucaagaguuaucuaggaaaaaaaaaacuuuuuaaaaagcauuuucagauggcuuuucaguuauuuuuagugcaucaauauggucagagaauauggccugugaccuuucagcugcauuaucaguaaucguuuagacuucacuauugguguuacugcugucuuugcuucuuauugcugcuccuuguauuauguguccugcucccugccccucaaguauaucccugaauaauaucugguuguuuuuuuuuuuuuuaaccuagaaaggguuuaaagggaugugcauggagagugucccuugaauacuugcugucuguuauuuguucaacaaauaucugacucuguauaaaguauuccacauugguguggagaaucuggaggugaacguacacagauaaugcuuccugucuugauggagcuagauauagaauucuaaguucauaauugagucuauucccaguucuuuacgcuuuuaucuucugauauuuguuacaaaugaaaagucugaugccuaucucauucuuaauucuuucuguguauuuuauuuuuucuuucugguaguugguaugauuuucucuguaacuguaaaguguggggguuuuacuuuucaguuuuacuuuuuuuuuuugaaacagggucuugcucucuugcccaggcuagagugcaguggugugaucacagcucacugcagccucuaccuuccugggcauaagcaguccucccaccucagccucuugaguagcugggacuacaggugugcacugccaccgugcauggcuacuuuuuaaaauuuuuuuguagagauguguuuucaccauguugcccaagcuggucucaaacuucugggcucaagugauccuccugccuuggccucccaaaguguuacaggcaugagccaccguguccggccuucaguauuccuauggggcuuucagagccacuuaauauucuaaagucuuucuuuagcucagcagcacuugucucuuuuguuucuuuuuauuccccuucauccucuggaugaauguuagaucucuauaucuucaaugucccuuaacuguucucuuacuuacaucucuucuguuuucucccccaucuccuuuuuuucucuguucuaaggaaaugucacuguuuguuuuucuuaaucauaaauaccuuguugggucaaguccauaguacucuggcccuucuacaagugguuuuuuggggguggaggggaucuuauuuuuacuuucuagaauugugcuugcauaguaaucuguuuuuuauuuuguggaugcaguaucuucccaauuacugcuaaagaucccaauuagguuuuaaaauucuauuuauuuccuucauuaguaaugcuucagaucaauugugcuuacuugacuuggcacuuucagauugcuaauuuucuucagcucucuggugauaccugguuaucuccucauuuauagaugagauauacccuugaucaguauccauuguugaccugagugucuucagaauugucacucuuuucuacuguggccucccccuccugguuugcagaccugugcucuuccuauggcaugaggauggggaggugcuggcuggugagcuuuccagcuccugagcuaaaaggaagagguggagucuaagauuuugcugcugcauugaguuauacuaaaaacacucucugucuuuucugucugguuuugacacucauagaggccaucaagauaggguuccuauauaggagagugauccuuaccaacuguagaugggacaaguacaguaaagaaugucugauucuucugaaaaaaaguggucccugcauuauuuggauugagucugugacuuucucaagcccagcagucugauuccaucuccuuuguaucuuccagcauguccuuauaguuuuaguucacuaaggguauucuccuuguauuuguuuuucugcuacugcggcagaccuacucuuuuuuuauaaaauucugucauuucagugggguuuugaaaagaggaccaggccacaucuugaaaugaaaucaucuuaggguuucccacgauuaacucacuuuuuguuuugauuaaauuacuuccccuuuuugaggugaugggggcucaguuuucucauuuuaaaaugagggauaguaacugggcugauggugacagacccagaugcaugugagaaucaccucagagagcuuuugaaaaacagauucucuggguaggcuuugaaauuggcauuucgaaaaugcucuuucaaucguugaugcaaccaaacucuuugggaguuuuaggcuagguauauagucuuuagauacccagaauaguuugauuuggaauauaacaauuuagggaaaugaaaaaagggagaauuacauuuuggaagcugcuugcuuccauuuuccauuaguuuuuagaagacaaugugucuaaagagaugcagauuuaaaggaaauacaaguuaauucugcauggguauguuuacauggaauucuccagcugacuaauccagaagaguucuaauacccucugugaucauggguuuguuuuucuugagaauuauuccaucagagugucuaauaacagaugcuuagauacugccgagaccuuuguuggucuuacuugaucucuggauccugguuucgugaucuuuuacauauucuguguucuaaccugaacuggccuucaugguuaaagaugcauguauaaacaguguccuggcgagggcuuaccuuuugaacuuugucaaaaauggauaugaaaguccuuccuaaaaccccaucaaauucauuucugaacuugauaaauuguaaauuguguaaauugguuaaguugugucuuguagggaaguauuuuguuguaaaauguuuuuaaaaagaaaauuugcuuuuuagugaggugguaaucauuucauaauucuuaguuuugugaaaugucuauuaucaauaacacaucugacuguucaaaauguaaggcaauugaauuuauguaaaugauucaggcuuuccaaaguuaaaaagggagcuauuuuaaggaaucgguaguuugggagauuuuauuuuaaauaagccauugaucuuaugcauauagccauauaaguaaaauguuuucuuauuuuaaauuagauuauguuuuaacauuuuuuucuguuuugcuuuauauuugauugcuuuucuuuguuccuaaggcagccauuaaguugaauuguucaaaauuguuucauuuuuaaaagcugauaacuuauuuguuagucaaagcuggauuuaaagauaaacauuuuaauuuuaauaaacugucugguagugggacuccagugacagauguuugagaguuuguggcaccagucuucuaauguacucagccugugcauauuuguucuguauagcccuggcagauucuuucucuguuucagaaugggacaacagaagaagugacuucagaagaagaggaagaagaagaagagauggcugaaguagguauuuuauauaaaagaagaguucauaaauuucuucauuuuugaacauuugaguaauucucaaaucuuuuuuauagacuacuauuaauguggaauaauugaaagcacauuguguuuggaauggaauauaauuucccaacucuggcuuuaccucuaacuaaugauaugccuuugagcaaauuuaucugaauucuuuggauuugauuuccuggaaaacaaaagcuuuuaacauuuagcaccaaaauuauauuuauguuuaauacuaaucaguacuuaaucuguauuugguuauuuuuaggaagaggaacuacuaaguuuaaaaaauuuuauguuugcauaaaaggagaauuugagaacauuuuagggacuacucgccagaaguagugaaacugucucuuguugaaaaaucaucaaagaauuuugucuuaaucugguuuacacuauuuuaacagaauacuggagacuggguaauuuauaaagaacagacauuuauuuucucacuguucugaaggcugggaaguccaagaucaagauaccaacauugggugucugaggaccuucuuguugcauccucacaugguagaaggcagaagggcaggagagcaagcuaguccauugugugaagccucauuuguaagggccuuaaucccauuaaggaggaaggagcccucuuggcuuaaucaccucuuaaagguccuaccucuuaauagcaucacauuggcaacaccugcauuuuggagggagcacauuuaaaucauagcaaauuuaguagagugcauuccaaagacauugagcuuaggccaguugucagucauggauauaauuuuagauguuuucaagcucugaagcucugcauuuaaauucaaacuucagaacaaagaucuuuguuucugcguugaccaaauagaggauaugugaauuccauggucuugauuuaaaaaaaaauuuuuuuuucuguuuugggucuuauaauuaugcuuuuauuuucuugauuuggaaauuuuuaaucuaaaaugugcuuuuagaaugcuucagaacuaaagaagcaguguuguaggcuuguuuuguuuuuuugagacagggucucacuguggugcaggcuggagugcaguagugugaucacggcucacugcaaccucaaacuccuggacucaagcaauccucacaccucagccuucugaguagcugggacuacaggcgugugccccaugccaagcuuuuuaaaaaaauuuuuguagagauugggucuugcuguuuuguccagguucaucucgugaacuccugaccucaagugauccaccacuggccucccaaagugcugggauuauagacauauagacaugcgccacugugccuggcuguaggcuuguuuuaugagucugggaguaaaauacucuuaaaacugucaaguuagaaugagaguuuaauguuuuuaugcaguuuagcuuagguggaauaaacugcaugaaaacauuaaaccuuuuuugugcgcccaguuuaccaugaagcagccauuguacuaaaguucaugaacuuuuucuuuuuccccucauaagauaauaaacaaggggccgcaacauggagggaaaccuagaaagguagacuggacuuuggagaugucagauuaggacaaguggaaagaagauauucuaggcuccuaaaauaauaugggaacaggcucagaacaaccuuggacauaguguguuugaguucauuggauacuuuucuuuugaggaggguugauggguggaagucaugaaaaaacaagauuggcuagaaaaggcagaugguuaaaagucuugaauucgagacagguguguuucuauuuggugugauuauuugaagggguggguugccccuccacaccuguggguguuucucguuagguggaacgagagacuuggaaaagaaaaagacacagagacaaaguauagagaaagaaauaaggggacccaggaaaccagcguucagcauauggaggaucccgccagccucugaguucccuuaguauuuauugaucauuuguagguguuucuccgagagggggaugugucagggucacaagacaauaguggggagagggucagcagacaaacacgugaacaaaggucuuugcaucauagacaagguaaagaaucaagugcugugcuuuuagauaugcaugcacauaaacaucucaaugcuuuacaaagcaguauugcugcccgcaugucccaccuccagcccuaaggcgguuuuucccuaucucaguagauggaacguacaaucggguuuuauaccgagacauuccauugcccagggacgggcaggaggcagaugccuuccucuugucucaacugcaagaggcaugccuuccucuuauacuaaucuuccucagcacagacccuuuacgggugucaggcugggggacggucaggucuuucccuucccacgaggccauauuucagacuaucacauggggagauaccuuagacaauaccuggcuuuccuaggcagaggucccugcggccuuccgcaguguuugugucccuggguacuugagauuaggaaguggugaugacucuuaaggagcaugcugccuucaagcauuuguuuaacaaagcacaucuugcacagcccuuaauccauuuaacccugaguuugacacagcacauguuucagagagcaugggguuggggguaaggucaaagauuaacagaaucucaaggcagaagaauuuuucuuaguacagaacaaaauggagucuccuaugucuacuucuuucuacacagacacaguaacaggcugaucugucuugcuuuuccccauaauuauugauaggaaggccuuaagcagggaauagugugcugaggauauuguuugagaaagauaauguugaauucuguuugggaugugcugauuaauacucagaaaaagaaauuucguggaugggaacaugacugagguugaagguauaggaggaaauacaggcuaaaggcauuugugagaauugugaggaaaacauguaggauggaagaucagggcugaaaggugcacacagggagaagggagcucaaugaaguauggagucaugggcagaguuugagugagaacagaacguuauagggcuugaagagauggcauuccaaaaaggaggccggggaggugaaggcugcagugagccgagaucuugucacuguacuccagccggggcaacggagcgagacuccaucucaaaaaauaaaaaaauaaacccaaaaaggaggccuauugaauggauagaagguagugauuaaccuggucuagaaaucagugaauuagccugcuuggggaaaaaaaaaaagccgagaugcguauaaacuacuccuuuagagauuuuggcaauugaaguagagaaauaagguaauugcaaaaaguuaggauuuaaauucugcauagauuuauauauguguaagaacagauaguacgggaaagaagggagcagaaugaugugaauaaagauauuggucuagggguauucaaauucuuuguuuucuuuuccuuuuuuuuuuuuuuuuuuuuugagauagagucuugcucugucacccaggcuggaguacaguagcaugaucauagcucacugcagccucaaacuccugggcccacaugaucuuccuaucucagccuccugaggaccugagauaaaauucuuuuucuaacuuuuuuucuaguuauaaacgucaauagaugcuuacuacauaaaacuuggaaauuaggggaaagcauuaaaugccuccagagauaacuaagauuaacugaaauuaacauuucaauguaaguucuucuggucuuucuuuuucugugcuuauuucagcguaacugaaauucuuucuauucuuuuuuguauuguuuuucauuuuaaaguuuuucguuacaggagaaauuaggcuauguuaguauuucaguggccucuuaauauuuugcuauuuugcacaugcagauuuuguguuuauuuuuguggcugcaagguugaaauagguauccuuaugccuaaauuaguguuuauaguuuaaacuaguuucuuagaauacaauucuagaaguugaguuucuggaacaaacuaggaacacuuaagguucuugacaccugcugcuaaacuguuuuaaagguuccucuuaauaggagauuuagaagauggcuuauuugguaauaguuaugauuuuguaaagcuuuuaaaucugcuuuacccagagucuagauuuuaaauaaaauauaggauauaaaaggugggagccucuugaauggaaugugggggcuuuuucucucucccuauaggauaguuacauuuuguuucuuguuccucauuugagucaagaauaauuuaauguuauuuuggcauaagaaacugcugaagaaaaauagguugaauaagcuaacauuuuucgucucuuuguaggauauagaagacuuagaucacuaugagaugaaggaagaagagccuauuagugggaaaaagucagaggaugaaggaauugaaaaagaaaauuuggcaauauuagagaaaauuaggaagacucaaaggcaagaccauuuaaauguaaguguguguagauaucuagaaccuggacuuuugugguuaaauaauuguaguuaauaccaggcaauucauuaacaugcccaucucagcugcccucuuccuccauuucugccuuagugguggauucagucauguguguuuuaaaacagggucuugcucugucgccuaggcuagagugcaguggcacaaucauaguucaguguaguagccuugaucucucaggcuccaguaauccugcugccucagccucccaaguagcuuggacuauaggcacaugccaccaugccaggcuaguuuuuuuuauuuuuaguagagaugaggacucucuguugcccaggcuggucuugaacaccugaguucaagucauccucccaucuuggccuccgaaacuacugggauuacaggcaugagccaccgugccuagccuuagucauauguuuuguugcuguagauuacguuucuuaucuauagauagccacuuuuuacccuguucaucugcucuucauauccuggaaccaccugcugaucccuguauuugccccuucccggccuguuuaugcuguuuucucugcuuaccuuccucucaugggaucuguauauucaaauucauccucuccgacaaaauacaauucaaguucuuucuccuucgugaagcugacuuuggucuguccugcucugacccaaccaaaaguaauuuuucucuuuugacuuaacauccuuuuuuuuuuuuuuuuggaugaaguuacgcucugucucccgggcuggagugugguggcaugaucucagcucacugcagcuuccaccucccagguucaagcaguucuccugccucacccuccugugcagcugggauuauagguguacaccaccacaccuggcuaauuuuuguauuuuuaguagagacaggguuucaccauguuggccaggcuggucuugaacucccgacuucaagugauccaccugccuuggccucccgaagugcugggauuacaggugugagccacuguguccggccacaacuuaauaucucuuuuacgugaagcagcaggaugugaaaagaacacugagucuggugacaaacacacaauuuaugguuucacuuuccucagcucuaaaauauggcuagacaguacauaccuuuuggaugauugcuaucaaaaauaaaugaaaaugauguguguauauauauaaaaugcucagaguagggaaacaucaaaugauugucugaacacuuacuacuuuuugccuuguguuagagcuauugaccaacuccgugaaaucugaguagcaguuacuuugucuugggcacagguuccccaaaacagggaaugaauuguuagguaaguagaugccaaauguugaaaacagguagauuacucucccuccuucagucuaauuuauauauuaaucuaauuuauaauuuuuaguagagcaaagaaauuuagucaagcccccauaucuugauuacuuaaaaaacaaaguuugucauuugaauuaaugaugacuguacuuuaugucuugugaucgauuccaguuugaguuauagucaaaacaacuauaaguuacugaacacuuuugcaugauggauacuaugccaaguacuuuauacuucacauaucuucacauuuagucuucauagccaccgugugaaauagguaugcuucauauuuuagagauaggaaaaacuucucauauuuuguagauaugaaaugagcuaggaaacuugauuuuuccccccuucaaaguauagugcaauguuuaaaaucuuuaauuucacgugaccaaaaaauaguuccguuuguauuuagucuuaugauaagauauugauguguuuucaucuuuagagaugucccugcacugaaaaacugaaaccagucgcauguaggcagauguuucucagugucuuaaugugcgaacuagaccaucuguguaauauucuuguuuguagucuuaugaauggaacucuauuuuaguaaauaaugugucaccuugagugucuucuaguauuuucaaaaauugcugggguuuggaauagacucauacugaauucuuuguuauuguggaauccaugguggucuggacauguuggcuagacuuuuucacaugagaagaaauaggaaaugaacuagacuugugccuaguuuuaauauccucuugaaacuucauaaugcuucauuuaauugggcuuuuuuuuacuucuuaaaauguugagguugggcacaguggcucaugccuguaaucccagcacuuugggaggccgaggcaggcagaccacgaggucaagagauugagaccauccuggccaacauggugaaaucccgucucuaccaaaaaaaaaaauacaaaauuuagcugggcgugguggugcgcaccuguagucucagcuacuugggaggcugaggcaggagaaucucuugagcagggaggcggagguugcagugaacugagauugcgccacugcacuccagccuggguaacagggcuagacuccaucuccaaaaaaaaaaaaaaaaaauguugaguggugauccauuuuugcuguaaucuuuuagaucagguugaaauaucuuaaaucuuagcucagcagacccugguaaacaguggcuuuuguguuucagggugcagugucugggucagugcaagcuucagauagacuuaugaaagagcucagggacauauacagaucacagaguuauaaaacagguaaggaucucuggaucccugcucucuuuaugauucuucugcucuuuucuauugucagauuauaaaugucauuucuuaaaacuggacagaaauggaaauguuuacuagcuuuauuucaggaaugugaaacucaaaugcaaucaaguuccaaaagauguaggaguaaaauaggaugaguuuacuugucuuuuggauuuuuaaaaaauguuuuuauagguccauuggaauuuuguccucuucuugauaaacagugaacucuuacaugauuuuuaucuucuggggaaagcaugagcgauauugcuuggaaaguaaauaagaguaaaacauuucauuuuacagagaauaauugccaaguugauuuuuaugauucccccccauuuuugaaagcaagauaaucagcuuuuauuguaaagauaguuauguuauuaccuuuaaaauauauaaguuuuuaaaguuuucauuuccuuguuugacgaguauucuuacucaauaugacuugaauguuauggaaccucucuaacuagagguaaaauucucauauuguuauggagauucuaauaguauuaaauaaugagccaaacuuuaauuugaaaagauagcauugguugggugcgguggcucacacuuauaaucccugcacuuugggaggccaagguggucagcucaccugaggucaagaguucaagaccagccuggccaacauggcgagcgaagccccaucucuacuaaaaauaaaaaauuagccgggugugguggcgcacgccuggugauccgagcuacucaguggucugaggcaggagaaucaccugaacccaggaggcagaggcuguagugagccaagauugcaccaccgcacuccagccugggcagcaagagugagacucugucaaaaaaaaaaaaaaaaaaaaaaaaggguuaugaccgauucaauucuagcauuaugaccgauucaggaauucuuagcgugagcaaaucaaaauuaauuagaauuugcuuaaagaauaaaaacaaggaaaaaauccuugcuuuguagugugcaggauaagccaaacuuguuucugaguuguuagaauuguggguguccuuacgguuuuuuguguaagaagucuaaaaguuuaucuguagaaaccuaauaaaguacaaacauuugaauacugguuuuauuuuuaaauguuaaauaaucauuuguuucagcauuguuuauauagaaaaaaaaaaacagauacuggguggaauuuguuaaagcauauccauaaaauaaacuaccacagagucauuaaaaagauugugaauagguuuauguauacuaacuuggaaagaugucccugaaaguugaagagagauuauaaaacaacauacguagaaggauuccaucuuuguagaaauguguguucauggaagaaaagucuuaaguacauaugauuuugcauaaucuuuuuuucagucagacuaaacgguaagcaguuuuucaacucauuaaagaaucuucucaguugauggcuguaauuaucuguuaagggcauaagauacucagcugcaguaguguaauauuuacuauauagcuuaguuguuccauguuuuaagagcaaaauuucuagcuuucguuggcuauuuaguguauacauuuauaccauaguaauaguuauaugaugaaaugaagaguagcuaacaugcucuauaucuuaacagggauuuauucaguggaacucauaaaugacaguuuauaugacuggcauguuaaacugcagaaguaaguggcuuuuuaaugcucacccacucuuugcaaugguagacuaucacaguggagguuauuuuccuucuaacuugauaccuuuauacuauggcuuuuacuuagaacuuuagacuuuguuucuauagaaauaguucuuagauuguuuaaaugagcuguugcugaggucuaauaagaaagugagaaagaggaaggacagaaagagggaccagcugcgggauaaaguguuuuauggaguuagagcaggggaacuuaaaaacaaaaguguauuuaauaacuucaugagacugugauaaccaguuuauauuugaaauauauacagcacuuugggagacugaggugagaggaucucuugagcccaggaguuugagaccagccugggcaacauagcaagacuucaucucuacaaaaaaaaaaaaauuagccaggcaugguggaguacaccuguagucccagcuacuggggguggugggaggcugaggcaggaagaucuugcacuccagacaucaaggcugcagugagucacgaucguaucacuauauuccagccugggcaacagaaugaggcacccggucucuuaaaaaaaaaaaaaaaaaaaaaaaaaaaguuggggggaggugggauucaaauuagaccuguauauauaggacaguuguagacaaauacagguuuuuuuagugauuuaaguuuucauaguucugaccauggcaaacuuuucuccuugaacccuuuggcuaauaauguaaguuuaauaugcuuuccuaaacuuuuuuugaguucuugagaaaauuauauucaugugacuauuuuccuuuagagugacugcaaacucugaacuccuuuacuagauuagauuuagaguauuauggucucuuuuggacauuuauucccaaggagcuggaaccuauggugaccucuauuuuuccuggugauacagagcagcuuuagaccuucucuuucuggaacuugcccuaggugcucuauuuuagcugucauacuaguucauuuuugaguuuaguuaaaaaaaaaaaucucuaacuuuuuauuugaacuguuuuuuguuuuguaauucuuaggguugacccugauaguccuuugcacagugaucuucagaucuuaaaagaaaaagaaggcauagaauauauuuugcuuaacuucucuuuuaagguaagaaaauaguuacaggaccccauauacuuccaguggggugcguauauuuguacaagugcuuuggaaaacaauuugguaaaguagaagauacucauacccuaugguucaggaaucucguagacauauucuccguuaagacgugaguacuuaggcguaccaggagacacaggaauguucagagcagcaucguuuauaauagcaccaaauagaaaacccaaguguucauuccaauaaaauggagaauugugguguuuauaaagugguuuacagcuaugugggacaagauggguggaucuugaacacaguuguaaaagagacuggacuccaaaaccuauuuuguacaauucccuuuauauacaguucaaaaauagguaaaacuaauguugauuagggcaugcauucuuaguggaggcaauaucaccugcaguguagugaaaacugaucuuuagagugaaaacaaucuuagcuauuaaaauggucugcugcccuccaaagggccacagaacauaaacagauauacgauuuaucuaugguguuaaaauuccauggagcagggggguaaaacuaggaagaaaacuucuaaaaaggcuucuuaggggggcaaaaaugaaaagaaaacugagaaacacuuauuuauggauucauacgugagcaguaaaacugcccaaagaggaaaacuguccaagaacaaagaggugauuacauacagguuaggguaaggaguccaucuaggugggagguagggaggugugaacugaaagguauaucugcgcaggcuucuuggauacuggcuggaauauauuucugggccagguugaugguuacaugagcacauaauuuacaauagcuucuuaagguauaucucuauauuuuauguacuuuucugaauuuauguguuauauuuaauaagguuuuuuuuuguuuguuuguuuguuuuuugagacagagucuugcucuguugcccaggcuggaguucaguggcacaguuuuggcucacugcaaccucugccuccuagguucaagugauucuccugccucagccuccugaguagcugggauuacaggugcaugucaccaugcccggcuaauuuuuuuauuuuuaguagagacgggguuucaccauguuugccagguuggucuugaauuccuaaccucaggugaucugccugccucggccucccaaagugcugggauuauaggugugagccaccacaccuggccuaauaaguauuuuaaagaugcuaaaaauaaugguuaaagaauagcaauggaaucuagaaaaaauguuaaugauuuuuuuuuuuuuuugagacagaaucuugcucuguugcccaggcuggagugcaguggcccaggcuggcgugugguggcacaaucuuggcucacugcaaccucugccucccggguuuaagcaguucucugccccagccccccgaguagcugggauuauaggcaugugccacuauguccgcauaauuuuuguauuuuuaguagagaugggguuucaccaucuuggccaggcugguuuugaacuccugaccucaugguacacuucccuuggccuuccaaagugcugggauuacaggcgugauuuaauauggaucuggaugagauguaaugguuuaaaaucuguggauauaugagauauuuugauggaaaaagcaauacuuccuuuguacuuacaaaaaagguaguaauuuucuaaaagcuucuuacguagcuuuuuuauguguguguuuuugcuuggggauauaucuuaugauugaacuuucuugaagugacccaaaugucaguauuaucucucacuuuuguuauuauagaaacuguugugguugucaacuggguugucuuccuaaaauaugagucugguauauauugacugaaguugcuaauggcuacauuuuuacuaauucauaugggggaacgaauaaagcacccaggccaaaaacaaaaaacaaaacacacaaaaaaggaagguaucuuucuuuuuaaaaaauugaauuauauguccuuaugccuaacaccaaacuuaagaaauagaaccuuuuuuuuuuuuauccgucccuguggcccccugugugccccucccuugucacuuccucuuugagagguaucuuuacgggaauaugaaauauuggccaggaaacuggaggauuugugacuauagguaguguuuucauuauuuuuuccugcucuagguagaacuucagggaggggacgaucugggagguaaauggcugaauuucuguuggauuuguguuucuggaccauggcuccugauaccacaaagaagggccuuuucugggguuggaguauuucuugagaggccuaggaagaaugugauugccuugagcuaacugaccuuaugaagaggaccuuaaacugaauugccaaguuauuaguaucgggauucacagacuuuggaggauagcagguaugacucagaaagauuugcaggaaagagccagaacaguauauauuuauggccucugauguccacggugacaacuugaauaauaagaaaaauggaacuugagauaaagcauaacacaaagaugggaguuggggcaggagggaaugugaccuuguugguaaauccaacuugcuauauuuuuaaggaagucacuuuuugguguuucgggcagcaucugaauuacugaauugaauucugagguaguacuuuaagaagggucuauuuagauaaacuuagguucauuuagagaauaauagccaggauugggaagagauugauuguauuccguguccuaggauagcuggugaaauuguggauuuggagaggagaacaugaggguugauguuaucuugucuucagcuauuugaaggacuguguauauggaagcauuaguuuuuauuugcuuuuggugaaugcagggcaugaaacuaguaagucaaauuacaaagaggugauuuucaacucaaugugaggaagcgauuuguaacuauuuagagccauuuggugauguagucuuuaaaauguuccucuuccuuaauaacuuagauggcuaagauguuaagaucucagauaacuuucugagauccuuuauagagucugagagucuguuucugaguuaauauguacuaagguaacugaaacuucauuuuaacagucauccucaaccuuuuuuuccucccugaggaacuuuuuauuucuguaaaaucuggauuccugaguuccaggguauagacuuuauggaauagagcccgcagauuuugauguagaagaguuauucugaacuguuuaaaaugaauuaaaucauacauaaugaagagguuuuguagucacucauuagggauucacauguuuaaagaucuaaauaauaggagguuaaaugaaauuguacuuuaccaagcuuacaucaaccucuauaccuuucauuaugucuguuaaauauagaugaaaggugagcuacuuuauuugaaaguagauuauaauaacuguuguuaaguugguaucuugugucauuaaguugguaucuuguggauaaucuuacauuucuauugcaaguuagaaaaugcaaaucaaaauuaauuagaauuugcuuaaaaaaugagaugauuaaagcuggcugucauucccugucagggcaauuugcaguuuguucuucagggucccaaccuaaggagccggagacuuagcagggccuguccucgguggacgcugagcuccaguauuuaucucccugugagcucugugagucugugaguucuagcucagcuugugaaccucuucuuuuucucuucuguaauuggaagaaaaccuaagggggaaaaaaagauccugcucucugguguucccuuuucuuagccuugaaauuauuauguuuuguucaccuuucuaguucucagucagaagauuuaucuaaguuaccuagucuaucauuauuggaaugguuccuuuauauaguucuagugaaguggaaccccuucauguguuucaucaguuuaccauaaugcuguucuguuugggccugauuuuaacuucauuuuuauuugcuuugguuuucauuuugguuuuggguacuaauuuuaugacucuuacccauuaucugauaauaaauguacacauucuuuauaguaucuuuuaaaaucuucuaaauaguauaacacuaaggauguucuuuaaauuaauuaaacuugcuuauuugcuuuuuaggauaacuuuccauuugauccuccauuuguucgagugguguuaccuguucucucaggaggguaaguuuaagugacuacuuaaaaagaaauuuuuuucaguuaaaaaaaauuuuuuuuuauagggacgagaucucacuauguugcccuggcuggucuugaauuccugggcucaagugauccucccaccuuggccucccaaagugcugggauuacaggcaugaggccacugugccuggccugcauuuuuuuuuuuucuucuaaauauagugugcaccagaaacauuuggagagcuagucccaggguuucugauucaguaggucugugguggggccugaguauuuacauuuuuaagaaguuuccaggugaaguugaugcuguuguucuggggcccacaccuagaaccauuaguuguaaagcauuauguuguugauagguaaaguuuuuaaugauucauacacacauguauuuauacauacacacacacacacacacacacacacguauauauacgcacauacuuuuuaccauaaaaaagcuaauguuuucaaauguaaauugugauugaggguuuagagaauguuacgauuagagaaugguccccacaugccugugauccuaauugguacuuuuagggauaaucaugggaaaaucucauggaccuauggaacuggcuaauuacuccuagagguaauacuugcaguuuauuagggucaaaugguaauuguauugcuucuuuuuaugguuggaagucuuacagaagguggggaaaagaucacaauuuguuagguuaguuaugaaauguucaguaggcccucaaaguaugagcaguuuaacuugagaauguuccaacacucgggugacuaauucuauuaugugacauaaucuacauuauggugguuaaaaucuaaauauauccagccuuuccuuugaucauuucuaugguugagauaguaauaguugcauuuaggguaaaaauaugagugacugcuucagacuucagaacuuucuccagaagagcuuuguuccuacaguuauuuuuaguuauauuugcuuuacaugcuuauauauguguuuugggggcuaaaauccuguuaagaaucauuucuguguagucagaauacauacuaacuuugguguugauacuacagaauaguuauuugggcaugguguccaucuguaaagcucagagaaacaaaaaguguguguuuguuuguuuuuuuaaccuuucguauuacauauggauaugcugagcucauuuugaguucugccacaugguaaagcaauauaauuuauuuuuacuuauuuauuuauugagauagguucucgcuuuguugcucaggcuggagugcaguggugcugucauggcucacugcaaucucugccuccugggcucaagauaucuucccaccucagccuccugaguagcugggaugccaccaugcccagcuaauuuuuguauuuuugguagagaugguguuuugccauauugcucaggcuggucuugaacuccugggcugaagccaucuuacccgccucagccuugcaaaguacugggauuacaagucuaagccacugugccuggcccaauauuguuuuucaaaauuauuuuauuauuuuuuguccuuuuuuguuuuuaaauauuucuuaauuuuauuuuuuucaguauuguuucuuaagaguuuacuuaccugacaccugcaaccuaaucuuugccauagcucucaaaauguucuguaagcacuaauaguagugggguuuuuuuuuauuuguuuuuugagacggggucucacugucaccaggcugaaaugcaguggcgugaucucagcucacugcaaccucugccuuccuggguucaaacaauucuccugccuuagccucccgaguaaggacuacaggcgugcgccaccauguccagcuaauuuuuguguuuuuaguggagaugggguuucaccauguuggccaggauggucucuaucucuugaccucgugauccgccugccucagccucccaaagugcugggauuacacgcaugagcuaccgcaccccaccuagugguuuguuaauagauguuuguuuugaggggacugcaagguuuugggaaaccagguucagaauaucuuuuaccaaaggacuucuuggaggcuuaaugcuguuuucuauuuuucccaaauuuguuuaauaauuuacacgauagcaucucagaggacgguguccucuggcuuacucucugggaaaggcuguucuuuuggaaaucuggaguucugagugauucccauguguuuucugcugcagagcaggaaaugcugaaggauuccuucgugagcagauguuagagguuuccuuuugacaggugguuacaaaguugaucacaaauauacuaucacagugaguggaaaucccagguugggugugaaauaguuguuuagaauuguguacaguuuucuuuuguuaccuuuaaagcuuccguagacuguuuuuggaucaggcaguaaaauugcuauaaaaaguacuucuuuugucauaaaaccucaugaucaguuuuggaaguggaauguuagguaacccagccaaauauuuacauauacaaaauaaacacaagacugaaaaauaguaaauuuuuaaccuuucucuugcugacaccaccagucuuuuacuagccaccaagucauaguucuuacguuuuucauaguuuaauguuaaaauaucuuuaacgaagccuuuacugauuggggagaaaugacauaacuauuguguuuuaguuuuuuuuuuuugagacagagucucacucuguugcccaggcuggagugcaguggcgcaaucuuggcucacugcaaccuaugccucccggguucaagccauucuccugccucagccuccugaguagcugggacuauaggcaugcgccaccaugcccagcuaauuuuuguauuuuuaguagagacaggguuucaccauguuggccaggcuggucucaaacuccuggccugaagugauccacccaccugggccucccaaagugcuaggauuauggcaugagccacugccuggccaacuauugugcuuuaguuuuaugugcuuguuuauaaaauugugauguuuacucaguauucccauaagcaugggaaaaggaagacaggucauuuuuuguucaaaaucuuauuugagagaaaaaaaagaucaaggaaaagauuuggaagaaauuugcaaauucagaauaaauauauaaaaacauuuuuaucagccagaugugguugcucacgccuguaaucccagcacuuucggaggccaaggcagguggaucaucugagucaggaguuugagaccagccuggccaacauggcaaaaccccgucucuacuaaaaauacaaaaauuagcugggcgugguggugggugccuguaaucccagcucaucgggaagcugaggcaggagaaucgcuugaacccaggagguggagguugcaguccagccugggcaauagggcgagaguccgucucaaauuuuuuuuuuuuuuaaucagaacauuuuaaaaugugauuauaaaauuggccaguauagcuuuucaacauuuuauuguaagaauucuaagaauuuaaguucaugaccuuaguuuaccaccuagaauagagacaaauauuuuaugcauaaugccauuuucaguuuuaaaaucuguuacguaguuucuuaauugauucuuuuuugccacaguguuauuguucucauuauucaaaugaguaauuugaauaagucagcuugugaccuacucaaauaaaucuucugauuccuaauaaagugucuuucauuauaccaaagccagcuauauaagaggggauuaaaaguacuaaguacuccauugauuaucaaaugcuaaccauggacuuaauuuaucagagguuuaaagcagcaaagaguugcuguggcaauagugaccugaagacuucaugaaguaggugagaucccagcugggcagugaaaugugagugucggguuuggucagcugguggagguugaaggaaaaugauuuacauaggugaaaaguaaacacaaucaguuaucuaggaaagagaaugagauacucagaguauaccagaccaguuugagcuauaacacaaggaggguaggacucauguagaagaguuuuaggaaauagugcugauguaauaucuuguacuuaaacaggucuguggacuggccacagaucuuuuuuuuuuuuuuucccccucugcuaaguagacuaucacccuggcuauucaucuuucuguauaacugguugaggaacaggggagugacaguaaagaaacuauuguaaaguaaaucuggugacagcagaagagaauaugagacacauugugcucacagagccuagaagagugugacaguaguugagggccacgcuguugucuuagagugaagugaggagaaccuacauugguuugguagucaugggaguggaaggaggaaugaaaugugaaagcucauuggaggcaaaaucaaaauggcuugcucuucauagucaacuauuaagugaggaggaggaauuauuugcugacuugggaagaaguaaaagcuugccaucucaaucaggguaaagcuuaagcauugugugauucuagauagauuauugagcaguuuuguucuauguauuucauaucccauaucuucuaguuaugacccuacuucuuuauuucuugacauagccaaacauuuuuuaaauuaacagcuuuauugugauacaguuuauauaugauaaaacgcuucgaaguguacaauuuggugguuguuaguauauucacagaguugugcagucauuacuacuaccuaauuucagaacauuuucaugacuucaaaaagaaaccccguacugauuagcagucacucccuguacccguuucccccaccauugauccuggcaaccucucaucuaauuuuuaucucuguagauuugccuaucuuggacauuucauauaaauagaaucauauaaaauguggcuuuuugugacugguguuuuuuacagugauuuuuaaaucaaauaucugaagaggcuaagcuuaggauaguguuugcuguacaacuuuggcaacugaacuuuuuuaaaguugaaaauacaguauuacuguguccauauauauggcauguuauccuuagaugacccuuacuuagaucauuaauguuuuuuuccuuaguauucuugaacugucucaguauucagcaggaacccuuuggaggcaaagagcaguaagaauuuggaacacuuguugacaaaaugaauguaauuuaauacagaaguagaaucggccacuuuuaggugucgaugcugcugaaaguguauauuaaggaaaaguuuaguuaucuuacuuuuuguauagguacuagaacuacuugucuuguguucaacaaacauuuguguaguuauuacguacuuguacaaaugcacuuuuugaccugaaaauccaaaaacucccuuucuuccccccaccucuuaagacucugcauccucaaaggaagagugggguaccuuaaaggaaaggugguugugacuggauaacagguaaaaugucuacuguagacuuccuuuucccgaaacaaguuccugucuaccaucagcauuuccaaaauuugaagauuguguuugauguuaacucaucaaccgauuauuaagcuuucagcaauuguggaaccaaaaucuaaaugaguaccuggaucuucuaauucuguuaaaucagugagugcacauuauauacaauacucuuuuagcccaguaggagaguuaaagaguggaagauagauuucuauguuucagaaauagaauacacaaaaaaaaauuuaaucccaugaaccuucgccugaauuuaaauuuuuggagaguuuuucuuuuagauuuucuuucacuuuuagauuaaucuuucacuuugaaaggucccaggguuugggcaaagcaaguggggagagacacuugcuuggauucuccaggaugggggagaugaaaaggacuucuuucccuuauuuuauuauuaaauauugucacuguaacaauuauuaauguuaguggucuacaguaaaaguuuuuagaugccuugucugcaaaguaauuugguuaguugacacaaagaugccuuugguuaacuggaauggaagaugugcaggcuagaguggucuuggcaagucuucuggggggaaauacagcauuuggaaggguaggaagcaguaggaaucucaagcaagggaaaggcaugggcagagccccggaggacagaacaauuugugguggacuugguguccacacagaccuaaucaguggucuuagcuuuuguguuuucaaaauuaccacaguuuuuguucuaaaacuaucauucccuugauuuuuuaaggcaugauauuuauguauuuugaaauuuaaaauaacauugaaggagaaaugaaauuuuguuugagaaagauaaagguuaaaaaucguuaucuaaguaaugauuuucuaaugggagauuugguacauccccagaaguuaucuuuuguucagagaauagucuucaggccuagaaagagcuuaagggagucccagagagaagcuccauggucagaaccauuugauucucacaacagaauggguaaaaacaauuugaaccauaaaaccauacagaucuucauagcauggauaggguaaggucagugucauugucaggggaaaaacucauggcuguaacaugguagagaaaguuucagauguaaagaacacgugaacgccauuuaaggaaacugauucuucugccccuauucuuuggaauauuuagggcuaaguucuuaauuacugauaucauacaaaucugaaaguauuauguucuaagaaccauuagaaaaaauugacuagaauuucagagggauuacauuagcaugauaacauuagaauuuuuaaauuacccauaguccuguaucccuaacaacuguugucauguuugcauguuauuuucucauccuuacuugugugcauauuuucuugguaauggcacuuagaaauuguuuaaggaggaauaauucucgagaauuuuguaugacuccuuuuuucuuuuuaagguauguauuggguggaggagcauuauguauggaacuucucacaaaacaggugacuuuucuuacgauacuccauuuucacccacaauuuaguguuuugaucauguaaauuagauuguaaguagaaaauucuuuaauagcuccuacucuuaaauuuuaguuuauuuuuaaaauagcgucuacuuucaagaaugaaaaagguaaaccaauaaaaugacauuguacuuggugcugaaucuaugcuaggauaggcauuaagagugaccuuuauuuaagguucuaauuugcucauguugggcacuuagaacauugguuuguuguuuuuuuuugugagauucuggaaauguuccaauuuuacuuuuuccccuugacuacagucuuuuuaacacugauuugcugcuguugaguuauauaccauuuuguuaggccuucccaagugggaaucagaaauacuacuguauuuuagagauacuuuguucuucuguagggcuggagcagugccuacucaauagaaucggucaucaugcaaauaaaugccaccuuagucaaaggcaaagccagagugcaguuuggagcaaauaagguacuucuguuaagaauuuuacauaaaccauaagauacauuuuauauuacuuuauaagcuuucuuccugucuugacuuaauucuuuuuugagauaguuucauuuucauuugguuuguuuucuucuuguuacaaaagugaucuauagaaaauauggaauuauaagaaaauuaaagauacuaauugauaaucacuuaaugauuucguaucuguuuuuagucuguuauauuugcuguagauaaacauuauaaguuuacaguuguaaacaaaaacuuauuuguaaacagauguuuacaguuguaaacuuauuauuaguauguauaguguaguaaauuaaaaauuauauguacuuugaaguuuuaaaaaauugaguucauguuauagaacuaauuccugguaagcuuuuaugugcuaggcucuagucuuuucauuuauuuuuacuuuuuuuuuucucugugccuaugcuuaccaaguuuuuuuuuuuuaaaucuuuuuauuaacucaauccucuuaauaacuuaaaaaauaggugcuauuauuaucugcauuuuguagaugagguaacugaagcauacagaaguuaguuagauaacuugucugaggugacaaguggcagaacaaggauuggaacuagacagucuggcugcccuaggcccaaccaagaggagcugagagcaagccaugggacauaaggauguuguucaggcugguuuucuuuucaguuaaccugaagcauaggcuguaauguuaauuuuaggacauuagugagacagccuuccaaagccggagguuuguuaccaugacuuuuagcaagaauuugugguuuaaaggcaagauggugcuuuaugaagcuuccauucacuauggagggaaugguaguugaguuaaauagugaaauccuggagcacacagucuuuagggcagcuucugaccuauuucuaugaucaggaaaggcaucugucuuucccugcugcccauaaccuccacuuauucucccacagaauccccuagacugugaucacauucagaagagagaucuguuuuguuuuuuccaggguaggaggaagugagucacuaccuauacuaagcagucuagucuucuguguauaaaugagcaaggguggggagccagaucucuuggagaaucucaggauugugcaagaugguaaaguggucucauguuaguuguauccacagcugucaucagaagcagacacagauacuuuuuguaggaaagcaucucuaauuuaagccuguaggauucccaaagauuaaaagaauucacucaaaucauagcauucaaauagucaacccaacauauuugagaauugucagaaauaauaaauaauagauauguuucccaaggacaguagguuuuggaauuaucagauacagaacacagacuucagauauuagaauugugagaaaauaguuauaugugaaaucuaauauaaagaaaaaaagauggaaucauaaaauugagcaagcagcaagaccaccaggaaugaugaagaagaccugaaaagaaaauggaugaaauagaacuuacagaaauuaaaaaauguagauggguaugguggcucacgccuguaaucucaacacuuugggaggccgaggcaggaggauggcuugagcccaggaguuggagaccagccuggggaacauggugagaacucgucuacacaaaaaauacgccccccacccuaaaaaaacaauuagcuggguaugggguaccugucuauagucucagcuacucaggaggcugaggugggaagaucacuugagcccaggagaccgaggcugcacugaggcauguuugcgcacuccagccuuggugacagugagacucugucucaaaauaaaaaauguaauuguugaaauaagaaacucaguagauuagacaccagaagagaauuaauugauuagaugauuaucucaaaaaaauaaguuagaauguuacacagagagacaugaggauagaugauagggcagaaguuggugggguugguggggagagaucagaaugaggucuaaaauaugucuuaguggaaucccaggaggagauauuagaauuacacuagaaagugagagaaauagaaguuguaaaggugauagaagcaagucuauauaaaucagucacaacaaauguaaauggacuaaaguuaccaguuagauugaauuaauaaaauccagcuguuuuaaucuauauauuuaaaauaugaagguacaaaaagguugaaaguuuuuauaaaggagagugauaaagauaugccaguauacauuaacuagaaacaaaugaugcagcuuuaguaucaaacaaaauaggauucuggaacagaaagcauuaguaacaauuugauaauaaguguuaauuaggaggauauagcaauuuuuguauuuuauguaccuaucagaauagccucaaaauacccaggaaaaacugauaaaaccacagggagaaguugacaaguccaccaucacaguuggagauuucaacauacccuguguacuacuaguaagauaaacagaaugcccauauguagauuugaacaaccagugaacaggcaugguauaauagacaaauauagaccucuguacccaauaauuagauauagaucguucucaagcauauauggacuaugggagaaaaauuaauuauagauccauaaaaucagacgauuuaaaaacaguugguaccauacauaccauauaauuuaaauaugaagcaauuaagguuagaaggcaauaaugaagagauuaacaaaaagcuaugugaauuuggaaauuaaacacacuuguaaaucauaguuuuaaaaaguaaaaugaaauuuuaaaaugcuuagaauugaaccauaauuaaaauuacuaaaauucuaucuauuccuuucuccccuccucucccucccucuuccugucuggaacauucaagaagcuaaucuuuuucaaugaacaacacuucaaauacugaaaaacagaaaaggacagugucauucucugaucuuaguuaaaucuauaaguuaauaauaaaaccagaaaacagauacuucuuucuggaauuguauaacucaugcaaacagccuuuaggucaaacagggauuugaaauuaaaacugcagaauaucuagagaauagcaauaaugcaaucauuacuuaucagagacuaaaggagagcucagaggaauguucauugccaaauccuugugccauuaagaaaagaaugaaaaugaaucaagccucugauuguuagaaaggacaauaaaaaaaaccugaaggaggccagggacaguggcuuacuccuauaauccuagcacuuugguaggcugagaugaguggauggccugagcucaggaguucgagaccaccuugggcaacauggugaaaccaaucucuguaaaaaaaacaaaacaaaacaaaacaugaaaauuagcugggcaucguggcaggcgccuguagucccaacuacucaggaggcugagguaggagaauuccuugaacccaggaggugaagguugcagugagcugagauccagccacugcacucuagucugagugacagagcaagacuccaucucuuaaaagaaccugaaggaaagcagaauggggaaauuauuaaagauauacaagcagaaaucagugaguuagaagaauaggaagggcuagacccccaguacaguaaagucucugcagaaacauuuguuuaaacugggcuuuugaguaccuugcuacugauaauugagacuggggaaggccaacauucuuauuuucuccuuguauucuggguggugggcaguaggguuggaaagugacugcuucacagucauuugggaguuucaggguauguauaguuuuuacguccaguuuguuucuuuuauuuuuguccuuuuugugaaaguacuaaaacaaaaacuuuuuugccuguaaucccagcacuuugggaggccgaggugggcggaucacaaggucaggagaucgagaccauccuggcuaacacggugaaacccugucucuacuaaaaauacaaaaaauuagcugggcgugguggcgggcgccuguagucccagcuacugggguggcugaagcaggagaauggcgugaacccgggaggcggagcuugcagugagccgagauugugccacugcacuccagccugggugacagagcgagacuccgucucaaaaaaaaaaauuuugagauggaguuuuguucuuguugcccaggcuggagugcaaugguacgaucucgggcucacugcaaacucugccuccuggguucaagcgauucuccugccucagccucccaaguagcugagauuacaggugugcuccaccacgccuggcuaauuugguauuuuuguagagacgggguuucuccguguuggucaggcuggucuugaacucccagccucaggugaucuaccugccucagccucuaaaaguacugggauuacaggugugagccaccgugccuggccggcuuuacuauuuuaaagagcucuuagauguugaaaaagacuacccuguagaaaaauaggaaaaguccuuacauaaauuuaacauguuaaaaaaaaauaggaaaaggggguauaaaaagucuguuuacagaaauagaaauaaauggcucaugaacauaauggagacaugcucagucucacucaauagaaauacaaaucaaaacuauacugggaguccaucuaguauauugucagaaaucuacaaauguuugaaguacugcauuggugaggcugcaucgaggcacucuuacagauggcuggugggcagacacauuugugcaguuauguagagggcaauuuagcaauaucucagaauuacacauauauaucuuuugacacagcagcucuacucuaggacauuuuuaccaguacucagcagauauacguacaagguugcucuuggcaacauuauaacagcaaaauauugagaaacccugauguccaccaauaggggacugauuaaauauuugaauauccauauaauagaaauauuucaguguuuaaaacagguauguucuauacugauaaggaacauucuccaagauaugcuagacaagaaaaggggcagaccagugucuguagcaugcaacuguuagugaaggaaagccagggacaguggcuaauaacagugggcuguacaugaauaaucuuaaagagggacauacaagaaauuaguaauagugguuaacuuguguggaggaagggggaugaacgggaggaaacuggguguucagggcaccaaguaggagggagaguuuucacuuaggauguagacauuuuugagucuugugcugugugaauuuauuaugcaaaaauuucugccacauaauauaguggauagauggguaccacuauggagagugcuccugguauauuaauucgaagcgaagauauagguugguuguacuuauggugacaaaauuaauccuagauuuggcuccuuaaaaagauuguauauuuuuaucaaaagagggcuccuuuaguaagcauggugacaauuaugggcauucuuuagauuucuaacuuaaaaugucauucauauguauaguuguggaagcuuaauauuuucuuaucugaaaguaauauuuuguaguuuuuuuaaaaauagaaauugugugaagacaguuugaguuuuauuaacauccagauauaauccuuuaacuugauucagcaauauggagacggacucuagaaccagaaagcuuuguacuuguccaaugguaggaagacuuauaaaaaugaacugugaggcuuguugaguuuuauugggguacaauuuugguuuuguuauuuuuauaaaauuguagagaauaaugaaacugagaaaugaggcuauuaaguuaaaauuguuuuugaaauggagauagucaguuucccauguucuuuuaagcacagugugaugcauucauaaauuuauuguaauaauuuucaccuaauuacacuuuugauuuaaaauguguaauucucuuucagaaucaauauaaucuagcaagagcccaacaauccuauaauuccauuguacagauacaugagaaaaaugguauguuuaauucaauaaguguuuauugccauuuaagaaguuuuagauaauguauuaauacuuaccauuuuauuuuucuguuuuugcuuuaguuucuuaaaaugcuguuaccauggugaaagaaacuugugcugcauacaaaaucuuuauuuauuuauuuauuuauuuuauuuuauuuuauuuuauuuguuuuuugagacggagucucgcucugucaccccagcuggagugcaguggcacuaucucagcucacugccagcuccgccucccagguucaugccauucuccugccucagccucccgaguagcugggacuacaggugccuuuuuuguauuuuuaguagagaccggguuucccuguguuagccaggauggucucgaucuccugacuuugugauccgcccgccucggccucccaaaguacugggauuacagguguaagccacugcaccacaaaaccuuaacauuguacuucagucaaaauuuuuguauccuauacacuuggccuagguaucucagagucagaaucaagauuucuuuuuuuuuuuuuuuaguagauuaaugaaugacucacuuuacuuacuugaaauauuaggaacugaguuaaaggcaacuccuuacagauggaguucuuguuguuauaacuggagugcagugguuguuuacaggcgugaucauaguggacugcagccucaaguuccugggcugaugugauccuccugccucagucuccucaguagcuuggacuguaggcacaagccaccaugccuguaaaguauucuuuacuuugcuagaaaugugucaguuugugacuuaagauuuguguuuugugcucauuuauuuuaaugacaaagcaaacuugucacucuuucagugauugcuuacuuauggaaauaguauucaaaacaaaauuuucaagcagaagagagaaacgauaaaauuugaggacaaggccagguuuucauaauaauaauuucuagcacacaaaauuagauccaaagaaaccuguguacuacuuugauacuuuauagaucuuggcauauucauacuauucuaaaguuucauacuaaacaguacuuagucuaauuugccuuuuuauagagagcuuagguuuuugcggaaccugggacacagauuucuucuuaucuuuguuuuuauuucuuaaccauuacaacuggcauucaaaaaauauuuauagaaaaugcuguauuugagaguguguggguauguguaagcuuagcugugaugaaagaguaauagagucagaagcaggggagaugacuucuaggguuuuguuuuuuuuuaaaucuuaaaauuuuuuuguuauuuuaaaaaaauagauauuauacuuacuguguacaaaguuuugaaguauacauaacuguggaaugacuaaaucuagcuaauuaaccuaggcaucaccuuacauaguuaucauuuuuauggugagacacuuuacauccacucuuaacauuuuucaagaauauaguauauuguuaacuauagucaccauguuguacaauagcucaagauggauucuaguuuggccugcuacuaacucugauuuuaggcauagucauuuagucauugcaccugcugcgauggcuuccuugucauugugaaaugacguuauggcuccgauaacaguccaaguuccuuguauucuaaaucgccaggauuuuguuuggggaaauaaguacuuuccaugaggcuuacuuucaaguauagaacugaaguggaauaaaacuuauucuuuuagucuaauauuccacagucaucuuuagcuagagaugccauuaauacagagcucuuguguugaaaacucagguacaauuuauucauagaaaauaacuuucuguugugaaauagcaaaaugcaguguucccaauccaaguguaaguuuaauuuuuagaguagacugggugcaguggcucacaccuguaaucccagcacuuuggggagguggagguggguggaucaccugaggucauuaguuggagaccagccugaccaacauggugaaacccugucucuacuaaauaccaaaaaaaaaaaaaaaaaaaaauuaguggggcauaguggcgcaugccuauaaucccagcuacuugggaggcugaggcaggagaauugcuugaucugggagguggagguugcagugagcugaguuugcgccauugcacuccagccuagguaacagagugaaacucugucucaaaaaauauauauauaauauauauauauauuuuuuacgguagauuuuaaacaccaaaauuaugaaaagagacuguagcuaaccuuauuacaugccaguucuucuaauuuauuuaagaauuauuuuaacuuuuuuuuuuucauucuauuucaggcugguacaccccuccaaaggaagauggcuaaauguguugacuguuguauguuuggacuaauguugcuuuaaagaaaaucuuucuaacaugcagacaaaagcuuugagugccccuauuacagcaguaccgaagauguuaguuaauagauauuuuaguggauaaucugucaucugacauccaguauaaguuacagccuuugcauuuugcucauuuuagauaucuuggacugagcaguggggccuuuacuguauuuuuccugauaaauacacauacuggccacuccuuaucucuuuuucuugaaaagugaacuuuuuaaagcagccaagucaacaucaggcuacugaaguugaggcuuuaggguaacuuuccuauauugagcccauggguuacaaggauuugcaauauauuguuccauuuacagccaauacagguuuaaucgauguucaauauugguuuaggaaauuuaaggccuucuaaaucauaauagcucuuucaugucuaaaaccauuuuaugauauugccaaaaugugauaggaaaccuacucauuaaauuguuaaacuuuuuaaugacuaugugaagauaugaauuguuuccugaagauaauacucuuaauugaguuguauuguacuucuuaggcaaagcaguguaaaacuguaucaauuaaggcuugugaguagugauuuccacuggggcaucagagucuuggcugggcugaaucugcugcuuguugguucaguguuucuuaugaacaagagccacaguacagagcuucaaguuauuuaaaauacuaagucaucuuacguuuccauuuuauuaacgggauguugcaaucguuuguaaacuaauaaacuuauaaagugauuggcacaaagacuccuugagcaaaagcugugcaguuaaguacaaaaagauacuuaauuuggagacucuuacaguaauuuuugccaugucaaaacaauggcuuuuacauugaaagauuaauagaaacucuacauauguuaauuuuuuuauagaaccugacucaaaucaagguacucuccauuuuauugccuuaccugaaucaguccuuuuugguugguaauagauuuuuuuauacacccacguuugauuuaaaaguaaauucuaguucuuaagcacuuuuaacaaauccagaagcacauuuuucugcacaaacaaguuacaaaguucaaaaguguuucuugugcauuagcuuugagauucaguuuuuaacuuuguaaaccacaucugagagacuugucauuucuacauuguguguguuuaauuucuuuugauuccauuuugguuaagagagcaguaaauagauuuucugguauucuuguucacuugauuacauuuguauaaaguucugauugccaguugcucagauaacaagugacaaggcagaauucuuuaaaucaguaaaguuccuuaagccuaaggcuaaaucuugaauacauuguugaauucuuuaauauccugauggcaagcagacugauagcugcacauuuggcaugcuuuguuuaauggauuuuauuuuuaauugcagauuuauuuggcaauguacaguaaauuuuguaaacuugcaucaaguuuaugaauaaagaaccauuuaaaaauuuuguuugugcugaucauggcaagcaaaaaaaagauuacuu

SEQ ID NO: 16004 - RNA, 8584 nt, Homo sapiens
gggugacccucuccaauccccaccucccuagugaaguuucaaaggacagguuuuucuggacgggaaggaagaguuucucugggcaggagacgguuaaaagcugggacuacgauuccagccuggggcugcccccuccuggccagcugucugaaccccugaauuauagaugugcuugcuccuggccuggcgagcaagagcuaguaggugcugggagccaggccuaguccagggucaccuaaggguagggccauugggccagacgcaccuccucacuccacaugcagacacacacaccgaguccccucccaguucugacugugcacccacauucacagauauaaccuguacacaaagucuaugcacagaccacacaucuccaaaccccaucuacacagcagacacacacacagcaagcacacaucgaaaucacaaagaaaucaucagaugacacauacugagacauacuuagaccuccccuccccauccagacacacgcaggcagggugggcagaggcucccaacauaaagauacagccacagucauaacugucauaauuaacacauauggagcacuuacucugugcuagguauugcucuaagcccuuuccagagaacaguuuauuuaauuauuauguaauagagauagcuacaauuauuauacccccauuuuacagaugaggaaacugagggaaggagaauuaaaauaagaugccugaggucacacagguguccuggcacagccucaggcacagauacccacccccucgcucuugucccccauuuacauaaacacauucauucaaacgcagcaucccccaaccccugaccugcccgcacacacucagggugagcgcucuuugggggacuguugacuaaagacgcaagaaauggccuauuggccaacgggugguaaacuguaacaagagccgguccgguggcccggcgcgguggcucacgccuguaaucccagcacugugggaagccgaggugggcggaucacgaggucaggaguucgagaccagccugacaaacauggugaaacccgguuucuacuaaaaauacaaaaauuagcggggcgugguggcgcucgccugcaaucucagcuacucaggaggcugaggcaggagaaucgcuugaacccgggaggcggagguugcagugagccgagaucgcaccauuacacuccagccugggcggcacagcaagagucuaucucaaaaaaaaaaaaaaaaaaaaaaaaaaaaaagccggaccggugagaagacuagaccuccuaaagguggaggcggagcucaaaagccggacgcuacuggacgaggcuuaaagcgcucgccccagcgcggggccggugaggaacguucaccguggaccauggucgaauaauguuagcgugcacucggggccucgcccuagccuucugcaaagccucggccugcgcccucggcugcauccguuucgacgccaaccaaccucaugcucuuaguagaacggcaguagcgaccgcgcccucaggcccacaagcccgaaggucugggcagggucuggaauggcgguggagacacuuuauccgcaggcguuucaccucgcgccccacccaggcgcacaccaaguucuugguacuccuuuuaaugggaaaacaagaacagacaccaugguuggauaaauguuauuuauaauucaugggccggucuuugaacccuuucaaacaaaacccacagcgauuucuuugaaagaaugccuggacugugcucagagcucucagauuuucucaggaccaacgagccgccgccucgcagauaccacuguaaauuacccagcgccuuacguucguuucugauuauuugcauugcaguggguuuguuaaugaaggacaagaguuuagaaaaaucuuuuauuuuggaaguuggacacgcaaucgaccccagcaguguuccuaaaaggagcuaugccauuuggaugggggaaaaaugagggggcggggaaguccauguuacauuuaaaacaacaacagcaacaaauuaaaagcaaaacaaaacaacaaaaaaaaggaaguggagcaggaggaggagguggugguggaggagagggaggaggggcagcagcagcggcagcagcagcaaggauggagucaggacccgucccagucccgggugagcgcuuuuggaucuggguucuggcucaacccacguaaugccccaaucuaaaguuuucuacguguguguggauaggaaagucuaaauagaguuuaucagaacccagguggucauucucuacacucucucuagcuuggacccgaagaacaaaggcacaugagaggagaaaggugaccagcuggacgaugacggucacguccaaacggaucccccuuguccucggcucucucguccugagaguggguuuaauuuuuuuuuuuuuaauuuauauaagaagggagcucuuaaaggagagccaucuccacccucagguauccaucacccagcuccagcgcgccugggaaaaccgccccgaaaguccaagaggaagcucagaguuguaacggccgcggagccagcucggcggugacgcaagguccaguccagauugccaggcccggggcaugagagaggauccuuguagguuucggaggugggggggcugcacuccauuguucacuccgggccaaucaggguuggcccacuuccucccagccaaucucccuucacccccagccuccaacccaacccaccccgcccaucagccccuggauccccaucaccucccccgcauccccggcaguucuggggaagcuucgugacgccacaggucccgcccccagcuccggcccggggcuagugcguguugacgucaugcugcgugcgggccggugcggaaucgcuccuucaacuccgcggggcaguaggaguuaguuagcaaagagccgaggccgggcgcgcgacccucguccuucugccccuggccgcacacuuugcgcacaucucuuuuucugcaugguggauauuauuuuucauuauccuuuucugggugcuaugggugaucauuccaagaguaaguauuucuguguguguguggggugggguguguguguaugcuuaauaugcaaaauuucuaaugcagaaaaauguuuaguggauucuacaaguggcuucuauuugucagaauaguuuaggagaggaaaaacgaaugcaugucuccugcaggacugcuuaucuuugggaauccuguuguuuuauuuuauaaguaaacacuauuucucaagccggcuaggaugacuucgggcugcgaaaucugcuucuguuuugcgcaaaggcaauuagguuugauuuagggauguggguuuuuuuuuuuuugguuguuguuuguuugccuuucgguuuuucaaagcuaggaagcuuucuuucgcuugcucugggauauuuaaacuaagaaaugucugagaggaugagcggggacugccgaaagacgaugugucuguguugggauaggaggcagccgcugugagugggagugugugagcggaaaugccaggacagcaccguuagguguugauauccaggcguccgcagugccuguguauuuacucucuucuuaguuucguguuugcguuuaguuucaagacacgucgacaaaacgacugucauuaaugaauguaauaacgaaauauuuggggugggggacagaagaaaccuucagcaauccacaagauacugguuuuucguuuccaaugcccuggaccuuuagagagcucaucaucuuuccuuauggucgcaagucuugaaagaaagagcaagagagcgagcggguuggguuggggcuggaguagccgaggccggccuggguccgggcagucaggccugacgcggccccgcgcccuuccccggcagagaagcccgggacggccaugugcgugggcugcgggagucagauccacgaccaguuuauccugcgggugucgcccgaccucgaguggcacgcggccugccucaagugugccgagugcagccaguaccuggacgagacgugcacgugcuucgugagagacgggaagaccuacugcaagcgggacuaugucaggugaggccggcgggaacgcgggcugggccaccgcgcgcaggggccggggccgggacuggggauggcggccugcccgcgcgccccggcccugcccagggagaaggccauccgcaucccgcacgggugccgcagcgcucccccgggcccgggaaugcccgcaggcgggucaccgcagucuccugguggccacaaaguguccugggcgcgcgccggagccguagcagccagggagaugagggcggccgcaggcccagcgcugacaccgccgcaccuugggcccgcaggcuguucggcaucaagugcgccaagugccaggugggcuucagcagcagcgaccuggugaugagggcgcgggacagcguguaccacaucgagugcuuccgcugcuccgugugcagccgccagcugcugccuggggacgaguucucgcugcgggagcacgagcugcucugccgcgccgaccacggccuccugcucgagcgcgccgcggccggcagcccgcgcagccccggcccgcuucccggcgcccgcggccugcaucugcccgguaagcgcgccggggccugugccggggugagcgggguguaugugcgugcguguguguagggguacgcuugugucccuaacgagaaguugucaguugugugugguuccgucugccgggauaguguuuuucuguaucagugcggaacugugugcugggaacaaggcuguguguauucucgugugcucgggagaaacugcguguguaugagugugugagcacggagaauugugcagaaucguguucuccaugaccaggaacaugcagggcacagugcuaggagcagaagaguggaugacaacagggaaucuuaagugguguccgucuuggggcuuguauuaggaauuucuuggaggaauauguguuauugucagaggguaagguuugcccagggguauguguguaaguaacacagcuccaaacugggagcugggcaggagcuuggucagccaggagccaagaacccaacaaagagggguuuuugccaucuuguuuugaggcccaguuugaugaacaauuuagccagguucuucugggggagggggaguaucaaugcauaguggacugucacuggaauauucuggguccuaaucagcagcugcccagagauggggucugaguguauaaugggcagguacggcugaacagaaacagaggugccuccaccccaggcaaggcaguuucccccagguagccauaggccugcagcacagauccguagaccaggcugggccucugggugcuguguggccuugccccgcuccuccccucucuggaucuucacuuccucccuauagaaagaggaaacugggcuggaugggcuauuuguaaauauuuguccagaccuagaaauucguagaggggaacauaaaccgaaauggugcaguacagauccacgguauauaugggucgggaucaaauggagaugugaaaugggagcaagcggguauucagugcacccccaucugggaucucggagaggcuccccuuuguuuguuucgggcuucagggugcaggcucuggaaucagucacuguuuccccgggauggagagaaccuggggccaagcgaggagagugccagcggcugcucagcaccuuggucggugggaggccacugggcuggggaaccuggagccuugaggaaggagacaggggccgaagcccaagggcgggcaggaaggaacuguugcaagcccuggaggcccguccauaaccguggaugagucuucuacacauguggccuggcccuguccaaaugggcucugaaggaggggaagggcccucguaggcccccggcauauucgcaccucccacccaguccccugggcagcgccucgcccuggguccacgucggucccuuucccucuccagaguccugggcaagccucuuuccucuuccucugaaacuccgacuucuuccggagggcuucgcucguuccgaggguccugcgacuggaggaggcacaucccugagcagccacucccuccccgcagcggccugucgccgagcucccgcgcccugcuugagcucgggagagaucgcugcggggcaguccggcccgggagcgagagaaagaacgaaaaugcacagcucucuccgaguaaggcgaacagauggagaggaagacgaacaauuaaacgaaacaaacagaauaaaacagaaacgaaaucgggccccggggggcugggccacccggagguugggcucggggcggguggguggcggccccucgcuaaccucuggccucacccuguccuggcagacgcugggucgggccggcagcccgcguugcgcccgcacgugcacaagcagacggagaagacgacccgcgugcggacugugcugaacgagaagcagcugcacacucugcggaccugcuacgccgccaacccgcggcccgacgcucucaugaaggagcagcugguggagaugaccggccugagcccgcgggucauccgcgucugguuccagaacaagcgcugcaaggacaagaagaaauccauucucaugaagcagcugcagcagcagcagcacagcgacaagacggugagcagccgcugggccggaggcucgagucgggugggggcugcgcuuccgccgcgguaucugcgugcccuuuucugggcgagcccugggagauccagggagaacugggcgcuccagaugguguaugucuguaccuucacagcaaggcuucccuuggauuugaggcuuccuauuuugucugggaucgggguuucuccuugucccaguggcagccccgcguugcggguuccgggcgcugcgcggagcccaaggcugcauggcagugugcagcgcccgccagucgggcugguggguugugcacuccgucggcagcugcagaaaggugggagugcaggucuugccuuuccucaccgggcgguuggcuuccagcaccgaggcugaccuaucguggcaaguuugcggcccccgcagauccccaguggagaaagagggcucuuccgaugcgaucgagugugcgccuccccgcaaagcaaugcagacccuaaaucacucaaggccuggagcuccagucucaaagguggcagaaaaggccagaccuaacucgagcaccuacugccuucugcuugccccgcagagccuucagggacugacugggacgccccugguggcgggcagucccauccgccaugagaacgccgugcagggcagcgcaguggaggugcagacguaccagccgccguggaaggcgcucagcgaguuugcccuccagagcgaccuggaccaacccgccuuccaacagcuggugaggcccugcccuacccgccccgaccucgggacucugcggguuggggauuuagccacuuagccuggcagagaggggaggggguggccuugggcugaggggcuggguacagcccuaggcggugggggagggggaacaguggcgggcucugaaaccucaccucggcccauuacgcgcccuaaaccaggucucccuggauuaaagugcucacaagagaggucgcaggauuaaccaacccgcucccccgcccuaaucccccccucgugcgccuggggaccuggccuccuucuccgcagggcuugcucucagcuggcggccgguccccaagggacacuuuccgacucggagcacgcggcccuggagcaccagcucgcgugccucuucaccugccucuucccgguguuuccgccgccccaggucuccuucuccgaguccggcucccuaggcaacuccuccggcagcgacgugaccucccuguccucgcagcucccggacacccccaacaguauggugccgagucccguggagacgugagggggaccccucccugccagcccgcggaccucgcaugcucccugcaugagacucacccaugcucaggccauuccaguuccgaaagcucucucgccuucguaauuauucuauuguuauuuaugagagaguaccgagagacacggucuggacagcccaaggcgccaggaugcaaccugcuuucaccagacugcagaccccugcuccgaggacucuuaguuuuucaaaaccagaaucugggacuuaccaggguuagcucugcccucuccucuccucucuacguggccgccgcucugucucuccacgccccaccuguguccccaucucggccggcccggagcucgcccacgcggacccccgcccugccccagcucagcgcucccuggcggcuucgcccgggcuccuagcggggaaaaggaaggggauaacucagaggaacagacacucaaacucccaaagcgcaugauugcugggaaacaguagaaaccagacuugccuugaaaguguuuaaguuauucgacggaggacagaguaugugagccuuugccgaacaaacaaacguaaguuauuguuauuuauugugagaacagccaguucauagugggacuuguauuuugaucuuaauaaaaaauaauaacccggggcgac

SEQ ID NO: 16005 - RNA, 8584 nt, Homo sapiens
gucgccccggguuauuauuuuuuauuaagaucaaaauacaagucccacuaugaacuggcuguucucacaauaaauaacaauaacuuacguuuguuuguucggcaaaggcucacauacucuguccuccgucgaauaacuuaaacacuuucaaggcaagucugguuucuacuguuucccagcaaucaugcgcuuugggaguuugagugucuguuccucugaguuauccccuuccuuuuccccgcuaggagcccgggcgaagccgccagggagcgcugagcuggggcagggcggggguccgcgugggcgagcuccgggccggccgagauggggacacagguggggcguggagagacagagcggcggccacguagagaggagaggagagggcagagcuaacccugguaagucccagauucugguuuugaaaaacuaagaguccucggagcaggggucugcagucuggugaaagcagguugcauccuggcgccuugggcuguccagaccgugucucucgguacucucucauaaauaacaauagaauaauuacgaaggcgagagagcuuucggaacuggaauggccugagcaugggugagucucaugcagggagcaugcgagguccgcgggcuggcagggaggggucccccucacgucuccacgggacucggcaccauacuguuggggguguccgggagcugcgaggacagggaggucacgucgcugccggaggaguugccuagggagccggacucggagaaggagaccuggggcggcggaaacaccgggaagaggcaggugaagaggcacgcgagcuggugcuccagggccgcgugcuccgagucggaaagugucccuuggggaccggccgccagcugagagcaagcccugcggagaaggaggccagguccccaggcgcacgagggggggauuagggcgggggagcggguugguuaauccugcgaccucucuugugagcacuuuaauccagggagaccugguuuagggcgcguaaugggccgaggugagguuucagagcccgccacuguucccccucccccaccgccuagggcuguacccagccccucagcccaaggccacccccuccccucucugccaggcuaaguggcuaaauccccaacccgcagagucccgaggucggggcggguagggcagggccucaccagcuguuggaaggcggguugguccaggucgcucuggagggcaaacucgcugagcgccuuccacggcggcugguacgucugcaccuccacugcgcugcccugcacggcguucucauggcggaugggacugcccgccaccaggggcgucccagucagucccugaaggcucugcggggcaagcagaaggcaguaggugcucgaguuaggucuggccuuuucugccaccuuugagacuggagcuccaggccuugagugauuuagggucugcauugcuuugcggggaggcgcacacucgaucgcaucggaagagcccucuuucuccacuggggaucugcgggggccgcaaacuugccacgauaggucagccucggugcuggaagccaaccgcccggugaggaaaggcaagaccugcacucccaccuuucugcagcugccgacggagugcacaacccaccagcccgacuggcgggcgcugcacacugccaugcagccuugggcuccgcgcagcgcccggaacccgcaacgcggggcugccacugggacaaggagaaaccccgaucccagacaaaauaggaagccucaaauccaagggaagccuugcugugaagguacagacauacaccaucuggagcgcccaguucucccuggaucucccagggcucgcccagaaaagggcacgcagauaccgcggcggaagcgcagcccccacccgacucgagccuccggcccagcggcugcucaccgucuugucgcugugcugcugcugcugcagcugcuucaugagaauggauuucuucuuguccuugcagcgcuuguucuggaaccagacgcggaugacccgcgggcucaggccggucaucuccaccagcugcuccuucaugagagcgucgggccgcggguuggcggcguagcagguccgcagagugugcagcugcuucucguucagcacaguccgcacgcgggucgucuucuccgucugcuugugcacgugcgggcgcaacgcgggcugccggcccgacccagcgucugccaggacagggugaggccagagguuagcgaggggccgccacccacccgccccgagcccaaccuccggguggcccagccccccggggcccgauuucguuucuguuuuauucuguuuguuucguuuaauuguucgucuuccucuccaucuguucgccuuacucggagagagcugugcauuuucguucuuucucucgcucccgggccggacugccccgcagcgaucucucccgagcucaagcagggcgcgggagcucggcgacaggccgcugcggggagggaguggcugcucagggaugugccuccuccagucgcaggacccucggaacgagcgaagcccuccggaagaagucggaguuucagaggaagaggaaagaggcuugcccaggacucuggagagggaaagggaccgacguggacccagggcgaggcgcugcccaggggacugggugggaggugcgaauaugccgggggccuacgagggcccuuccccuccuucagagcccauuuggacagggccaggccacauguguagaagacucauccacgguuauggacgggccuccagggcuugcaacaguuccuuccugcccgcccuugggcuucggccccugucuccuuccucaaggcuccagguuccccagcccaguggccucccaccgaccaaggugcugagcagccgcuggcacucuccucgcuuggccccagguucucuccaucccggggaaacagugacugauuccagagccugcacccugaagcccgaaacaaacaaaggggagccucuccgagaucccagaugggggugcacugaauacccgcuugcucccauuucacaucuccauuugaucccgacccauauauaccguggaucuguacugcaccauuucgguuuauguuccccucuacgaauuucuaggucuggacaaauauuuacaaauagcccauccagcccaguuuccucuuucuauagggaggaagugaagauccagagaggggaggagcggggcaaggccacacagcacccagaggcccagccuggucuacggaucugugcugcaggccuauggcuaccugggggaaacugccuugccugggguggaggcaccucuguuucuguucagccguaccugcccauuauacacucagaccccaucucugggcagcugcugauuaggacccagaauauuccagugacaguccacuaugcauugauacucccccucccccagaagaaccuggcuaaauuguucaucaaacugggccucaaaacaagauggcaaaaaccccucuuuguuggguucuuggcuccuggcugaccaagcuccugcccagcucccaguuuggagcuguguuacuuacacacauaccccugggcaaaccuuacccucugacaauaacacauauuccuccaagaaauuccuaauacaagccccaagacggacaccacuuaagauucccuguugucauccacucuucugcuccuagcacugugcccugcauguuccuggucauggagaacacgauucugcacaauucuccgugcucacacacucauacacacgcaguuucucccgagcacacgagaauacacacagccuuguucccagcacacaguuccgcacugauacagaaaaacacuaucccggcagacggaaccacacacaacugacaacuucucguuagggacacaagcguaccccuacacacacgcacgcacauacaccccgcucaccccggcacaggccccggcgcgcuuaccgggcagaugcaggccgcgggcgccgggaagcgggccggggcugcgcgggcugccggccgcggcgcgcucgagcaggaggccguggucggcgcggcagagcagcucgugcucccgcagcgagaacucguccccaggcagcagcuggcggcugcacacggagcagcggaagcacucgaugugguacacgcugucccgcgcccucaucaccaggucgcugcugcugaagcccaccuggcacuuggcgcacuugaugccgaacagccugcgggcccaaggugcggcggugucagcgcugggccugcggccgcccucaucucccuggcugcuacggcuccggcgcgcgcccaggacacuuuguggccaccaggagacugcggugacccgccugcgggcauucccgggcccgggggagcgcugcggcacccgugcgggaugcggauggccuucucccugggcagggccggggcgcgcgggcaggccgccauccccagucccggccccggccccugcgcgcgguggcccagcccgcguucccgccggccucaccugacauagucccgcuugcaguaggucuucccgucucucacgaagcacgugcacgucucguccagguacuggcugcacucggcacacuugaggcaggccgcgugccacucgaggucgggcgacacccgcaggauaaacuggucguggaucugacucccgcagcccacgcacauggccgucccgggcuucucugccggggaagggcgcggggccgcgucaggccugacugcccggacccaggccggccucggcuacuccagccccaacccaacccgcucgcucucuugcucuuucuuucaagacuugcgaccauaaggaaagaugaugagcucucuaaagguccagggcauuggaaacgaaaaaccaguaucuuguggauugcugaagguuucuucugucccccaccccaaauauuucguuauuacauucauuaaugacagucguuuugucgacgugucuugaaacuaaacgcaaacacgaaacuaagaagagaguaaauacacaggcacugcggacgccuggauaucaacaccuaacggugcuguccuggcauuuccgcucacacacucccacucacagcggcugccuccuaucccaacacagacacaucgucuuucggcaguccccgcucauccucucagacauuucuuaguuuaaauaucccagagcaagcgaaagaaagcuuccuagcuuugaaaaaccgaaaggcaaacaaacaacaaccaaaaaaaaaaaaacccacaucccuaaaucaaaccuaauugccuuugcgcaaaacagaagcagauuucgcagcccgaagucauccuagccggcuugagaaauaguguuuacuuauaaaauaaaacaacaggauucccaaagauaagcaguccugcaggagacaugcauucguuuuuccucuccuaaacuauucugacaaauagaagccacuuguagaauccacuaaacauuuuucugcauuagaaauuuugcauauuaagcauacacacacaccccaccccacacacacacagaaauacuuacucuuggaaugaucacccauagcacccagaaaaggauaaugaaaaauaauauccaccaugcagaaaaagagaugugcgcaaagugugcggccaggggcagaaggacgagggucgcgcgcccggccucggcucuuugcuaacuaacuccuacugccccgcggaguugaaggagcgauuccgcaccggcccgcacgcagcaugacgucaacacgcacuagccccgggccggagcugggggcgggaccuguggcgucacgaagcuuccccagaacugccggggaugcgggggaggugauggggauccaggggcugaugggcgggguggguuggguuggaggcugggggugaagggagauuggcugggaggaagugggccaacccugauuggcccggagugaacaauggagugcagcccccccaccuccgaaaccuacaaggauccucucucaugccccgggccuggcaaucuggacuggaccuugcgucaccgccgagcuggcuccgcggccguuacaacucugagcuuccucuuggacuuucggggcgguuuucccaggcgcgcuggagcugggugauggauaccugaggguggagauggcucuccuuuaagagcucccuucuuauauaaauuaaaaaaaaaaaaauuaaacccacucucaggacgagagagccgaggacaagggggauccguuuggacgugaccgucaucguccagcuggucaccuuucuccucucaugugccuuuguucuucggguccaagcuagagagaguguagagaaugaccaccuggguucugauaaacucuauuuagacuuuccuauccacacacacguagaaaacuuuagauuggggcauuacguggguugagccagaacccagauccaaaagcgcucacccgggacugggacggguccugacuccauccuugcugcugcugccgcugcugcugccccuccucccucuccuccaccaccaccuccuccuccugcuccacuuccuuuuuuuuguuguuuuguuuugcuuuuaauuuguugcuguuguuguuuuaaauguaacauggacuuccccgcccccucauuuuucccccauccaaauggcauagcuccuuuuaggaacacugcuggggucgauugcguguccaacuuccaaaauaaaagauuuuucuaaacucuuguccuucauuaacaaacccacugcaaugcaaauaaucagaaacgaacguaaggcgcuggguaauuuacagugguaucugcgaggcggcggcucguugguccugagaaaaucugagagcucugagcacaguccaggcauucuuucaaagaaaucgcuguggguuuuguuugaaaggguucaaagaccggcccaugaauuauaaauaacauuuauccaaccauggugucuguucuuguuuucccauuaaaaggaguaccaagaacuuggugugcgccuggguggggcgcgaggugaaacgccugcggauaaagugucuccaccgccauuccagacccugcccagaccuucgggcuugugggccugagggcgcggucgcuacugccguucuacuaagagcaugagguugguuggcgucgaaacggaugcagccgagggcgcaggccgaggcuuugcagaaggcuagggcgaggccccgagugcacgcuaacauuauucgaccaugguccacggugaacguuccucaccggccccgcgcuggggcgagcgcuuuaagccucguccaguagcguccggcuuuugagcuccgccuccaccuuuaggaggucuagucuucucaccgguccggcuuuuuuuuuuuuuuuuuuuuuuuuuuuuuugagauagacucuugcugugccgcccaggcuggaguguaauggugcgaucucggcucacugcaaccuccgccucccggguucaagcgauucuccugccucagccuccugaguagcugagauugcaggcgagcgccaccacgccccgcuaauuuuuguauuuuuaguagaaaccggguuucaccauguuugucaggcuggucucgaacuccugaccucgugauccgcccaccucggcuucccacagugcugggauuacaggcgugagccaccgcgccgggccaccggaccggcucuuguuacaguuuaccacccguuggccaauaggccauuucuugcgucuuuagucaacagucccccaaagagcgcucacccugagugugugcgggcaggucagggguugggggaugcugcguuugaaugaauguguuuauguaaaugggggacaagagcgaggggguggguaucugugccugaggcugugccaggacaccugugugaccucaggcaucuuauuuuaauucuccuucccucaguuuccucaucuguaaaauggggguauaauaauuguagcuaucucuauuacauaauaauuaaauaaacuguucucuggaaagggcuuagagcaauaccuagcacagaguaagugcuccauauguguuaauuaugacaguuaugacuguggcuguaucuuuauguugggagccucugcccacccugccugcgugugucuggauggggaggggaggucuaaguaugucucaguaugugucaucugaugauuucuuugugauuucgaugugugcuugcugugugugugucugcuguguagaugggguuuggagauguguggucugugcauagacuuuguguacagguuauaucugugaaugugggugcacagucagaacugggaggggacucggugugugugucugcauguggagugaggaggugcgucuggcccaauggcccuacccuuaggugacccuggacuaggccuggcucccagcaccuacuagcucuugcucgccaggccaggagcaagcacaucuauaauucagggguucagacagcuggccaggagggggcagccccaggcuggaaucguagucccagcuuuuaaccgucuccugcccagagaaacucuuccuucccguccagaaaaaccuguccuuugaaacuucacuagggagguggggauuggagagggucaccc

SEQ ID NO: 16006 - RNA, 24143 nt, Homo sapiens
uaggccuccuccuggcgcgccuccgcaccgcauugguggaccggcccccagcccguccaugggcguuguggccgccaccgcagguuccgccucccguucccuccgcccucaacguacgucgcaccgccucucuguagccgcccgcggagcaucgcagccggcccgggcccccgccagccucccuccucgcgucccucgguguccuccgcgggccggcgcgaugcggcugggcccgaggaccgcggcguuggggcugcugcugcugugcgccgccgcggccggcgccggcaaggccgaggagcugcacuacccgcugggcgagcgccgcagcgacuacgaccgcgaggcgcugcugggcguccaggugaggcggccaggccggugcugggagggccgggccucgcaccgcggcugccgcgggcuuugucccgggacaaaggggggcggccgggcgaggccuggcaggggcggccugacaaugggggccgggcggcgcggcacucgcucucuggggguccuggggccuggaaagccugaggagauagcacggcccaagagcuggaucccuucuaccccucagaucauggaggguguguaggggguaggggccuugaagugcaggugcgggucaccccgaaacccuuuggcaagggggucuucuaguagcccuguuuuucuccaccauuuugccccacugauaguaaugcuuggcccuccugugugucgcuucccccuaaaggaagauguggaugaauauguuaaacucggccacgaagagcagcaaaaaagacugcaggcgaucauaaagaaaaucgacuuggacucagauggcuuucucacugaaaguaaggacugcccuacacgacuaacaauggagacaaacacaaauauguuaagcagcggugucugcugaauguauagauugcuagugucccaaguuggaaguccugugagaaggagaaaaggacauggagaauaggcuuuauacuuacaaaucuuuagacacugagaaccaaguaaaacucggugcuuucuccaguuauauauaaacaucauugacccuguacucuauguggaagucacaccuugagacacccucuuucucacgugacuuuuguuagugucaacaauaugauuuauuuuagagaaauaugccccaaaacuuuaaggcaguaaaugauuuaucgcucuuuugauauaugcuucauuuaaauuuuaggaauuugcuucuuuuuuuaagcaaguagaaaaagaccuguugccugugaauuacguuuauuauaacauuauaccaaaauguuagagcugguaggggccuugggaucaucuuguccacaucacuuuguagagaugaagaaaugaagcacagggauaagugccuucuacaaauaaguggcaaagcuggacuagaauccagguauccugcucuuaauucagguuuuaauauccuucaguuaaaaaaaaaaaucugaugcucucagguaaauucucuagucagaaaugaaaugcacagacuauuaaaagaauguucuaaauaaauugcugugcaguugucucuccccauuguucaauucaaaugauguucccugucagcguuccaaguggguccucagaaaaauucagguuguuauugugacucuuaaguuagcuguuuuucuguaacucucauuuaaaugcuguucaccaucaaggaauuaaguugcuggagacaauuaaaaacugguaaauuuaagaugugcugucaaugacauauucacauuggaacccucuggaagauuaagggcuuuuuucuuccacuuaguuagacaauaauaacaagaccuuuggucucugauuauccaaucuaagaauaagucaaucuuugguuauacuagaguaaucaaagaacacaacacguugauuuggaagacugcgugguaccuaucugucaagaccuagauauguucaaauauuuaauaguaagguuuuaagaaguuuaaacuuagaaaaguuuuaguccaaauauucauuauacagaugagaagaaaagcuugagaugguaaacuacccccugauggcaaagcugaagugugaacccacauuucugaucccuguuccauucuguuuucuucuaugccauggugaucucuuuaaauaaacuagaagaaagauucauggugcuuacgaaagccuucauucuacuugaggacccuuaagauaauuuuggcaauuugcucuuugagggccaggucuggaaucagauguuaagagguagcaaaacucaguaggaguuggcuuugaagccagacagguuugaaucuggacucugcuauuuacuaguugugaaggcuuggacuuuucugaaccucaguuuccucaccuguauaauagugaugauuauaauugcauuguuuugaagauuagaggcaacauguacagaggaaccugauaaaugguauacucaugcuguccucacaaauauucguguucgucccucccuuuguuuccuuuaacguaguuuaguaaauauuuuuaugaauaguuuuuuguuuuuuuuuuugaggcagagucucgcucuugucacccauguuggcgugcaguagugugaucuuggcucacuacagccucugccacccagguucaagugauucuucugucucagccucccaaguagcugggauuacaggcacuggccaccaugcccggcuaauuuuuguauuuuuaguagagacgggguuuuacccgagaccaggcuggucucgaaauccugaccuuaggugauccgccugccucagccucccaaagugcugggauuacaggcgugagccacugagcccagccaaauagauuuuuuaaaaguugauugaaaagugaacauuugaauuuuagaaacuuucccaugccuucagguaccaaguuaagacagauagcuguugcaggaagggcauaaauugcuacccauaacuucguuaaaauuuacuccagauguuuuaacaacauauuuaaagguaauauacugaagcaguauucucagucacuugaauaccuuuucagaauuuaggccauaucuacuuaaccaucuauuauuuucuuacuauaguuuuaauucaacucacauaaaauuuauuuuaaaggaagacuuuaugucaccuucauaaauaaaaaacacuguuuuuucucauacauacuaaaauaaauagcuaucaaaauauuuaugcuuccugagagaucugugguaguuagcaaagguuuucugcaagauuuuggauaacauuuuuuuuaaaaguaaagugcuauuuuggccaguugguaauucauucaacaaauacuuacagagccaggaacuuuccaggcauuugauguacaucagugaacagaacauacccaaacuuuuauggagcuuacauuauauuuagaucauauguuauaguauggaagcuccggccaggcaugguggcucacgccuguaaucccagcaguuugggaggccgaggcagguggaucacgaggucaggaguuagagaccagccuggccaacauggugaaaccccgucucuacuaaaaauacaaaaaauuagccgggugugguggcacaugccuguaguuccaacuacucaggaggcugaggcaggagaaucguuugaaccgggaggcagagguugcagugagcugagaucgcaccacugcacacuccagcaugggugaaagagcgagacuccaucucaaaaaaaaauaauuaaaagcuucaugagcucuucuaaacagccuuucccacuuccuaccccauuucuauuaauacaacuaggccaauucucaguauuugcaaacaucaaagauuuugccuuuucagagaagguuuggaaauccuuacucuuaaguaucagaauuaacgucacaugcguuguguucugggaaauucucauaggugaacucaguucauggauucagaugucuuuuaagcauuaugcuaugcaagaagcaaaacaacaguuuguugaauaugauaaaaacagugaugauacugugacuugggaugaauauaacauucagauguaugaucgugugauugacuuugaugagaacacugcucuggaugaugcagaagaggaguccuuuaggaaggugaguucaugugcacaagcuguuucuuuugaucaugucaguucacuuuaccuuccugcaugaaugagcacauugagggccugaggucauaagcuggauugucuuguucucuaggaaaucaccuguuccacuucagcagucauuuugaugguuuccuuucuggccagauuuaggacucuuauucuaaauuaccuacaugauccuucuaucuguuuuucucggcugcaucauuuaauuguccucauuuccagaguugcuuuuuaaauguguuuugaaugaguaucucaauauuuuaauaucauugaauaaucaguuuuaucuuuauuaagaaggccauuauggcccauucccauuuuuaaacacauaguuuuauauacucacuuaaaaaaacugcgguuuccacaucuguggauucaaacaacugagaaucguaaguauccaaaaaaguaaguauuaaaaaaaaaaaaacugugucucuauucaacauauacagaacuuuuuucucuugauuauuccuuaauauaguauaacaaugauuuauuucucauuuaaguuguaauuuauauuauaaguaaucuagagaugauuuaaagcagagguccccaaccuuuuuggcaccagggaccaguuucauggaagacaauuuuuccacgggacaguguguggcggggggguggggaaugguuuuaggaugaaauuguuccaccucagaucagcaggcauuagguucuccuaaggagugcgcaacgaagaucccucacauguacaguucacaguaggguuugcacuccuaugaaaaucuaaugccaccccugaucugauaggaggcagagcagagcucagacgguaaugccugccacucaccucuugcuauguggcccaguuccuaacaggccaugaaccaauacccguccgcgaccuagggauugaggguccgugauuuaaaguauucaggaagauguguguaggcuaugugcaaauacugcaccauuuuauaucagggacuuaagcauucucagauuuugauagggaggucuuggaaccaauuucccaggaaugugugagggaggacuguguaacaaauugaccauuguaaccauuuuaaaguguacaguugaguaauauuaaguacauucaugguguugugcaaccaaucuccccgacucuuuucaucuuacagaguggagacucucuacccauuaaacaauaacuccccauucccuccucccacuagcuccuggcaaccacuguucuacuuucugucucugaauuuggcuacucuagguaccucaucuaaguagaaucauacgccguauuugucuuuguaacuggcuuauuuuuacuuagaauccucaagauucuuccauuuuguagcaugcaucagaauuuccuuccuuuuuaaggcaaaguaauauucuguuguauguacagguugaguaucccuaauuccaaaaucaaaaugcucuuaaauaugaaacuuuuggagcacugacacgacacucaaaagaaaugcucauugaagcaucuuggauuugggauuugcaaaucucugugggauccugcuuuccauugguuuggguauauaccuggaagugauacugcuagaucauacgguaauucuauuuuuaauuuuuugagaaaccacaguaccauuuuucauagugaguacacccuuuaaaauuacuccuuuuuuuuuuuuauuuuuauuuuuugagacaguaucucacucuguugcccaggcugaagugcagugguauaaucucggcucacugccuccugggcucaagcaguccucccagcacagcccccgaaguagcugggauuucaggcucaagccaccacgcccaucuaauuuuuguauuuuuuguagagaugggguuuuaccaucuugcccaggcuagucucaaacuccugaggucaagugaucuacccaccucagccucccaaagugcuaggauuacagguguaagccacgacaccuggccccaaauuacucauuuuuugaaaauuuaguaucugugugaguucuaaugugucucaugguuuaauuuguugaaauauaugcuucuuaagcagagcugagaaagacuaauuuuauuuaggaauuaggaacuuuuuaacacuucuaggaagucuauuaaacuaaaaguauaucaacagaaaugacugugagcuugagaaauugauauaucaaauacuuuuguauuucaaagcuaauuuuaaagaauuaaaaucuuuuuuauagguacaugauaguuguauuauacauacuuacagaguacaugugauauuuugauaucacacaaacguauauuauaaugaucaaaucaggguaauuagaggaucaccaagaauuuuuuuaagauaguuuuuauguguagaaaaacauaaaaauaaaaucaaacaugcuguugcaaacugucccaaaauauuagucaagggugcuuggaaaauauucaaggcucuucuguuucuuaacuuauccuguuuugguauauaccuuuuaauuuuuguuguggccauaauuuauuguauuaaacaauauaguguaacaaugauuuacuccucauuuaaauuguaauuugucuuauaaguaaucuagaaaugauuuaaaauauuugggaagauauguguagguuauaugcaaaugcuaugccacuuuauaucagggaauugaguauccuuggguuuugguaucugugggagguucuggaaccaauuucucacaaauauggagggaggagugcauaacaaauuuacuauuguaaccauuuuaaaguguaccauucaguaguguuaaguacauucacaguguugugcagcuaauccccagaacucuuuucaucuuggaaagcugaaacucuguaccuguuaaacaacaccccauucccuccuugguaaaugcuuucuaagugugcuauuuauuuagaaucauauuggccgcuugaacucuguaagccaccacuaacucuaaguugguuaauucucugcuaauaacuacagcaucaauguggagguuuggggcuccauccucagagccagucugcuuagcuucacauuuagcuccagcacuucacgguuguguaacuuugggcaaguuauuaaacuuucaugugccucaguuuccucaucuccaaaaaugaggauaauaauucccauucaggccaggugugguggcucacaccuguaaucucagcacuuugggaagccaaggugggagaaucacuugagcccagaguucgagaacaacugggcaauguggcaagaccccgucccuauggauacauuuuccucuuaaaaauuaaauccuaacuaaucuaaagcugucuaguuaacaaaugcccaaacaaaauuuaaaaauuagaugggcaugaugguccguccugugaucccagcuauuugggaggcugaggcaggaagauugcucgagcccaggcagucaaggcugcggugagccauauuuaugccacuacacugcagccugggcaacagagagaccucauuucuaaaaauaaauaaauaaauaaauaaauaaauaaauaaauaaauaaauaaaaauuuccucuuuaggauuauaauaguguggauaaauauuaauaaaugguagcaguuggaggggcaagcaguucuguuuugauuuaaaagaauauugaagaaagcauuuacaguucacauaaauuuauauuuaaucaacuuuuuaaaacuuuaugcauuuguuaacuaucagcuuuagauuaguuaggauuuuauuuuuuaaggggaaaauguaucuuuuguuuucuuuuuauuugggucuucauucuacaguggacuaaagugaguaaaaaucagucuuuuuacugcuuguaaauacuaaaggaaaaacaaguagugauaaugagauuugggaucaucugucuauuaaguauccccauuuacuauaggaauuaacuuaucuuaaaccaauguaacuuaucuaaaaccaaagcaugguguggugugguuucccuuccuaggaacaacagagaaguuaaauacaguauuuuaaaaucuugcuggaauuagauucuaauuauguuuucuauuuuuauuuuuuguuacucaaaagacuuaauuacuaucccauuaaaaaauaagaagugcauguuccuguauucuuagaagggggugauguaauagauggugcugagaagaaaaucuucacuuugaagagauacaugacucauaaauuguuuaugaacaguucuuuuaaaaggugucugguucuaauucuguguucuccaccagcuacuuagaauguguugauuauaacacucugcuuuuaaaggaugaauuagaugaaucuuaacagccuaaaggaauagauugaucccgaaaaugaacacuucaaugggaguccuuuugguuauuuuuuuuuuugacagccuaggaauaugucucuaucuucaugaaguucuaaucauauguuuuuagaauuugcuauaaguaacuuccuguguguauguguagucccagcugcucaggaggcugaaguaggaggauugcuugagcccaggaauuugaggccagucuggacaacauagugaaaccuugucccuuuaaaaaaaaaaaauaacguccuaaaaauugauguggaguguaaagaugaacccagaaaccauaugcauuauuuuucuaaauaaaaaauaacggaugaggaaugaaucaaucucaaaguuauagacuaaacacuauaccauaaauaaaauaaucauaaaaaguaauuggauaugugaauaaaauaaaguuuucuauaagaaagucuguuauaacugacgaaagucagcuuaauaucugaacuucaccuuuuuuuuuuuuuuuuuuuugagagggagugucgcucugucacccaggcuggagugcaguggugcaaucucggcucacugcagucuuagccucccagauucaagcaauucuccugccucagccuccugaguagcugggacuauaggcacgugccaccauaccuggcugauuuuuguuuuuguuuuuguuuuuuuuaguagagacugaguuucaccacguuggucaggcuggucucaaacuccugaccucaagugauccaccugccuuggccucccaaagugcugagauuacaugcgugaaccaccaugcccagucugaauuuuaucuuauauuuaauaaguuuucauauagggaauaaagauaacccuuucaggcugugaaaugccugaagaagcauuucuuuauaauauaaagaacaguuauggucaacacaggauaauuaaaguuuggggaucuaucuggcaaaaguucaaguguucuuuguuuuuguuuuuguuuuuguuuugagacggagucuugcucugucacccacgcuggagugcaguggggcaaucuuggcucacugcaaccucuuccucccagguucaagcaaucguccugccucagccucccaaguagcugggacuacaggcgugugccacuaugcccagcuaauuuuuuaguagagaugggguuucaccauguuggccaggcuggucacgaacuccugaccucaggugaucugcccaccucggccucccaaagugcugggauuacaggcgugacugcugaaugugcauguauaagcaguauuuauuuauguaagauauaaccuugcauguggcuaaucagaauuuuuaaugccuagucauuuguucuaguaucacacauuauauauuuccucauguagaaucauuagucuaccaaaagauggcaguuuuguuccucacaaguuucuguuguaaucuaaaaauaaaugauuaugguagcuuuuuuauuacuguaccuaacacuuuuuacccucuacuagaauacaaaguuuuuauauacaagaaaaaaaaagaguguugaaguuuuaugaaacugaccaucuuuuuuguuauuuuuuuaggaauuugccauuuguaaaaaacagucuuucuguuuuuggcuucuucgauuuaaugugagcuauucuuauuuuguguucuucaaauggccgugaaaugugaaccagaaaaagcuacccccuucacuuuuuuuuuuuuuaaagaaaucucagcuuguugaaagagauccuuucuuuccauaggcaaauuuggccaaauuuagcucuucuccugaaacauggaccuuuuugcuccaaagugaaggguucuuucauaaggaaaucaaagcacuugguauuuugaauaaugguuuauucaaaaagaacuugauugacucagcaaaguaccucaaauucuuguuugucugcuuuuaccauguuaaaccugaacauaaaaugcaaauuauuuggucuaguuauuuaaaauuuugaaacauuaaguuaaaagcuauuuggaaacaaguuauuauuuuuucuuuucugucaugauugggugaauauaacuggcuuguagagucugauguuaauaaaacaaauucuuuggggaaagaggugagccucuccgcuguaaaucaguaauuguaaaagaacuaguguuuagguaaaugacugcuaccugaccucuauuauucuagaagacugaagaggguauuuuuauucaguagugaaacacuuaaaagcuucuaaaauauuugaaauugugcuuuaaaaaaaugcacaguuuaauacauaucaguuuauaggaaggaaagcuauucccagaaauucucaaaacagaaauuaugcaggauuagcaguauagcauuauuggcucccaaggcucuugguuacagaauuaccauugaaaauuuuaucaaaagcagccuugucccugauagcugccgaaucauuuuuaaaaagggggguggaugggaagaugggagagaaaguagaaaaggauauguguuuauuaaaccuuaacaugggauccauuuaaacuuuugauguuauuuauaucugaauauacagaauuaacacuauaaagagccugcuaagacuagacuuccaggcugagcacggugacucaugccuguagucccagcauuuugggaggcugaggcagguggauagccugagcucaggaguuugagaccagccugggcaacauagugaaaccccaucucuaucaaaaauacaaaaaauuagcugggugugguggcacaugccugugguccccacuacuugggaggcuggggugggaggaucacuugaaccugggcgguggagguuucaguaagccgagauugcaccacuguacuccaaccuggaugacggagugagaccucaucuccccaccccccaaaaaagaaaagauuuccaaauauuagguacauauacuaauauuaugagauucucaacauaagaagacuguuuuucugaaacaauaauguauuuuugaaaagucacuuagaggaccagaaacauuuuuuaaaagcccuaccaagauuuaauacaugguauaaaguuauugauuuuugggcauucaaaaaaguauugagauuaauuauuaaaguagacaguauaguacuguagaaagaauagggaggauccaaguucaguaguuuuguuuguuuuuugagucagggucuugcuauggugugaaggcuggccuugaacuucugggcucaugcagucuucccaaguugcuggaacuacaggcgugcgccacuaugccaugcucaguauuuuuuagcuguauuucugacuuuuaucaaaucauucaaucugcuuuucuaucaauaauaguauauaacacuaaauacuuaagguuuauuaauggugugguagggauucucaucccaauugcuuauuagagauuuuuaucccaguuugauagaugaggaaaccagagagguuaagcaguuugcgcugacaccacagcuaguaaguggcauugcuggaauucaggucugggucuauaugacucuagagcuugugagucuauccugccccuaauacauguauuuguguagcuuaccuucaaagggacgaugugaagauaaaugagauaacggaugggaauguacuuuaaauuucacauaguuuguauuuuucaaaguauuuaaaaugaugugguauacuaaugagaaauuuuaauuuucaaagcuucacuuaaaggacaagaagcgauuugaaaaagcuaaccaggauucaggucccgguuugagucuugaagaauuuauugcuuuugagcauccugaagaaguugauuauaugacgguaagaaagaaacauuuuuaagagaauuauugagugaccaaaacuuuaaaaaaauauauuuaaaauuuuuguggguacauaguagguauauauguuuaugggauacaugagacuuuuuuuuuuuuuuuuuuuuuuuuuugagacggaguaucgcucugucgcccaggcuggagugcaguggggcgaucucggcuuacugcaagcuccgccucccguguucacgccauucuccugccucagccucucugaguagcuggaacuacaggcgcccgccacuacaccuggcuaauuuuuuguauuuucaguagagacgggguuucaccguggucucaaucuccugaccucgugauccgcccgccucggcuugccaaagugcugggauuauaagcgugagccaccgcgcccggccgagauguuuugauacaggcaugcaaugugaaauaaucagaucauagacaaugagguauccauccccucgaacuuuuauccuuuguguuacuaacaaucccgugaacacucuuuuaguuauuuuaaaauguauaauuaguuacuacugacuauagucaacccuguuaugcugucaaauaauagaucuuauucauucuuacuguuuuuuuuguacucauuaacuguucucagcgcccccucccccaacacuucccagucucugguaaccaucuucuaccgucuauguccaugaguucaauuguuuugauuuuuagaucccacaaaugagugagaacaugggauguuugucuuucugugccugacuuauuucacuuaauaugaucuccaguucauccaugcuguuguguggaucaacauguuguugcaggaucucuuucuuuuuuaugacugaauaguacuccauuguguauauguacauuuucuuuauccauucaucuguugauguacgcuuggguugcuuccaaaucuuggcuuuugugaacagugcuacaacaaacaugggagugcagauauuucuuugacauagugguuuccuuucuuuuggguauauacccagcagugggauugcuggaucauaugguagcucuauuuuuaguuuuuugaggaaccuccaaacuguucuccauagugguuguaugaauuuacauuuccaaguaaccaaaacuuuaaaaccuguucauuaaguuguuaaaaugaauuguauaaccagaauuuuaagagauacacagauuuaaaaugaugcucauucuccccacuuaaaauuaggcuugguaaggaggcuuucuuguggugacgaaguugcuuauugggagggagaaggugaaagacugaauuuuuaaaucucuguacuauguaugaacagcaggcuuccucaggcuauuuucucucauaacuguguuaccuucagugccuuccuuauccuuuuguagcuuucagauuuuuuuugguuuuucaauguuaguaauauuaggauuucuguuuaauuuacaacaucacuuaugaaagcuuuuggucuggaaaaacaucauguuuggauucuucauaggguugguaggggugcagcugcuaguuaacuaguaauguuuuugcaauuuuaaguauaaugaguccucucaucccuuuaauauuuaaaauaaguaccaguuuuucaaaacuuuuguugaauuguaaguuuaacucaacaaacauaaauugagucccuauuaugacuuggccaagcuugaaagcauaaaccaucacacugggaaauaaagacuaauguaacaaauagcuuuuuaaaaaagagacuaaacauuuauauugaagucuguugcaugacaucagccuccagcuacguggcuugguucccuggauauuucaaagaaggaagauauaucuuuuuguuuaaugugucaugguagacccugcugccuugcauaacaaggcugcagauacauuuuucuccauagcucagugguaagacacugucauuaauaccacuucucuugccauugugaagcuucuaauuucucauuggcacagaauacaugacccaguuuaagaacagugcuggguguaauuuaaguaccaaaauuaaguugggaaaagcuaauugagcccaagaaugacaggcaaaggaugcuagaucuugauucucuggagaauaaggaacaauugaagacuaaagaggggaauuaccaguaaaagcaaugaaauaauuuaggcauaaugugauacggcccagaguucuaucuggcaauugaaugaaauagauuugagcaacauuuugaagaaagcauaugcaggaauguugacuuacuaaauaaguguuaagggaaggcaagagucagagaugggccaggcaugguggcucacaccuguaaucccagcacuuugggaggccaaggcaggaggacagcuugaggcuaggaguucaagaccagccuggacaacauagcagaccuugucucuacaaaaaaguuagccaggugugguggcaugcaccugugguccuagcuacuugggagacugaggugagaggaucacuugaguccaguaguuggagccuaugaugccacuauuauugugccacugcucucuagccugggugacagaaugagauccuauguuaaaaaaaaaaagaagggggagggcuaggcggaguggcuuacgccuguaaucccagcacuuugggaggcugaggcuggcagaucauccgagguuaggaguuugagaucagccuugccaacauggcaaaacacugucucuacuaaaaauauaaaaguuagcugggugugguggcauacgccuguagucccagcugcuuuggaggcugaggcaggagauuugcuugaacccgggaagcagagguuguagugugcugagaucauaccauuguacucuagccugggcuacagagcaagaccccaucugaaaaaaaaaaggagauaggaagauauugaggaaaguacugaaacagcuggccauugaacaggucaucuuuagggaaaaggauugguuguuugauaagaagcuuugauaagagggaggaacagauuugggggcaguuugggauggauagggcuagguuugcugaaggggaagcaaggagauugagguauaauggcgggcugguacauuuuagaucuggaggcagaacagcaguucuaagguaagggcucuuuuaggguuguucauggauuggagggcaaaugaaguuaaagacaaagguaguauaagaugcuuuucuugagagggagagaugugcggaaaauagcaugagaguaacgcugagguuguuuaugagagugaaaguggaguucuucacaauaucagaagcuuaaggauguugaauuuaaagcuacauaguacuucagguuuuauucuugcuucuaaauuccaguguuuagaaggauugucuugaagauauggacaaccaaagugauuuuuccuguauaaguaccuuacuagcugauugcaccacuagagcuccaaaaauuaucauuuauuucuaaagaaguucuguaguagaauugaaucggauggcagugggacugaacauuuuguaacuuuuuuuuuucuuuuuuaaugaacguggaauaggaauuugucauucaagaagcuuuagaagaacaugacaaaaauggugauggauuuguuaguuuggaagaauuucuuggugauuacaggugggauccaaguaagucaccugggagaaugugaaaagagaaaaggaauugaagaaagacauugaaagacagccuugcucauugaaagcucucuucaacaggaaauguaaugaggaucugugucugauccuacuuguuucguuaacuguaauacaaguucaacaaauggauuuauagcuuaucugagaacgcugucuugcuuacuuuuacuuccgugucuagagucaaacauuuuucuuucuuuucaaacaaaucuaauuuuauuaucaguuuaaauggggaaggaaguaagguagauauuuuuaaacaaaauccugugcuguugcagguggaucuuaaaagagauagaaacauaaaacacuacaaauacugguguaaacacaguaucagaagcuuaguagaaggugaauaaguguuugaaauuaagaguuugcuuuuauauaagcagcuguuuuuucagaauuguugcuuaaagacaccaaacaaugccauuuuuaaauuggucaccaguuuuacuuauucugauugucacuuuaaaauuacacauggcauuacuuugugaaaacauguaagaaacuuuguauagaaacaugauauacaguaaaacauuacccaccucacaucugggaaaacuagauaucggaacaaauagcaguuaacaaaauuacuaguuugugaaaacauccaaugauuuuaaaacuggguuguuuagacucgugucacuuuugaaaaugacuauauauuuguucuuaugucaggacuuuucaguuaaguaguucuguuuuauugggcuuucuuuaguaaacuuuaaauucacuuccuuuauucuagggauauaccaaacuucuuauuggauacaugugauauucuuguguauguauauuuguguuuuuuuauauuaagcugcaaaugaagauccagaauggauacuuguugagaaagacagauucgugaaugauuaugacaaagauaacgauggcaggcuugauccccaagagcuguuaccuuggguaguaccuaauaaucagggcauugcacaagaggagguaaguguuacagaacaacuguuucucuccacccccuccccccgaauuuggugcuguugauaggaaaagaaguucaaaaucuuaagccaaagaaagaaguaauggaguuauuugggauugaugcauuacuauguuuugaauuuacgaacuguuuagauugucagggagacgaggaaguuaagauugugucauguauuaauuugagaguacagugaauagaauaauaguuuguauuuaccuacagggacucaaaacagguuauaauaauuuuucauugccuugauauauccuggauuggauuugaguggagagagacagaacccagcagaaaugaagaaaggagauaaugggaaaagcaguagacggaccugguuacaacguguaacauuuuuagauacuuaaacaauaaugaguacuuguacaccuggaugauuuugacaagucaaaucacauuaaauugugaacaucuugcugaaaauacuuauuacacuugacacuuuuuuguuuuauuuugaaggcgcuucaucuaauugaugaaauggauuugaauggugacaaaaagcucucugaagaagagauucuggaaaacccggacuuguuucucaccagugaagccacagauuauggcagacagcuccaugaugacuauuucuaucaugaugagcuuuaaucucugagccugucucaguagaguacuggcuccuuuuauaauuuguuaccagcuuuacuuuugugauaaaauauugauguuguauuuuacacucuuaagucuuaaccacagucagaauuaucuuaauguagauuauaauuuuggucuuuuaggaaaaaaaaacaaaaaucugauauuuauuucaaaauguauugaagcaacaaaauauuaauauugugccauaugacaacaaagucuuuccuaaauacuccaucuguuuaguacuguauuguggaauauuugaguucuauuuccauacuugaaaacauggaggauuuuagagaugccugaacaauauuauuuaaguaguaugugaccgagcuauaaauuuuuguuuuuguucuaaguagauuuaauuugggaacugacaggacaauguuuuuagguuuagcauuuuguuuaaaaaccuuuaaagaaaccuuuagaaggacuuagaccucacauauuaauguugagaaguucugcuuaauuuuaaaaugguuucuauaaaggguuuuauuguaugaaauagaacuuuauauuuuugcauauguauagauaguaauuauauuuaauguauaacuauagcauuauggugaguggaauuugacauuguccaaaccuuuuucauuuuugagugauuaaaaaugaaauguccuuuguauauguuuguuugcuuuucuuuaacuuucagauaaauauugaauuuagcauagguuuugugguauuguacauuaucuugccucauccauuccuuuauguggauaguucccaaaacugucaaauuauucuugcugcauuuucuuauuuuuuuuuuaaauaagagaaucauguuauaauauaauugaaugugcaccugacacauuuuaauaauugguguuguagcaaaugugguuuugcucuuuggggcuauaaauaaucuugaguaacgcagguuggaauuaccaauagagcuggucaguuaucaacaguagagcucaguaucaauuuuacugaaauuaaaaucauacuugauaagcaugauaaucaauuuuaaccuaauucagcaggucaacuuauuuaacuuugguggaggugggauagggaaaagugaagggaggaauuaauuuuuuucuaguucugauguacagagauuguuuuucauucuuuuuuuuuuuuuuuuuuuugugacagagucuugcucuguggcccaggcuggagugcaggggcacuaucucggcucacugcaagcucugccuccuggguucacgccauucuccugccucagccucccgaguagcugggacuacaggcgccugccaccacacccggcuaauuuuuuuguauuuuuaguagagaccggguuucaccguguuagccaggaugguuucgaucuccugaccucaugaucagcccaccucggccucccaaggugcuggaauuacaggcgugagccaacgcgcacggccucuaguuuuucauucuuuaaaucacuuuuauuugugggugaagaggucagcuaugcauucucuuaaucacuuuccagccuaaaguugucucauauacagcacacugggggcucaacaaguaccuaugacuauuugagaagacaugaaacucuucucugauagaaucgacugcaccuauauaccucucuacugccgcaucuuugcugaugugaggugugcuugcaaauuguaagcuuccacaccuuaaugacugcuugcuuggguaucuacaugguuuucauuuuaaccuacacuauaugucuggcuauagcaguuuuagaauuacagauuuaccacuaucacucaucugucauuugucagacucacugaagcuggcauauuugaaaucaccaguuugacuaguuaacuauuuguuuuucucucuagcuucuccaaaaucuaugccagaauagaucaucagauauggauuauauuucaauccuuugcagaaaugcaaugucuguacuacuuuccuuccuagcauaaagaaaacuacacuucccagcccucuuguagguaggcgauggcuaguucugaccaguuaaacauggguggaaguagugugugucacuaucagacuaucucaugacaaacccuuuuccucugccacagcacugugcaggaggccucagcugaaauggugcagccacaagaugaaaguggcuuugaucuugagucuguguaggucagcuggauccacagugggcuuuguaugaucaaaaaauaagcuuuuaauuauguuaagccacugagauuugguugugcuuuuuuguuuuuaaccacagcagagcccauccugcugugacugagugaagauuucacauuuaacaauaggcuuuuaauaagcaugcagagaaaaagaaucaucugcuugaacagagaugcuauaucuacugcugagucaaaauagaaaauuuuaaggcuuuuuuuagauuugaauuuuaaauaagacuuuuaaaauaaagcuuuuauuuugguuuuaauauaauuaggauaauuugaauuuauccuugagcaugagaguaaaaauaguuugagacuuucugaaucauuggcugauucugccugaaggacuuaaugacuuccauuauuugaguucagguacaacuucaaaggggaaaauugaaugggaugugcacauguuggcucauauguaguucugauugggccaauuugcaggacagaaaaugaugucuagauuaugauauaaauuuaaaggaagccaggacguucagaggaaaagcuagcauaucauguuugccuuacuuaguucuuuccuuugcaguuuuaaaaauaggcuuuuuuuuuuuuuaguguaguuuuauguucacagcaaaauugagcaaaaaguaguauagagaguuucaauauguccccugccccacauacguacagccucccccacuauccuauccuauaugucaugagauaguaccuaccagagugguacauuuguuaaaaucgaugaaacuguuaacauaucauugucacccaaagugcauaguuuacauuaggguucacucuuggugcugcacaugcucuggguuuggacaaauguauaauuacauauucccaccauuguagugugguagaauauuucccuugcccuaaagucuuucugcuccaccuauucaucccucccuucccuguaaccccaagcaauacugaucuuuuuacuguucauaauuuuuuagauuguaguaaaauacacauaacaaaauucaucuuaacaguuuuuaauuguacaguucggugguaugguauuaaauacagucaaaaugugaaacuauuaccaccuuccaucuccaugaacuucauuuguaaaacggaaauuuauacccauuaaacaauaaagcccccuuuccccuucccuucagcaccuggcaaacaccauucuaguuuuuuuguuugagauggagucuugcucuuguugcccaggcuggagugcaauggcaugauuucggcucacugcaaccucugucucuuggggucaagcgauucuccugccucagccucccgacuaggugggauuacaggcgggcaccaccaugcccccuaauuuuuuguauuuaguagaaaugggguuucaccauguuggucaagcuggucucgaacuccugaucucaggugauccaccugccucagccucccaaagugcuggaauuacaggcgugagccaccgugcccagccucccauucuaguuuucuuuuucuuucuuuuuugagacggagucucacucuugucauccaggcuggagugcaguggugcgaucucggcucacugcaaccuccaccucccagguucaagcgauucuccugccucagccucccaaguagcugggauuauagaugcccgcuaccacgcccggcuaauuuuuguacuuuuaguagagacgggguuucgccauguuggcauggcuggucucgaacucuugaccucaggugauccaccugccucggccucccaaagugcugagauuacgggcaugagccaccgcgcccagccccauucuaguuugugucuauuaaaauagacucauauaguauuugucuuuuugugaguggcuucacuuagcauaacguccccaaaguucacccauauuguuaccagaauuucuuucgucaggcugaacaauacuuuauuguuugcauauaccacauuuugcuuauccauucacccuuugauggacacagguugcuuccaccuuuuauugugaauaaugcugccaugaauauggguguacaaauauuucuuugagauccugcuuuuaguucuuuuggauauauauuauacauagaagugggauugcuggaucauauaguaauucuauauauauauauauauauauauauauauauauauauauuuuuuuuuuuuuuuuuuuuuuuuuuuuuuuugagacggagucucgcucugucgcccaggcuggagugcaguggcgcgaucucggcucacugcaggcuccgccucccggguucacaccauucuccugccucagccucccgaguagcugggacuauaggcgccugccaccgcacccggcuaauuuuuuguauuuuuaguagagacgggguuucaccguguuagccaggauggucuugaucugcugaccucgugauccgcccgccuuggccucccaaagugcugggauuacaggcgugagccaccgcgcccgacuaguaauucuauuuuuaauauuuugaggaacugccauaguguuucccacagcagcugugccauuuugcauuuccaccaauagugcacaagaguuccaguuucuuuacauccuuaccaacacuugcuauuuucuguuuuuuuuuuuuucuuuuuuuuuuuuaauaguagccauccuguugggugagacgugguaucucguuguggcuuugauuugcauuucccuaauggucugucucuacaguuuugccuguuccagaauaucauuccuuugcaauuuaaaugugaggauaaauguaugcuauuguuucucaaacguuuuuguguuacaauaccuccuuuugagugagaaaugucaacucaaacuuacacuuuuucacuuaggaagaugauuuaggaaagccacuuagaguaaaaguuuuuaaacaacuguaaaaacuaauuugcuucauugcaacauuugaguucugucgaauaaauauuuggccagauuuccugccugcuauaaaauuuuuuauaacuaguaaccaauuaccuaagggccuccagugcagcuacuaaaacgucucuauuuuauuuggcggggggggggggaaacaccucaauccaagcacaaaaaaaacaaguacugcugaauaccuacaguuugcccuaucuuuaucucaaauuaaccaguuaguuccugagcuguagaaaggaaaccauuugagcuuauaaaacuauuuuaaagugauuauggggauuuuuaaaaaucucauagcuuuuaaucaugauuuuucauaccuuaaagaaaaaaacccuacuuuugcuuucuguuccacagagauauuuuucuucugagaccagguuccaaugaacagagggcaucaacauuuugcucaguuauuguaccauuagcagugauugguaaccuaaguagagagacuguuccauuacaaugacacacuaaaagcauaaacuaaggucuuuuugugccagcugcuggccugucugaauuaaugcuuuguuguuccgucuacaacaaaugaugucaugcaagugauuuauuuuguaagaguacucuguaaugaaaaacuugauugaaguuaauuguggacucccuucauggugguaaggaggcuaggcugaggcugagcuaugacuaagcuacaguuauuuuaccucgcugucauauagcaauuagucuuuagcccuuccacuuuacaaucccaaaugacuaggcaaaacucuccuaaacuuccaaauaacccaccaaagcaaaacaacuauuacuaggagcuuagagaaggaaagaggcaagaaugauuuaccuugaugccaccuuccuucugcuaaauuuaaagauguaagaaaaucuaauuuauaaaauuucauuuggcaaaaagaaaagguaaaaaguuuaccuggaaaucaauuguccuacauuaaagugaaaaaggccaggcacaguggcucaugccugcaauccuagcacuuugggaggcugaggcgggagauuugcuugaggauaggaguucaagaccagccuggguaacacagggagaccucaucucuacaaaaaaaaaaaaaaaaaaaaaaaauuagcaugaugugguggcuugugucuguagucccagcuacuuaggaggcugaggcaggaggauuacuugagcccaggagguugaggcugcagugagcugugauaacaccacugcacuccagccuggacaacagcauaagacccugucucagaaagaaaaaaaagaaaaaguaagcuccuugagggcugcaacuguuucuucaucacuguaucuccccugcccagcaugugauuaggacauacuagauagucacugaauaaauuuacuaauagaaugauacaa

SEQ ID NO: 16007 - RNA, 24143 nt, Homo sapiens
uuguaucauucuauuaguaaauuuauucagugacuaucuaguauguccuaaucacaugcugggcaggggagauacagugaugaagaaacaguugcagcccucaaggagcuuacuuuuucuuuuuuuucuuucugagacagggucuuaugcuguuguccaggcuggagugcagugguguuaucacagcucacugcagccucaaccuccugggcucaaguaauccuccugccucagccuccuaaguagcugggacuacagacacaagccaccacaucaugcuaauuuuuuuuuuuuuuuuuuuuuuuuguagagaugaggucucccuguguuacccaggcuggucuugaacuccuauccucaagcaaaucucccgccucagccucccaaagugcuaggauugcaggcaugagccacugugccuggccuuuuucacuuuaauguaggacaauugauuuccagguaaacuuuuuaccuuuucuuuuugccaaaugaaauuuuauaaauuagauuuucuuacaucuuuaaauuuagcagaaggaagguggcaucaagguaaaucauucuugccucuuuccuucucuaagcuccuaguaauaguuguuuugcuuugguggguuauuuggaaguuuaggagaguuuugccuagucauuugggauuguaaaguggaagggcuaaagacuaauugcuauaugacagcgagguaaaauaacuguagcuuagucauagcucagccucagccuagccuccuuaccaccaugaagggaguccacaauuaacuucaaucaaguuuuucauuacagaguacucuuacaaaauaaaucacuugcaugacaucauuuguuguagacggaacaacaaagcauuaauucagacaggccagcagcuggcacaaaaagaccuuaguuuaugcuuuuagugugucauuguaauggaacagucucucuacuuagguuaccaaucacugcuaaugguacaauaacugagcaaaauguugaugcccucuguucauuggaaccuggucucagaagaaaaauaucucuguggaacagaaagcaaaaguaggguuuuuuucuuuaagguaugaaaaaucaugauuaaaagcuaugagauuuuuaaaaauccccauaaucacuuuaaaauaguuuuauaagcucaaaugguuuccuuucuacagcucaggaacuaacugguuaauuugagauaaagauagggcaaacuguagguauucagcaguacuuguuuuuuuugugcuuggauugagguguuuccccccccccccgccaaauaaaauagagacguuuuaguagcugcacuggaggcccuuagguaauugguuacuaguuauaaaaaauuuuauagcaggcaggaaaucuggccaaauauuuauucgacagaacucaaauguugcaaugaagcaaauuaguuuuuacaguuguuuaaaaacuuuuacucuaaguggcuuuccuaaaucaucuuccuaagugaaaaaguguaaguuugaguugacauuucucacucaaaaggagguauuguaacacaaaaacguuugagaaacaauagcauacauuuauccucacauuuaaauugcaaaggaaugauauucuggaacaggcaaaacuguagagacagaccauuagggaaaugcaaaucaaagccacaacgagauaccacgucucacccaacaggauggcuacuauuaaaaaaaaaaaagaaaaaaaaaaaaacagaaaauagcaaguguugguaaggauguaaagaaacuggaacucuugugcacuauugguggaaaugcaaaauggcacagcugcugugggaaacacuauggcaguuccucaaaauauuaaaaauagaauuacuagucgggcgcgguggcucacgccuguaaucccagcacuuugggaggccaaggcgggcggaucacgaggucagcagaucaagaccauccuggcuaacacggugaaaccccgucucuacuaaaaauacaaaaaauuagccgggugcgguggcaggcgccuauagucccagcuacucgggaggcugaggcaggagaauggugugaacccgggaggcggagccugcagugagccgagaucgcgccacugcacuccagccugggcgacagagcgagacuccgucucaaaaaaaaaaaaaaaaaaaaaaaaaaaaaaaauauauauauauauauauauauauauauauauauauauagaauuacuauaugauccagcaaucccacuucuauguauaauauauauccaaaagaacuaaaagcaggaucucaaagaaauauuuguacacccauauucauggcagcauuauucacaauaaaagguggaagcaaccuguguccaucaaagggugaauggauaagcaaaaugugguauaugcaaacaauaaaguauuguucagccugacgaaagaaauucugguaacaauaugggugaacuuuggggacguuaugcuaagugaagccacucacaaaaagacaaauacuauaugagucuauuuuaauagacacaaacuagaauggggcugggcgcgguggcucaugcccguaaucucagcacuuugggaggccgaggcagguggaucaccugaggucaagaguucgagaccagccaugccaacauggcgaaaccccgucucuacuaaaaguacaaaaauuagccgggcgugguagcgggcaucuauaaucccagcuacuugggaggcugaggcaggagaaucgcuugaaccugggagguggagguugcagugagccgagaucgcaccacugcacuccagccuggaugacaagagugagacuccgucucaaaaaagaaagaaaaagaaaacuagaaugggaggcugggcacgguggcucacgccuguaauuccagcacuuugggaggcugaggcagguggaucaccugagaucaggaguucgagaccagcuugaccaacauggugaaaccccauuucuacuaaauacaaaaaauuagggggcaugguggugcccgccuguaaucccaccuagucgggaggcugaggcaggagaaucgcuugaccccaagagacagagguugcagugagccgaaaucaugccauugcacuccagccugggcaacaagagcaagacuccaucucaaacaaaaaaacuagaaugguguuugccaggugcugaagggaaggggaaagggggcuuuauuguuuaauggguauaaauuuccguuuuacaaaugaaguucauggagauggaaggugguaauaguuucacauuuugacuguauuuaauaccauaccaccgaacuguacaauuaaaaacuguuaagaugaauuuuguuauguguauuuuacuacaaucuaaaaaauuaugaacaguaaaaagaucaguauugcuugggguuacagggaagggagggaugaauagguggagcagaaagacuuuagggcaagggaaauauucuaccacacuacaauggugggaauauguaauuauacauuuguccaaacccagagcaugugcagcaccaagagugaacccuaauguaaacuaugcacuuugggugacaaugauauguuaacaguuucaucgauuuuaacaaauguaccacucugguagguacuaucucaugacauauaggauaggauagugggggaggcuguacguauguggggcaggggacauauugaaacucucuauacuacuuuuugcucaauuuugcugugaacauaaaacuacacuaaaaaaaaaaaaagccuauuuuuaaaacugcaaaggaaagaacuaaguaaggcaaacaugauaugcuagcuuuuccucugaacguccuggcuuccuuuaaauuuauaucauaaucuagacaucauuuucuguccugcaaauuggcccaaucagaacuacauaugagccaacaugugcacaucccauucaauuuuccccuuugaaguuguaccugaacucaaauaauggaagucauuaaguccuucaggcagaaucagccaaugauucagaaagucucaaacuauuuuuacucucaugcucaaggauaaauucaaauuauccuaauuauauuaaaaccaaaauaaaagcuuuauuuuaaaagucuuauuuaaaauucaaaucuaaaaaaagccuuaaaauuuucuauuuugacucagcaguagauauagcaucucuguucaagcagaugauucuuuuucucugcaugcuuauuaaaagccuauuguuaaaugugaaaucuucacucagucacagcaggaugggcucugcugugguuaaaaacaaaaaagcacaaccaaaucucaguggcuuaacauaauuaaaagcuuauuuuuugaucauacaaagcccacuguggauccagcugaccuacacagacucaagaucaaagccacuuucaucuuguggcugcaccauuucagcugaggccuccugcacagugcuguggcagaggaaaaggguuugucaugagauagucugauagugacacacacuacuuccacccauguuuaacuggucagaacuagccaucgccuaccuacaagagggcugggaaguguaguuuucuuuaugcuaggaaggaaaguaguacagacauugcauuucugcaaaggauugaaauauaauccauaucugaugaucuauucuggcauagauuuuggagaagcuagagagaaaaacaaauaguuaacuagucaaacuggugauuucaaauaugccagcuucagugagucugacaaaugacagaugagugauagugguaaaucuguaauucuaaaacugcuauagccagacauauaguguagguuaaaaugaaaaccauguagauacccaagcaagcagucauuaagguguggaagcuuacaauuugcaagcacaccucacaucagcaaagaugcggcaguagagagguauauaggugcagucgauucuaucagagaagaguuucaugucuucucaaauagucauagguacuuguugagcccccagugugcuguauaugagacaacuuuaggcuggaaagugauuaagagaaugcauagcugaccucuucacccacaaauaaaagugauuuaaagaaugaaaaacuagaggccgugcgcguuggcucacgccuguaauuccagcaccuugggaggccgaggugggcugaucaugaggucaggagaucgaaaccauccuggcuaacacggugaaacccggucucuacuaaaaauacaaaaaaauuagccgggugugguggcaggcgccuguagucccagcuacucgggaggcugaggcaggagaauggcgugaacccaggaggcagagcuugcagugagccgagauagugccccugcacuccagccugggccacagagcaagacucugucacaaaaaaaaaaaaaaaaaaaagaaugaaaaacaaucucuguacaucagaacuagaaaaaaauuaauuccucccuucacuuuucccuaucccaccuccaccaaaguuaaauaaguugaccugcugaauuagguuaaaauugauuaucaugcuuaucaaguaugauuuuaauuucaguaaaauugauacugagcucuacuguugauaacugaccagcucuauugguaauuccaaccugcguuacucaagauuauuuauagccccaaagagcaaaaccacauuugcuacaacaccaauuauuaaaaugugucaggugcacauucaauuauauuauaacaugauucucuuauuuaaaaaaaaaauaagaaaaugcagcaagaauaauuugacaguuuugggaacuauccacauaaaggaauggaugaggcaagauaauguacaauaccacaaaaccuaugcuaaauucaauauuuaucugaaaguuaaagaaaagcaaacaaacauauacaaaggacauuucauuuuuaaucacucaaaaaugaaaaagguuuggacaaugucaaauuccacucaccauaaugcuauaguuauacauuaaauauaauuacuaucuauacauaugcaaaaauauaaaguucuauuucauacaauaaaacccuuuauagaaaccauuuuaaaauuaagcagaacuucucaacauuaauaugugaggucuaaguccuucuaaagguuucuuuaaagguuuuuaaacaaaaugcuaaaccuaaaaacauuguccugucaguucccaaauuaaaucuacuuagaacaaaaacaaaaauuuauagcucggucacauacuacuuaaauaauauuguucaggcaucucuaaaauccuccauguuuucaaguauggaaauagaacucaaauauuccacaauacaguacuaaacagauggaguauuuaggaaagacuuuguugucauauggcacaauauuaauauuuuguugcuucaauacauuuugaaauaaauaucagauuuuuguuuuuuuuuccuaaaagaccaaaauuauaaucuacauuaagauaauucugacugugguuaagacuuaagaguguaaaauacaacaucaauauuuuaucacaaaaguaaagcugguaacaaauuauaaaaggagccaguacucuacugagacaggcucagagauuaaagcucaucaugauagaaauagucaucauggagcugucugccauaaucuguggcuucacuggugagaaacaaguccggguuuuccagaaucucuucuucagagagcuuuuugucaccauucaaauccauuucaucaauuagaugaagcgccuucaaaauaaaacaaaaaagugucaaguguaauaaguauuuucagcaagauguucacaauuuaaugugauuugacuugucaaaaucauccagguguacaaguacucauuauuguuuaaguaucuaaaaauguuacacguuguaaccagguccgucuacugcuuuucccauuaucuccuuucuucauuucugcuggguucugucucucuccacucaaauccaauccaggauauaucaaggcaaugaaaaauuauuauaaccuguuuugagucccuguagguaaauacaaacuauuauucuauucacuguacucucaaauuaauacaugacacaaucuuaacuuccucgucucccugacaaucuaaacaguucguaaauucaaaacauaguaaugcaucaaucccaaauaacuccauuacuucuuucuuuggcuuaagauuuugaacuucuuuuccuaucaacagcaccaaauucggggggaggggguggagagaaacaguuguucuguaacacuuaccuccucuugugcaaugcccugauuauuagguacuacccaagguaacagcucuuggggaucaagccugccaucguuaucuuugucauaaucauucacgaaucugucuuucucaacaaguauccauucuggaucuucauuugcagcuuaauauaaaaaaacacaaauauacauacacaagaauaucacauguauccaauaagaaguuugguauaucccuagaauaaaggaagugaauuuaaaguuuacuaaagaaagcccaauaaaacagaacuacuuaacugaaaaguccugacauaagaacaaauauauagucauuuucaaaagugacacgagucuaaacaacccaguuuuaaaaucauuggauguuuucacaaacuaguaauuuuguuaacugcuauuuguuccgauaucuaguuuucccagaugugagguggguaauguuuuacuguauaucauguuucuauacaaaguuucuuacauguuuucacaaaguaaugccauguguaauuuuaaagugacaaucagaauaaguaaaacuggugaccaauuuaaaaauggcauuguuuggugucuuuaagcaacaauucugaaaaaacagcugcuuauauaaaagcaaacucuuaauuucaaacacuuauucaccuucuacuaagcuucugauacuguguuuacaccaguauuuguaguguuuuauguuucuaucucuuuuaagauccaccugcaacagcacaggauuuuguuuaaaaauaucuaccuuacuuccuuccccauuuaaacugauaauaaaauuagauuuguuugaaaagaaagaaaaauguuugacucuagacacggaaguaaaaguaagcaagacagcguucucagauaagcuauaaauccauuuguugaacuuguauuacaguuaacgaaacaaguaggaucagacacagauccucauuacauuuccuguugaagagagcuuucaaugagcaaggcugucuuucaaugucuuucuucaauuccuuuucucuuuucacauucucccaggugacuuacuuggaucccaccuguaaucaccaagaaauucuuccaaacuaacaaauccaucaccauuuuugucauguucuucuaaagcuucuugaaugacaaauuccuauuccacguucauuaaaaaagaaaaaaaaaaguuacaaaauguucagucccacugccauccgauucaauucuacuacagaacuucuuuagaaauaaaugauaauuuuuggagcucuaguggugcaaucagcuaguaagguacuuauacaggaaaaaucacuuugguuguccauaucuucaagacaauccuucuaaacacuggaauuuagaagcaagaauaaaaccugaaguacuauguagcuuuaaauucaacauccuuaagcuucugauauugugaagaacuccacuuucacucucauaaacaaccucagcguuacucucaugcuauuuuccgcacaucucucccucucaagaaaagcaucuuauacuaccuuugucuuuaacuucauuugcccuccaauccaugaacaacccuaaaagagcccuuaccuuagaacugcuguucugccuccagaucuaaaauguaccagcccgccauuauaccucaaucuccuugcuuccccuucagcaaaccuagcccuauccaucccaaacugcccccaaaucuguuccucccucuuaucaaagcuucuuaucaaacaaccaauccuuuucccuaaagaugaccuguucaauggccagcuguuucaguacuuuccucaauaucuuccuaucuccuuuuuuuuuucagauggggucuugcucuguagcccaggcuagaguacaaugguaugaucucagcacacuacaaccucugcuucccggguucaagcaaaucuccugccucagccuccaaagcagcugggacuacaggcguaugccaccacacccagcuaacuuuuauauuuuuaguagagacaguguuuugccauguuggcaaggcugaucucaaacuccuaaccucggaugaucugccagccucagccucccaaagugcugggauuacaggcguaagccacuccgccuagcccucccccuucuuuuuuuuuuuaacauaggaucucauucugucacccaggcuagagagcaguggcacaauaauaguggcaucauaggcuccaacuacuggacucaagugauccucucaccucagucucccaaguagcuaggaccacaggugcaugccaccacaccuggcuaacuuuuuuguagagacaaggucugcuauguuguccaggcuggucuugaacuccuagccucaagcuguccuccugccuuggccucccaaagugcugggauuacaggugugagccaccaugccuggcccaucucugacucuugccuucccuuaacacuuauuuaguaagucaacauuccugcauaugcuuucuucaaaauguugcucaaaucuauuucauucaauugccagauagaacucugggccguaucacauuaugccuaaauuauuucauugcuuuuacugguaauuccccucuuuagucuucaauuguuccuuauucuccagagaaucaagaucuagcauccuuugccugucauucuugggcucaauuagcuuuucccaacuuaauuuugguacuuaaauuacacccagcacuguucuuaaacugggucauguauucugugccaaugagaaauuagaagcuucacaauggcaagagaagugguauuaaugacagugucuuaccacugagcuauggagaaaaauguaucugcagccuuguuaugcaaggcagcagggucuaccaugacacauuaaacaaaaagauauaucuuccuucuuugaaauauccagggaaccaagccacguagcuggaggcugaugucaugcaacagacuucaauauaaauguuuagucucuuuuuuaaaaagcuauuuguuacauuagucuuuauuucccagugugaugguuuaugcuuucaagcuuggccaagucauaauagggacucaauuuauguuuguugaguuaaacuuacaauucaacaaaaguuuugaaaaacugguacuuauuuuaaauauuaaagggaugagaggacucauuauacuuaaaauugcaaaaacauuacuaguuaacuagcagcugcaccccuaccaacccuaugaagaauccaaacaugauguuuuuccagaccaaaagcuuucauaagugauguuguaaauuaaacagaaauccuaauauuacuaacauugaaaaaccaaaaaaaaucugaaagcuacaaaaggauaaggaaggcacugaagguaacacaguuaugagagaaaauagccugaggaagccugcuguucauacauaguacagagauuuaaaaauucagucuuucaccuucucccucccaauaagcaacuucgucaccacaagaaagccuccuuaccaagccuaauuuuaaguggggagaaugagcaucauuuuaaaucuguguaucucuuaaaauucugguuauacaauucauuuuaacaacuuaaugaacagguuuuaaaguuuugguuacuuggaaauguaaauucauacaaccacuauggagaacaguuuggagguuccucaaaaaacuaaaaauagagcuaccauaugauccagcaaucccacugcuggguauauacccaaaagaaaggaaaccacuaugucaaagaaauaucugcacucccauguuuguuguagcacuguucacaaaagccaagauuuggaagcaacccaagcguacaucaacagaugaauggauaaagaaaauguacauauacacaauggaguacuauucagucauaaaaaagaaagagauccugcaacaacauguugauccacacaacagcauggaugaacuggagaucauauuaagugaaauaagucaggcacagaaagacaaacaucccauguucucacucauuugugggaucuaaaaaucaaaacaauugaacucauggacauagacgguagaagaugguuaccagagacugggaaguguugggggagggggcgcugagaacaguuaaugaguacaaaaaaaacaguaagaaugaauaagaucuauuauuugacagcauaacaggguugacuauagucaguaguaacuaauuauacauuuuaaaauaacuaaaagaguguucacgggauuguuaguaacacaaaggauaaaaguucgaggggauggauaccucauugucuaugaucugauuauuucacauugcaugccuguaucaaaacaucucggccgggcgcgguggcucacgcuuauaaucccagcacuuuggcaagccgaggcgggcggaucacgaggucaggagauugagaccacggugaaaccccgucucuacugaaaauacaaaaaauuagccagguguaguggcgggcgccuguaguuccagcuacucagagaggcugaggcaggagaauggcgugaacacgggaggcggagcuugcaguaagccgagaucgccccacugcacuccagccugggcgacagagcgauacuccgucucaaaaaaaaaaaaaaaaaaaaaaaaaagucucauguaucccauaaacauauauaccuacuauguacccacaaaaauuuuaaauauauuuuuuuaaaguuuuggucacucaauaauucucuuaaaaauguuucuuucuuaccgucauauaaucaacuucuucaggaugcucaaaagcaauaaauucuucaagacucaaaccgggaccugaauccugguuagcuuuuucaaaucgcuucuuguccuuuaagugaagcuuugaaaauuaaaauuucucauuaguauaccacaucauuuuaaauacuuugaaaaauacaaacuaugugaaauuuaaaguacauucccauccguuaucucauuuaucuucacaucgucccuuugaagguaagcuacacaaauacauguauuaggggcaggauagacucacaagcucuagagucauauagacccagaccugaauuccagcaaugccacuuacuagcuguggugucagcgcaaacugcuuaaccucucugguuuccucaucuaucaaacugggauaaaaaucucuaauaagcaauugggaugagaaucccuaccacaccauuaauaaaccuuaaguauuuaguguuauauacuauuauugauagaaaagcagauugaaugauuugauaaaagucagaaauacagcuaaaaaauacugagcauggcauaguggcgcacgccuguaguuccagcaacuugggaagacugcaugagcccagaaguucaaggccagccuucacaccauagcaagacccugacucaaaaaacaaacaaaacuacugaacuuggauccucccuauucuuucuacaguacuauacugucuacuuuaauaauuaaucucaauacuuuuuugaaugcccaaaaaucaauaacuuuauaccauguauuaaaucuugguagggcuuuuaaaaaauguuucugguccucuaagugacuuuucaaaaauacauuauuguuucagaaaaacagucuucuuauguugagaaucucauaauauuaguauauguaccuaauauuuggaaaucuuuucuuuuuugggggguggggagaugaggucucacuccgucauccagguuggaguacaguggugcaaucucggcuuacugaaaccuccaccgcccagguucaagugauccucccaccccagccucccaaguaguggggaccacaggcaugugccaccacacccagcuaauuuuuuguauuuuugauagagaugggguuucacuauguugcccaggcuggucucaaacuccugagcucaggcuauccaccugccucagccucccaaaaugcugggacuacaggcaugagucaccgugcucagccuggaagucuagucuuagcaggcucuuuauaguguuaauucuguauauucagauauaaauaacaucaaaaguuuaaauggaucccauguuaagguuuaauaaacacauauccuuuucuacuuucucucccaucuucccauccaccccccuuuuuaaaaaugauucggcagcuaucagggacaaggcugcuuuugauaaaauuuucaaugguaauucuguaaccaagagccuugggagccaauaaugcuauacugcuaauccugcauaauuucuguuuugagaauuucugggaauagcuuuccuuccuauaaacugauauguauuaaacugugcauuuuuuuaaagcacaauuucaaauauuuuagaagcuuuuaaguguuucacuacugaauaaaaauacccucuucagucuucuagaauaauagaggucagguagcagucauuuaccuaaacacuaguucuuuuacaauuacugauuuacagcggagaggcucaccucuuuccccaaagaauuuguuuuauuaacaucagacucuacaagccaguuauauucacccaaucaugacagaaaagaaaaaauaauaacuuguuuccaaauagcuuuuaacuuaauguuucaaaauuuuaaauaacuagaccaaauaauuugcauuuuauguucagguuuaacaugguaaaagcagacaaacaagaauuugagguacuuugcugagucaaucaaguucuuuuugaauaaaccauuauucaaaauaccaagugcuuugauuuccuuaugaaagaacccuucacuuuggagcaaaaagguccauguuucaggagaagagcuaaauuuggccaaauuugccuauggaaagaaaggaucucuuucaacaagcugagauuucuuuaaaaaaaaaaaaagugaaggggguagcuuuuucugguucacauuucacggccauuugaagaacacaaaauaagaauagcucacauuaaaucgaagaagccaaaaacagaaagacuguuuuuuacaaauggcaaauuccuaaaaaaauaacaaaaaagauggucaguuucauaaaacuucaacacucuuuuuuuuucuuguauauaaaaacuuuguauucuaguagaggguaaaaaguguuagguacaguaauaaaaaagcuaccauaaucauuuauuuuuagauuacaacagaaacuugugaggaacaaaacugccaucuuuugguagacuaaugauucuacaugaggaaauauauaaugugugauacuagaacaaaugacuaggcauuaaaaauucugauuagccacaugcaagguuauaucuuacauaaauaaauacugcuuauacaugcacauucagcagucacgccuguaaucccagcacuuugggaggccgaggugggcagaucaccugaggucaggaguucgugaccagccuggccaacauggugaaaccccaucucuacuaaaaaauuagcugggcauaguggcacacgccuguagucccagcuacuugggaggcugaggcaggacgauugcuugaaccugggaggaagagguugcagugagccaagauugccccacugcacuccagcgugggugacagagcaagacuccgucucaaaacaaaaacaaaaacaaaaacaaagaacacuugaacuuuugccagauagauccccaaacuuuaauuauccuguguugaccauaacuguucuuuauauuauaaagaaaugcuucuucaggcauuucacagccugaaaggguuaucuuuauucccuauaugaaaacuuauuaaauauaagauaaaauucagacugggcauggugguucacgcauguaaucucagcacuuugggaggccaaggcagguggaucacuugaggucaggaguuugagaccagccugaccaacguggugaaacucagucucuacuaaaaaaaacaaaaacaaaaacaaaaaucagccagguaugguggcacgugccuauagucccagcuacucaggaggcugaggcaggagaauugcuugaaucugggaggcuaagacugcagugagccgagauugcaccacugcacuccagccugggugacagagcgacacucccucucaaaaaaaaaaaaaaaaaaaaggugaaguucagauauuaagcugacuuucgucaguuauaacagacuuucuuauagaaaacuuuauuuuauucacauauccaauuacuuuuuaugauuauuuuauuuaugguauaguguuuagucuauaacuuugagauugauucauuccucauccguuauuuuuuauuuagaaaaauaaugcauaugguuucuggguucaucuuuacacuccacaucaauuuuuaggacguuauuuuuuuuuuuuaaagggacaagguuucacuauguuguccagacuggccucaaauuccugggcucaagcaauccuccuacuucagccuccugagcagcugggacuacacauacacacaggaaguuacuuauagcaaauucuaaaaacauaugauuagaacuucaugaagauagagacauauuccuaggcugucaaaaaaaaaaauaaccaaaaggacucccauugaaguguucauuuucgggaucaaucuauuccuuuaggcuguuaagauucaucuaauucauccuuuaaaagcagaguguuauaaucaacacauucuaaguagcugguggagaacacagaauuagaaccagacaccuuuuaaaagaacuguucauaaacaauuuaugagucauguaucucuucaaagugaagauuuucuucucagcaccaucuauuacaucacccccuucuaagaauacaggaacaugcacuucuuauuuuuuaaugggauaguaauuaagucuuuugaguaacaaaaaauaaaaauagaaaacauaauuagaaucuaauuccagcaagauuuuaaaauacuguauuuaacuucucuguuguuccuaggaagggaaaccacaccacaccaugcuuugguuuuagauaaguuacauugguuuaagauaaguuaauuccuauaguaaauggggauacuuaauagacagaugaucccaaaucucauuaucacuacuuguuuuuccuuuaguauuuacaagcaguaaaaagacugauuuuuacucacuuuaguccacuguagaaugaagacccaaauaaaaagaaaacaaaagauacauuuuccccuuaaaaaauaaaauccuaacuaaucuaaagcugauaguuaacaaaugcauaaaguuuuaaaaaguugauuaaauauaaauuuaugugaacuguaaaugcuuucuucaauauucuuuuaaaucaaaacagaacugcuugccccuccaacugcuaccauuuauuaauauuuauccacacuauuauaauccuaaagaggaaauuuuuauuuauuuauuuauuuauuuauuuauuuauuuauuuauuuauuuuuagaaaugaggucucucuguugcccaggcugcaguguaguggcauaaauauggcucaccgcagccuugacugccugggcucgagcaaucuuccugccucagccucccaaauagcugggaucacaggacggaccaucaugcccaucuaauuuuuaaauuuuguuugggcauuuguuaacuagacagcuuuagauuaguuaggauuuaauuuuuaagaggaaaauguauccauagggacggggucuugccacauugcccaguuguucucgaacucugggcucaagugauucucccaccuuggcuucccaaagugcugagauuacaggugugagccaccacaccuggccugaaugggaauuauuauccucauuuuuggagaugaggaaacugaggcacaugaaaguuuaauaacuugcccaaaguuacacaaccgugaagugcuggagcuaaaugugaagcuaagcagacuggcucugaggauggagccccaaaccuccacauugaugcuguaguuauuagcagagaauuaaccaacuuagaguuagugguggcuuacagaguucaagcggccaauaugauucuaaauaaauagcacacuuagaaagcauuuaccaaggagggaaugggguguuguuuaacagguacagaguuucagcuuuccaagaugaaaagaguucuggggauuagcugcacaacacugugaauguacuuaacacuacugaaugguacacuuuaaaaugguuacaauaguaaauuuguuaugcacuccucccuccauauuugugagaaauugguuccagaaccucccacagauaccaaaacccaaggauacucaauucccugauauaaaguggcauagcauuugcauauaaccuacacauaucuucccaaauauuuuaaaucauuucuagauuacuuauaagacaaauuacaauuuaaaugaggaguaaaucauuguuacacuauauuguuuaauacaauaaauuauggccacaacaaaaauuaaaagguauauaccaaaacaggauaaguuaagaaacagaagagccuugaauauuuuccaagcacccuugacuaauauuuugggacaguuugcaacagcauguuugauuuuauuuuuauguuuuucuacacauaaaaacuaucuuaaaaaaauucuuggugauccucuaauuacccugauuugaucauuauaauauacguuugugugauaucaaaauaucacauguacucuguaaguauguauaauacaacuaucauguaccuauaaaaaagauuuuaauucuuuaaaauuagcuuugaaauacaaaaguauuugauauaucaauuucucaagcucacagucauuucuguugauauacuuuuaguuuaauagacuuccuagaaguguuaaaaaguuccuaauuccuaaauaaaauuagucuuucucagcucugcuuaagaagcauauauuucaacaaauuaaaccaugagacacauuagaacucacacagauacuaaauuuucaaaaaaugaguaauuuggggccaggugucguggcuuacaccuguaauccuagcacuuugggaggcugagguggguagaucacuugaccucaggaguuugagacuagccugggcaagaugguaaaaccccaucucuacaaaaaauacaaaaauuagaugggcgugguggcuugagccugaaaucccagcuacuucgggggcugugcugggaggacugcuugagcccaggaggcagugagccgagauuauaccacugcacuucagccugggcaacagagugagauacugucucaaaaaauaaaaauaaaaaaaaaaaaggaguaauuuuaaaggguguacucacuaugaaaaaugguacugugguuucucaaaaaauuaaaaauagaauuaccguaugaucuagcaguaucacuuccagguauauacccaaaccaauggaaagcaggaucccacagagauuugcaaaucccaaauccaagaugcuucaaugagcauuucuuuugagugucgugucagugcuccaaaaguuucauauuuaagagcauuuugauuuuggaauuagggauacucaaccuguacauacaacagaauauuacuuugccuuaaaaaggaaggaaauucugaugcaugcuacaaaauggaagaaucuugaggauucuaaguaaaaauaagccaguuacaaagacaaauacggcguaugauucuacuuagaugagguaccuagaguagccaaauucagagacagaaaguagaacagugguugccaggagcuagugggaggagggaauggggaguuauuguuuaauggguagagagucuccacucuguaagaugaaaagagucggggagauugguugcacaacaccaugaauguacuuaauauuacucaacuguacacuuuaaaaugguuacaauggucaauuuguuacacaguccucccucacacauuccugggaaauugguuccaagaccucccuaucaaaaucugagaaugcuuaagucccugauauaaaauggugcaguauuugcacauagccuacacacaucuuccugaauacuuuaaaucacggacccucaaucccuaggucgcggacggguauugguucauggccuguuaggaacugggccacauagcaagaggugaguggcaggcauuaccgucugagcucugcucugccuccuaucagaucagggguggcauuagauuuucauaggagugcaaacccuacugugaacuguacaugugagggaucuucguugcgcacuccuuaggagaaccuaaugccugcugaucugagguggaacaauuucauccuaaaaccauuccccacccccccgccacacacugucccguggaaaaauugucuuccaugaaacuggucccuggugccaaaaagguuggggaccucugcuuuaaaucaucucuagauuacuuauaauauaaauuacaacuuaaaugagaaauaaaucauuguuauacuauauuaaggaauaaucaagagaaaaaaguucuguauauguugaauagagacacaguuuuuuuuuuuuuaauacuuacuuuuuuggauacuuacgauucucaguuguuugaauccacagauguggaaaccgcaguuuuuuuaagugaguauauaaaacuauguguuuaaaaaugggaaugggccauaauggccuucuuaauaaagauaaaacugauuauucaaugauauuaaaauauugagauacucauucaaaacacauuuaaaaagcaacucuggaaaugaggacaauuaaaugaugcagccgagaaaaacagauagaaggaucauguagguaauuuagaauaagaguccuaaaucuggccagaaaggaaaccaucaaaaugacugcugaaguggaacaggugauuuccuagagaacaagacaauccagcuuaugaccucaggcccucaaugugcucauucaugcaggaagguaaagugaacugacaugaucaaaagaaacagcuugugcacaugaacucaccuuccuaaaggacuccucuucugcaucauccagagcaguguucucaucaaagucaaucacacgaucauacaucugaauguuauauucaucccaagucacaguaucaucacuguuuuuaucauauucaacaaacuguuguuuugcuucuugcauagcauaaugcuuaaaagacaucugaauccaugaacugaguucaccuaugagaauuucccagaacacaacgcaugugacguuaauucugauacuuaagaguaaggauuuccaaaccuucucugaaaaggcaaaaucuuugauguuugcaaauacugagaauuggccuaguuguauuaauagaaaugggguaggaagugggaaaggcuguuuagaagagcucaugaagcuuuuaauuauuuuuuuuugagauggagucucgcucuuucacccaugcuggagugugcaguggugcgaucucagcucacugcaaccucugccucccgguucaaacgauucuccugccucagccuccugaguaguuggaacuacaggcaugugccaccacacccggcuaauuuuuuguauuuuuaguagagacgggguuucaccauguuggccaggcuggucucuaacuccugaccucgugauccaccugccucggccucccaaacugcugggauuacaggcgugagccaccaugccuggccggagcuuccauacuauaacauaugaucuaaauauaauguaagcuccauaaaaguuuggguauguucuguucacugauguacaucaaaugccuggaaaguuccuggcucuguaaguauuuguugaaugaauuaccaacuggccaaaauagcacuuuacuuuuaaaaaaaauguuauccaaaaucuugcagaaaaccuuugcuaacuaccacagaucucucaggaagcauaaauauuuugauagcuauuuauuuuaguauguaugagaaaaaacaguguuuuuuauuuaugaaggugacauaaagucuuccuuuaaaauaaauuuuaugugaguugaauuaaaacuauaguaagaaaauaauagaugguuaaguagauauggccuaaauucugaaaagguauucaagugacugagaauacugcuucaguauauuaccuuuaaauauguuguuaaaacaucuggaguaaauuuuaacgaaguuauggguagcaauuuaugcccuuccugcaacagcuaucugucuuaacuugguaccugaaggcaugggaaaguuucuaaaauucaaauguucacuuuucaaucaacuuuuaaaaaaucuauuuggcugggcucaguggcucacgccuguaaucccagcacuuugggaggcugaggcaggcggaucaccuaaggucaggauuucgagaccagccuggucucggguaaaaccccgucucuacuaaaaauacaaaaauuagccgggcaugguggccagugccuguaaucccagcuacuugggaggcugagacagaagaaucacuugaaccuggguggcagaggcuguagugagccaagaucacacuacugcacgccaacaugggugacaagagcgagacucugccucaaaaaaaaaaacaaaaaacuauucauaaaaauauuuacuaaacuacguuaaaggaaacaaagggagggacgaacacgaauauuugugaggacagcaugaguauaccauuuaucagguuccucuguacauguugccucuaaucuucaaaacaaugcaauuauaaucaucacuauuauacaggugaggaaacugagguucagaaaaguccaagccuucacaacuaguaaauagcagaguccagauucaaaccugucuggcuucaaagccaacuccuacugaguuuugcuaccucuuaacaucugauuccagaccuggcccucaaagagcaaauugccaaaauuaucuuaaggguccucaaguagaaugaaggcuuucguaagcaccaugaaucuuucuucuaguuuauuuaaagagaucaccauggcauagaagaaaacagaauggaacagggaucagaaauguggguucacacuucagcuuugccaucaggggguaguuuaccaucucaagcuuuucuucucaucuguauaaugaauauuuggacuaaaacuuuucuaaguuuaaacuucuuaaaaccuuacuauuaaauauuugaacauaucuaggucuugacagauagguaccacgcagucuuccaaaucaacguguuguguucuuugauuacucuaguauaaccaaagauugacuuauucuuagauuggauaaucagagaccaaaggucuuguuauuauugucuaacuaaguggaagaaaaaagcccuuaaucuuccagaggguuccaaugugaauaugucauugacagcacaucuuaaauuuaccaguuuuuaauugucuccagcaacuuaauuccuugauggugaacagcauuuaaaugagaguuacagaaaaacagcuaacuuaagagucacaauaacaaccugaauuuuucugaggacccacuuggaacgcugacagggaacaucauuugaauugaacaauggggagagacaacugcacagcaauuuauuuagaacauucuuuuaauagucugugcauuucauuucugacuagagaauuuaccugagagcaucagauuuuuuuuuuuaacugaaggauauuaaaaccugaauuaagagcaggauaccuggauucuaguccagcuuugccacuuauuuguagaaggcacuuaucccugugcuucauuucuucaucucuacaaagugauguggacaagaugaucccaaggccccuaccagcucuaacauuuugguauaauguuauaauaaacguaauucacaggcaacaggucuuuuucuacuugcuuaaaaaaagaagcaaauuccuaaaauuuaaaugaagcauauaucaaaagagcgauaaaucauuuacugccuuaaaguuuuggggcauauuucucuaaaauaaaucauauuguugacacuaacaaaagucacgugagaaagagggugucucaaggugugacuuccacauagaguacagggucaaugauguuuauauauaacuggagaaagcaccgaguuuuacuugguucucagugucuaaagauuuguaaguauaaagccuauucuccauguccuuuucuccuucucacaggacuuccaacuugggacacuagcaaucuauacauucagcagacaccgcugcuuaacauauuuguguuugucuccauuguuagucguguagggcaguccuuacuuucagugagaaagccaucugaguccaagucgauuuucuuuaugaucgccugcagucuuuuuugcugcucuucguggccgaguuuaacauauucauccacaucuuccuuuagggggaagcgacacacaggagggccaagcauuacuaucaguggggcaaaaugguggagaaaaacagggcuacuagaagacccccuugccaaaggguuucggggugacccgcaccugcacuucaaggccccuacccccuacacacccuccaugaucugagggguagaagggauccagcucuugggccgugcuaucuccucaggcuuuccaggccccaggacccccagagagcgagugccgcgccgcccggcccccauugucaggccgccccugccaggccucgcccggccgccccccuuugucccgggacaaagcccgcggcagccgcggugcgaggcccggcccucccagcaccggccuggccgccucaccuggacgcccagcagcgccucgcggucguagucgcugcggcgcucgcccagcggguagugcagcuccucggccuugccggcgccggccgcggcggcgcacagcagcagcagccccaacgccgcgguccucgggcccagccgcaucgcgccggcccgcggaggacaccgagggacgcgaggagggaggcuggcgggggcccgggccggcugcgaugcuccgcgggcggcuacagagaggcggugcgacguacguugagggcggagggaacgggaggcggaaccugcgguggcggccacaacgcccauggacgggcugggggccgguccaccaaugcggugcggaggcgcgccaggaggaggccua

SEQ ID NO: 16008 - RNA, 11258 nt, Homo sapiens
aucagcugcccgccugcugccuucagagugcaaaacugauucagcuucuguugaccugguagggcugguuggcuugguccaguuggugaaaugccucugcaaaagguuaccugcaugguaaggagaagaaguagagcguggcgggggaaagggagcugguggcucacuuugggggcuagucacuaauuuggagggagagggggugacuggcuuuauggaugggucuuucuguacuuuggugguaggacugucuguggucugaggugcuucagccucaccacuaggcugagauguaaagagagauuugggccggacuggcguacucuuaggugugcucuuagcaacaucagcaucuggaggaauggcauaaagcucuuccacacugcaagcuuuagggccagauugagguguuucuggaggagacuguggggguuggauugaagccacaaucugagaaagcacugugcuugcuuucucucuggugcugcugcugcccaccaucugagacuccugagugccuucuauuuuggccacaggcucuugaguggcucucuggaucuuugcuggggagcuguggcuggaacuauagcuucucuguggugaagacugaccucuguugagacaguuguuaaacucuugaaccuucugagccacugagccccuuuuaugcucugugcuguuugaaaacccuuuaguuugaagacagucagugguuuugcuagugguguuaucaggcacuuugcuuucuguuucuauuucuucauaaguauggcuuauuacacuugugguuuuuuccuucacugagaguucuccacuuguucccagaaaacuuuuguagauagcuagauugucauaugcauuuggauugauaacaaugggaacuuugauagcauuuuuggaacuccgagcauaaguuggcucgucaugaaugauaauuggaaaagguggcauaccagcauuguuauaacuauuaaauuuaauuucagacaaauuaggugacuuaacagggaugguuuuggaggaaauguuuguagcugugggugauguaggugcugauuugugacaguuuuuccuuggaggaacauuugguccaguuccacuaguaauuaguucuacuuuagguaucuuuugucguggacuggugcuagaaguccauacuucuugguaucgaauugcacuggauuuuuggaaaugggcacuuauuuguccuggugucaaugaagaugauguaacuggagaguuuggaguagaggaugagcuuuuugucuuggggcuguuaacagggcccucgaggugcucacuggccauggcugcugacacauccacgacaguauauggcuugcacaauggcuguuccagguucacaacucgguaagguuuugcuugcucuucuguggggacaagguuuaugguuacugcuugcccagcaacaucuguagaggcuuuacuuucuuccuucucaguuuguacagcaaucuugccaucuuucucuucuaaucggagagcaaggacugcuuugugggucucuggaacuuuuauugagcuuuuggaagccugugaugaaucuuuauccugauuauuacuagagggacuuucauaauugggcucaauuuccuucauguccuuagaaucuccuggguuaccaggagauaaucccccauuacaaaucuucugggauaaacuacuggcugucucagaacgugauucuucuguuaaagaagaaucuggugauguggagucagaugacaccaugcucugaaugcuuccuuguccauaagagaccacagaauuuuccucauaaccauucaggauuucaucauagcugucaucauaguccacagcacagauucucugcagagacuuguuucgcagggggaugguauuccauuuuuuguccacaaagaaucgaacaggagacaauguguuugcucugaaguuggcaaagcgagguugcccucucaugcgaaucuccauggccaacagcucuucaucacucucaucccaacucucgugcuccuccuccauguuacugaaaaguacauccucuucacucuccucgccacuggaaaacucuggguaacagaaccggcccccuucauuacuaaucacuucugugcucccacucagaauaacaugcuugcccugaguuuccuuuaucccaccuaucaugcaacuugguggaagcuuucuuuccaaugaucguuuauagcaaucauuuauucuucccaagaauguuucucuggaguuuguuucauuuccucuuaucugaggggcaguauccaagccugcuaucuccuuuaacacuucaguuaguccauuauuguuaucugacaucuucuuugcacuaucauuauugccauaaggcuuaggaacauggcuaauuccuucaucaucuucauuauuauuguuaagugguuucugacucaaggcagcucuguuucgguuccacccuaugaugacagguuuguucucacaguguucuuggaugcuaagcucaccacauauacuuugcccaucugccacuaucauagugggcuucacagcuauaguggguuuuuuagccacaggaggccggaaauugcccguguuccugaugcggugguuguuacugugauuggcauuaguuuucacauugccaugggugaugggugccuucucagggucugggggaagcuggugcaaacuuuuagguuuaaagcaauucuugcauucaccagguuuccaaacauguucaguaaagguguuacaagcagacauuuuuaaaaauagaacuucacagacaaugcuuuucuuucagugcaugacaaaacuuucaucuguuaguuuucacuuccccuauguguuacagcagcucuucuaagaaugaucaaucuguggaggggaaaagaagacaaaaaaucugaaugaaaaaggcacuaugagacuuaccauuauuagugacuugaaaaaacugacuccauuccuaaacuuuuccuuaaauuaaaagacugagagcuaaacuaauuuguguacuuuguaauuucccuuuagccaaucagcauuuggaaagugagcuuuuuaacuauaauuuuaugcacucuuaucuauccauacauaaucuucagcuugaugucucuguugcaaugauucugugaccuucccucccagaaaugccuuugauaccacuccuucuguuauccaccaauuucucuaacacuucccagcccauuauagauuccucuucuuccaccuacccuugaauguuuuagacauuucguagacuccucaaacucaaugcauugaaaaugaagcuucggggcugggugcaguggcucaugccuguaaucucagcauguugggaggcaggccaaggugggaagaucccuugagcccaggaguucaagaccagccuggcuaacaugauaaaaucccaucucuaaaaaaaauauaaaaauuagcugggugugguagcacacaccuauaguuccagauacucaggaagcugaggcaggaggauuguuugagccugggagguggagguugcagugagcagauugugccacaguacuucagccugggugacagagugagaccuugucucaaaaaaaaaaaaaaaaaaaaggcugaaaaggagaccaggggccagaucaugcaaggccuuuuaggcuuuuaaagauuauagaguuuauccuaagagcagugggaagccacugaagggucuugaauaggggaaacaacauaauccaauuugcauuuuaaaaagacagcucugaccaaaacccaugaaauucuuacguauauaaguccaacaaaauauguguaaaaucuagaaucuauaugagcaaaacuauaaaacacugauagaugaaggggggaagaagggggaaagguaagcaaauuauagcccagaggccaaauguagcuuauuccuguuuuuguaucccaagguuaaggaugcuuuuuauguuuuuaaaugguuggaaacaaaucaaaacgagaauaauguucugcaacaagugaaaauuauaugaaauucuaaauucaguacccacaaauaaagcuccauuggaacgccagucacacucauuuguuuacauacucauuugccuaugguggcuucugugcuacaauggagagaugaguagcuaugaaaugugugacacacagacuguaugcuucacuuuuacugcuuuguggcacucuacaaauugcaggauuuccacuggugcaucuaucagcugugugaaauuacauuuuucaaagauaauacauaaaauuauaaaauaaaauuaugaaauacguaaaauuucauuacagauaugaauuaauagaugaacauuuguaaucaauuuugaugagaggaaguacuaacuuugaacccccaucaagcacaauguuauccuccccaaaauggaauuucauucuucucacuagcaaaccucuguuauaaaauauuguaccuaaauauauuuugccuuuuaucaaaaacauuugccaaaaaaaaaaugacaagagaaugaagacaaaccccagaguaggagaaauuaugugaaacauucauaucugacaaaggacuuuguauuuggaauauauaaagaacuuucaaaacucaacaaaaagaaaaacccaauaaaaaacagguaaaagauuugagcagacacuuaaccaaauauauaugauuuuugaucuuuuuuuuugagacaggaucucacucugucacccagucugguguguagugguaugaucacagcucacugcagccucaaccucccuggcucaaucaagccucucaccucagccucuggaguagcugggacuaugggcacaugccacuaugccuggcuaauuuuucuauuuuuuuuauagagaugggguuucuccauguuguccaggguggucucaaacucuugggcucaagggacccagcugccucggccuccccaaaauguugagauuacaggcaugagacacugugcccagccaaagauacauggauugcauuuaaacaauauaaaaauuguaaauauaauuuacaauauuuauaauauuguaguaaauaaaauuuauaauauuguaaauauaauuagccacauggaagugcaaauuaaaacuacaaugugcuaccacuacacauuuauuagaaugguuaaaauaaaauuaaaacaaaaacaacugaugcuagcgaggaugugaagcaauugaaacucauauauugcuggugggaauguaaaugguucagguauucugaaaaacaguuuugcaguuucuuauagaguuaaucauaaacuuaccuuggagcccagcaaucccacuccuagguauuuacccaagauaaauaaaaacuuuuguuuacacuaaaaccaauacacaaagguuuacagccaaaagcuggaaacaaucuaaauguuagguggcagugguuacauaacugcauacauuugucaaaacucacagaaccggcagguaggcugggcgcgguagcucaugccuguaaucccagcacugugggaggcugaggcggguggaucacuugaggccaggaguuugagacuagccuggccaacauggugaaauccugucucuaccaaaaauacaaaaauuagccaggcauggugguguaugcccguaaucuuagcuacucaggaggcugaggcaugagaauugcuugaaccuggguggcggagguugcagugagccgagguugcauugugccacugcaccacagucuaagacaaacaaacaacucauagaacuacgcacuuaaaaaaagugaauuuuacuacauguaaauuuaccuucaauaaaccugacuuuaaaaagacagcucugcugcuauguagaaaauggacucgggaagaacaggacaggaggcuuaaaagacugacauaggcaaacuaagaucugaugaggaucuggauuaggauguggugucagggaaggcagagaaagaugcaggaaugacuggauuuugaagaguaaaaaguauugagguuuuagguuuauguauucaaaugauuauggagccauuuacugagaugacaacauuggaggaggugcaacuuuugaagggaagacuaugaguccauauuuugucacccugcauacaagacaguauaugaauuuaggagucugaaacauggaugagaauucugugguucuccucugcuuaggaauuacuaguauagagauauuuaggccgaaaagaaaauagugagcugaggagguggccuuggugggugaaccagggagaaggggcuacuuccucuccccuaacugaaaacuaacagccaaggugugaugacacagaagccagaugaggaaaugucaugaaggagaaagacaauaacuauuucaaaugcugcugagagguaacggaaaaugaggacuuacauacaugcccauuggacuuggcaacaugagcucaucugugaccuuagcaugaacuauuugguucagugguggggauggaaaccagacugcagugaguugaagagugagauaauagagcaaugguagauaacuuuuggagaagaguaggcaggaaggagaagcaagaaggagcuaggaggauggggguccagaaaggauuuccuuauuuuaagaugggaaaaccuagauaauguugaaugguaauauuggggaaagauacaggccagggugagaggcugaaaaaacaggaaagaggaaagaaucacaauacuuagaauguuaaaacugugcagguuucuaauucaacuguguuuuauggacaaaggaaucgaagccuagaagagacagugacuuuccuaaggacacacaguaaauaagaaagacccagaacugggacucaaggcuacaacuaccuacaauauguuuuguuuuuaccuuuuuugguagauguuuuuuucuuuuguuguauaugcucacuguggaaacucagaaaagcauaaagaaaauagaaaccauauguaaacuuauuauucagaaguaacuuuuauuaacaguuugggggcaguuccugucagucaccaagaauuuaaauuaaaaaauucccuguguacuuagcacuaugcagcacugaauacaaaaaagaauaaggcaucuuggcauaauaucuuguuaaccaaguuaaacagacucugauaagagugggauuaaguuuucucuuuguaaguaguacaauauauuugcuuuuucaaagacuaguagauaauaguaaaaauaauuccccacuuugaguaaaaguaaguuaauucagucaaaagauggcuaagcugauuaacagcuaucacuuaucaacagaauagccaaaugagacucaccaggaacaccauuugcuuaugucaguguugugugcacuaggaacccauguugcauaugacauucguuuacaaguuuguguccaucuguauucaucugguuuaaaaccgagacacuuauacauauguaacaaaccugcacauugugcacauguacccuaaaacuuaaaguauaauaauaaaaaacaaaaaacaaaaaaaccgagacaugaaccaggcaaacaccuuuagcaagcaccagauggagcugcugucuaagccacaaaaccuuaaccacgagggcuucauuuuaaacacuaauuauauuuggagacaaagaggugcacuuaaagacacugucaaaacuauuuuaaccuacaacagucucauagagggggaaucuguaccagaugcaggucuguccaaagagcaauccuuggguuuuacagccuuugugaaaugacuucaguggcaaucaauaacuagcagcuuucccugcucaacaccaacgcuccccaaaugggaaacuccagucuccaaaguuaugcuugagaaauaagaaaugugucuccugaggcacuuacacaaggaaauaaaacagucuauccuggugucuucuauuuauuugccagaacaggucugauacagagcacccaaauggaauguuugauaagaaaagcucauuuaccuccacauuccuuauaaucucaaagcaaaucuucuagaugaaauagucuaugggagaguuuaauggcugaagcugccccuaggagguagccaggauuccaugaucuaaaauccuauuucauauuugacaguuuucaggaccaaagcccuucaggcuauagauuaagcuauucaagaguggccuauuucacuucaagucaugacagcuuuuuaagaaccuauuacuguuuuuuauucucucuacugccauacaaugacaauaauuaguuugcuucuaguccaacaguuucaggcagauuugauaccaaaaaaaaaccccacaaaaauacaaaaaaacaacaaacaaauccacaauggauuucaaucuugaaauaaacuggccagcagaaagagcuggagcuccucaagcuggauucaauuuccauuagugaagaaaaggaaaguguguaggugggagauuaaacaccauauauacagcauuuccuaaaggcacccaaggagaaucuguuaauaauaaaggaggauggagaaugaacugcuaagcuccuccaauucugugacucccgaagcccaccaucucucuccauaaaaucugucacauugccauggaggcagagucaagaauccucacugcuguacgugggcuuuuaaggacacucucagugaggaucuauugccuauaugucaucccacauauuaguccaucuccaggaugcuagggaacaauuuacaagucaagguucucacuaggcuuuuguuaaagaacaugugggucacuuaaaaaaaaggaaaggaaaaugugacaaccauacccacgucacuguucccaaccuuuccuucuuccacagugaaaaaugcugaccugacaccucaaccagcugccaaacucuucaguauaugacuaaaaggguggggagaggaagugaaagcaaagcugcaggaagaaguuuugcagaagauaaaacacagcuuaaauuugguacacaaauggaaauuccaugaguaaaagggacuuucuugagaucugacugaaaaaaaaaauuaucauuccuugcuaucacaagaacaugagguucuccuaucuaaagaagaaaccaaaguaaaaucugcuuaauuuuggaaacuuaaugaaaucuccagaagcccauccaguuccaauuguucuaaccacaacaguuuuucuaacaguucacugcuccugucacaugguagucaucucaggauaagaaucauguaacaacaaaugcaccccugcaaagcagcaccgcucaguuccaacuaauuuuuaaauucaaacucuuugacgaaucaguuaacuacuacuaauaauaauuauuauaaacuugguaauaacuaguuauaagauuagaaguuccaaaauguucccugaaaccacuuuagaccccuauuuaagaagguauacaucagagaagaaguuaaaguauuaucuaauaacagccaagacuccauagucuuuuauaguuuuauuuuauucacaagcuuuuucuucugcuuggaauguauuuccucuaaugcuguuccauuuguugaaacccuauuuauccuucaagaugcaguuuaaauuuuaccucugugaugaaguuuugccuaacucgauuauaccacauuguuuuguaauuauguaaguccccagaaggcaggucuaaguguuuuuccucucuauaucucuugaauuguuuggaauacauuggauacuaaauaaauguuuucacucaagaauaauucuaguuagcauuuacuacuaaguaccaggcccuuuacccauaaaaacucauaauucggccaggugcgguggcucaagccuguaaucccaacacuacauuuugggaggccaaggcgggcagaucaccugaagucaggaguuugagaccagccuggccaacauggugaaacucuguccauacuaaaaauacaaaaauuagccaggcgugguggugcgcgccuguagucccagcuacucagaaagcugaggcaggagaaucacuugaaccugggagggggagguugcagugagccgagaucgcgccacugcacuccagccuaggcaacagagcgagacucuaucucaaaaaaacaaaacaaaacaaacaccucauaauucucacaaaacucuaugauagacauacuauuauuugcccuacuuuacugaugaagaaacugaaacuugcccaaggucacauagcuaguaaauggcagagccaggaugaaugcaugcaugcacguaugcaugcauaaaugguauagcuucauggcaucuggaggcugcuuuaaacauaaacauggcagugucugaaagacaguccacacagcagcagcagcagcagcagcacuguccaccauaguggaauuccaccaugaaugaagaaguguaagaaauaggcacacccacaccuuccccuccucagcucuaagaugaucaguccaggugcucacugcagaauaagccagaaggaaacaaacaggcauaaacuuagcuaguaggcugucucaaaguuguguuuuuuguguuucagaguguugaggaaguaauauuacgaggcaaauuaagcaugaucuuucauccagcucuccaagucaggaaccacucugauuuggaggggccacugaaguggcugguugagagugaguuggugagauguugcuaucagucaccuugcucuguuccucuucuccauugcccucaaccucagagccaacugccaagugaagaaagcuggacugcaggcuaaauuagggagucacagcugauugagaugugagaagacagggaauaagaaagagacuaaauaagggcagagcaaaauucaaauaagagaaggugggaaaaaggaaauugggaaggaaggagaaauaagaaaauaguuaaugauucuaagaaaaauccugcuugaauguuuauagccacauaaucagagugagcaaugucauuuucuaccacucuucacucauuuuuggaggcuuuauugucuuguguuacuuuauguuuggcaggaggcauuauuuuuccaauuaaaagaaauuuuaccuuucccagcuauagaaaagagugaacaauacauacuguaaaacauuuauaauuuagacuuuuaaagggaaaaaguacuucuaaauuaaugaaagucugaauuacacaauacuuugaagaaguauagauuuauugcuuuugaggaaauaccauaauaaacuagucuuuccuagugcagauauuuggaccuguucuaauaaauaaguuggaauuauuuucuuaaugguuguaaauacauaacuuaaaaugcagucaaagaauacuucuca

SEQ ID NO: 16009 - RNA, 8284 nt, Homo sapiens
gcugcagggagcugaaacacaagguguguuggcucccggcaggggcugccauuuugggguagucaagcucagcuaagcucaaguugauaaaugaaggagaagaggggacaagaaggagaagggaacagacauucagagggaagagagaggagagacucugcagcuccagguggagauagacacagauaggugguuuucaguuugggagagggaggccugggcaguucauucugcaacugugcuuccuaaaauuucucuguaaccuuauauucaaagggcacuuuguuugagaaggacagaaauccacugaaacuggccuuaagacagagacugacaccaggacugaggugaccagaaauagacccucagauaagauguagaguuagcugggaaagaaugaaggggggagucugugauccgugguaugugauagcaaagccgcuaauuaugccgugccccauagguguuggguccuagaccucgggaccugcuggaagccagacucaggggaccacagagaaaagcagaaucagcgacucccccuagccuagcucugccccuccucacauccucugugaccugcagacuuggcucucgguagcccccaggcucaccuuucccagccccgcugcagagaaaaacucauagugacaugcuccgguuccaaguucaacuauccuagggaagggcucuguuuagcagcacuugaggcaggugccaauuccuuguccacgcauagcaacaaggagaugugggugugauugacccagcuugggucagguucccuccccuagaccaggccauguccaggguaguggguuucauaagaagacagcaguuucuauucauguuguaugauuugggguggcagggcaaggaacaccucacauaaacaggggcccuucugugcagacacacacaaaaacguccacucuucuuuggcacagacaucuggggaggucaggccugcuccuaccaccuauugcucucagaaaaagcggaggggccugguuggccucuguugaugacaauuguguaguguuggcuaaaaacuuagcauccucccuguucggcuacccagaaguuuucauugcacuugggcugacuuccucccaugaucuuauggcagguguguugauagguaaagcuaccacuuagcccaguguuccccagcuuacuuggugacaagacucaccagggguccuucucagacauuuugauucacaagagcuggacuacgucuaggaaucagaauucugacuuuaucuucgcuugugacuggccaggaaacccugauuuaggccauggaggguaaaccucucaccuggccugaaauaagaccaaacuagaggaaugaaugccauuuggggcauggacucaguuaccaggaggucuuuaaagcaguggucuguacccuggcagcugcaccauagaaucacccggggagaucuugaaacgcuuauuacccaggcagcacccugcaccaaugaaaucagaaucuucgggaguuagauauccguauguuuuaaagcuccccuggugauuacaacauucagccaggauugaggaccacugguuuagggaaagccaucauuuucacucuacccacacuccuacugcaagauccggccucucccacaacauggaaaagauggcuuuccugaccuucugguccugcuucagcuaauuggaccaaggguggacacccgaccuaauccuggcccauuguaguuucucuugggaauuuggaauugaacacagaggcuaaguugcuccagggagcugaggcugucaucuuaggguaacugugcucaguuagacaccuugggcagaagaggaagccacuccuucugcagagagggacaggugaccugagccgaugugcagccagaagcugagccaaggggagagagagggagugcauccccaacccccaggcuggucugggcuucccugagacucuauccuuacagaaaccucccuguuagaggaugucuucaaacacuguuccuugcagccaaauaguuuuggauacagaacacugaaagcuaaaacuugucccagcccagagccccacacugcauucccuggagggcccagcacagggcagcagcuggcaccuauugggaacauccacaagucaggugcuuuccaugggcauuguguacaaguuucccaacaacgcuguaaggugggaaugauuguccccuuuuguagagaagugugguaacgugccccgggguaucuggcugguuagugcagagcagagacauaaaccuggguaugccaaaucacuuccaauggaucucacuggaaaccaauuaugcaaaacagaguagaguggagguccugcugcaguaagggaguagggggcugcugcuugccuguccccagaguggggaccaggugugagaggaaggcagggcugcccauugaggacagcuccacuugggcccaggcccugagagaugcugcugaagaggcagggcccacaguccacacacacggcgugcuuggaagcugagacagggagcuaugauuacucacauuguuacugucgcugucauccaggcuaaagagcauuuggugaaccacagggccugcuccucugccauccggcaugguuucucauaaugccagggacugguaucccugaucacaauuuucaaauguguauuguuugagugauccccucuuuggaaucugucucccucucagacugugagcucccugagggcaggagcuuugccuaccuuguuccucauaauauucccaugccuagccagugacuaaugaaaguagguguucaaugaauaagugggaaggaggaagggagacaguguuccagagcaagaaucauuacaucaucuuauagauggggaaaggaaaacucagggaggggaaacugaugggggucacagagaaugacagcugaucugugcuagaaccuggcccagagucaggagaaaggaaccagagagaaaaguaggagugagauucuaagaugggugagguaugagcaaucugggauaaauguauagauacagacuggguguggaaugaaggagcggugaggacacccucagcaaagccccuuccugcagcugagaccacacucuggugaggaacagccucccauuccagugggagcaggaggaaugaacagugauggcucucucugaggcccguagcggcaguacaugggccacgagcuggagauugcaaaaggccugcagggucucagcacagggccuguuagaaaucaugcuugcccauaauauuccuacagagagagacagauaagcuuguccauccaguguggucaaagacaguuaugacugguggucaccacagacucuaacuuucuaccccaaugagacaagucucccuuuuggacagggcaccugguguuggaaugggucuggcuguguggcaaggacaugcccugcuugcccuucaccgugagucaccuggucuaggggcccacgaccguucugaauguucugaaugaagucuggggacuggaagcugagugaggaauuccccggaauaauaacaguagaagccaacauuuauuggucacuugcucugcaccagacacugcgaugagugcuuugcgggaacgaucucacuuacuccuuacauguuacgugggcaacuugcccaaaguuacacagcugguagguugcagagccaggauuuggacccaggucaucuggcuccagaccccaugcuguuaaagccgugcacuuagcugcuuugaccagccuccaccucaacauaugccuuguguuucaacaugaucaaaaacucaaggacugguagugccuaguccccauuuacacaggcccuaaaccaggggacugauuuugaauauguguguguguguguccuaugccaugagcugcaguuugccagaaaaaaagugagcguguguguaugugugcgcgugugugagaugggggagaaaggguagggaacuuuccgagcagagggaggaacacauggugaggccuggagggaaaggagcuugggcaucuggggaagagaaaggaggucaauguaaucucuucagaauccugcgaaggugacaggauugagucacagaggcuuccuggaggcugagccagguccccuggcagccacacaguucaccucuggccaggaugcgcaccuguccccggcccauccacagggaagggcaucucugggauucauuuugggcucauuaucaggcgccucugagguaccccugccacuccugcccucagccuagccccauucuaacccuuugagaaugagggucgagggcacaagggucgcgaguggugcgggaggugggacagggguccuguggccacgccccucccuggccccucccaucucguagccuggcagcuccagcuggucgccuaggagacagugcccggcgcgcucucauuggccagccgaggcuccgagggcaggagcgaggcuuccgggggcugccccccugcaaguccgugugugugugugugugugugugugugugugugugugugugugugugugugugucugugucuguuugagggggaggugagcacugagcccaggggccagccuggccgcgcugugauuccaggaaggagagaggccgcggcauggagacgggcaugcgagcgugucugcgccucugugugugugcaggaggggcugcucugugggucuaugcauucgugugaaugcaagggcgagagugucgcguguaaguguuccaauguaacagcuauuuaucugguguguauugaugguuugugcuuguaugggugccugugaaaagguuuuguguggacccgaauugcugccuggcuuugugggagaauaugugaggcuguacauaugugagcuccuccgugugcccacuugugcuugccugcacacaaggggcauugugugugugagcauagaggugugcauacucauccuaaagaacaagccuuggccucugucuccucuguucccacaccucaaaucuuuccuccuuagauucugagaugugucccucucaugcucaagcacccaccauagcuccccauugccuggguggugugcuacagaacacccugccucagcuucccuaaccacccacacucauccuacacuccacaugagcagcaagagccagaaggagggggcaauucugucucuggcauaggggagucuucaagggcaaggagggaauauucaaagcagauuuuccucguccuaagccagggaacuggagcugagggccuggggacaccugcaaagcuggugccugccuuucaucuccucucucuacaugaaugguuacuaucccuucgcccccacugccugugggacacuaggcuccauggcuucagggugcuccuggggugugguccuugucuucccguaaaaguguuuggagagcuuucuauuguggggguugggcuggaggucagcuggagggcacagcugggaccugggaacccaucacaggcuguccuggccccugcagcuuuuugccuccacacagaacaauuccccaucuaccccacacuuccagcagucccuccugccucuggaugacccugggagcccgucaaccuuccagcgucccugucccuuccagcugcccugcaggagaaagggaacaacuguccuccuggcuccuggccagccaggugccagccaguggucaggcaguccugcuucacgcuucuggccgcagggcuucgccacagucccuacuucccagcuaggggcucugccuggacucaccaugggcagaggaccuuguuauuccccagagaccgucuugucugguugggaucucagagcccguuguacccaacucuggcuguacagagagggaaagugaggcagaggggcgaggacuccccccagguggucgacguuggcaggcugccugagaaggacacaggaagacuccagaaaggugaccucuggguggaggggagugacuguucugauggcaaggauccugggggcuuuggacauccuggcucuggacugagcugcgcuugggaaaugggcaagaggugguccugggguggccaggguggggcaggcggaugggucagcagaccccuugcucuguuccaggagacugcauggcguggagggagggauuuaugggcccagguauagggcugggccauaaaggucauucugcuagagaggcugugacuccgccucacuuuggcaguggcgugggggcagggaagucagauaggggacaccacugaggccuggggugaacccugaagcuggaagaaugugagauaccuaguguaggcuucuccuaggcccuugggaggggucaguccagagaugcucagggucuuauacaaggucacaccaccuccuggcacagggcuguggacagagcccaggaaaacagaugccuuaaaagcuucccccagccccagcucugggugcugcggaggggcagcugcauaccuccucccauccaggucugcucccugcgcccuuggaguguccugcaagaggucuggcagucaacgggggaacgaggcuuucccgagccggcucucuccucuuuacgacaccauauuuuuuaaugagcuauguaaaugucugcaagucagacagcaaaggcaggaagucagagccuccagcugccgcccccgccccugggaaugggugucccccuggggccagucugaccuuguguuucccauaggaagguuuucuggaugccauggaaauggccaccucccaauucagcugagucagaacuggugcuauugccgacugacuuguuuugugaccuuaggccugucacaaaaugcuguaccucaguuuccccucacuguaccucaguuuccucauuuacagaaugugcgcacacaaagggcauuuugugguuucugaggcuccauggcuuagccaugcaacuugggcaguggcugggccucucugagguuugugguucucaucagcagaacagggagccggccaugcugaccgcugccuuugggcugagcuuggaccgcaggaaccaggagggaugcaucacgggcagggcccgccuauccucucucuugccuggcuuucucuuucuucugccuccagcuuccuccuccucuguuccuccggaacauccugccaccccagccacaggauuggcugucuacguggcugugucacaguccagaccgggagugagggggcguaggcaguggguguacagggagagccagaccuugggucccugcuggggucacauauagggcauggagaggccuccuggguuggccugaaggcugggguaggaaggagcuggggccgagcacuggggcaucccucagucuccguggccccuucucagacaccagcacugucacuuggcaggaugacagggccugggcuggggccacaggacgagccauaauaggcuuaaggggagacuguaaaucccuuuccaggcugagcaaucagcuccuucaggcaggcagaggcuggagcucccgggggagggcccuguacuccuagggaugugucaugugguugcuguucuuagacuccugccccauggucccuaguggcccagcagggaccaggccaggccuagcgugccagucccucagagcaggcugcggggccugggucucagggccccacagggaugccagguggguugggggccaggaugggggaauugacuggcagaagcuuagagcacgcccccgccaccaugugcucacccauccaggccacagcacacccuccucccccaacuuccacaaagaaaggaggccgugccugcuucacagaugagaagccugagucuggagugguucgggcccaauguggggcuuuguuucagggaaguauugaugcccuaagugugaauccugacgucagcaccuagcugguggugggccgcagauagucacuucucaguauucucaucugaaagggagccuguaagccccuccuccugggaugaugaaauaagagaaggcacauagagcaucuggccuggggccuggcacaaacccucaaugaacaguagcuauugugauuauugccauacuucccccguacccucacuauggaaagggacucagacugcacagcaaacuuggguucagguccuggcuuuuuccuuaccagcuguagaucacugggacagucaccaucucucucuaagcccccuacuccugagcaaaccauacagggcugugcaccugugagugguuccucaaaggaauaaggcaccacagaggucccug

SEQ ID NO: 16010 - RNA, 2867 nt, Homo sapiens
uacagagaggcauggcaugaauaaugaccaggcccacucuacggccagagcaguaguagcugggggccuggggcagggaccaggaacaagaccaguuggacagcuagcuccaggagguagcuccucuaccaggggcugguggcuggcugcuuuccaccacagaggcugggucagugccccaauaaaugccugcccagggccgcucugcuguuuccagccaucuucaugggccagucauggagaacuuuggcaguguuccagaucuaaucaucacaccagguccagccgagagacugagaguggcccacauggaauucgaggaggcagugggcauuucccacccacuuccucugaaaccccugguuuccuaagccaggcugaaaagcaggucaccaaguguucagagaaaugccccacccagcugggcugucuccuugcuaucucuaaacacauccaaucuccccaccuccacgucuuuccccaccuguccccaucacuuuugguuuccacacgucucaaguccuuccaucccuaagcagcuggcgucaaccacccccuccccaccccgaucucccucuuuacucuuggcagaguguggccaggagauuuucauucauuggcucacccucacacuaaucuugguguuaucauucccauuucagagaagaaaaaagcaaggcucagggagaaguuccaggauuugaacugagagccaacauucuuuauucuuuccaugaauaugcauugugggccuacuucaugccacacauugcgccaggcauggggaauacgugguggagaccucagaguccagaugagacagggagaaaccaaaccaccaugcaaacaaauguaaaaugacaacugggacaaaugcugugacaaggucuguggggaccuggucuagucuggacuagggagucaggagaggcuucuugcaggaugugacauucaacguagcaccagaagguggaguagacaaugacccagagaaguggggacuccagagagagggaacaacgcuuucaaaguccccauggugagaggaaagagaaaaaggccauguggccagagcaugaggagagaggauuagagaugggggugcagguggcaugggucaggacaauagguucuagugggaccagcaaggaguugggguuuuagccuagaggcucugggcuggcccuggagguucaaagcagaggacagugcugccacuguuccuccaacugucaccucccagcccaccacucugcacccagggaccacuuccacccucuucucugaugcccaggcccuggcacaaggugagacauccuggggagucagacugggcagcugagugggcggccucgugagggagcaggaggccuuggccccgccucuugucagaugcuagcuggaugccuccaggcagcacuugccccucugugucccccagaacuaugaagaauggacugauugucuucugccgucucugguugauccuguaacaagggaauggagaagauacagcaugacuccaaccaggccagauuccagggccuuggcccugcagugagcagaggggcugccugaggccugcugcuggccuaugccuucccaucccuccuccacccuugagccugccucaccuggcucuucccaaggagugcacuccaggaagcuuucuuccucucuccaccccagaccucaccugcacccucacccaugucuccacuaucagccuggcaacugcaucagaugacugggagucccuguuggccugucagugcucagcuggacuguugagccucugguuuuccagcuguagaagggugucauucuguacucuuccugucucccuggacaggagaggacgguguaaacuggaauucuugucauaaccaucagcuacucugccagagugcuccuugcugucaagcauccuccugagacccugaagucagcaccaccgugggccacagacauaccagcugaccccauaaaaccuucccuggaaaguuguagccagcugcaucccccgaguaggacugugucgccgucgugggcaccagugagcagagacaagauuauagugcccauuaacagcuggaaaacugaggcuccagacagaaggggcuggcccaggccaccacagcaagcccuccuaccucaccccauccuagacugccuggguggguccagggaagcaggacuauguggggugccaucucccaucccccaguguucccucgcagguucagaaagcagcugcucccucccaggugacacugcaccuugccaucugugugaggggccucuucucuugugugaguugcaguuucugcuugggaggcugccuuaccuuguuaagggcccugccuaaagaggcagggguggcccuguaggagcuguccccaggucagcacagggccuugagcucauggagcaggggccaggcccacuuguugagagggccgaggucaauccacagucugccacaucagcuuuuucuauacuuaaucacaccuaccugaaacguggggagugcuuugcuguccacaagucuaauuguacgugucuucucagggaaggcgcccuacagcccagggaagcaggaacagggauuaucggcauuguacagauaaagaaaccaaggugcaggguuauggccaucuggacgcuggaucccugcaguccagcgcagucacacaacagggccucaggaaaggguggugcuggaggcagcagggcagcaggagcugugggugucgggguucugggcagagagugauccuugccuguuacugagagauagagauaggacugggcuugcacuuuggaaggccgaggagugggauggggauggguggugggaauuuggg

SEQ ID NO: 16011 - RNA, 1123 nt, Homo sapiens
agaacgcgcucucagcuucggguccugcggcugcggcugccgccaucauggugcggaagcuuaaguuccacgagcagaagcugcugaagcagguggacuuccugaacugggaggucaccgaccacaaccugcacgagcugcgcgugcugcggcguuaccggcugcagcggcgggaggacuacacgcgcuacaaccagcugagccgugccgugcgugagcuggcgcggcgccugcgcgaccugcccgaacgcgaccaguuccgcgugcgcgcuucggccgcgcugcuggacaagcuguaugcucucggcuuggugcccacgcgcgguucgcuggagcucugcgacuucgucacggccucguccuucugccgccgccgccuccccaccgugcuccucaagcugcgcauggcgcagcaccuucaggcugccguggccuuuguggagcaagggcacguacgcgugggcccugacgugguuaccgaccccgccuuccuugucacgcgcagcauggaggacuuugucacuuggguggacucguccaagaucaagcggcacgugcuagaguacaaugaggagcgcgaugacuucgaucuggaagccuagcggaucucccacuuugcauggcugucuuuuacagaugggaaaacugaggccugaugcuggagauucuaugagggugcucuccucaaggguaucagacggucguagguucuuaagaauuugauucaucaguggcaggccaugcauagagccacgggaggugcguccuuguuuuccagggaauguucuuagaacuuggacuacugauuauuaauugacugugccuugggaaacagugggaaguaacuuggugcagcacugggguauuguuggcuucuuguguuggaaacuuuguaauguaaaaggaaaaacuggaaauccccacgcccuguuucccuuuaucgucuugugguuggacugguucaauucguuuaacucgaauucuugcuccuggccgugguuaagcuguguacagaugauggagaguuuggccucaaguuuuuauaaacugagcgagacuaguguucaggaucuccucccuuguuuaaaugucaauaaaugccccaacugcuuuguaagugcaa

SEQ ID NO: 16012 - RNA, 2167 nt, Homo sapiens
aauuuuauccauucucugaguguggcauguccccaauguuaauuuaugccguggccuguuuugguguuuuccucuccuuucucaguucugaggaugccuccagauccacccgggagaucgugaguaccuugugccucacgcuccgccuuccggaggcuugccagggcgguggcuguuagagcccgccucucuuuugguuaucuccgcccucuuaggacugcauauucagcucuagggaguuuacuucuccgccuaggucuccagaccuuaguucuguacucuacuuggcugaaaggaguugccagcugcuccggauauuuguguuuacaaggacgcaguguguagaauguaaacuguaaagauaacuggacggaaggaugaguucucauucucucauuuuuuuugugagggaguccuccauggugggcugccuuuccuucaaauccuaggauguggagucuccgcugaugagcuccgcucccccuccuaucucgggcccuggaacuccgagcuucagucucuaguguaaacauuccacaaaaggacugcuaagguucagccuccucgcgcaggguggaauuagcuccuuccuagacgggcgcccuggccaauggaggguccuaccagcgccaagauauccaauccgacucuuggggcggggccuggcccggcagugcgguaggcggagccuguuucacuuacagacauuuuaccccacaucgguuacuuaccuuacuggggcggugggagagccagggguagccuuccaaugcgaugaccagcggaggcgggagccaacuuguuaggccuguggcugagacgcugcagggcggguuaugugguguccuccaaugagacaggaagagcuucccugcuuccuccaauaguguuggggcucgggggugggcuucagcaguccgucuccaauaggcgggguugaguuagggaagcuccccgccaauaggggcguggagaaggagagcggcucccccuccccuaccagucgagggggaaggggcgggaaaaucauaagacaggccucggugguuggcugagucuuugacgggcggguauugcguccuguauuggaacgaagcugagucuucccucugcggggcggggucgggggagugggcgggauuucccggguaacagagaagcggccgcggcgguagaggcggcggagacgguuucuccaucuuccccccuccccuuccccccucggaguuucccucccucccucccucccuccuucccagucugggcaccggagccugugaccgcuucguuaguggagagguagcuggcaguccgcuucggcgggccugugccccgcgccguucucggggccucccugcugagcucgcggcucacgcugagagggacacgcagugacgagcggccgaagcagcuuugcggugagagcacgcugggccgggggccgggcgggagccugguggcggguaacgccggacucgaggguguguauuuuggggggggggggcugaccuccucggcuucccguagagcagacgggcgggaggugugugguugugugagggggguggggggcggagcgggguagcucuccgcgcgggagggggaggagagcguagucccggugcgcgcggaggggggcgggcucucgcgccgccgcucagaggcggggccggcgcgcgcgugcgauuguggagaaaggggcggggccggcuucgcgcugagugcaguuugcggccgaccacccccuccccuccuccuggggugggcggggccucgggcuggcggccgcgcucuggccugcuggggucggggagggguaggggggggucucccgcguguagauucagggcgcggcagggagggggcgugaagucugaguuccuccgccuucuugggauccgguuggccggaggggccguacugauccgugaugccacuccccuuggccgucccccccugcaccccgcccaggccccggguuuccgccuccuuggcaaugaggaggugcuagggaaagcccgcugucgggucuggcugggagucucggcgccuagaucugccccgcccuaugucuccguggggagggaggggcacccgccgacugggagcuguggaggugucaggacuuacucuuguggcugggucaugccuucugccugggggcaca

SEQ ID NO: 16013 - RNA, 13351 nt, Homo sapiens
cccgggacugggaggcgcccucuggacgccggaaccuuugguuuccugccguggagcggaacgguagcgccaggggccuuccggaaagaggagcgagagcccggcgauggcggcugcgccggccuugaagcacuggcgcaccacgcuggagcggguggagaaguucgugucgccgcucuacuuuaccgacuguaaccuccgcggcagguguggccccuggucccccgcagccggccgaccgcaaccgugcgccucaagcuuuccuuccggggagaaaccuaagcugcagccacccgggccgcgggacaaagugcccgccgcgggcagggcaggggccggggaggaggggguagggaauggacugugccgcggagcggccaggcagcccucuuggcggaggauccagggaaagugcggccccaccggccagcuggcccccaggcggaaacggggcggccuccagcaugugcccaccggcccgucccacgcaggcuuuuuggggccagcugcccuguggcugugcucuccagcuuccugacgccggagagacuucccuaccaggaggcaguccagcgggacuuccgccccgcgcaggucggcgacagcuucggacccacguagguaacgcccagcgggugggcggggccacaggccuaggggaagucccaacccagcucccagccacaccuucguugucugcccucugccguagacaacuacgugggaucgagcagcacccucugcugggagcagcacccucugcugggaacagcucucuggucccugggucuucaggggaugguuuucauucccacguggccgccucuggacaucccuuaggaagggcacccuagggaucacgaaccuuugacgccucugccuguuucccucaucuugcuucucaccuuguugcuccuuucuugugacucaaagcugaguaccuugugacacugcagaugcuuggagaguuucaagccccugccgacacuuuauccaaggaaggauaucaggauaggacuucuaccucuaggccuaucacaacagcucucuugcagaugguggaccugcugguuccggguggagcugaccaucccagaggcaugggugggccaggaaguucaccuuugcugggaaagugauggagaaggucugguguggcgugauggagaaccuguccaggugaggaacccuguccuagggccagguauggccacauuucagcccugaaaugacuacagcccuucuucuguggacucuggagaagccacagcugaguugcucugcccacagggugguaucaggauuucaggacuagggaaguugccacuugggcaucugugcaauugguccuuaguuuuuauuguguauaauacaaacuuauaggaaaacauuucaaacaguucuagauaaaguaauggaucucuccuuaucacccaucccauuccccagcuauaaccacuguuaagugucuuauucaugcuccacccuuaucagguuuaguccuuauacuccuaucuaguaggucuuuauacccauuuacaaauuaagaaacagauguguaguugacucacucagguucacacagcuucuauuucaaauuggacugacucucaaucugggguuaagacuguucuuccuggcuacaagaaggcagagaccaucccuuccucccuucacuggcucagcaaauaucuccugguguccauucugggccauacccuuaagcacuaggguguagcagggaaugaggcaaaccugccccugacuucacggaguuucuuucccgguauuuauuuaggggugcagaggccaccagaauccacacucaggcugccuaaccccuucccagggcccuucccauaagaccauggguuugccacugguaaacaggggcuauuugacggucauggugcuggcugccaugggaguuggggcaucuacugccaagggucccugauuugccaaucuuggcccugcuugggagagaggacccagagcugggaaccagauggaggggccugacuccccauggcuuacacuuuaccugaacuguccaaaagccucaagccuugucucucucacuccccucccuacuaggguuuaaccaaagagggugagaagaccagcuauguccugacugacaggcugggggaaagagacccccgaaggugagucccugugcccugguugaccagugcugucagggagggaguaccagugagcaaggaggagcugaggcccagagugaucucauaagcccgccucugcucuagcacaaucauccucacaucucauuguuugcuuuuaaaagcaugauuuuuuccuaaccauaaaaauaaugggcugggugcagugacccacacuacccugggaggcugagugggaggaucaccugagcccaggaggaugaggcugcagugagccaugaucacaccgcugcacugcagccugggcaacagagugagaccuugucucaaaaauaauagcaauguuugccugugguaaauacaggaaagcacaaagaaguaaauaacuaccguuauuccacucccuagaauagagaugaacauuauuaacaucucagcauucauguucuuuuuuuugagacgaagucucccucugucgccgaugcuggaguacaguagcacgaucgcagcucacuguaccuucugccucccagguucaagcgauucucaugccucagcuucccgaguagcagggauuacaggugugugccaccacguccagcuauuuuuuuuuuauuuuugguagagaaaggguuucaccguguuggccaggcuacucucaaauucuugaccucagguuauccgccccucucagcuucccaaaaugcuggaauuacaggcgugagccaccgcaccuggcccaguauucauguucuugguguaucuuuccggcauaguuuuuuuuguuuuuucggggggguuuuuuuggauuuuuuugagacggaguuucgcuuuuguuacccaggcuggagugcaauggcacgaucucggcucacugcgaccgccgccucccagguucaagcaauucuccugccucagccucccuacuagcugagauuacaggugcccaccaccaugcccagcuaauuuuuuguauuuuuaguagagacgggguuugacucuguuggccaggcuggucucaaacugcugaccucaggcuauccacuugccugagucucccaaagugcugggauuacaggaaugagccaccgugcccggcucaucccgguauaguuuuuacuaguuaagauuguauccugacuucuuacauuccauguuauaacauggacauuuuaugacaccauuaaaaacacuucuuagacauuaugaauguauuuuauauagauugacacuguuucagaugcuuucagacacugggaguaugguggugaauaaaauagcccuugccaacaaagggagacagauucacucauauaauuacaaaacugagggcucuggaaggaaauccuggguacuccacugaggaauuugcucuagacuuagcagcgaaguggagucaggaaggccucccuaaggaagucguguuugcucucugaagccuaaguauggcaucaccacagcccagccuguucuccaaugaauggcccgcccauguuggccguguugguuuuagaucuugggucuaaaaguuugagccugggagauccgaacaugauuuuaauaugcaaagaggguuccaagaccaaggcagugcuuugcaaagacaacuuuggaaauauaagacuaaacagcagcguacuuuacaugguuccaaacuuugcuacuuauucucucugacagcaagacaugggauccaucugguguuuguaccacaacccucccacaugcacucuugucacacugugggauccucuggguaguggauccuggaagcagacagguugggcucagcuggaugccuccugggugccccuuccccaaguccccggaguacugugccagucccuuagccugaggcugucuccccaucuuuguagccucacucucuauguggaaguagccugcaaugggcuccugggggccgggaagggaagcaugauugcagccccugacccugagaagauguuccagcugagccgggcugagcuagcuguguuccaccgggauguccacaugcuccugguggaucuggagcugcugcugggcauagccaagguacuugacacccccuguacccccugcuacccucuagagcccugcuccaagaagguuguucuuugggucagauaaaugggacucugggaauccagaguaggacgaggguuuccaccugcuugaggguugagagaauuuuccuaugugaaggggaggagggagacggugcugagcagggggaccagcagggaaaaaggguugggggucaggggagcucugcugagagcccugagaucaguggagccuaggucuggaagcugugcuugaaaaagggauuaaggggcagaacccugcugcagggccucgggaaggacaaccagcgcagcuuccaggcccuguacacagccaaucagauggugaacgugugugacccugcccagcccgagaccuucccaguggcccaggcccuggccuccagguucuuuggccaacaugggggugaaagccaacacaccauucaugccacagggcacugccacauugauacagguaggacagcagcugguugggcuggcuggggaagcaggagugcccuugaagaccuggaugugcccuagaagcacugugugaugcucagcaaguucuugcuccucuuggaccugcguuuuccccgucuguaaaacggggccggggggcuggacugugggcucugcuugcuuuggauucacuuuuuuuuuuuuugagacggagucucacucuugucacccaggguggagugcaauggugugaucucggcucacugcaaccucugccucccggguucaggcgauucucuugccucagccuccuuaguagcugggauuacaggcacccaccacaaugccugguuaauuuuuguauuuuuaguagagacgggguuucaccacguuggccaggcuggucucaaacuccugaccucaggugauccgccugccuuggccucccaaagugcugggauuacaggcaugacccaccgugcccagccucauuuauucuuucaacaaaaucugaugccucauggggcccaugcuagauauugaggguaggauuacagagacagauucagcaggcagaguuggugucacaaugguggggagucugaggcacuggagagcacaggagagguacuuacuccagcuggguugggggauuccagagaggcuuccuggacaaguuugcagugucugaguuuuacgggaaauccacauuuuuaacaagcuccugaagguauugauucugaugcagccgaaguuuugggaucacagaacaagggcuuucucugcugugccaagauguaggguaaggugugagagguucugggcugguaagggaggaacugcagccugggagucaggagaggcuguagcaccucugguaggacagcuggcuccauccugggagccaugccucuguucccagguauacaucaaguuugugcaggggcaggguagucccugcuacuucucguaggauccucuaggggaugucuaauuccccaagaggacugaggcuauucuggggccuggagccuccauuuccugaccuguauaauuggccucauagcacugccgccuccuuuccccagccccuccucccaccucgcuggagugaagugaagugaccacuuaggagggacaccacagggcuuuccagggugaagggccugggaugggaggggggcuaggugacccucuggagucccagcccaggccuggucagccuugcugcucccucuguccuccaccucacuccccguauagccuggcuuuggcccuucaaagagacugugaggaaaugugcccggagcugggugaccgcccugcagcucauggagcggaacccugaguucaucuuugccugcucccaggucagagggacagcugugagggaggagggaagcacguggcccucccuggagcuccacaggcccugaaggcuucccaggccuggggucagggcugcuccucacccucagccacacacugagucccauaugcucaguccuggguggggcccuugucacucuggucccagcucccuucaaccugcccacaggcgcagcagcuggaaugggugaagagccgcuacccuggccuguacucccgcauccaggaguuugcgugccgugggcaguuugugccuguggggggcaccuggguggagaugguaagugcacugggcacuccucagccuugaacuguaugacaacagccuucccucagguagccccgcccucccggcuuugcuggugaguuuccacgggccacucauccccgcuguguggcagggcuggcucauuagucccugggaucucaaggccugggacuucaagggggaggagagccuccagcgcugugacaaguugcauggccuaguccugggcacccccucaggcagauggacagucaggccugaaggacaggggcccuuccugaguucuggcuguaacucccauguuugagcagcccuggcuucuccugcagggauuggguuggccugagcgccugccugcuccccguccagcgcugaccugggcugccucccacuuccuucacugccaggaugggaaccugcccaguggagaggccauggugaggcaguuuuugcagggccagaacuucuuucugcaggaguuugggaagaugugcucugagguaggcugagagcugcuacaccaggcugugggcgaguggggcuggcgcucgacuuggagugcugaggggcugaggcuggggugaguccgccuggagcucugguuccugcacuccaggauccucuuucuccacaguucuggcugccggacaccuuuggcuacucagcacagcucccccagaucaugcacggcuguggcaucaggcgcuuucucacccagaaauugagcuggaauuuggugaacuccuucccaguaagcaggcccccggggggucagggucagagugggccucagucccgccuggcccauuugccucucccccuuauugugggguccuagacagaccaccaaacccucacucugccucugccagggucacauagcaggcaggggcaggaccaagucuggaaggccuggcucugccucagcccugacucuggccucucugcccugcuucuguuucccugcugguagcaccauacauuuuucugggagggccuggauggcucccguguacugguccacuucccaccuggcgacuccuaugggaugcagggcagcguggaggaggugaggggucaccuaggguggugggguaggggcaggcuggagagggcuggcuuguuccaggcugauccaugcuggccugcccucaccugucuaggugcugaagaccguggccaacaaccgggacaaggggcgggccaaccacagugccuuccucuuuggcuuuggggaugggggugguggccccacccagaccaugcuggaccgccugaagcgccugagcaauacggaugggcugcccaggucaggccaggccuuggcucuccuuuagccccacccugggcccuugccaugagcccugccuucccucagacauugggcccaaccccuccucuggaccuuguccugucccaauccuagaccacggguuccuccaaacuuccacccugggggugggugggggagaagcugaagcugguaagggcuccagcccaucagagagagaggcucuccuagggcguccagggcuggccaucugugaacggggagcuuucuggaguggcuccucucuguaggagcuggauccuuugcuuugguguggaagaagggugagccauguggucuccaaggcugggagaccuaggcuuguggucuccucagggugcagcuaucuucuccaagacagcucuucucagcacuggagagugacucagagcagcugugcacguggguuggggagcucuucuuggagcugcacaauggcacauacaccacccaugcccaggucagggggagguugcagggcugugcagggagggugugcccuugaucugcagagggucagagaaggcagcaggggacagagcccaggccagaucuaggggaagagaaguuuggaggagagaaguucaagaccuggguuggucaagaaagcuugaaggaggcagaaaccccugaagaaagaaggguuugggcugcggggagaagagggaaggcauuuaaggcaggucacccgccagaggccuucuccacgaggcccuuggugaguccucagggauucugagcaagggagggcuuuggaagguguccugggacagcuaagcaggcuccagacuaaucuucccauccugggcucagaucaagaaggggaaccgggaaugugagcggauccugcacgacguggagcugcucaguagccuggcccuggcccgcagugcccaguuccuauacccagcagcccagcugcagcaccucuggaggucagcccaguucugucccugccauccaccugacugcucacugcaguuaccucugugccugccccucccagccuucccaucccugcccuuggccccugcaggcuccuucuucugaaccaguuccaugauguggugacuggaagcugcauccagaugguggcagaggaagccaugugccauuaugaagguuaggcucacaauaguccugccugcucucuccaaccccagggcugagcccagaguguccccugugggauacccaugggcacauuccagaccuguugcccaccuaugaccagccagucuuuccucagacauccguucccauggcaauacacugcucagcgcugcagccgcagcccugugugcuggggagccagguccugagggccuccucaucgucaacacacugcccuggaagcggaucgaagugauggcccugcccaaaccgggcggggcccacagccuagguacgagcugaggggaaggguugcuacugcagcaggaaggauggaggccagacagaucaggccugggauaccccgagggaucugggugccccugacuggagaguaguagcacaucuuccaccaacccauccccaccugcgcaagcuuccugaaaggucaggaaggcugcacugaugcccaggccucacccccagcccuggugacagugcccagcaugggcuaugcuccuguuccuccccccaccucacugcagccccugcugccccagcagccuguguucguagugcaagaggugaguccugcaugcccuggggggcaggaacugugcugggauacuuucuuacaacugaggguccugagcuccccugucuggagcaaguggugaggcggggcugggguuggggugggaagacuuuuggugugggaagccccuacagacucagccucaaggccuccucccacaaagacugauggcuccgugacucuggacaauggcaucauccgagugaagcuggacccaacuggucgccugacguccuugguccugguggccucuggcaggugccaaauccucauugcccuuucccagugccuggcaaguagaccccaggccauuuccucucuccccuugccacaacacugcccacagcagcccaccaguggcucugggcuggaacccacacauggagcagggcaggcugggcaguaguccccuguccacugggucuacucacuccacccuaccccaccaagagcagcuggagacagcgaggucaguugguuguacagcaccaaucccauguccuuccagggaggccauugcugagggcgccguggggaaccaguuugugcuauuugaugauguccccuuguacugggaugcaugggacgucauggacuaccaccuggagacacgguauaggcugggcagcauguggggaugguggagguggugggaacacaggcugcucuggaucaguauguccaccccugucccauaggaagccugugcugggccaggcagggacccuggcagugggcaccgagggcggccugcggggcagcgccugguucuugcuacagaucagccccaacagucggcuuagccaggagguugugcuggacguuggcugccccuauguccgcuuccacaccgagguagucgggggguaggggguggcuguuuuccccaagugugcuugguaaggaggggccagccccaggccuuggugugucucuuccuucccugacucccacccuccuucccacucccagguacacuggcaugaggcccacaaguuccugaagguggaguucccugcucgcgugcggaguucccaggccaccuaugagauccaguuugggcaccugcagcgaccuacccacuacaauaccucuugggacugggcucgauuugaggucugacauggcagggugggaguggccuuggacuccucccuggcuggggagacugcuuguguggaacaggcuggggaggaagaggauaaucaacauuugcugcuuccuaacgugugugccaggcauugcacuaaaugcuuuacauuggcaaggcacaguggcucacgccuguaauuccagcacuuugggaggccgagguggguggaucaccugaggucaggaguucaagaccagccuggccaacauggugaaacgccaucucuacuaaaaauacaaaaauugggccgggcguggugacucacgccuguaaucccagcaguuugggaggcugagguggguggaucacgaggucaagagaucgagaccauccuggcuaacacgaugaaacccugucucuacuaaaaauacaaaaauuuagccgggugugguggugggcgccuguagucccagcuacuugggaggcugaggcaggagaauggcgugaaucugggaggcagagcuugcagugagccaagaucgugccacugcacuccagccugggcgacagagcgagacucugucucaaaaaaaaaaaaaaaaaaaauacaaaaauuggccaggcgcaguguucucaggccuauaaucccagcacuuuggaaggccgaggugggcggaucacgaggucaagagaucgagaccaucauagacaacauggugaacccccaucucuacuaaaaauacagaaaaauuagccaggcgugguggcacauguccuguuaucccagcuacucgggaggcugaggcaggagaaucgcuugaacccuuuaggcggagguugcagugagcugagauugugccacugcacuccagccuggcaacagagugagacuccaucucaaaaaaaaaaaaaaagccgggcgugguggcacauguccuguuaucccagcuacuugggaggcugaggcaggagaaucacuugaauccuggagggcggagguugcagugagccgagaucaagccacugcacuccagccugggugacagacugagauccugugugaaaaaaacaaaguuuuacauuuaauuugauacucaugaucauucgauggggugaguacuauuauuuauucccguuucacagauaaggaaacugaggcuuaggcagguuggguggcaugcccagggccccguacagugggagcuggaguucaguugugugguucuagagcuugugcucggccuagugacaggagcucuggagucugggagcacaaagaggggcacagggccaccaagugggucuuggaucugcccuccaggugugggcccaucgcuggauggaucugucagaacacggcuuugggcuggcccugcucaacgacugcaaguauggcgcgucagugcgaggcagcauccucagccucucgcuguaagugggguacccaccaggccugggagcuggcauggagaaaugggucuucccgaccacaacuccaacagcuucagcguggccccuacgcgcccuccucaccccagcuugcgggcgccuaaagccccggacgcuacugcugacacggggcgccacgaguucaccuaugcacugaugccgcacaagggugagugcuggggacgguggggccuuccugcagcccuagacaccucucugcccuucccugagcccaaaccccagcaaccuggcuuccugccccuucuagggacaggggaggguagcccccauucuccaccagcauuguuuccuggucguaccccaggcucuuuccaggaugcuggcguuauccaagcugccuacagccuaaacuucccccuguuggcucugccagcccccagcccagcgcccgccaccuccuggagugcguuuuccgugucuucacccgcggucguauuggagaccgucaagcaggcaaggggugggacgugcuggggacgggguuccgaacugggccugcccucggccccucccaccagacguguuccucugcaggcggagagcagcccccagcgccgcucgcugguccugaggcuguaugaggcccacggcagccacguggacugcuggcugcacuugucgcugccgguucaggaggccauccugugaguggcggugugggauuggggcgggggucgagucucgcccucgcagagccuucauggccccuccuguucuccagcugcgaucucuuggagcgaccagacccugcuggccacuugacccuucgggacaaccgccugaagcucaccuuuucucccuuccaagugcugucccuguugcucgugcuucagccuccgccacacugagucccuggggcugggguuuuguuuguagaaggcucuggggacuccuaauuucugcuuccccagccuaaagcagggaucagucuuuucuuguggaauaaauccuuggaucgggaacccugcugcucaguccccuuagggcccauccucacgcuuggggugggggugggaagucuggggugggauggcuucccagguauuugguggguaggggcaagauccuaagguaccugugcgugcagggucuggguugcagcccccacaggagagacuggggaccucgagccaccaaaagccagugaagagaccaugaguugagaagccccuccccugugccagcagguaaagggccugggccuggggcuggggaggggccgaaggguggguuuugccuggcuccugccaggaugagggggcagcccuggacccuggagaaucuggacuggaggagcucuggcuccugggcugccuggggccagggucuuuguaccaccucugaggggcuguccuugcagaggcaaacuguccucugauagagucagagccuugaggacugggaugggggcucag

SEQ ID NO: 16014 - RNA, 4251 nt, Homo sapiens
ucgacucagcugacccugcgggaccggaaaaagaaauucccgggcccuggcuucuuggcgcgauggugaggcacuaggggcgaagcgaggcuugggcugcuggagcgggaaugagggggcgccaaguggcuccggaaacugggggagguuguacuggccucuccgcaaacacagugugugcgggcgugagggcugugagucugguagggaaaaguccaccacucucccgcucccgagacgggggcggggguacggggcggguaagacagagcaggccggccggcuuagagucccggugcuucccuggcggaaggaagggccccugccucccggggcaggaacuagggcuugucuggagcugggaguccuuucaggucuuccccauccccaagaggaccucccaaggauacccccuuccccagcccugccguggggcuuguacaagaaggugcuuagaaucaggcucacucuuccacacuguuaggaagccccuccgcucuuuccagagccagaaaguaguaguuuugggguugagacuuauccauccauccauccaauccauccauccguacguucuaagcgccuggucuauaccaugaagugugcuaggcacugggaggacuugagcugccaagggaaggggaaaucggaggcuugaauuggagucauagcuaaggcuccaggggcagagaccuaacugcgccuuguguguagugcuaagggggcuuccuaaggaugccaucaaacuuaaaggcggauggauggcaggagcuggcuggcugaaguacaguuuguguaccagggguagggaggcaagggugggagacgugugucuucagacagggaacagcaugugcagagacuucagguuagagagaguauggcuccccaggaauggaugcauuucccauagcugggagaguaucaucugcagguuagggaaagaugaggcuggacaaguagagaacaaaucuuccuggcucuuggaucaccacaaucaagauaaugaacguauccacuggccuccauaauuuccuugugugaggggcuauuuuaagaaguauaaucaagaaaggcuguucuggcugggugcgguggcucaugccuguaauccuagcacuuugggagagugaagaggguggaucaccugaggucaggaguucgagaccagcauggccauggcacuccagccugggcaacagagggagacucugucuuauuuuuuuauuuuuuaaaaaaagaagggcuggucugaugugucacuuaaaggauagcaagccacuggccaggcgccguggcucacgccuguaaucccagcacuuugggaggcugagggggacggaucacuugaggucaggaguucaagaccagccuggcuaacauagugaaacucugucucuacuaaaaauacaaaauuagccgagugugguggcacaugccuguaaucccagcuacuugggaggcugaggcaggagaaucacuugaaccugggaagcggagguugcagugagccgaggucgcgccauugcacuccagccuggggaacaagagugaaacugucucaaaaaaaaaaaaaaaaggauagcaagccacacagagagugcagcaggcauggaggcgggagcaaggcuggugugccccagcagcagcagggaagcuggaguggcuggaguuguguggguauggggaagaggggagagaguucacucgucucugugaggcccaggacuuuguuuuaucccaugcuguacccccagcacuuagagugggagcuagcacagagaaggugcuuaauugauguuugcugagcagaugaaugccuggaguagaccucagagcaggguuugguggcagggugggucagggagagaguuuacucaacagccuggugauaggggagaacaagaggccagaggguauccaucuaugucggggaccaggggucccuggugggcagcagugugggagacacacggauccuggccacaccucaggccucccuccagccugauuaccugccucccucccuugcagagguuccgguucuguggugaucuggacugucccgacuggguccuggcagaaaucagcacgcuggccaagaugguugagugcacagggucuagucuggguggaggagggguguuggggguggggauuguggguguagaggauggugagguuucucuggggcuagggccucagugcucucagccugugcuaccaugcuuugugaccuugaucaguggcuggccugcucugagccaguccccaggaaggaggggugagguuugccagccuggcugauguaaggacuucccuuccaguccucugugaaguugcggcugcucugcagccagguacuaaaggagcugcugggacaggggauugaugugaguacaagauccagcaccccauugucccaugaccuuaugaccaccacugcccugaaacucugcacuaggcccagggagacgggugagccagccucucaaccucucugggcaccucccuuccuucuuuccagccugucuguuccuuaucgcaggauccaggcugggggugaggggcuggugagcaggggccuggcacccccugaaggucuccuuuccccauaguaugagaagauccugaagcucacggcugacgccaaguuuggugaguaucccgcugagucuauaggccccaggcaacccugggaacuuggccuggugccugguacagaggggccccccaccccucccagcagcauccuuaacuuaccuucccuaguggaggagcaugagggaaagaaagaccgacagucccaccuuccuguccucugccagcuccugguggagcaguagcagugccuguggcuccaggaggccugggggcuuugagcuaaaguuaauagggcaacagggagguggcuggacccacagugacacccccugccccacccacgggucccucagagucaggcgaugugaaggccacaguggcagugcugaguuucauccucuccagugcggccaagcacagugucgauggcgaauccuuguccagugaacugcagcagcuggggcugcccaaagguacggguugugggugggcagcugggcagccugugggccaagggcugcuagagaaggggacaggcccugugacccugagguguaccugcccugucugggccaggagcccaagccaggccccgacaugcuaccuccagagcuacuccauucuacccccagagcacgcggccagccugugccgcuguuaugaggagaagcaaagccccuugcagaagcacuugcgggucugcagccuacgcaguaaguaugaggccagccaggguccgggcucauucuagaaggugcacgcagcacacaaagugcauggagaguccagggagacgacuuaaccacggucacaugguuacuagcagccguagagcugggaccuggcccugggucuccugacuccccacaagguuucuugucacugaggucugcugugggugaucagaacugauuaucgggcaccugcccuguucugagccugggucagcaggaugggagcuucuuagaggccacauagccuugaaugguugagagcugagccagggugucggcugaggucuacuuggcuugccugcuuugauccugagagccacccaccccaucucacagugaauagguuggcaggugugggcuggcggguggacuacacccugagcuccagccugcugcaauccguggaagagcccauggugcaccugcggcuggagguggcagcugccccagggaccccagcccagccuguugccaugucccucucagcagacaaguuccagguccuccuggcaggugaggcucagcuauuccucgacgggugagaggcucucccagauccgccugacugccucccaccugcccaccucuucccucugcagaacugaagcaggcccagacccugaugagcucccugggcugaggagaaggguguuccaggccuguguggagccgcccugcccguauggagucacgcccucugaacugcucuucgggaggcagcccugguucuaggaugcugaggcccuggcccggacucuggccucccagauccccagcugccucacuucucucuugagaacuuggcucagggcuccugaggaccuuucccagcauuaccuucccuucccuugaaaggcaauuguuggcuguuuucauaagcaggaaaaauaaacagaaguauaaaggaaugugu

SEQ ID NO: 16015 - RNA, 14512 nt, Homo sapiens
ccgcccgggaccgcagacggcgcccagcggcggcgcgaacggcagcuaggaggguugcuccgggcuuggugcucacugcgacuucccgcgcagggcccggucggacuaggacccgcggccugagagacgcuggaggaugcggacgcggaggccgccugggguagcggcggcgggaguccuggcgcucugcagguaggagcucgcccgcucggcgggcgcggaaacuugggccgaguuugcgggcggcgcguggagaaggggcggguggcgcugccccagggcgccccuaccggccggcccggggacugagggagccgcgccugggccgaggggcugcggcuucuggcugccgccggccccccgcgaacgggcugcggggcagggguggcgcugcugcuccgacuuuccccggacuucgaggcucccgggaccugguagcgcucugggucuccggcggagaacaggcgccuaaucuggcgagaaggaacucaggccgagcccuccggccucccgcaggacccugucacguggauugcugggggauggcguugaggaggagguauggggacaagggggcacuggagggcugggccugggggcgccgggcgcugaggcaccgcggggcccuggacgcgcccugcugggaugggacggcccugcgguuuucucgccaccucuugacucaccccucuggccucagcccaggcuggcaggaucgcccugaggcggaggcugcccggacccugucgccgggccgccccuguuccgggaccucccgccgguccgcgggcgucgguguggggcugggugcgcgggccugccugcgugcacacguaugcccggggcccgagcgaggggagagcgcaguucuggaauggcgugugugcagaugugggccaugcacguacgugcaggcacggguuugcaugcguggcggcggccugugugucagccugcuggaugcacgugcgucucggcgccgccgggaggggcuuggggacacccggaagcccgccaggucgggugcggcggcagccucuaagcgaaaucggcugugggcccuaggcacccgaguuauguucagggcggguaggggaaaggggauagagaccgaucccguucgcuuuccccuccacuggagacuuugggcugccccagguuggguuguagcgucuggagagcccagagccucagguagggaaggugggagaugggagaacacucggcgaggcccgauccagcccuccgggagaauccagaugcuggccacaauugggcaggaaucgcgcucuucuuccuggucuuugccaucggccaucccgaggccccuagaaggugaaagugggaacagagagcuguuuccuuucccacugcguaaggcaggggcggugcugcgguggugggcucuucuccgggacccuggccugggugcuggcugagugacguuggagcuuggcagagaggaucaacagagcugccucucaaggaugaucugagccugcucccugggcaccugcccuuuccgagagcuugcuugccucaguaugggucagggaaggaggcaccuacauuuuggcaacugucuugaguggaggagucgucucccuugagagaguguauccugggcuuuccaccuccuacuggcaggagaucaggucauucccacaccccuaagaguucucuguuggcucccugaagccgccaccccucccacaaagacuccugagggucccaggugguuuccugucuauugacugggucccagauaggggccucaagaagucuccagagcaaaggguauuccaugggcugagacccaggagagagggacuccugggguggggguggggacccagcagaccccaagaagcaugugggggaggugagaccaaagucaguacuuaacccagagugucccaaggguggagguggggaggauccacacuucaaaacccuacaguuccuucucacagcauugcuguggagugagaugggggcuuucaccccucgauagcagguuucuaucauaggacacugcuguugggacugucaccuguguccuaauggccccucugugucuucucuaggcuggccugaggugugggguucuguccaggagaugaaccagcuugcuuucugggucugccuugguggaagugggcauuggcccccacacuagccuuguguuuucuaaccccaaaaugugccggucuaacucagccuguggcugucauuggcuccaaccagaagaggcaaggagagggcugguccuugcuugccagucacugaaaccugugacacuuugcccuaaucauagcaagauugagcuaggugguccuuucuaagcuacugagaguuuccaggaauagggugcuggcugggggagguagagguaggucaguguggccccagaagacaggcuucagaugagccccuaacggguuacugggugccugcugcccugaggggccucaguccccauccuuccuuggucuugucuuagagcuuugucuuuuuucagcacauaguuuuuccaucaauacaaugggaguaguggcuaaguagcacucuggccccuggggccucccucccuggacuuuuuucuuuucuuuucuuuucuuuuuuuuuguuuuguuuuuuguuuuuuguguuuuuuugagguggagucucacucugcugcccaggcuggaagugcaguagcacaaucuuggcucacugcaaccucugccuccugaguucacgcaauucuccugccucagccuucagcguagcugggauuacaggcaugcacaaccaugccuggcuaauuuuuuuguauuuuuaguagagacagcguuucaccauguuggucagguuggucuugaacuccugaccucaaaugauccgcacaccucggcuucccaaagugcugggauuacaggugugagccacagcaccuagccaccucccuggacuuucacacacgccccugacgcugucuuggccccacccugccaugugccuaggaaucgccaucugcagcuugggggcuggggguggauccaggcuccucaugcucugggaccuuccugcuggugcugcagcaccaucugcugggcugcccugacuccugcggagggggaggaguggggcgagagggguguggcuuguacagacugauguccccaguuaccucuccuaggggacugcucuccagagccaaguccaguaucucagcauuggcuuugggccuagggaccugggcuggaggcccgacucugccauuuuugacaagaucagcaggucagaggagugucacaagaaaucugugaauuuguagacaauacucagauuccauguuuuggcugcagugggcaucacuguggcaucuuggaauaggacccuguggugggaggcaggaggccugcuucucguugugucuauuucauuggugacuuugggaugaaugggucuccucaucuguauaugaggggguggcggcaggguaugucaagugacccugagacccagugccccuacaaauucugaaaucccaagaaggaggggaucuugggaguuguauggaggaaaaucgaacagaaggggcuccuggaguggggauggguggggguucuguguagaauaauucauuaaacaaaggguucugcagcuuaaaauauacgaguuggggucaggagcaguaggugguucaugccugugauuucagcauuuugggaggccaagaugggaggaucacaugaguccaggaguucaagaccagccuggguaacauaguaagacccuguuucuacauaaaauacuaaaaugagccgggugugguagcaggcaccuguggucccagcaaccugggaguugggagaaucacuugagcccaggagguugagacugcggugagccaaguucaugucauugcacuccagcccgggcaacagagugagacccugccucaaaaaauacauacacgaguuggaaaccucugucacguggcucaugcacucacagucuuaacugagcaucauuuaagcgccagguucuuagguguagccgugagcugaugagagcagcagcccucuguugcuuugccuguagccuguuuuccugacagccccugccuuucucucucuaucccaggucagaaguugaguagcaggggccuaggagggcucgaagccuucacagcgauggcagagaagcgaccccugagaacccuggggccugugauguauggcaagcugccccgcuuagagacagacuccgggcucgagcacagccugccccacucuguugguaaccaggaucccugcaccuacaagggguccuacuucuccugccccauggcagguacuccuaaggccgagucugagcaguuggcguccuggaccccauacccacccuuguacucuaccgguauggcaggacccccacuucaggcagacaaccugcugaccaacugccuguucuaccgcucgccagcagaaggcccugagaagaugcaggacuccagcccuguugagcuccugcccuucaguccccaggcucacuccuacccaggcccaccacuggcagcacccaaaccugucuaccgcaacccucugugcuaugggcucucaacuugucugggggaaggagcagugaagaggccacuggauguugacuggacucuggcgacugggccccuguugcccucagcugacccacccugcucucuggccccagcuccuagcaagggccagacucuggauggcaccuucuugcggggggugccagcugagggguccaguaaagacuccucagggagcuucuccccaugccagcccuuccuggagaaauaucagaccauccacagcacgggcuuccuggccuccagguacacagguccuuacccuaggaacuccaagcaagcaaugucugaggggcccucaaguccuuggacccagcuggcccagccccuggggccacccugucaggacaccgggcccacccacuacccaccaccccaccacccaccaccccacccuccacaggcccugccuugcccuccagccugucgccacccagagaagcagggcagcuacagcccagcacucccacugcagccucuggggggccacaaggggaccggguaccaggcuggugggcugggcagccccuaccugaggcagcaggcagcccaggcaccuuacauucccccacuggggcuggacgcuuaccccuaccccucugccccucucccagcacccucuccaggccucaagcuggagccgccucucacuccacggugcccauuggacuuugccccccagacacugaguuuuccuuaugcccgggaugaccucucucucuauggagcauccccugggcuuggagggacaccaccuucccagaacaaugugcgggcugugccacagccuggugccuuccagagggcaugccagccuuugccagcgagccagcccugcucagagccugugaggccugcacaggaagccgaagagaagaccuggcugcccagcugcaggaaagagaagcuccagccccggcucagugagcacucugggccgcccaucgucauccgagacaguccaguucccuguacccccccagcacugccccccugugcccgggagugccagucucuuccacagaaggagggcgcaaggccacccagcucuccaccaaugccugucauugacaaugucuucagccuggcccccuaccgugacuaucuggaugugccggcacccgaggccacaacugagccugacucugccacagcugagccugacucagccccagccaccagugaaggucaggacaaaggcugcagggggacccugccugcccaggagggccccucagggaguaaaccccuaaggggcucacuuaaggaggagguagcccuggauuugagugugaggaagcccacagcagaggccuccccugucaaggcuucccguucuguggagcaugccaagccuacugcagccauggaugugccagaugugggcaacauggugucagaucugccaggccugaaaaagauagacacagaagcaccaggcuugccuggggugccagugaccacagaugccaugccaaggaccaacuuccacagcucuguggccuucauguuccgaaaguucaagauccuccguccggcaccuuugccugcagccguggucccguccacgcccaccucagcuccugcucccacacagccugcacccacccccacaucugggcccauuggacugcggauucucgcucaacagcccuugucugugaccugcuucagccuggcacugcccagcccuccagccguagcuguggccuccccugccccugcuccagcuccauccccugcuccggcucgagcucaggcuccagcuucagcccgggauccagcuccagcuccagcuccaguugcaggcccugcuccagcaucuacuucagccccaggggacucccuggagcagcauuuuacaggacuacaugcgucccugugugaugcuauuucuggcuccgucgcccacucuccuccagagaagcuucgcgaguggcuagagacggcugggcccuggggccaggcugcguggcaggacugccagggugugcaggggcugcuggccaagcugcugucucagcugcagcgcuucgaucgcacccaccggugccccuucccccauguggugcgagcuggcgccaucuucgugcccauucaccuggugaaggagcggcucuucccucggcugccacccgcuucuguggaccaugugcugcaggagcaucguguggagcugcggcccaccacgcugucggaggagcgggcacugcgggagcucgcccugccaggcugcaccucacgcaugcugaaguuacuggcgcugcgccagcugccggacauuuaccccgaccuucucggccugcaguggcgcgacuguguacgccgccagcugggugagcauggggcagccccaguggccaccggagcugugugagcaagugacaggugugugugcugugugagugcgucacagcuggggcugagugauuccaaggacuccugcccggguagggggcuuuaggaugagcucuagguacccccaccccuugacccuccagacaaucagugagcaccuucauagccucuuuuguaggcuucugaacaugccagcugcucuguccccauggaaacuccucggccuccccuggugcugcaccuucuuggauucccuccuccucugccugugccuucuccaucuuuggugcaguguuuccggcacucugguuaggcccuguuuucuagcugagauaauuucccugaucuccagccuagcauccccuuugugagcucuagcccuaaauaacccacugcaugcugggccucagccccugggucucucucccacacugaacucaucccaaaucacacucccgagccuuccccucagcucacuucccacaaccaguucuuuuccaugucagugaagggcacccccuuucacaaagcuccucaugcucuagaccuggugagggccacagcugccuuuuugaacguguaguuuugcaguccuccccggcccuuacauacacagaagugugcgcauaagucgcauuguuuugugguuugcuuuuccucuacuaaaugaugugccugcuguucuccagcuuguuuucuuuuaauguccuggaggaccacacaacugccgaaguguuguguggcguguaugaucacacuucuucagcuagggaucuggugaugggaccaaguggauucuguuauugccccuccugcgucaguacaccuggcauugcagccugaggcccccucuaguuuuucucucccugcugcccccaauuccacccucucccauuuccacugcccagccucuucccuguagaaacuguuccuaguuccauccccguaguggcagccuugccccgggcccuuaccugguugggauggggaagggccuguggcagugaggugcagaugagcuuaggggcuggcugaccagaaucccugaucccugaguacuuacaaaauuggagcagaugccuuaaugggaugcaaaggaaauccagacucaggcgaucuguuacugagugagggucccacaucacucagggcugggcugcccagcucaguccucuccccauacaguugggcugucuggggcccagagagggucaggucuguuucuccugggcugccugaucagcaguggagucugggcacuccacacaguccgaggugcucugacuggagcuugcaacaaucggggggccugggaagcaagugauugagaccaggcuucuggcuucuggcugaauuuuguugccccuguccucacucccucccaccuugggggccguuuuucucugugugccccuagacaguuaucccugccuuccuuuguuguggguggguuccugugcucccccagcauggcucuuaggacagucccuaccugggcucggccucgggcuugggcuuggucucuggggcugguauggcagaaacaugauggcugucuuauauauggcaggguccucuguucccaugccucaguuuuccaucugagcaauggguauuggaccaggccaaugguuccugaccugcugagccccuuugcucucauccuuguacccaaacagccucuccugaguggugcccucaucagauagaguucuggugucaccuggggagaagcacaucuuuuuugcuuggauggucuggccagugggcauguguggggaagaguugugaugccagccugacuuggggcagagcagaagcacuguuuggauggcuuuggaagccaggaggugggaccugaggguauggggucugcaggcugacuauguguucguuuuccaggugacuuugacacugaggcuggagcuguguccuccucagagcccacuguggccagaggugagccagagagccuagcccuggcucagaagucaccggcccccaaggucaggaagccaggcaggaagccaccaaccccuggcccggagaaagcagaggcagcugcuggggaagaguccuguggugccuccccuaccccugcuaccagugccagcccaccuggccccacacugaaggcccgcuuccgcagucugcuggagaccgccuggcucaauggccuggcucugcccaccuggggccacaaguccucaagaccagaccagcccucacccugcccacagcugcuggacagccagagccaucaccuguagcacugguugccagugcuguguguauagcagucacucuccacccuucccuucugccugcccagcugccccggggccacgaguggaugcuggggcuguggcugcuccccuggagggguuccaucucugacccuguggcccauucagggugggcugaagagccccugagcuuuuaacgugagggucuuuauuggauaggacuacucccuauuucuugccuagagaacacacaugggcuuuggagcccgacagaccugggcuugaaucccggcucguguucuugcugcaggaccugggcaagaaacuucaccucugcugagcccucauuccccauguguaaaaugggacaacgcaaccuaccucacaggguuguuguggggaugcugccugauacauacccugucaccauuuggucucugcuuccucucugggacagggccuagaauuggaggcagagaaccuuccuauagaaagucuucguguguccuaggacuuggcuaucguagagugguaccuuaggcaguggaugugacucacacuuucaggagucaccccccagcauuugggguuggguuggcccuacuccagccuggagcucccugagggagccugcacucccugcucccaauccccgcuacuggugcagggaugcagccuggagcuggcguccuuguucugggccugcugcugccgccaccccaggaggccccaggccuguccugaauugacaucagugcuucccugaacugccucccccaccccuggcauuaucccaggaaacuuauguuuucuagaagcuaagcagcugcugggacucagggacuggugcagguaggcugaguggcagcucaguccuagaaggucucugaagaucuggacugaggacccugcugcuccccaagccagagcccaucagccaggccugcugugagccaccugccuguggagugcugagcucaaccaaaggcuggcaagcucugggccucauuuaagggauucugaugagccgaugggcccuggaggcagcccauuaaagcaucuggcucguuuuuggaaguggggccuguccguguguuuggggauggucgguuucauguuccgucacugugugcuuagcccuuugcucgcaggcugcucucccugcucccaguccagaaggugcuucugcacccucgugcagauggcuguggcucuguggaccccucucacacacauacuugcuugcucugggaaagcccucucuccugagaccccguggguccucgugguuguuggucugugggcuacugccuggugagaaaugcuggucauuagacccagcacgugccucucucccagggccagacaugucuuucauggucuggguagaacuguuacagccuccccauugcuggugaccaugcaucccacugaccuuagcuuggagggugggggguagugugcugggcccacccucuggagacccugccccugcugggcucuguucccccagaggcuuguucucagggcagcuaagguggcuuccugggccugucuucccacucccccugggccaggggccaguccacuggggcuuguuggaccuguguggcauccuggugguggucacugagcccagcugcacugucccuccugugccagccuggccuuaacacuaggcugggauuuggaguggcagcugccauuguccccuuccauuguucauauaggcccaagaagagcuacugggcugugaagggauagguaaccacaacacauuguggcugcugcagugacaaccaggguggaggguccuugggucccagaagaggugauaccugaauuggaccuugaagacaaauacaaaaucacaugcaaaguggggucuggguagagagagccgcacgugcagagucuuggugagucuggaacaggaaaauccccaggcgaggcuggagcucccagaaccagaaggggcaggagcagggcuuggaagccuggcuagaaauccagcaacccagggacucagucccacaaccugaagaauggggaugugagccacguggaaucauuugacacuacuacagggaggaaagaauugcaguggagguggaguuucugaacucugggccccccgggcccugggcagccaugggcaccucgucagccccaucagucacauccaucucaucgucagcaccuuaauggagugagcgcuuuauuccuuuuccuucgguccucccuucccgccguccucuccucucccucccucccuucacaccugugccccugcuguaugccugacacacaucuuaccaauggugaccaggcagagugagggcucagaacagguagggcuucgcaccuggguuccucuguggccccagaggacucagaauggugcagaggccaggcuggggugguggagagccaggccuggcuggggugguggagagccaggccuggcuggagugaggugcugcucugcgacgacagcucuaugcagggaggcccucucuuccccugcaccagucugagggaagagacuuaacccggacuugggaguucuagucuaaggaaggagauaugacagugucccagggacccccagucugagguggugggggcaggaaccagacucugcccaggacuccuagucugagggaagcagcgcccuaccuagggcugccaccccuagggcaaggaaggagugagggcaguggagugugcuggccccgcccccacccccaaggagacccgagcagguccaccuaagaauggggcucaggugagacccagccucaccaugccccaccuggcacccuagcccaauacaaaaggcaaagggccugggcggccggcuuugcugacaggaguggagcuagcaagguagugagugggaaggaugacagcccugucuugggggacucggagaguaggagcugggaaggggagaggggcuccccggacagagucgucucauagggaacagcaccuccagccaggcucagcacuacaccaccccaaccuggccuuggcagggacccuggugcugagcccugcuuguccugaggccucauucugcccugucgcugcuggcaacgcccaugucugggguguugugaagaccccaaagccccuucgugacuccagacgccucuuucccucugucauuccuggccucauugauguuccucuucccgugaguuuguucucacuaaggggguugagucgagccagcugagucuucccucaaaccuccuuuggggauccucggagcaggacccgacucugaccugacuggcugugacucuucucauccugcaguuccugugccggagaagggagggccgaaccccgagcccagccugcugccccagcugguggugggaggcgggccauggggacgcuucagcccguggacauggccuugcugcuggcuauaugcugugcucucuccaugggcagcuccccaagaccccaccuccagacacccccucaguggggagcacccagugcagcucuucuggagcccugucugcccaggagaugggaaugggggaaugcugccaagccccuccugucucuccugcugcacauggaccccuuuuccaggguggcgggaagcugggggccuccuugaggacgcugcugccuccauggggacuccaacucuggauguucuagcuauggcccacucagaggugccugugucgaugagcccuccaccccuccugccacagccccuagccucagccugccuggccacuguuccucccacacccugccuuuguccaagaggggcccagcuuccaggucccugugauuucuuaggacaauuggaacccaggguccuaggaaggggugcugagccccuuggaaggaccucaaggggccucuucuaugauuucuggguuugucaggggaucccuugcuucuucaagagccucugauaaggcaucugcagacccuuuuccuccucagauuuggaugaugggaccagggcaggccccuccuguauccccuagcuccucuccauauaauucagaacuuggggucccaagcuuggcugcaccuccucaaacccuguaaaccucuuagacccaaucccacuacacccucagaggggcuggggcuucagcuugggcccuacuacacagaaagcuagugcuucucugccuccugcugaggccuugaugacuccucagugaggccugggcucccagcugccuuaaguaggcaagagacccuggagacagccgcuacucaaggaggccuggguucuccaacagaccuggggagcccgccugccuuuccacaaggcuugguaccucccuugggcuagaucugggguaucccuguccauccuuugcugccacccuucugcuugccacuuccuggccccgcggacauaccaggacccuagcuuccagaggccaggucuuccccagccccacccugccaucugcugccacccuggcaucucuaagcccagcaggccacaagagucccuagcuacuaaaagacugguccccaccagaucugcccagugcuuccccagaggccagugagcaugcccagcccccagcccuugguagcccagccccuucuggguguugccagcuuggagcuuucuucuagaccuguggaugcuauccuaucuggaguuagcuuagaccucuccccuggccuccugggcacuucuggcccuaauccccuggcagccuguuuuccagcauuccugggacugguggggaggccucugccagcucagcgggugccccucugcacaccagacuugcuuuccuugcaaccccagcaggaagccucauucuuuguggcauccagcccaccccucugaugugggcccuaaaccuccagcuggcccagcccugcagaguaggugcccaaagguaucuucagcgguuccugucaugcuggucuccccccaggguccccuucuggagccuggcaccauagaucucggugggguggggaguacagcucagucucccuucccccucacaccacucauagggggcccuguccaccaaggccccugacugcugggggacccacacccacagcccccuucuuucugacugcuggcccuuccccagccuggauacucgagcccugggcagagggguaacgaucccaggacugucuucgcaggcagagaggccacuugguaccaggcccugacuccuugggcugagcucagcagcaggcgugucaccaaggcccccugggcagaaggggcucagcccugagggcccaucacucg

SEQ ID NO: 16016 - RNA, 676 nt, Homo sapiens
agcacgcugccacgccgacgcagaccacucucugcaugccagcccgcccgcacccaccauggccacaguucagcagcuggaaggaagauggcgccugguggacagcaaaggcuuugaugaauacaugaaggagcuaggagugggaauagcuuugcgaaaaaugggcgcaauggccaagccagauuguauugucacuugugauggcaaaaaccucaccauaaaaacugagagcacuuugaaaacaacacaguuuucuuguccccugggagagaaguuugaagaaaccacagcugauggcagaaaaacucagacugucugcaacuuuacagauggugcauugguucagcaucaggagugggaugggaaggaaagcacaauaacaagaaaauugaaagaugggaaauuagugguggagugugucaugaaccaugucgccuguacucggaucuaugaaaaaguagaauaaaaauuccaucaucacuuuggacaggaguuaacuaagagaaugaccaagcucaguucaaugagcaaaucuccauacuguuucuuuuuuuuuuuuccauuacugcguucaauuaucuuuaucacgaacauuuuacaugcagcuauuucaaaguguguuggauuaauuaggaucaucccuuugguuaauaaauaaaugcguuugugcuaauaa

SEQ ID NO: 16017 - RNA, 3392 nt, Homo sapiens
agcgggcgcgcugcggggcgcaugagcaggugaaggugaaguuccacuauaaucgccaucagcgcucugagagccaacccucacaaaccggcagucuaaauaaaagcugcgcuugccgugcaaacacugcuucaaauccgguauccgagcccuucccauuugcaacugaaggccgccccucguccccucccagggagagauuuccaagaggcuugcuggggccuugccccuccucccccgccccggggaacacccccaccuuuuuuccgcucccaaguauucuugccucaaggacagcuagugcgcggucagcagagugcgggaggagcuggcugcggcuccacuccgcgccuccccgcgggcgauuacgucgcggcgugguccucgcggggcgcggaagacccagacuucagccucgccacgccugcccggagcucgaggcucccggacccccguccaccccugggacgugaggagugaggcuuugggccaggcuguuccccgaggcgcguggggaagcgggcgugaccucuucugaaaaggcgguaggcucgcuccacccaggcccuagagcccacccuuagagcugcgcgcuuuagggugagccaggcacgaugccuugccaacguggccgcccccuuccucccaggcggaauucgcucaggcaacauuggccccuugagauccagugggguccuuuucgaaaggaggcuaggugaacgcagguuuuaaaaaagagaagggaggggccgggcgcggugucucacgcuuuuaaucccagcacuuugggaggcagaggugggcggauuacuugacgucaggaguucgagaccagccuggucaacauggugaaaccccgucuccauuaaacguacaaaaaucagcucggcguuguggcacgcuccuguaauccuagcugcucgggaggcugaggcaggacaagcgcuugaacccgggagcugaaggcugcagugagccgagaucaugccacugcacuccagccggggcgacagagcaaagcucugucucgaaaaaugaauaaauuaauuaauuaaauaaaauacaaaagagaagggagggauaccccauucuccaggaugugauuauuaugcauugcaugccuguaucaaaacgucucauguacccucuaaauauagacaccuauuguauacccacaaaaauuaaaaagacuuaaaaaaaaauaaaagagagaaagaagggaggaagauggggaguugaagcccugggggcauuauggaacuacuggaugccucuccggcggaaacuccacgggaccgaaagagaggcccggggucuccugccgggugagagaagcauuagagaaagaugagauugggggcugucaggacuacugauggaagggagggggucugagaaggggcccgacccucccuaaaacugcucucgggauucccccguccuccuuccacccgcccuacgcagucaggacugagagagggcggcagaucugguccuagccaggggacugugacggggcguggcggggagggacacagagagcuggggcgggcgggccaccgggaaagugcugggggcaugacagugccuuggauugcugggccucaguuggagauggggcugccagaugcuguucucccuccucccgcuguucucgcccucugggcaucugcagcagcucucagucccugcuguucaaaaccaggguuuacuuccuugucacuucuugggagcggcccucggucccugcuguucagaaccgggauuuacccucuuaccacuuccugggaguggcugcggcgacuggaccuuggcaccgcaaugugugaauggcugacccccuccccgucuccuggugggaucaggaacccucgggguaugcuccgaaccgggacuucggucucgguccagucuccaugggccccacacagcggugggggcuggaggcacagcagccuugggaagaaacaaagacuguccgcagcgcguagcggggcguggagaaccgagggcuguguaaggucaggcccugagaaaaagcccccgaaaggcuggaaguuacguuggaacgggcugguuguggaaggagcgagcucuccguccccgggaguaugcaaguuugggcugcacgaucacuuggaagggauugggcggaguucugucauuuggagaaaggguccugggagcuucagguuuguguagggcgaggacggggcgguucugcguccggccagguuggcccucgaggacccagccguccccaaccuccuaaacugcugucggauguagaagacucgcauucacugcucuccacagucggugaagggagaacgccgaaaagggccgcauucccuccugccgguccccuccccuucccgcgcucccucugcagcacuuaaaauguaaauguacaucgugauuagccgcggggucgcuaauuacagcugaagccauucauuacacugucagcgcgcgucgcagcccgccggcugugcgcucccuccuagccgugaagggguguagggggugggggcgggagaugcggggagugagggaggaaggauggggugcugugaauuaggguaauguggcaggccuggaggaagcuggagugggagagagcgggcagcgagcggggaaaacagggugggcggugaaggacggggcgggguggcgaggagagaggagaaacgcgagaggcaggaaggaauuggggcaugaaguagugaggacacagggaaaggggcuguaugaggggggaaacagcguaggggacagggcgaagggagaaaaagcugagaagagggugggaaccccaggguggggccagagucagaggaggggagcacagggcucaacuucagaaaggcugguaaauuuuaaaguagagcaucaguggugcacaccacacaaugguuagaaaaguggagucagugaagacguuguguuaaaggagcugggugccagccauacacagaguaggggggcauuuauuuccguguguguuuauagauguaaauguauuuuuaaaauaucugcaagaaaacagcacacugaccucuuguuaccgcaugaaguuuucauuaccuucuuuaagaaaaggacaauuaaauaugaauacagagucuuggagcagcuugcauaaaugagcuacugacccugaagcuucagcuucuauuagcuucuuucugccucugugugaccuuggacaauuuacuuaacccauuugcuuuggcuuugucaucuguaaaauggggcuaauuauaguaaucuaccucacagagugauuaugagacacagccgucuuggaaccuuggcugcuaaguucucaggaaauguuggcuguuauuauuuuucauauauuauuugugaauuuaaaaaaauuguaaagg

SEQ ID NO: 16018 - RNA, 6914 nt, Homo sapiens
ugcgcaccgccaucuuguuaaaagagcccgccucucccucggccggucacucuuucgccacgggcgggguugcaccauccggcagggcggggcccggccauggcgaccgcggagcccagcgggcgcgcguugcgguugucuaccccgggaccccggcccagcggggcucgggaccgcgcgccgggagcugcggggccacccuccgggcagaucgguaauagagcccuccgucugggggagcgcacccccgcggccguggaaaagcgggggccauacauggugacgcgcgcacccuccauucaagccaagcugcgugaguguggcccgauggucgggggagguuucucccugggcgggcggccgcguccccagggcggguuccggagcuccgcugggccucggccccggagggaagggguuagcugcagccugcucucgccccucaaaauccguucggaaagagcggccucccagccuucgggagacgcggcggaguggggaagacccggcugacccggguccuuuaacuuccagagaagcaccgggaccuggccaaggccguucugcggagaaaaggcaugcugggggccucgccgaaccgcccagacucuucagggaaaaggucucagcaggcgccaccuccucugugccagcagcuuuagagaaggcuuuaauccccaggacggaggcagggugcucugguuuaaggccgagcuagcgauuccccugaugcaaccugucagguucacuaucuuuaaaaugggaagaggaacaaucucucuuuuccuuuaaggaugugauaggaucagauaaagggcuucggaauaagggaguucugugagugcacaggcucauucacuaucauucuccuccucuguuagggaggagaaugguggcuggaguccccagcaaugaggacgaagagcagugugggaauggcuagaccuguuuuuguuuguuuguuuuuaacagaauaguaaacucggagcugcauagaaccuuauucagugccuccuuuuacagaugaggguugaaacucggagaagugaagguuaacccuaaccuuuuacccaaagacuugcaguuuuuguguccucugauuaaauaaguggggagagggugcuuuuccuagaucaggcaaggggaggugugcuuuuuuccaagaccuaugggaggaguagaauacaggccgggcgugguggcucacgacuguaauuccagcacuuugggaagccgaggcggguggaucacuugaagucaggaguucgagaccagccuggccaacauggugaaagcccgucucuauuaaaaauacaaaauuagcugggcacgccuguagucccagcuacucaagaggcugaggcaggaaaaucacuugagcaugguaggcggagauugcagugagccgagaucgcgccacugcacugcagccugggugacagggccagacucugucuccaaaaaaagaaaaaaagaaugagaacauacacauucugaggcacuguagccagguacauggagcugcaggcagugguggcugugaccagggagaaggcaagucaguagugcagucaauucuuucuccuucagggcgaggacucugccuaucccugugaaaugccuaugcuuucaucuauguuuggucucuucucccccgucuccccucaggucagugaaguuuaacaagggcuauacugcucuuagccagaguccagaugaaaaccuggugucccucgacucugacaggugagugcuccccuuggaaauacccccuugggaagcaacuuggcugggacugaagaucgccugaugccuuugcuuguucccugucuccuccaaggcccuucauguacauuccagggccguucucuucugaacaauaucccuucccaggauggcuugguuagaagacucauagguaaucgugcugcucuagaauucggagcaccaauguccgggggaucauccugcccuguuauguuugcauuguuagugagagugacccugucccugccagaaccaauugagggaaccaguauuauucaaggccuguucggacuugaguucuguuguguguggccuuugcuucaaaagucuuccagaugcccuugcaugcucuccgccugaugauuuacagcugugcaccacagguaccucccggaacugacuguuuuccucuucuccuagugauggggagcugggauccagauacuccuccggguauucaucugcagaggcaaguccagaacaccuuucugugcagggccaggcugcaggcagcauuaccaccacugccaaaugcuuguuuggugcccgcugugagcacagcacugugccagacuucuggucuguucuacgaucuuccacucugcccucuucccccgguggagguauaggugaccaaggagggcuguugagaaucgaggagaccauuuagacucagggcuagaaaugaucucagaagucauguaagcugggcauggugguacaugccuguagucccagcuacuagggaggcugaggcaggaggauugcuugagcccaggaguuccaagaccagccuggacaauauagcaagacccugucucuaaaauaagacucuaaaauaaaagucuucuaggccacagcuuacaaaaggaacccuuuugauagaucccagcuaaguguuugcuagucugugcuuacuugaaugcuuuuuguaauuggguacugaccaccuccaaggagccuugcuacccacccuucccucaacacacacagaauuuuuucuuugaguagcuguuagagaaaucuuccuuauuaaucugaaugguuccauugguccuugaccugcuuuccagugucacacagcaacucuaguuucucugagaucagcauuuccgucucuccccugcccaucuuucaccaagcuugcuuucuuccagaccaaacaacuucuguuucuucaguuguuccaucuaugaaaacucaggcuaaaacacuccugggauagccauguagacauuuuucuagagugacugucccagauagaaaaacagggauguaaaauccuggcaagugaagcccauucccuuugacagaggugaagugcuggggaccugacucuacaccacuugcuuuucuuacucuccuggaaaucuuggcuaaucucugaguuucugucacagagaauagagcaguuugcaaauuuuguccuccuuaaaugucugagugucaaagauuguguguaagaggaagucuuacacuuuccccagccucauuuauuuuucuuuuucuuuuuuuuuuuuuuuuuuuuuuuugagacagagucucacucuguggcccaggcuggagugcaguggcaugaucucagcucacuggaagcuccgccucccagguucacgccauucuccugccucagccucccgaguagcugggacuacaggcgcccgccgucacgccuggcuaauuuuuucuauuuuuuaguagagaugggguuucaccauguuagccaggauggucucgaucuccugaccucgugauccaccugccucggccucccaaaaugcugagauuacaggcgugagccaccacgcccagccuuauuuuucuuauguucagugaacugaugaaaccaaccaacaaauuccacuuugcaggaacccaccucuguuggcaucaaaggauaagucuaaccagcaguguguagacaaagcugcucaccacccccuuccacuguaacccaugcucuacuacgcuagcccauuguucuguuauuaucccauauucuucagcuuugauagggacuagucugggcucccagugggaacugucagagcacugauuuucaaacauauugggaacucgauauuuacaugaaugccucaggauuuagugagaacagaucccugggggucagugacagugaagucuggacaguacuaaggcuuacugcuggcugaggcacaaguaggagaaggugguacuuccuccuguaguccagggaugugugggguuggccuggggugggacauggacaggaagcccugguaacggaaugugguucugucuuuuggguagcaguuacuucugcuuugcaucuuggccuauaguucccuccucuccuucucuuagcaggugaaccaggaugugagccggcagcugcuucaggauggguaucaccuggaugagauuccagaugacgaggacuuggaccucauccccccuaagcccauggccucuucaacaugcuccugcugcuggugcugucuuggggacucuucuuccuguacccuccaguagacauuacccuccaaggugggcccugcucaccaugaggccuacagagcccuguuggccacucauagcucacacagugcagugagcacugaagucacugaccccuagaaagugaccugcagguagcccuuaccuguugcuucucaggccagaggcccccaucugggcugugggcugauagguagaauucuguaguuuuccucugcuguuggagcagaguuuggagaagucacuuuaauaagggcaagacagaaaauucugguucuuauggugggugacaaagguggcuaaggaaaacacuugcagacagcuugauugguauuugucauagugcuucagggaggcaaaaagggagcucuugugcccaggcugugcuagauaguguugaauggaggcagaaaauagcacuuuaugguuuauuauagcuggcaauccaaaaaagaaacuguuugagaccaguucgagaaauuccguuugcucuauucuuccuagcucuaagaugguuugcaggcuugaccuucaagacagcauaaagugaguccuuuugucccucuucagguugcaccugucuaacuaugacagggaucauagcagguugcuuaaugauacagcaggauccuggcuuccagaaucccuggaccuggggcauccccaacugguccaaccguccgggugaguuuagugauucugguuugcccuucccuaguuagagaaaaacugcucugacauguucauauuuauuuauuuguauuuccuuggucugggugaguuucuucacccagucuuugagcuaaagauuaggucgaagguacuggggcuggccccagaagccugcaguuuuuauuauuaccagcagagggagcuacagggagcaguccggugccuuccuauuguuuacuuuuuaaacuuuugagaaguagcaauggacucgugagaguggguauacagcugugugggcuuuguccuagacugaggcuuacagacaggaaggguaagagagaccuaagccagcuccuagacccuugccugaggaaaucaguccaccaguguagagggccucccuucacuccagcauggaccauucuauugccagauucuucuggucacagcaugggccuuacuggauacucaggauugggcuuuaagcagaccucugggugugacacagccucuuucagcccccagcccaaacagcagaaauaggcauaauuucugcugugacacccccuacccacaaauuggagaguauaucuugcuauacucuauaccaagccucuuucuagaauuuuuccaacagguuuuguuuuguuuuuuggcuuaacucagaaccauggugagcguucugcuuuguuuuguuggagacagggucucugucacccaggcuggagugcagugguguaaucacagcucacugcagccucaaccucccaggcccaagcaguccucccacauggugagcuuugaaugggcauagacaggguucccagcccaauagucgggauugggguauagguucuacaugggaaaguauccagucucuugcuuuacucaguguccugugaccaccagaggcaugagagggacaacacacucuuuucgcucuaccacaaggggugacuagaagaugagcaagucuaauaaaaagauacggccuuauuuguuauuugucugacaaccauccuuacgaugguaauccugugagugccugauggacaucuaucuuuguguuuuucucaaaccauggaagguugagaggaauauacaguaucugggggcugacuuacucuacuagcuaggagcaucacagcagagagauaggacagagaccagagucaugccagcuuggggucuugggaagagaggcagaugguuacucuguucuggaaugggacucugcagcucuaugcaguggccaacauucugagcacuuugugcaaaugcuuguagagcucaagaacaucuccauccagaaccccuuccccaucugcagagaccauguccaggccuuucuugugucugcagaggugaagugcacauguggaaagggaucaaauguagcacaguguaaagaaagacagcaacacagguagagggacccagugugugcugggagguggcuguggaagguaaguauagaccuacaucucuguuggggagguggucagggcagaauggccuggguguuuagcagcuucuaggggugaggguggcaggaccccaaaaccaaggcccucugcaucguuguuguaauaaucagcucuggcauauucagcugcaacugucccugaagaagagguuucugagcuggcugaccccauguaggaggguguuaccuuguagaaaaagcuggagggaccuggugggacagugcagugaggcaggguagaaauggucaguuguuuagggccaguggccacauaccaaaauaccaccaaugugcccagggccaaacugccuuaauucugagugcuguguguucugcaggugacaguuuccugaggagagggguguauccaggcuuaccucccagcaggagugguaccauaugguguuuauguacuacucuauagaacucuuggcuugcacuucuacagcucuguacauuuauaagaauaaaugcaaucacacuaguugag

SEQ ID NO: 16019 - RNA, 2908 nt, Homo sapiens
acucagggcuagaaaugaucucagaagucauguaagcugggcauggugguacaugccuguagucccagcuacuagggaggcugaggcaggaggauugcuugagcccaggaguuccaagaccagccuggacaauauagcaagacccugucucuaaaauaagacucuaaaauaaaagucuucuaggccacagcuuacaaaaggaacccuuuugauagaucccagcuaaguguuugcuagucugugcuuacuugaaugcuuuuuguaauuggguacugaccaccuccaaggagccuugcuacccacccuucccucaacacacacagaauuuuuucuuugaguagcuguuagagaaaucuuccuuauuaaucugaaugguuccauugguccuugaccugcuuuccagugucacacagcaacucuaguuucucugagaucagcauuuccgucucuccccugcccaucuuucaccaagcuugcuuucuuccagaccaaacaacuucuguuucuucaguuguuccaucuaugaaaacucaggcuaaaacacuccugggauagccauguagacauuuuucuagagugacugucccagauagaaaaacagggauguaaaauccuggcaagugaagcccauucccuuugacagaggugaagugcuggggaccugacucuacaccacuugcuuuucuuacucuccuggaaaucuuggcuaaucucugaguuucugucacagagaauagagcaguuugcaaauuuuguccuccuuaaaugucugagugucaaagauuguguguaagaggaagucuuacacuuuccccagccucauuuauuuuucuuuuucuuuuuuuuuuuuuuuuuuuuuuuugagacagagucucacucuguggcccaggcuggagugcaguggcaugaucucagcucacuggaagcuccgccucccagguucacgccauucuccugccucagccucccgaguagcugggacuacaggcgcccgccgucacgccuggcuaauuuuuucuauuuuuuaguagagaugggguuucaccauguuagccaggauggucucgaucuccugaccucgugauccaccugccucggccucccaaaaugcugagauuacaggcgugagccaccacgcccagccuuauuuuucuuauguucagugaacugaugaaaccaaccaacaaauuccacuuugcaggaacccaccucuguuggcaucaaaggauaagucuaaccagcaguguguagacaaagcugcucaccacccccuuccacuguaacccaugcucuacuacgcuagcccauuguucuguuauuaucccauauucuucagcuuugauagggacuagucugggcucccagugggaacugucagagcacugauuuucaaacauauugggaacucgauauuuacaugaaugccucaggauuuagugagaacagaucccugggggucagugacagugaagucuggacaguacuaaggcuuacugcuggcugaggcacaaguaggagaaggugguacuuccuccuguaguccagggaugugugggguuggccuggggugggacauggacaggaagcccugguaacggaaugugguucugucuuuuggguagcaguuacuucugcuuugcaucuuggccuauaguucccuccucuccuucucuuagcaggugaaccaggaugugagccggcagcugcuucaggauggguaucaccuggaugagauuccagaugacgaggacuuggaccucauccccccuaagcccauggccucuucaacaugcuccugcugcuggugcugucuuggggacucuucuuccuguacccuccaguagacauuacccuccaaggugggcccugcucaccaugaggccuacagagcccuguuggccacucauagcucacacagugcagugagcacugaagucacugaccccuagaaagugaccugcagguagcccuuaccuguugcuucucaggccagaggcccccaucugggcugugggcugauagguagaauucuguaguuuuccucugcuguuggagcagaguuuggagaagucacuuuaauaagggcaagacagaaaauucugguucuuauggugggugacaaagguggcuaaggaaaacacuugcagacagcuugauugguauuugucauagugcuucagggaggcaaaaagggagcucuugugcccaggcugugcuagauaguguugaauggaggcagaaaauagcacuuuaugguuuauuauagcuggcaauccaaaaaagaaacuguuugagaccaguucgagaaauuccguuugcucuauucuuccuagcucuaagaugguuugcaggcuugaccuucaagacagcauaaagugaguccuuuugucccucuucagguugcaccugucuaacuaugacagggaucauagcagguugcuuaaugauacagcaggauccuggcuuccagaaucccuggaccuggggcauccccaacugguccaaccguccgggugaguuuagugauucugguuugcccuucccuaguuagagaaaaacugcucugacauguucauauuuauuuauuuguauuuccuuggucugggugaguuucuucacccagucuuugagcuaaagauuaggucgaagguacuggggcuggccccagaagccugcaguuuuuauuauuaccagcagagggagcuacagggagcaguccggugccuuccuauuguuuacuuuuuaaacuuuugagaaguagcaauggacucgugagaguggguauacagcugugugggcuuuguccuagacugaggcuuacagacaggaaggguaagagagaccuaagccagcuccuagacccuugccugaggaaaucaguccaccaguguagagggccucccuucac

SEQ ID NO: 16020 - RNA, 1904 nt, Homo sapiens
ccccagaauccugugcaugaggcauguguggauaagcagccaacagucgaaagguggcauccuuccauggcaacaugcauauuuuaguguaaaaaucccugguagguaggacagacauacaaaggcugugacagaacaacagcuuugauccaauauagccugcguucaaauugugguucccacacugacuggcaggacuuaaaaucagaguagcauggcaucacaggguuggugucaggauucaaggcguguucaaugcuaaaugcauucaucaucccuaccagcuguugcuugcugagcccaggaacccucagaggucagagcugcaagguccuugggggucuccuugaccacccuucuccuuccuuuguccagauagggaaacagggcccagcagggauggcaguggggcucacugcugaaauguggcucaccuccuuucagguaggcaugggguacguuggccuccagaaacauggccuccccaggcuucaggguaagcagguucaggaaguagauggcaaagcagccgauaucaccuggguacugcuggugcagcuguagcaaaagcuccccaaagauguccuccauguuguuuccggcagccgcugagggucacagagcaccccaaggucacuuagggggauacucagugcuguucauagccccacauuggccagggaguccuaggaaaaggucccugccacaggaauccagaagccaaaguggcccuguccuucuggccacgccuccagcccuuugggggucgagccuugcuugauacuccaguccauacaaauaccaucuuucaucauaucuugacuauucauaugcccaggacuauacuagccacuaaaagagcuagaguaugguccuuucaggaugggauuucucagccuuggcgcuacugacauuugggcuagguaauucuuuauugugggggcuguccuguguacugauggauguguagcagcuucccuggccuccacccacaagaugccacuagcaaccccuaucuggguuuugacaaucaaaaaauggcuccagacaacagccaaauguccccuguaugagaaccacugcccuuggagcucaaaaucuagggagauaacgcaaaagaguuucaugaaggguaaccaacaugcccgagcuuucccuuuuuuuuuuuugagacggggucucgcugucacccaggcuggagugcaguggcacgaucauaccucacugcagccucaacuguccaggaccaagcaauccuccuaccucagccuccugaguagcgagaaccacacgugcaugccaccaugcccggcuaaguuuuuuauuauuugcagagagagggggucgcuauauugcccaggcuggucucgaacuccugaacucaagggauccucccaccuaggccucccaaagugcugggaauacaggugugagccaccgcacccggcgacuuucuaguuuuuagcacugaaaguucugugucucagcugggcgcgguggcucacaccugucaucucaggacuuugggaggccaaggcaggcggaucacgaggucaggaguucgagaccaguuugaccaacauggugaaaccccaucucuacuaaaaauacaaaaaaaaaaaaaaaaaaagccaggugugguggcacgugccuguaaucccagcuacucgggaggcugagacaggagaaucgcuugaacccgggaggcggagguugcagugaucgagauugcaccacugcacuccagccugggugacacagcgagacuccgucucaaaaaaaaaaaagaaaguucuaugucucagagaaucucucucggucugcuccagagagcaugaggcagaaugcgcugagggccaaaauguguccuggaaacgacaagggaaaaugagcucagccugggu

SEQ ID NO: 16021 - RNA, 3038 nt, Homo sapiens
ccuaaaauauuucuccugccuauuuaguggagaaaaagccaaagcauaggaaggcuuucgccucugcuucugaaacuggaagauguauguuaaccccugaaagaaucauuuaagagucauaguuuuucugcuaccuugacagugcagaugucauucuccucuuuggacagacaaagaagauacaucuaaagaagggaaauaacuaguccaagucuucauagauggcuagaggccgagucuggacaagggccugggucuacugccucccuguauguccaugauggcaugaacauuuguauccagaccugggaggccuuucccaggacucaguugcccuguggggagcacagcauaacggauugggacaggccaacucaggguggcagguuucuucccccuuccccucccaaguuuccugucuuuccaguuguggauggggacucacccccgaggggaugccaagauccuugacaaccgcaucucacagaagacccuaagccaguggauugcugagaaccaggacagcuugggcucaaaggucaaggacaccuuuaauggcaaccugcccuuccucuucaaagugcucucaguugaaacaccccuguccauccaggcacacccuaacaagguaaaggacagagugcggugcagaggucaggguacagaagggcuuaugcuaaggcccucccgugacuuuuacugccacuuuuaccccacccaugccaggcuccugcccaaggccaaauccaggcugacaacucccaauuuagcucugcaaagccagaugguagugacacaugcagcaacuaagucuaagcaaacagcucaccggccugugccaggggaguuucucuaagcucauuccaaggggcuuguuccuggucuucccucauccaacccaugucuauucauaucugccauuuacucaucugcuuucaggaagaguucaacuugcaaggcagggcagguacccucagccccacccccauggagucucccuacacaagccggagucccauccuaagcaacuguggaucaaaacuccuuuuuuuuuuuuucugagacuugagucuugcucugucgcccaggcuggagugcaguggcgcgaucucggcucacugcaaccuccuccucccaauucaagcaauucuucugcuucagccucgcaaauagcugggacuacaggcacgcgccaccacacccagcuaauuuuuguauuuuuaguagagaugggguuucaccauguuggccaggcuggucuugaacuccugcccucguaauccgcucgccucagccucccaaagugcugggauuacaggcgugagccaccaugcccagccaaaacuccuuauuucuagauacacaaaguaagacccagagaagggagggauuuaccaaagccacacagcuuguuagugucagagcuuggucugguauuuggguuuccugauucacaggccaagccucuuaaagucugccccagcuuuucccugauuugccccgggguugccccugauuugccccugcccuggguuggcugagccccaaguuucugcaacaugcuuugacugggcuccuugccagagguagguagucacugccauccugcaacuggggaggguggacagcaggggcuagguggcacugguguaccugcuagguaauggcuguacccucaccauccuccucuuccccuggccaccccacaggagcuggcagagaagcugcaccuccaggcuccgcagcacuaccccgaugccaaccacaagccagagauggccauugcccucacccccuuccagggcuuguguggcuuccggccaguugaggagauuguaaccuuucuaaagaguaaguugggcagaaugcugaaggcaugcguacugggccagggauaccuggggaaccaagaugauaggaacaguggcugagaacgggucacaugucacaggaacugaagggccucaugaagcaguuuuuggagccagugagccaggccagugagaccaggcucaggugugguagucaagggcugguggugagugauugguuuccacugcaaaguuuacuuagcauugccggcucuuugguuagggcugggauggaaagguguccuccaacuccccacuuguguggguuccaucuuaccauuccugauaugggcccugggccuugccuuccuguagaggugccugaguuucaguuccugauuggagaugaggcagcaacacaccugaagcagaccaugagccaugacucccaggcuguggccuccucucugcagagcuguuucucccaccugaugaagagugagaagaagguggugguggaacagcucaaccuguuggugaagcggaucucccagcaagguggacacaguuauauuccugguugggugcaaugcucuggccugggcuucccagcagacaccagacucuggggacaguucucaacccccuugcccaaguggaacacuaaaaggggccccacuuagaugaccuguuggcaacuuagcauugcuugccuagucuuuguggagcagggcccuucuuaguugagugcugcuucccaacuggucaucuucuccagaugguuggaggcagacuggcauagaggacucuuaggaugccuuccaccuaggcauucugagauuuucccuagcccugcagcugcccuccauggauggacuuguaucucggggcuaaagaggcaggaaggggacacgagcauccucccucuccuggaaaggacugaugccuccagcacucagucauuugaucuuuccuuuaccuucugugugcccaaccuugugcuaagaagaguucaggaaaugacugugauggguguggucacugucacccuaaagguggggagucaacacaagcaguaagaaacccaaaacagaacagacucccagcaaugagcuuauguggugcaggcgaugaggucucagcuucuuagccuggcagccacaaccccuucucuagguggcccagagcucucuuuuuauuuuaccucuacagguuucccauuaccuu

SEQ ID NO: 16022 - RNA, 27077 nt, Homo sapiens
cucuuuggauuccucuuggcugugacaguuucucaggauauccuuguuuuugaugaccuugacaauuuucaggaguacugguuggacauuuuguaggaugcccacuauuggaaugugccugauguuuuucuucucaugguaagccugggguuaugguuuguuggugggaagaccuuggagguuaggugccauucucgucacaucauaucaggguuacauccuaucaaugugacuuacagauguggauguugaccuugaucaccuggcuaagguagugcgugucaggucucuucacuguaaaguuacuccuuucccaccuuuccauacuguaccuuuuggaaggaagucacuaugcacagcccacaccgaaggagugggggauuacgcuccuucuccuugaggggggauuaucuccauaaacuauuugaaauucuccuguaugacagacuauuuaucuuuuuauuuuuaauguuuucuuaaaacuuaaaaaaauuaaauuacaggauacaauauagaaaagugcauaugucagcugggaccggugacucacaccuguaauucuagcacuuugggaggccgaggugggaggaucacuugagugaggccaggaguucaagaccagccuggccaacauagugaaaccucaucucuacuaaaaauacaaaaaaaaauuagcugggcgugauggugcacaccuguaauuccagcuacucgggaagcuggggcaugacaauugcuugaauccgagaggcggagguugcggugagccaagaucgcaccacugcacuccagccugggugacagagcaagauucugucucaaaaauaaauaaauaaauggaaaagugcauaugucauguauagcucgaucauguguagcuugaugaauuuuugcaaacuuaacaaacacacauauaaccagcucuaaucaagagacaucauaagcauccaagaagucccguuguguuccuuucucaaggguacccaugaccccaacaucuauugcauggauuuguuuugcuuguuguauuuuacauaaaugagaucaugucauauguacacuuuuuggaggggagccaaggaauuuuaaaaagcuaauagauuuuuuuagagcagucuuugguucacagaaaaauugaguggaaaguaugaugagggagguaaaaguggccauuuaccacccccacucugcaguuuccccuauuauuaacaucuugcagugguguaauauauuuguuacaauucguggaugaauauugauacauucugguuguuguuguuguuguuuugagacagagucucaggccugguguggaggcucacaucuguaaucucagcacuuugggaggcugaugugggcggaucacuugaggucaggaguucuggaccagccuggccaacaugauaaaaccccaucucuacuaaaaauacaaaaaaauuagccgaccaugguggcgcaugccuguagucccagcuacucaggaggcugaggcaggagaauccuuugaaccccagagguggagguugcagugagccaagaucgcgccacugcacuccagccugcgccauagagcaagacucgucucaaaaaaaauaauaaaauaaaauaaagagagacaaaguuuuguucuguugcccaggcugaagugcggugguacaaucucagcucacugcaaccucuuccucccagauucaagcgauucuggugccucagccuccugaguagcuaggauuacaggcacacaccaccaugcucggcuaauuuuuguauuuuuaguauagacgggguuucacuguguuggccagguuggucucaaacuccugaccucaggugaucugcccaccucggccucccaaaguguugagauuacaggugugagccaccacgcccagccucugauacauuauuauuaaccgacgaccauaguuuaaauuaagaugcacuuuguguuguacaguucuauggucccccaccuacacuuuuuugguuguggugaaauaauauacauaacauaacauuuaacacuauagggccaggcaugguggcucacaccuguaacccuagcacuugggaggcugaggugggaggaucgcuuaagcccaggaguucaagaccagccugggcaacauagugagaccccaucucuauuuuaaaaaaaauuuuaauuuaccauuuuaaccauuuuaaguauacauuucagugggcgguauauaaucuugugucugguuucugguuucuguuacuuaacauucuuuuuuuaugagacucauucaugauguugggcauaguuauaguucauucucauugcugcacgguauuccauuauaauaugaauacccaacaccuuauucauucauucaacuguugauugauacuucgguugcuuccucuguugggcuaagaugagcccugcugucaggagcaucuuuuuuuuuucuuuugagacagaguuuagcucuuguugcccaggcuggagugcgauggcgugaucucggcucaccacaucugccuucccgguucaagcgauucucuugccuaagccuccugaguagcugagauuacaggcuaccaugcccagcuaauuuuguauuuuuaguagagaugggguuucuccauguuggucaggcuggucucaaacucccaacucaggugaucuguccuccuuggccucccaaagugcugggauuaccggcgugagccaccgugcccauccaggagcauucucgaaccugcuuuugaaugcauguuugcugcucaggcuggaauugcuaguucauaggauaggugaauguccagcaguaauauauucuaccaaacaacuuuccuggcugggugcaaugguucacaccuguaaucccagcacuuugggaggccaaggcaggcagaucgcuugagcucaggaguuugagaccagccaggcaaacauggcaaaacguugucucuacuaaaaauacaaaaauuagcugggugugguggugugcaccuguagucccagcuacucgagagguugacacacaagaaucguuugaauucgggaggcggaggagguugcagugagccgagauagugccacugcacuccaaccugggugacagagugagacccugucucacaaacaaacaaacaaacaaacaaacaaaaacuccaacuuuccuaagcaguugaaccaguuuauacccccacccgguguguaugaggcuccagcugcuucucauccucaccaccacuggauauuuucuuucuuucuuccuuccuuccuuccuuccuuccuuccuuccuuccuuccuuccuuccuucccuccuucccucccuuccucccucccucccucuuucuuucuuucuuuccuucuuuuuuucuuucuuucuuucuuucuuucuuucuuucuuucuuucuuucuuucuuucuuucuuucucucucucucucucuuucuuucugauggagucucgcucugucacccagucuggagugcaguggcacaaucucugcucacugcagccuccgccucccaaguucaaaugauucuccugccucagccuuccgaguagcugggauuacaggcacccaccaccaugcccagcuaauuuuuguaucuuuaggagggacagaguuucaccauguuggccaggcuggucuugaacuccugaccucagaugauccaccuacuucagccucccaaagugcugggauuauaggcaugagccaccacaccuggccaccacuggauauuuuugaucuuuuucauuugagccacucuggagguauguugacuacuucccuuuuaaaagugcuucaauauuccccagagauuucaggauaaaaccaacucuuuugcuuagcacccaaaggcuucagcagcaguuucuguucacucucuggcucuguugccccccaugucacccuugcccccaccuuuacugucuuucuccaaagcugaucccuuugcuugaaaccuucuccccacccugcauuccccggccacuuuggcucaucauuuuauacccugcucagcugucaccacacugucugagucucagcucccccgcaguuaaguucccacagccuccauacugcccuccuuagcagcauccguaacaccguugccccucuggacuuugagcuccuugaaggucaaggcagcuucugccuuucuuccuaucucuagucuccaacgcaggggcuggcaugcagccacacaguuggcccucguaucuguagguuccauggauucaaccaaccacagauggaaaauauucggaaaaaagauggaugguugcaucgguacugaacauguacaaacuuacuuuucuugccauuauucccuaaauaauauaguauaacuaacaaaucuuuuuuuuuuuuuuuuuugagauggagucuugcucuuguuuccaaggcuggagugcaauggcacagucuuggcucacugcaaccuccgccucccggguucaagcaauucuccuaccucagucucccuaguagcugggauuacaggcaugcgccaccaugcccggcuaauuuuguauuuuuaguaaagaugggguuucuccauguugcucaggcuggucuuaaacucccgaccucaggugaucuuccugccuuggugucccaaagugcugggauuacaggcaugagccacugcgcccggccaacaacucuguauauagcacuuauguuguauuagauacuacaaguaaucuggagaugauuuaaaguauagauuauaugcaaauacuaugcaaagauuauaugcaaauuuuaugccauuguauaucagggacuuuggcauccauagauuuugguauccauggcuaguggggagguccuggaaccaauuccccacaguuacugaggaacaccuauucagaaaaacauuuauugaaucaauuaguguucacaaguaagaaugcucaccugcccaagaacuuuaggaagacucugcuugggggcauuuccugcauugguuuuauggaaauugcaaggaauaaugcauuaagauuuauugagcaccuacuaugccccaagcucugugcuacaugguuaacacgaaccauccuuguuuuagcuuuauagccacccugugaggugaauacuaguuuuuucguuuuguuuuuaaaaaagggucucacucuguugcucaggcuggaguacaguggcacagccuuggcucacugcaaccuugaccucaugggcucaggugauucucccaucucagccucccaaauagcugggaauacagaugcaugccaccacauccagcuaauuuuuuguauuuuuuuguagagauggaguuucaccauguugcccaggcuggucucgaacucuugggcucaagcaacaagcccaucuuggucuuccaaaguguugggauuacaggugugagccacugcgccuggccuaauuuuaaauuuaaguagccacacaaagcucuaaggcuuccugcucccucauccuuccaauccacacacuccacgcugccacucaagugaagucucugaaguugcaaaucugagcaugucagaucucuaaucaaaaucccuuaucaauuucuucaggcauucagaauaaagcuugaacuccucagcucaacaugugagccaguuccuacucuucucucaccucauuucccaucccuuccuccucacacaauuuucccaccagccaguggggacaauuucucuaguuuucugucuuucugcaugcacacaugauguucccucuguuuggaacacccaaccuuccuuccaaccacuucuuccccauucaacaaacacccucaaggaaaugcauugcuuuuggguuagagauacuuacucauacugcaauauuaugaugcauuaaugacaaagcauccucaccucuccauuaaaacaaguccuucaacacuugguaccaggcccaccuccuccaggcccuacucuggucagagccuccuuccuugggcaugucucucuccugguaugacaccaagaugccauauugcuuugguuuuacucucccucuccagcuugugaacaacugaggcacgcuauguuuuauucauuugauuuuuuuuuuuuggagagucuugcucuguugcccaggcuggcguauaguggcaccaucauggcucacugcagccucgaccucccgggcucaagcaauccuccccuucagucucuugcauagcugggaccacaggcacacaccaccaugccuggcuaauuuuaaaaaauucuuguagauccagggucucaucauguugcccaggcuagucuuaaacuccugggcucaagcaauccuccugccuaagccucccaaauugcugggaucauagucgugagccaccacacccggcuucauuugauuucuaguacagugccugcugcauagugggugcucaaccauauucuuugagcguaaguugugcagccauccgcuguucuaggaggaaacuuacagcaguaaggcaguuccugccuucagggaggagaccgccaauaugcaggcaaacagaugaaaaagauaauugcaggcccggguagugcugaaaauccuuuguccucuagaucacucugcgagucucuguguucugggaggaugaccucugcauauuguccaugggcuccccgcccacuggcuucuuguuggguucagccaauggaaggcacuggcauaagaugggcggguaggagaagaaugaguuugggguuguuccccuccagacccugucugugaagacaccugcuaggcagcucuccucuccuuauagugucucucuggguuccugccccuugcuccuucaggcccaagguggugagggcuccccuccguuacuaguccauugguacuacacuauccuggguuaguuucucuaugcucugccugcacuuuuguaaauagcccccuuauugaauucuucuaauaauccaguuugaguggauccucuguuuauuaccaggauccugaaaaaugcaggaucuuucugcauuuuugcacugcuaaucuuugaaugcagcuuccccccacgcuggcucccuuguggucacaagauggcugcgguagcucuggccaucacaucauccacaccugacaaaggccagagagacuagaguguaucucuugccacuuaucccccuuucagaaaaacuccccacaccuugcaauuauuuaauuuaauuuauuuuauuauuauuauuauuauuauuuuugagauggagucucacucugucgcccaggcuggagugcaguggcgcgaucucggcucacugcaagcucugccuccuggguucaugccauucuccugccucagccucccaaguagcugggacuacagaugccugccaccaugcccggcuaauuuuuuuguauuuuuaguagagacaggguuucacuguguuagccaggauggucuugaucuccugaccucgugaucugcccgccucagccucccaaagugcugggacuacaggcgugagcaauagcacccagccuauuauuauuauuauuuuuugaagaugaagucucacugucacccaggcuggagugcaguaguacgaucuuggcucacuguaaccucugccuccuggguucaagugacucucaugucucagcuucccaaguagcugggauuacaggugcaugccaccacuccugguuaacuuuugucuuuuuaguagagacaagguuucacuauguuggccaggcuggucuugaccuccugaccucaagugauaaccccaccugggccucccaaagugcugggauuacaggcgugagccaccguguccagccuaauuuuaauuuuuaauuuuuguggguacauaguagguguauauguuuauggggcacauuaaauauuuugauacaggcauacaauguguaauaaccacaucggguuaaaugagguauccaucaucucaaacauuuauccuuccuuuguguuacagacaucuauucuuucaguuauuuaauaauguacaauaaauuuucauugacuaauaugguuuggcuguguccccacuuaaaucucaucuugaauucccacaugcugugggagggacccagugggagguaauugaaucaugggggcagguguuuccugugcuguucucgugauagugaauaagucucaugagaucuggugguuuuaaaaaggggaauuucccugcacaagcugucuucucuugucugccaccaugugagaugugccuuucaucuucugccaugauugugaggccuccccacccacgcggaacuguaaguccauuaaaccucuuucuuuuguaaauugcccagucucggcuaugucuuuaucaacagugaaaacggacuaauacauugacuguagccaucuuguugugccaucaaauacuagaucuuauucauucuuucuaacuauauuuuguacccauuaaucaucccuacucccucccugcucccacuacccuucccagccucuaguaaccaucauucuccuaucuccaugaguucaacuguuuuaauuuucagcucucaaauaagugagaacaugugaaguuugucuccccgugccuggcuuauuugacucaacauaaugaccuccaguuccauccguguugcugcaaaugacaggaucucauugguuuuuuuuuuuuuuuuuugagacggagucucgcucugucgcccaggcuggagugcagugguguggucucggcucacugcaagcuccgccucccggguucacgccauucuucugccucagccuccugaguagcugggacuacaggugcccgccaccaugcccggcuaauauucuguauuuuuaguagagacgggguuucaccguguuagccaggauggucucuaucuccugaccucaugauccgcccuccuacgccuuccaaagugcugggauuacuggcgugagccacugcgcccggccggaucucauucuuuuuacagcugaauagcacuccauuguguauaugcacuauauuuucuuuaccuauucaucuguugguggacacuuagguugcuuccaaaucuuaacuuuugugaacaaugccgcagucaacaugggagugcaaauaucucuuugacauacugauuuccuuucuuuggguguauacguaacagugggauugcuggaucguaugguagcucuauuuuuaguuuauugaggaaccuccaaacuguucuuuguaguguuuacacugauuuacauuuucaacaguguacgaagguccccuuuccuccacauccucuccagcauuugucauugccugucuuuuggacaaaagccaucuuaacuggugagaggauaucucauuguaguuuugauuugcauuucucugaucaaugauguuaagcaccuuuucauauacuugcuugccauuuguauuucuucuuuugagaaaugucuauucagaucuuuugccagauuaaauuuaaaagccagauuauuagacuuuuuccuguugaguuguuugagcuccuuauauauuccaguuauuaaucccaugucagauggguaguuugcaaauauuuucucccauucuguggauugucucuucacuuuguugauuguuuccuuugcugugcagaagccuuuuaacuugaugagaucucauuuguccauuuuugcuucagccuguacuuguaagauaucacucaagacaucuuuguccgggccaggcaagguggcucaugccuaugauuuccagcacuuugugagaccuaggcaggaggauagcuugagcccagaaguuugagaccagccuggguagcauaguugagacugugccucuacaaaaaaaaaaaaaaaaaaaaaaaagaaagaaaaaaagaaaagaggaauuuuuguccaguccuggagaguuuucccaaugcuuccuuuuaguaauuucauaguuuguggucuuagauugaagccuuuaauccauuuugguuuugauuuauguauauggugagagacaggggucuaguuucauucucaugugucucuuugaagagugaagaaagcuucuccuaaaaguugucccagcagauuuuuucccauaucauuggccagaaucaugucacagaucuauguuuaauuaaaucaccagcaagacagccagggcaacaaugacugguucagaucagccaagacccacucugugaggcuggggcuggggucagcuuccccuaaagcacauaguucuagaaaggaagauggaggguuccuagacaaaacaagagcggugagugcuaaggaggaaaaaucaagauugggaggaagggcuauugggugucuacaagugauggagcaguugaguuggaaaaggauucguaaguuggcugaguggcccucacuggcuggacaccccaguggaucugaauaggcuaccuccuuggcaaagaccaugggagcauguaugucucagucuguucucgguugcuauaacaggauaccacugacuaggucaggcgugguggcucacaccuguaaucccagcacuuugggagguugagguagguggauuacuugagaucaggaguuccagaccagccuggccaauauggugaaauccccgucucuacugaauaaaugcaaaaauuagccgggugugguggugcaugccuguaaucccagcuauuugggaggcugaggcaagagaaucacuugaaccugggagguggugguuguagugagccgagaucacaccauugcacuccagccugagugacagagugaggcucaaucucaaaaacaaacaaacaaacaaacaaaacaagccaaaacaccaaaacacagagggggacauuacaugguaagagggcaagaguguggugucagcucaggucucucuuccucuucuuauaaagccuccagucucaucaugggaguaccaccuugaugaccuuaucuaaucuuaauuacuucccaaagcccucacuaccuuuaaucaacauaugaauuuugggauuauguuuccaacacaugaaaauuggggcgcacauucuaaccagggcggaacacuucuaggagcacuuggcugauagagaaguguccccagaggcucugcuuugauugaggacaugaauguucauuaucaacaaacaucaguguuuauauguaaagaggcauuacuaacuuggaaacagaguguuccucugaucaugccgaacaugcccuucaguagcucaaacauuccccugcaaggcuuauuucauaauucauuggcuugggaaacauuugugcaauaauaaacugcuaaccugagaagaauuagucaaauucucaucuauaauauggaccuaaauuaaucauauuugauguuauuaaaggcagaagagaaaggaaaaagaagaucuccuuucaucuccacugcccuccaucuagggucaguccagaagcucugggccaccugcuccccagcuuucucugggcagcaucccggaggcuggaucuucauagcccuuccccacccaccaaaacauggaggauuuuugucccaauccugcugagagcagcugcagagccugaucuccccugauuacugugguguaucugggguguguagagagaagccauccuguugggaggaaccuggagacuuuaaaauuggaggagguugggaaagucugaggaucauggccaugugguuggcagugagacccagcccagauguuggucuuggauagagugaagcuggcacaaggcaggaugcuaagcuaggccagaccaagaugaacuucuuaaggcaggaguguaccugaucaccuaucuccugggagcaaaaugauuaacgcccaucuagcaggcauuaaaaaagcaucugagcugaggggauccauucagcugacugucuuggacuuggugcccugccuaccaggaaccagacucucacacaaggccucugccacuucaaaucucguguauuuucccacuugggggccugccacgcuuaaauucaauuauuuaacaacuaucuauuuagcaucugcuaugugcuagaugcuauucgugaagcauugaucacaagagaucaaagugccugcucuguuggagcuuacauuuuaguugagggauauagccuaucugcaacauaaauacgcaaaauauacaguauguuuggagucucuaagugcuauaaaauuaaguagagagaaggauagaaacuaugagucaggguaacaguuuuaggugggauggccaaggaagguaaggaauaccugagacuggguaauugauaaagaaaagagguguaauuggcucaugguucuggaggcaguaccagcauggaugcagcaucugcuuccggugcgggccucaggaaccuuacaaucaucccagaaggcaaagcgggugcaagagaaagcaggaacaaggguagggggaggugccacauacuuuuaaauaaucggaucucacaugaacuuagggugagaacucacuuagcaccaaggggauggugcuaaaccauuuaugaggauccgaccccaugacccaaucaccucccaccagcccccaccuccaacauuggggauuacauuucaacgugagauuuggaggagacaaacauccaaacuauaugagagucugggcguggugacucacaccuguaaucccagcacuuugggaggccgaggaggguggaucaccugaggucaggaguucgagacaaggcuggccaacauggugaaaucccgucucuacuaaaaauacaaaaauuagcugagcaugguggugggcaccuguaaucccagcuacucgggaggcugaggcaggagaauugcuugaacccaggaggcagagguugcagugagcugagaucaugccacugcaaacccggugagacugucucaaaaaaacaaaaacaaaacuauaggagaaggcauacugagaaagugauauuugaggaaguaagacaugaggauuuugggaaagaagaguuuucugguaaaggagguggaugaugagaaauuacuuaauggguaauuguacaaugcuuuuggguaccuuaaaaguccuggccugaccacuuugcaaucuaugcauguaacaaaauugcacuuguaccccauauauuuguaugaaaaauaaacaaauaaaaauuggggaagggggaaaagauaaaugcaagcaagcuuuaaaaaaaaguuugcuggugaagggaggagcaagugcaaaggcccugggguagagcacuagaugcuuuccacuugucucuccagacucacuuuccacccuucucugcccacuguccuagagggcuaacuuaugcaggcugcauucauggacucuuugcauccuggcuuccaguuagguuccauucauggaagucaccagcaggacagagagcacgaauggagcgagguuggaacauguaggcuguuucucugcgggucuuugagcacuagcugugacccucuacugaaggccacagcuccugucuauagccuuuccauagcaacccucucuggguuccguuuucuccuccuuucccuuguuggcuauuugcuuggagccaaggagccuccagccuccaugguggugagcucugcucccagacugcugggagugcaggaggaacugcacagugacacggcgcagacucaacugaucaacaaugucacgcacauggcuucucucacaggaacuguccagccaacaacuugacaccaucauggggucuucuggagauacaauuugccucccacagugguucggaugguggccauuuagguacagaagcagaccagugggaagcugcuagauagaaguaaccucuuaggacucuguucaaccuggguaggucuucuuggggccugcaaguaccaggcuuuagucacucagagagcucugccagguaaggcuuccuggcuggcagguuuguguucuugcaguuguaagucccccaaacccaccucauacuagaaaagaaagaagaggaggaggaggagagggaagaggaggaagagaaugaggcaggggugaagaagaaggaaaaagagggagacaggaagagaagggggaggugauggugauauugguuuuuuaacagggaccuucuaugggugaacuucauugacuucaggaauaacuggaucuagaggcuuaaugucuucaauuucccccccgcuuccuccccucaucucccagaucugcuuuuccuugaguagguaucauucuaaggccggcuuccuuaaaaaaugacuacuggcagcuucagacuuacuuucuagccaguguagccaccucugacagaaggagaaccucucuuuuccaaugauuucaucaaaacucccauagggggccaggugugguggcucacgccuauaaucccagggaggccaaggcaggggggaucaccugaggucaggaguucaagaccagccuggccaacuuggugaaaccccgucucuacuaaaaauacaaaaaaaaaaaaaaaaaauuagcugggugugguagcaggcgccuguaaucccagcuaccugggaggcugagucagaagaauugcuugaacccaggagguggaguuugcagugagccaagaucgcaccacugcacucuggcgagcaacagaaggcaggggguguugggaaacucccauaggguucucauuggcuuggccuggggugggucagcuacaguaacccuaugggcugagaguaggggugaggugaucccgaaaggacaauugaugugguauugccaaaagaagggagaacagaugcugggcccccaaaacccacccaugcccaccaucacuggggugacuauauaacuuauuaucaucuaagccaggaucuuuugagagugaaagagggcacuuuuaacaauucuuccaugacaacaggcuuagacuguccugggaaaauacugucauccuaacuauagcagccaagagccagggagccaagagcugccccaucugagcccuguauccugcaaacucaaucuaucuggcucucugggcacaggcaggagaggaagggaagaugcucaggcucagaucucaguaggagaaggggaugacuggguggggagaggacacauugggagacaagucccaguucuccacauccacccaaacugccucaccccgaccucccacuacuaucuguuguucacauugugucucuuccccaugcuaggaaugcccuuccuaugcuccuuagacuccaggggccuucucuaguucuccacucuccggggagcaucccuuuaacaccccuccugccccagccuccucacagcuccugcagcaucuccagacucaucacaggacuugucuaggguaugacucccaucucuaccauggggcagggguuugcuguggaucuugcuugucuuccaguccccuuugcccacagccuucagcagggcucacugaaagcccuaggcugaugauuuugcugggcuaaggccucucagcugucucgaucucuccagcccagagcccuuuccccuccccagcacuucugccccugcuccugguauugaucacuagggaauccuagccaaagagcuucucacgcaaaggcaugcaaacuuugacccaggaaugaguguucagcuccaggccaagguccucuaaccuccugccugacucccuccuucucugcccagugcucagugugggcccccuuccuguuauugugaacuguuagccaagauacggcuuggugaugagaagugcaacaucucuuguaaccccagugcaccaguccagggguguggagaggugaggggcccuggcccaggggcugagucugucuaccuuuggcccccuggggcuucacucauagucugggaugauaaguuauggugagacgggcccuggccuagaagcaagaagcuggaguucuaggcucugcuuugauuugccaugcguacuugggccuuuucuuuucuggcacccaucucuccaccuaagaagugagagacgaauugguuuuauuagcuaaugaguuuuugaggagucaagagccucuuagauaaugcaagcaaagcaacgcacuuucuaucaagagaagggucccugguugggagcccuagcacuaguuggucuuccagcccuggugaccaggcugccaugauucuccagcgcuggggcauugguggggacccugggaagcugaagaagagguugugcugcagagcauguuggaggaucuaggagugccuugcuuuccacuuccuugccauggcuuccacacaggcucguucucuguggcucuagcuccaacuaggauugaaggacagaccucucuuggguaccaugaagcuccucagacugaaucaaagaugcagagaguagaauaauuggaagggugcugagaaagcccagcaauaccucccuugucuccugccuguucuguugccuaaauuccaccauuauagcaugagcacuuuggauucaacaucucucuugccauuuggccuguguauaguauagcugugucuaauuccuuuaccaguuauuaauaucuugccuggacuuggcuuaucagaucaauuuccugcagguugguuuuccuuguuagagcauacggaaagaaguggcagguugggucggggcuauagcaaguauccaguguccuaagaauuaccguggagaagugcuggaaacagcgaccaggagaaacauaauuuucuggggggagaauccaggaaggcaucccagaggaagugauguuuuaucugagacucaagguaggggacacuagaacuagaggcaggcaggccugguagguucugcuaaagauacuuuuuuuuuuuuuuucaagagugcaggauggauuuauugcucgugguuugaggaggcuucaagcauguccuuauuuuuuuuuuuuuuuuuauugaucauucuuggguguuucucgcagagggguauuuggcagggucauaggacaauaguggagggaaggucagcagauaaacaagugaaaaaaggucucugguuuuccuaggcagaggacccugcggccuuccgcaguguuugugucccuggguacuugagauuagggaguggugaugacucuuaacgagcaugcugccuucaagcaucuguuuaacaaagcacaacuugcacugcccuuaaucccuuuaacccugaguggacacagcacauguuucagagggcacaggguuggggguaaggucacagaucaacaggaucacaaggcagaagaauuuuucuuaguacagaacaaaaugaagagucucccaugucuaccucuuucuacacagacacggcaaccauccgauuucucaaucuuuuccccgcuuuuccccucuuucuauuccacaaaaccgccauugucaucauggcccguucucaaugagcuguuggguacaccucccagauggggugguggccgggcagaggggcuccucacuucccaguaggggcggccgggcagaggcgccccucaccucccggacgaggcggcuggccgggcggggggcugacccccccaccucccucccggacagggcggcuggccgggcggggggcugacccccccaccucccucccggacggggcggcuggccuggcgggggcugacccccaccucccucccggacgggguggcugccgggcggagacgcuccucacuucccagacgggguggcugccgggcggaggggcuccucacuucucagacggggcgguugccaggcggagggucuccuugauucucagacggggcggccgggcagagacgcuccucaccucccagacggggucgcggcuggguagaggcgcuccucacaucccagacggggcagcagggcaaaggcgcuccccacaucucagacgaugggcugccgggcagagacgcuccucacuuccuagaugggauggcgguggggcagagacgcuccucacuuuccagacugggcagccaggcagaggggcuccucacgucccagacgaugggcggccaggcagagacgcuccucacuucccagacgggguggcggccgggcagaggcugcaaucucggcacuuugggaggccaaggcaggcgggugggagguggagguuguagcgagccgagaucacgccacugcgcuccagccugggcaccauugagcacugagugaaccagaauccgucugcaaucccggcaccucgggaggccgaggcuggcggaucacucccuguuaggagcuggagaccagcccggccaacacagcgaaaccccgucuccaccaaaaaaauacgaaaaccagucaggcguggcggcgcgcgccugcaaucgcaggcacucggcaggcugaggcaggagaaucaggcagggagguugcagugagccgagauggcagcaguacaguccagcuuuggcucggcaucagagggagaccguggaaagaggggacagggagagggagggagagggagagggagagggagagggagagcugcuaaagauucuuauuccugccuucagaguggugggagcuaccaaagaaauuuaagcaagguggugauggaaugagauuuugcauuuuugacaggaccacucugggugccacaggauggagaaguaauuggacggagcaaaaggcaaaugggaaccuagguggaggcuaagugcuccagggagcaaugaugggcccuggaugaguuguggcaguggagcuggacagaugccaaagcagaugccaagcagagaaaugugccuccuauucuuagcacaguagcccgagugaccuugcuucucuuacaccccagccaugucucuaucucgcacagaggaagucucaugucucucaauggggugcucccugcacaugcggcagggcgcugugccucaugggcaucccaucccccuggacuacaugccaggagaacuccccagucacaugaccucugcacaucccugguacugcucgguccuucaagaaccacuguggugggggguggcgggaggcuuugauuuugcuuauucccucugccaguugcagucuuuuauuugagauggagucucgcucugucacccaggcuggagugcaguggcgugaucucagcucacugcaacaucugccucccagguucaagcaauucuccugccugacuccacuccccccaaaccccccucaccgccccaguaucugggauuacaggugagcaacaccaugcccggcuaauuuuuguauuuuugauagagaugggguuuugccauauuggccaggcuggucuugaacuccugaccucaggcgauccucccgacucggccuuccaaaguccugggauuacaggcgugagccaccgcaccugcccagguacacuuuuuauccagauaucuaugcacauugauucuugacuccacacuccugccucucuccgcaaggccuucccugacccccuuguuuugaauugcaaucugcccucacauaauccguacgccuuuucuguuuaauuuuuuucaaccgcacuuuuuacccucucacauucucuagauuuggggcauauuacuugucuccuuccaucagaauguaaacuccacgagauuaggagugcugucagcuguguucccuucucugucaaucgccagcgccuccgaacagcuccuggcacauaguaguugcuugguaaauauuugugcaaugcacgaggccgcauaugaccggaaugggaggugaggggauuauuuucuggccuggaccagcgacggaugguggugccaccggguuggggagcacgucggggauggcgcguaacgauguuagcuggggccagguugagcuaggcacgcaaauacaacuuuuuuuuuccuggaaacccuguaacaggaagguuccggagggcgggacagcgucggaggcaggcagcuaggccaugccaaauggcacuggggcuucgugucgugccacaggcguggaccgaaaaugcggacacaugcaggcugccucuccucgcaggcagaagccacacgcagaccuagacccuuugcaccgcauccccuuauucaaucgcgcacccgccacccuucgacaguuccucucccuccaccccaaccccacgccgcgcgcgaggcuggcccuuuaagagccccgccccgacucccuccccccucgcgugacugcgagcccccgcgccgggccggggaaugggucggcuggguggcugcgcgggccuccgguccuucucacgcaacgccugggcaccgcgccuccgggccagguggggcggggacgggccgccugaccucugcccccuagagggaugucgccggcgcacgcaagcuagccggggguagggugggggcuccgcgccaggugcccccuccguggucccugggcccgagucuuuccguggccccccgccgccggauuucugugcucugccaaucaaagcacuagccaccccgggagccaagagggacccucaagggccgguggguccuggcuggagggaccgcgcguugcaaucagcacuaaggcgauccuagaggcugcgaggagccgcuagugagcgcucagcgagccugccccuucgccauccauuccgauccuucaaucaagaggcgcgaaccucagcuagucgcccgggcucugggggacagguccagccccgcggcgccucuggccuuccggcccccgugaccucagggcuggggucgcagcgcuucucacgcgagccgggacucaguaaccccgggaaggaggucaccacggggcagccccgcccccgccugccgaguccugguaggcuguagcgcuggggaggcaucugcacgcccagcguuccagugggugcaaaaaugacgaagaggaguccccgcgccccaggauggagcuucccguacccucucuucgggcuguccugggacuucucccucaagcccccuccucggcuggguucugcacugcccuugggacgccuuggaauugggacuuccagguguucccagcccucaccccucuauguacaggcaccgagaugugucccauaguggguucuugcccacccgaccccccacccccgccgcccuccgccaccuuucucuccaaucccagagagaccagcccgguucaggcugcuucucccuccaucucagcucgcuccagggaaggaggcguggccacacguacaagcccgccuauaaagguggcagugccuucacccucacccugaaggugacaguuccuuggaaccuucccugauccuugugaucccaggcuccaagaguccacccuucccagcucagcucaguaccucaggugaguugcugggggacuucuggcuugcccuuucucucccaauaaaaggaacauuuuggugccuccaggacuucuuagguagcuaccugucuagcaccuccaaaaagggaggcucagaguguuuuuagugaccaggcagucuagcccccuaguggggaaacugaggccaggggaagaggaggacuugcccauggucccacagcugguaccagaccucuagauacagauggcaucucauucaggacuucaggacccaggcuccagcuccauccccuagugagugucucccugccuacccuggggcuuccccaucaaggccaccuggcaggcuggaauaugugcagccccucccucaggcuuucugaugacaggggcuucuccuuggguggacaggguggauggagggggugggcuggguucuuaccagcuguacccugcccuagccuaagaagcuaccccuggcagauuuuacccuccuaaggguggcuugucagugcugagauguccuagacagcugggacaauagaggcagaucugugcaggagucccaggccuuuccuaucucauugaccaucuucuuuguccuuugcugggagacaaucagggugacagauugccaacugcagggagcuggaaauaccagucccuaaaaacucaccagucacaucucccuuggccuccuaccaucuuacaaaggcugcagguccuugggauacccacugugcagaaggggacaccauagcacaccaaagccuggcacuguccccuguugacucagggaucuagugugcuuugauauuuagccccuccaggaagccucccuccacuauaauacuugugguaggaaccauccaucucccugucuugugagguucuccuguggggagccuaacugguaagacugucagguuccccacagcagaucuggguuuucucuucccucuggauccagcuggguacucugaacugagagaucuugucuuacccucucucagauguugaaauuggaccccagaaaaguaaaaugugcaguccaagaucacuuugacuagaauguugggucuacugaccucuaguccaggguaacaggcagagaugccugauauguuggagagagugguuuaugaauuuaaacacccuuuuuaggucaagcuuacagagaaaguauugccucaguuuccuuucaguuuagauccauuccugauuucccugauuccagucugggguuuucuuacagccuagugggaaccuuccauuuauucucugcucucugguaaccugcaaaagggggagguccaaacuguucauucauugagaauugagccaaaaaaaaacccuggccuggauuucucugacuaaagagcucaaucuagcuggucuccagcugccuuuaaacuguggaucaguugaacucagagagcuggggcugaaagcaaugugguuugggaaguggccauccuguccccuaucucuuccucagucuguccuggggucuggugggauuuccugcauccugggauugagcagcagagaacugaggguucugggaaaauuccuucauugaucugaccacucuucaaaaggagguacaugugacagcagcuggaaauuuccagggaagugucccuaaggagucugaguccuggcucugucacugauugcugggggacuuuggacaagucagcgcugcuucccccaaauguuaaaugaggcuaaaggaucagaugaucccuaauuccccugagaacaugauuuuccuaagugugguggguaggacucggggugauacaccuugauuauguguuuauuuuaauguguuaggggaaaaaucaaacuuguacuuucacauagauauuguuuaugaugauauguagguagauuuaaaguugauuuuaggaaaaugugaaguaaauaacaguacugguacuauguggaaaucacagauugacauuggaagaugucaguuuagauugguacagcaguuaagagaaagcguucuggaauuaggcaacuuggcuugggagucugcauccaacacuuucuggcugugugaccuugggcaaguuacuuaccuucucugagccucauugcaggcuacuucauagauuuguggccagggcugaaugaagaaggacugugaaauucuuagcccacagugguaguucaacaacuucuccccaccucacccucuucuucaugcccaguaagcaguucugguggaaagguuuccccuuucccugacacucuagauauuggcuuuucucaucccccaaucugacggcuugacuuuuuuucuuccugcaccuucucucagcagccaccuccaagaucccuacacugaucaugcuuuucccaaucuccaugucggccacggaguuucuucuggccucugucaucuucugucugguauucuggguaaucagggccucaagaccucagguccccaaaggccugaagaauccaccagggccauggggcuggccucugauugggcacaugcugacccugggaaagaacccgcaccuggcacugucaaggaugagccagcaguauggggacgugcugcagauccgaauuggcuccacacccgugguggugcugagcggccuggacaccauccggcaggcccuggugcggcagggcgaugauuucaagggccggcccgaccucuacaccuucacccucaucaguaauggucagagcauguccuucagcccagacucuggaccagugugggcugcccgccggcgccuggcccagaauggccugaaaaguuucuccauugccucugacccagccuccucaaccuccugcuaccuggaagagcaugugagcaaggaggcugagguccugauaagcacguugcaggagcugauggcagggccugggcacuuuaaccccuacagguauguggugguaucagugaccaaugucaucugugccauuugcuuuggccggcgcuaugaccacaaccaccaagaacugcuuagccuagucaaccugaauaauaauuucggggaggugguuggcucuggaaacccagcugacuucaucccuauucuucgcuaccuacccaacccuucccugaaugccuucaaggaccugaaugagaaguucuacagcuucaugcagaagauggucaaggagcacuacaaaaccuuugagaagguacagucuggggaaaggcagguggguggugggaagcagauggcaucagggccugggaggucaaagguaagaggaacugcauggggcuuggcaaguucucaggaaggcuucaaccugggaucuugaagccaguuguggaauagucuucuuccuuggcagggaaauagaacuuuaucuugacuaacccuuccaugcuuccacagacagcaauagccacugaagagucauuacaugcaggacccuggggcaguugcugagggagccaggaagaguuaaagaguucaucuccuggccucauaauagaaagaagauaaagagcacauccagaugauaacaguacaagacgcugugugucaaaugucccaugaguuggggcuagcagcauucuaagguaguaggagagagccuugcagaggcagagagaagcugggacaacagccucagggggcaucaccuccagaacaaaugugcuaggaauagugaaggaccagaccuggauggagagguagcucuggguuugagaucuugcucaccuguggacuuucccuaccuaagggccacauccgggacaucacagacagccugauugagcacugucaggagaagcagcuggaugagaacgccaauguccagcugucagaugagaagaucauuaacaucgucuuggaccucuuuggagcugguaugguuaccccauuguguccuuccugugcucaagugcccugaccugcugcugccugccuaacuucuucuguucuacccuguccaggguuugacacagucacaacugcuaucuccuggagccucauguauuuggugaugaaccccaggguacagagaaagauccaagaggagcuagguagguaguggcucccuucaaaggggucagugccaggggucuggccaggucuaggcagccccugcauccaucuugucccuguguucugcagacacagugauuggcaggucacggcggccccggcucucugacagaucccaucugcccuauauggaggccuucauccuggagaccuuccgacacucuuccuucguccccuucaccaucccccacagguaaggccccauggagccacugcugucuguuacugaucuuacuccggaccacauaccugauuaggguuagugggagggacacggcaugggagacagggagauuugccuguugcccugagccugacugagcuuccuuucucccuagcacaacaagagacacaaguuugaaaggcuuuuacauccccaaggggcguugugucuuuguaaaccaguggcagaucaaccaugaccaguaaguucagagaugcagaggaaaggcuggguccacccucuuaagcucuuauauaugauuaauacaaucauugcauugauccuccuguccaugggcugcuugccuguccucuauccuuuggggcuggagcuccacucacuugacacuucugagcccugaacugccacuucagcugucucccucugguuacaggaagcuaugggucaacccaucugaguuccuaccugaacgguuucucaccccugauggugcuaucgacaagguguuaagugagaaggugauuaucuuuggcaugggcaagcggaaguguaucggugagaccauugcccgcugggaggucuuucucuuccuggcuauccugcugcaacggguggaauucagcgugccacugggcgugaagguggacaugacccccaucuaugggcuaaccaugaagcaugccugcugugagcacuuccaaaugcagcugcgcucuuaggugcuugagagcccugaggccuagacucugucuaccuggucugguugggcagccagaccagcaggcuggccuauguggucuaagguucagccugaaacucauagacacugaucuggcugcaguuuugcuaucugggcugugggcaagccuaagggauccugccugccccuacccuggacuugccucugcacacccuccagagacaacagguaaaacagggccacauagaugcugauggagccuucccaaguugugcuugagccaggaggccugcuaggguuaggagguccuuaggccucugagaagcucugaagaacucucuggaagccccugggcccaguaccuagcuggcucugugagggugcugacuggcuucagcaaguuagaacuagccaaaccaggacccuguccaaucuuugacaauugggagcugccaagagugaagggaagagacagcccaggauacuggcacagagguagucucacugcuugaacuaggcugagcaaucugacccuaugggucuaggacacaguuccugggaacaucacauuccucugcccuuccugcaggcaggaacaaacagggcugccuucuggccuuguaagacccuuauugcuguccuggaggggcuggggacuugugucugcggggaucagagcgcacagggagugcacauauccaggcaccaggacuagggcuggagugagggggggguauuucaauuaccuucuauuggucucccuucucuacacucuuguaauaaaaugucuauuuuuaauguuuguacacaacaauccuucuauucuagccugcauugagcuugcaugcuugcauaagagcuuaagaaccauugauuuaauguaauagggaaaauucuaacccagguauccaaaaauguguaagaacaacuaccugagcuaaauaaagauauuguucagaaa

SEQ ID NO: 16023 - RNA, 730 nt, Homo sapiens
caacuucaguauuuucauauaaucacuuuuuucuuuccuuaguucuugaauuauuaauuccuugagaagaguccaaucagagguagucuuucuucaguauuuucgguaauccuaauuucugugcaaaaaaauuucuguuccauuuuaaccgugcagaacuuucuguuaucuaaaacacaguuucucuaugagaguucagugaaaauuccccuucccaaacugauucuaugaaugacuguuagauaagcuucaccacugcauguagaggguguaccaggaacccaaguuaguagcucuccucaaagacccaacuuuuggagggggucaucgucugguuccugguaugccuccacagguagguccgccucaggaagucagcggcgaggagcacagaagaggcugccuucaccaacggacagcaguuuucaucgugagggccgucggcaaccgcuuggaugugucuaaaggggccguuugggaaccggcccuucuggagggaagggucggagugggaggggauccgggauccgccuuacggccgaguguccagcagcgcguuccaaccuggcagaaccgacguacuucauaugcuccucaggggagcgcgggaaucaccaggcugaagaaugacuggaaaugggacccucuccaaccaaagcacccagacauuccggcgccggacauuucaaagagcgcggaagccacgccuucccccagaaccggaagcuuu

SEQ ID NO: 16024 - RNA, 15213 nt, Homo sapiens
gaauuuccgguuuccggcgagagggccagagugaguguuuacaccggcggcagugcggccggguuccuuccgcgggacgggugagggcgcuggggcccugggcagcgcgggcucgaugugugucagccaaguagcuggucccacuggagcggugaggucgccaccggauaguguuccugccccauuacuagcgaucugugaccuugggccagugauuuuacugagucuugcuucccucaucuuuaaaauguggcuaaugccugccuuagggaaccguugugaggauuaagugagacaugguauauaaaacgaccuccuucuggcauaaacuugagguggaagauaccuugaggaugcuugaaggucugcuaggcagcuucacagccuuuucuuuccucuucucuaucagaggucucuuuggaagcaauaaugaugacuauaacaagaacuuaucuugcuuugcaagauucuuccgccgucagaguuucugauuuauuuucugggguuccauguaugccagguauggggacaaggaugaagaaaacuuuagucuuuuguuuucaagggcauucaagaauugggguggaggagggggcaagcagauauuuguagcccuuuuguucugaggggaugugggaacaacagaggaaagagaggggacugagguuauugaaucuguguugguuucgguaggaguuugcuaaaaggccaaaaagggaagagaaauuacaugcagaguuagaugagcagagguguaaaauaggggagagcuuuguuaugaguguguacuuacauguuguggagguccuuugcagggguagggcucuguuggggaaugaggcuggcagggaguuuuguaagccaggcgaugaaguuuagacuuaauuuauauagaugguuuagagguauuggaagaggucuuuuucuggggggccgggguggggcagggagggacggagucucugucgcccaagcuggagugcaguggcgcuaucucggcucacugcaaccuccaccucccggguucaagcaauucuccugccucagccucucaaguagcugggauuacaagcgccugccaccacgcccugcaaauuuuuucuauuauaguagagauguaguuucaccauguuggccaggcugguuucaaacaccugaucuuaagugauccguccuccgcggccucccaaagugacaggauuacaggugugagccaccgcgucuggcuuuuuuuuuuuuuuuuuuuuuuuuuuuugcgacagagucucucucugucacccaggcuggagugcagugacgugaucuuggcucacugcaaccucagccuuccgaguagguggcacuacaggugcgcacuaccacgcccagcuaauuuuuguauuuuuaguagugacggguuucaccauguuggccaggcuggucuugaacucuugagcuuaggcaauccgcccgccuaggccucucaaagugcuaggguuacaggcaugagccaccgcgcccagcccgacauuggaagaguucuaagcagagaagugacuuggucagaucuguguuuuagaaugauggguuguggccaggcgcagucgcucaugccuguaaucccagcacuuugggaggccgaggcagguggaucacgaggucaggagaucgagaccauccuggcuaacacagugaaaccccgucucuacuaaaaguacaaaaaaaaaaaaaaauuagccuggcgucguggcgggugccuguagucccugcuaccugggaggcugaggcaggaaggcaggagaauggcgugaaccugggagguggagcuugcagugagccgagaucgcgccgcugcacuccagccugggcaacagagcgagacuccgucucaaaaaaaaaaaaaaaaaugauggguguuguuagguggcagcauagauauuugauagggagaggcaagaggcagggaacuuguuauaaagcuguucuacugguucaagcaacaguugaagaaaauuggaaaaaggggcauacagaagggagaggguuagaugaucucucucacaacauuccuauuagauuggauggcguuuuuauguccacguuagggaugaagaaacugaggccuagagagcuguccaucacaguaugaguagagagagaaccccagauucuaguucuggccuccugaugguacgcccuaugccucuucaacagugucacauugaauugucuuucauucaacccuuugguggguggggguggaguagagugguggucugucuuuuaaccacugagguuuuguucuuuuacagggagaaagagagagcgcgaaagagagaggaugucucucucagacuggcaccuggcggugaagcuggcugaccagccacuuacuccaaagucuauucuucgguugccagagacagaacugggagaauacucgcuagggggcuauaguauuucauuucugaagcagcuuauugcuggcaaacuccaggagucuguuccagacccugagcugauuggugagucucucuggacugggguugggcugcugcucugaucucuuuugggggaggauacuucuggaauuacaagaguaaaguaagggcuugggauuuguugccucauaauguuaacacuccagggaagugaauguuggguaaauagaaacacaaaucauauaaugaaacuauugguugccauuucagccauguauuauacugaacuaccuuaucaccagguucuuuaugacauugucuuguuuuuuguuuuuguuuuuguuuugcuguguagcccaggcuggagugcaguggugcgaucucggcucacugcaaccucugucuccugggucccaguucaagcaauucugccucagccucccgaguagcugggauuacaggcacacaccaccaugcccagcuaauuuuuguauuuuuaguagagacaugggauuucaccauguuggccaggcuggucuugaacuccuaaccuugugauucugcccgccucagccucccaaaaugcugggauuacaggcaugagccaccgcuccuggccaacauugugaauucuuuuucugaaagaacagaaguuugggaugaguuaggaaaggagaaguuggucaggggaggcuccucaguauauuugagguaggucuucagggaugauuagaaggauuuuugcuugguugacugaguaaaggaaaggcaguaaaaaagaaaaaguggcgugggcaguccagguggaggagggaggaauuuaaauauaauuaaauuacacugaaaagguaauuuuuaauagcuaaaggauccaacuggcaagaaagauguuuucagucauaccuggauuggguucauccuauuuuguuguuuuuccauugauuuaaauugggcagccuccacaauguuaaacuccagaguuuuucuguggauagauucugugugaauccuuuuuuuuuuuuuuuuuuuuugagacggagucuugcucuguugcccaggcuggagugcaguggcgagaucucagcucauuguaaccucugucucccagguucaggcaauuuuccugccucagccuccugaauaacugggauuacaggcccgcacaaccacaacuggcuaauuuuuguguguauguguguauauauauauauauuucuuuuuuuuugagacagagucuugcucuguugcccaggcuggagugcaguggugugaucuuggcucacugcaaccuccgccuccuggguucaagcaauucuccugcuucagccuccugaguagcagggauuacaggcgucugccaccaugccuggcuaauuuuuguauuuuugguagagacgagguuuaccaucuuggccaggcuggccuugaacuccugaccucaggugauccacccaccucggccucccaaaguguugggauuacaggugugagccaccgugcccggcccuaauuuucgccauggcccagguuucgccaugucggccaggcuccaaaagugcuggguuuauaggugugagccaccacaucuggccagauucgauguaaguccauuuuaugaguuuauauuugcaaauaguuguugaaauguauuuaauuggcuaggcauggugguucacgccugucaucccagcacuuugugaggcuaaggcaggaggaucccuugagcccaggaguuaagagacuagucuaggcaacauggcaaaaccccgucucuacaaaaaacuacaaaaauuagcugggugugguggcaugugccuguagucccagcuacucaggaggcuaaggugggagaauugcuugaccccaggagguugaggcugcagugaaccgugauggugccauugcacucaagccugggcaacagaguaagacccuguuuuccaaaaaaaaaaaaguauuuguuaaguuauugaauaagaguaucuuuuaaaacauguaucauucuccagcuaucuaaucaaaauaagguucucgggacaaaaaccauguaaauuuguuuugaggagcaaaauauaaguggacaguucuuuuuuuagaucugaucuacuguggucggaagcuaaaagaugaccagacacuugacuucuauggcauucaaccuggguccacuguccauguucugcgaaaguccuggccugaaccugaucagaaaccgggugagugaggggcagcccuuaggcaggcagaguuucuguaauauccgcaagggaaggaucuguguguucuugaggcacaagccuggguggaacaaagggaugauuuacugagcugaugauaaaugauaucuuuauuacuuauuggauuagaccaugcugauaaacagaguccaauuuugaccuucuuacugccggcaucacuaauggaagauuuguuucuccauuuuguuuuuuguuuuuugguuuuuuugagacagucucacucuguugcccaggcuggagugcaguggcacaaucuugaucuuggaucacugcaaccuccgccucccagguucaagugauucucaugccucagccucccgaguagcugggauuacaggcaugagucaccaugcccagcuaauuuuuuuuuuuuuuuuuuuucugagacggagucucacucugucucacaggcuggagugcaguggugugaucuuggcucacugcaagcuccgccucccggguucacaccauucuccugccucagccucccagguagcugggacuacaggcgcccaccaccaagccuggcuaauuuuuuuuguguuuuuuaguagagacgggguuucaccguguuagccaggauggucucgaucuccugaccuugugaucugcccgccucggccucccaaagugcugggauuaaaggcgugagccacuguacccggccuucaauuuuuguauuuuuaguagagacggggugucuccauguuggucaaccuggucucgaacuccugaccucaagccauccaccccaccucagccucccaaaguacaggcaccauuccuggcuuguuucuccacuuucuaaguuugucauccacuguuuccuaaugggacagggaguuugugucuacuuaaacuccuuuaaguuaacaguuuauuuuuuagugauacaaaguaaacuuuguauccuuuuguuauuaucguuguucucauuagaaaaaagcuggaaacuuuuggcacuuuccuaaugcugcaguuuauucccuuguuaacaaaucuuccuacaaacugccucagguggugauuuguucaguuagcuaacugcucuugcuauacugguauuuuccugaagauauucaaagaguauuuaaauagcucuuggagaaaauauacaaagccucagaugccuuuuugguuuauaaauagaaggugcuuggaauucaugauuuaaauuuugcauguguguuuuaaaagccucccuaagaauaaagcuaagcuguguaaaagagauuagcuuuguuacacuggcagguugacaucuuuuuauaauguucaugauugcugugacuaguuaucaguuugaaauuuaccccccuuucaguucuaacuguaaaagacaaaaaugucuuucauacccugaugggaagugagaaagaggaacagaguuccugacauccagagguuggccuggcacucacagccaggcccuggaauccuuuuggggaucaugaacaauuguacagauccccaguagcagucaaggccacucugagaccacuauggauuaagacaaaaacaagaucccuauuauugcugaacagaaacacaaaaacaugagcauuauccaaaccacaaaggugaccaaguaucuuucuaucuuggcugaugagaguaacagcugcuucuuggccaauuacagcuuccaccuugcucuaguuuuccuuccuucuagguaagaguuauuaagauacucaauuauaaaaucacucccacugccugaaagcauccuauccagaguaaaaccucacuucuuuaaauuuuuccccaaaucagccagacaaaaccaaaauccuguaagaaguccuuucuggccgggugcagcagcuuacgccuguaaucccagaacuuugggaggccgaggugggcggaucaccugagauugggaguucgagacaagccugaccaacauggagaaaccccgucuauacuaaaaauacaaaauuagccaggcaugguggugccugcuuguaaucccagcuacuugagaggcugacgcaggagaaucgguugaacccaagaggcagagguugcaaugagccgagaucacgccauuguauuccagccugggcaacaagagcgaaacucugucucaaaaaaaaaaaaguccuuucuaauauccucuuacugagacagcccacgguuuccuguggugugcauucuucucucuguacugagcaguaaacccaacuuguuuaaauacagauaugccccucagcucuuuggcuggagggcauuaacagaaggaaaauaacauuuguggcuucugugagccagguuuuuucccuuuuauaccucauuuaaucauuacaguggcccugcaggguagguaacagcauuagcaucuuauggaggaagaaaaggguuagggcauuuauucaaggucagcuacuuagaaagugaaugcaagagcugggauauggaccagggguuuuccuggcucaagaggaaaaccauuuccacugggcuggcugcguuccacuucuaaaggaugaauuuagcucagagaucuuacagugacagccauggcucuuagcugaauaauggcuuaagauauuaagaguccuuuuccucccaccuucuaccuggaggauuauuuuugaaacaaaugaccuuuuuauuggaagguuacaauaaacuuuuagaucuguaaagaaacuguuuugugacaguguuuuagauauuugcuccuugagugcuuuucuucacaaaggaaucacauuuuguguucucccacagauuagggccuauaggagaagaacccauuguugucugucuucccaccuggaucucuuugguaguccuccauggcggguuacaaaucccuucaggacgucaccuuaaccugcuguuugagcuggaauguguaccccaagcuccagccacaaagaaugacuugcuguuuguucaaagcaccacauucuuuuauucucccaugccuuugcacauguucucauucaggcuuggaauaccuucacccccccaguaaauaucagcucucucuuugauacccauuucaaauggucuccucugggaggcagcugucuaucuucacccucccucucaguggugccugucugccuuuguguuccugguacccuagcugggauccacgucucuguugaggucuucaacguggcauuuuguaauuguguauuugauguagucucauuucuccuccugcccuaagaguuccuugauggcagggguucuuauuuuucauauucuaguuccuugccuaaagccaggcauggaguaaaugcuuaguacauguuuguugaaugaauaaauuagguaauuuacuuaagaugacuguuuuucaaaagacagccucaugaucaggacugucgauaaggauguggcugccacccugaaccccaggggugcuauucaccuugcuuugggaguggugcccuggaguugggcaguacacagucaguacagucacaaguagugguccuucgugaggauaaccauacuuuaaaaagugugacccagggcugggcacgguggcucacgccuguaauccuagcacuuugggaggccgagguguguggaucacuugaggucaggaguuugagaccagccugaccaauauggugaaaccccaucucaacuaaaaauacaaaaauuauccaggagugguguugcacaccuguaaucccagcuacucaggaggcugaggcacgagaguugcuucaaccagggagguggagguugcagcgagccgagauugcgccacugcauucuggcugggcaagaggugagacugucugaaaaacaaaggcaaaaacaccaaaaaacaaauguuauuagucuagaauuccugcagugguauguugaucagagcaccguuuuucaugugguaagagucuccucugcugcaacuugaauuuguuuguuuaucugugcaagaugcuuacaagugaauguaaagaugcuuacuagcaguuuucacauccauggcacaaauggguuuuucugagcaggcacucacauucuuaaggggugaugagggaagggaaugcacagaccaggcugcuccuuggcacaugcugaaaugauguugccaugucuguggcagagacaggaccugcgcuauaggguaacucugaaugucuugucccccagaaccuguggacaaaguggcugccaugagagaguuccggguguugcacacugcccugcacagcagcuccucuuacagggaggcggugagugugugcugcggcccccagccaggacuguaggagagggugugaacgcuggcuggcgagugguguggagugggagcuggaagcccguugccauggcaaccaagaguuccuuggggaguuuuugccaugucugugggccucaguagagcccugucuuuccccaaagagccugucucagucaggcguuguugauucccucuaaugauaauaauacaaccugcccguauggugacagccaaaagauccucauacuguuucugcugggccucauucuucgacuuuggcugaacugccugcuuacugccccuugaccuagauguccucacuggggaagugggcugaugucuuucuguaggagaguugagaggcaaaauuaguauagcugugaacuuagcgauauauacaaauaugaaauaguaauuguacagagauugaaaaggacuuuuggauuggaaccuagagaaaccuuuguuaccgggcuuguaaugagagcuuuuauuuuggaagcacuaaacuguagguggggaaaaggagcacagagauuugaagguuuacuguggucuugccuuuuuuuuuuuuaaauuguuuguuuccccuccaguaagcuaagaucuuagagcaaaaagagguucaucuguuucuggggcuauuguuccauuguggugauguacaugcaagcacuuagagggaggaaguccuuuggcagagugugggcauuugaugaguacauugagcugguuggagugcucagcccccgccauuucuccugcaggucuuuaagaugcucagcaauaaggagucucuggaucagaucauuguggccaccccaggccucagcagugacccuauugcucuugguaagugcaggacugaauuugaggaaauaggaguugucggaaaaggagaaaacaggagaagacaauuccucuaaagagacuuggacuaucuuuugaagaaugacuggucuugugggaagagggagaguaaucaagguguguuugauauccccagcccuuuaagagcucucagucccacagagagauaauggccuaacuaacaucguaaauaaggguaugaggaugccaaaugaggauagcaguuagcccacaucacagcaaucagggaaggcguccugcacacccugaguaagggaagaacccagagauacgggagaaagagacaggugucuugguacccagucugugaugugacuaaagugcaggggagguggagagcaggggaccauccucacuagaccaagaugaggaguaccugaauuguauugcuuggcgcuuugcuuccucuacuucucaugaagauuggcuuguuguccugugucccuguugagcugguugcucugagacgcaaagccucuucucccuccuggaucuggcugauuuccuuucuuugaggugagcucugcucuuuuucagggguucuccaggacaaggaccucuucucugucuucgcugaucccaauaugcuugauacguaaguguaccuguccuauuagaggguaccuucucucuccucgugcucaggccagaagccuaauugucacccugcagucugcucugggagcccauccauagucugucaccaagucuaccccuuagauacgucagggggugagaaagagcaaagcccaagagcagggcuuuugucaagagugcugggaggaagcaggauucugagggaaagggucuugucugccaggcucaguuuagguuucgugugguagaaauuagggagcuuuucaaggauuuuaagcuggcaaaaggagaagcagguguacagauccguaaagugucaaagcuaaaagggacauguccucauuuugcaagugaagaaaacagccccacccugggaagagaagggaccaguccaggguugccugauguaguaguggugccuagaccagacacuccucaugugcucaggccagaacccugagccucccaggcugcaccuuucccaucaugccuugccuguggagagggugaagaaucugcagcggaccccaggaauuugaaggccuugcacccguugcugggggcagaucagcaggaggauaaagcuuccugguggaagaugcuaaagacugaggaauuugagagcaggcacagguggcugcauuguugugagggggcacccagaacuccuguuauggcugagggugcucuuuuggagucacccuuggguuucuuccugcuucuauccuagguuggugccugcucacccagcccucgucaaugccauuguccugguucugcacuccguagcaggcagugccccaaugccugggacugacuccucuucccggagcaugcccuccagcucauaccgggauaugccaggugagcgccugaaaaguguaaugugggccccucaggagccggcaguggcccaggaauuugcuuuacucagcagcuauguauagcguuggcagagggcguuccuugggaacucucgguuugagucaggaagugcaucuguccuguaauuuuccgaggggagagaugaaaauaugaauuuggagaguaacuugagcugagauucuggagcugcgccugugccuuucuguucuuccuccugaaaucuguucguccuccuccagguggcuuccuguuugaagggcucucagaugaugaggaugacuuucacccaguaaguggccugccugccugccugacaugcugacaugugggggagauggugcugggaaugagcugcauccugggaccuggcacucccaaggcugggagauggacauacgccauuggggggccaagaccaugucauacuauuucugcuuuuggauuccuuucugaaccugggaacuuaagaguuuccccaagaacuauugcuggagguggguggaguucaucugggaguuucacaguacugcuucccugauucugagugucuucuuucuccagaacaccagguccacacccucuagcaguacucccagcucccgcccagccucccugggguacaguggagcugcugggccccggcccaucacccagagugagcuggccaccgccuuggcccuggccagcacuccggagagcagcucucacacaccgacuccuggcacccagguaugaagacggggccgggaagaucaaggcugggcccccaaggaacaagcuccccagcaguagaguagauuugccuuugcugacccuggugcuagaucuaguuuaagcugaacccuggaguccugguggggauuucuuacugcagcuugagugaccuccccuucacuugccuugaggacucagaagucuagauuuuaacauggucccguguaguccccccuauuaguucagaagacucuuccugcacacaauaugcccuuccucaucccugacagggagcagacaucaccagcuuaagcauuucugggugacaagucacuucagcuuucaaggccaucucucccagugcugcagugcugggguccuaggcugggacaaggggcucagugcagaagagaauggaaccuuuccugcccacauagagagcuucuaguuaccuuuguuugguugucuuauggcaggucuuuguugggaggcagaaguuggguaccucaggagugcugugaggugauaugacaacagcgagcaucugcuauaagauugagauggcgcugaggguggcacugaccacuaauuugucucuagggucauuccucagggaccucaccaauguccucugguguccagucagggacgcccaucaccaaugaucucuucagccaagcccuacagcaugcccuucaggccucugggcagcccagccuucaggucagucuuccccacgucuugguuuccauguggcuuccuuguuauuuuggaugcccagccuuuguuuugcucucuggcgguccuucacaccuggcaugcuucauucuaggaacagcuggagcauggcagugggacaggugcagaguguuccuagcaagggcacacucucagaccauacacaguggucacuaggcuucuccugccccuagugaccauggccugacucccuagaccaccuggcuuagauaaucauggccauuucauucauucauucagugaucauugacugagcauguguauacuaggccugaguccagaugcugggcuaguggcaagcugguucucaucccugccauggaggggcaccaggcaggcacugagcuggggagcaacaaggcaagaaacccagcugcuugaaguaagggccuaggucagacaaaacuuuucugagagagggguauuuaagcugauugucagaagaauuaguuagaaguuagcuagccagggaaggggguuugagguaggaaggggcugauuuccaggugaagacagcuaccuguuugugcacauguguggagguauaugugacauacucaaaacuacaaggcuaggaugcaguguccaguguagaagauccgcagauggggccagagaaagagcaggagccuacgagaggggcuugcaugccaaccugcggagauuagacuugaugacuugauguagcagucaccagggaucccugggaggcauugauugauugauugauugauugagacagggugucacucugucacccaggcuggaguacaguggugugaucacaacuuacuguagccucaacuuccugggcucaggugauccucccaccucagccucccggguagcugggacuacagguaugcaccaccaugccuggcuaauuuuuuguauuuuuuguagagaugggggggucucccuauguugcccagccuggucuugaacucuugggcucaagcgauucacccaccuuagccucccagaguucugggauuacaggugugagccaccacaccuggcccaugggaggcuuuaaggaggagaaaggucacccuagcagcuaaguggaauaccugaggggccagcauuguaguucacagcuccaugcaugagcaguuugguucacgucuguuuuccucuauuccacauaguaagccuauggguagagcaucaucccuggaacuugucuggggucauaaggccaugaagucguaacgauaggguucaagccugugugguuuucacuguuccaugugguccuuguagacagugagggaacagaagcaggauucgugaacaacuugucuucuccauucuugcaucuccccuguugcuagaugccuguuuacuuuauucccuagcucagaagcuuucacugguuccaccuggccuguaaaaugaauucaaauugaucugugugcauuuuuuuuaagcccuccauguucucaucacugccugccucuuugacuuugcuuuucuuccccuuugcauugccuucuucccacaugugaacacguuguuuucccuaaauugugcucaucccugcugucaugaaauagagauauuaaugaagcuaugaaaguacuagaagaaaauaugggugaauuucuucaaauccuuauaguagggaagggcuuucuuggcugaaacucaguauccaggagccauuaaauaaaaguuaugcauuuuggguuuguaaaagcgaaaaauuuaaaacaucucuuacaguccacaaauagauauaccuacuauauaccacaaaaauuuaagacauuuaaaaaaaggugaaaauuucugcguggcaaaccaaaccaaacaaaaaaccgaagcaaaguccaaaggcuaacaaacugggaaaaaaaucuguaacacucaucacauaaagagcaaaaucuugcuguuguguguguacacauagcaagagaaagaaaguaauuuagccucuuggaauucagacagugaauaauuuguacauucucuuuugauccuuaugccaagaauuuccuuuuuuuauuguaaaacuuuggauuuguucucuuaacccucaagccuaucuuuuagucuuccuagaagcaccguguucuguggaacucagcaucagcagcuuugcugaggacucccccaucuuccuuuccuuccccggaaagcacagaccuaagugagucuucacuggaucccagcuaacagcuucugcccauuccuaucuuuccacagagccaguggcagccccagcugcagcagcuacgugacaugggcauccaggacgaugagcugagccugcgggcccugcaggccaccgguggggacauccaagcagcccuggagcucaucuuugcuggaggagccccaugaacucccugcuuccccugaacccccagcaaguugcagaggcuacugcccuugggaggcacucaugaaggugccuccaucucucccuuccccaauauaccugauggucaacucuccu

SEQ ID NO: 16025 - RNA, 14229 nt, Homo sapiens
acaccugcacuuggauccuggcaccacaguugcgagaucuggggcaaauugccacucucuuugaguuucauuuccaugggcugcacagugaggguuacaugagauaacuaagaugcacggagcaucuccccaaagccuggcacuggagggcugcgguaaacagccgcuagugaauuauuauuugccaagugaauuauuauuugcauggggaaaacuggaaggggcaauuguccagcaaauagacccugaguuguagaaucuacccagcccgccaggggaugugccaggacuguuggggcauggggcuggaacuuagugcuggguacugggaagcuacacgggaaaggaccccagaggcucuagcccuguccccagggccccaggcuugggcuggguuuccuacaguuggcaauuuccccuucaagcaucccccaaacucucuccguauuagcaugagaauagggcgccggcugagaccggaggauccaaagauauuuguauuccaaagagcuuccucuguucccucaaagcccuuguugccagagcugggaggcugggcugggauccagaggccacugugggccagcgagggaggagaggcacccaccagaggccacccugugcuccuggcccuccacccugaggccucucagagggggcugccaguccucccagcucccaccccuguagugagccucaauuguguauguguguugggggggcgggggcaggggugcucucucaucugaaaaagcauguucuauauaauaagugcuucgauuuguuuuuugccucaaccuucuauuuccuugauguuuuaaauccuauacuauuacugggaggaguaugagguuuguaugcuuaucacaagugagccuggaauuuaaaaagguugagaaacguugcccagcgggauuaauaauaacuguaauaacaguuaacaguggugagcauuugccccaugccaggcauuaugcugagcauuuuacauacacuauguuuuuuuaguccucacuacaaccuugagauacuguuacaaaccccauuuuacagauggggcaacuaggucuuagaagaguaaauuaacuggcccaggacccuaaaaucagucaauggcagcauggaccacagugucccccagcaccucccugccccucugaugccucuuugggaagaacuagcacuaauggggaguuuggggaaccaugaccggggcaggugcuaguccaggcagaaguacuuuccucaggccccucuccacuguccugcuccagaggugcccacgcugagcgaagagagagacccucucauauuguuuuauauuguuuuauacucaguaccuguuuuaagaaaaaacaacaaggagguaaaaccaaagacagguagccuggcgccaggcccgaaaccaggccugggccugcuuggccuaaacccaguaguuaaaaaucaacucauaacuuagaaaccgauguuauucauagauuccagacauuguauagaagaacauugugaaacucccugcccuguucuguuucucucugacccccggugcaugcagccccuguuacauaccaccugcuugcucaaaucagucacaacccuuucaugugaaaucuuuaguguugugagcccuuaaaagggacagaaauugugcauucgggaagcuuggauuuuaaggcaguagcuugccaaugcucccagcggaauaaagcccuuccuucuacaucuuggugucugagagguuuugucugcggcuaguccugcuacaacgccggggaggacagacuggcauucaagcuaaacacccugcaagccugugugcagcuguggggccagagcccucaggguuucccuguugggcugagcacaguggcauuuccaagggauggcccaggaguuggggaacaagaagacaaaacacccuaguucuacccacaucaccccgugccccccacaagaaagaacccaggauccugggccugcccugcaagaaugaucuuuacuugucugcccaacuacucucccucaucuuuugucacuguugcccagacacacuugacaccuccucuuccccuccugccugcccacugagagccaagaacacaccaagcccuucagcugcucugcaauggagggaagagagucuccaagcccagccauguugucccaaccacaaauccccagccaagccccaagaggaggcaggccuaugaccccuuccacuggcuuccuucugugaaauuuguccuuugcuucccauuccaucacaaauuucagguuucauacaaaccagaggccuuaauguauggcuuccuuauccaaacugucccaggaucccagugugguaugaaaaauucuaaccauucuuucuagauuggguaggagugcuuggugugaccccaauaggaagugcuaaugagauuucaggcacugugguagagagaauccaagguaaucccugugaucugugaaucacacaagggccaugggugcuggggcccucugcagaccagggugcaaggccuuaaccuaagcccaaagaggcugaagguggggccgggggcagccugggugcuaagaggugggggccucuggaaggagcaaccuucccaggcuuuucaucugcuccucauuauccucucccucugccugaggggguaauuaagccuuccucccaucaaagguugagggcuggcuucaccccaaggccuagcuggcaaggaaggaagguaaugagagcucucaucaggcccgaggagggggucaaagcccagcccagggcuggcccccacccaaucacgcucacacauccaggauaccagguuugaaagacaccauuagugcucuccagggcugaggaagaaagccuagcaacucaggcuguccugagauucaaaagugugagcacuguuguccugggcccuggaguucagggguucaggacccagccauggaggagucugaggggaggggcgcaugcccacacauugcuucucuaauuaaauggagcacaggacagagaccaaggguacucugacagcucagaagagggagccacagagucccucuuauuauccccuuauuauuccacagaaaggaggaggaagagugguugaugaugaugauuguaucaguccauucuccugcugcuaauaaagauguaccugagauguacauuacucaguacauuacauguacguuacagauguacauuacauguacugagauguaauuuauaaaggaguaauuuauaaaggaaagagguuuaauuuacucacaguucagcauggcuggggaggccucaggaaacuuacaaucauggcagaaggggaagcaaacauguccuucacauggcaucaggagaaagaagaaucagugcccaguaaaggaggaagccucuuauaaaaaccaucagaucuuaugagaacuaacucacuaucaugagaacaggaugggggaaacugugccccacgauucaauuaucuccaccugguccuucccaugacacauggggauuaugggaccuacaauucacgaugagauagccauaacauaucaaugaugaugaugaaauugacccagcauccuuuguuggaguccucauuguacaagagguacugugaugugcccuggguaugcauuauuucauuggugacagccucacgacaacccuuuggaggcagcaucuuguuauucccucauuuuuucccagaggugccaucugaagcuuggaaagguuaaguagcuugccccaauuacggaguggagacaggaaggcuuccuggagaaauggcuuuuaagggaugggaagauggcaggaaggccacaguggagauggaggagagggcagagggcaggugggugcuaagaguagcaggcaguccagacagagugaggcuggugaugcggggaggggccagcagggaauguugcagcagauccuggaggugauagggagccaucgaauguuucagagcacaaaaguaauggaaaaaugcguuagggacaguguuguaggguggggagaaggagcuggaauauagcagugccaggaggguggucuagccccuggcuccaaaagccugcacuccuggcucuuaaccaacaggagaggagguuccuggagcccagcaggaaggauucuggcccagaaccaccuuuggccauaccacccaaccucaggcagcaggcugccaugacacucaaccugguaaaaugggagucagcuacuccucucugauccucaguuuccccauaugcucuggguugcuacugguuucuuccagccauaggagggccuggaugggcucccugccuuuugaagagagcucuugaaucccagggacaagcacauuuaaugggaggguuucaggccaaccuccaacuuucaagcagcaacucccucauccagaacagcugcucaauuaccucuuaaucuucuugauggaguggagccagccaaccacugcagguccacgccaaguccccaagccacauccacagaucauacccuaccccagaauucccagauggcuggguggagguguggagagcucaggacagcuuuucccucauacccaaaacugcuucccugugccagugggucagaccaguagccuggaagagacaaaguuuuagccacagagaccugguuugaaauucuaccaauaauguuuggcgcuaggccuggaaggcccuucccaaccuauccauccacucugggcacccuuauuagccaugaacagcugccucuaggagugguuuuauuagauucauuuaaaccucugguuuggagcagguuuggauggugggauuggaagacagaggauauagauggggcaggaaaggaagccaagaaaaccgagcacugauaacuaacuagguuggggcguucaucucaaaagccaaaaacgaggggcccugucccagcuagagcuucgguugaaaccauuccauugcaggagccugguaggaaguuccccagguccaugacaaaacacacacagguguuuguguacacagaugugagcgcacaugugcacagacacacacacacaaacacaugaccaagcaguaaucuaggagaggcuguggacuuacuuuucccuucugaagauuuucuuuucuuucuuucuuuuuuuuuuuuuuuuuuuuugagacggggucucgcucugucacccaggcugaagugcaguggcauguucacagcucacugcagacucaaccucuggggcucaggcgauucucccaaguaacuaggacuacaggcaugugccacuaugccuagcuaauuuuuaaauuuuuuguagagauggggucucaucucaccauguuguucaaggcuggucuugaacuccuggccucaagcacuccucccaccuuggccucccaaagcuuacaggcauaagccaccaaugccuggccucuggagauuuucugacaucaugugauaagcacguguccaccauauccucauccuggagcugaugaaaguacuaguacugugcaggacugaguucugagaccugcaacuggagacuggaggacugagccguaacugcuucccugggaagccuuuucacugauucuuucaggacaguggccuagagaggugggauggggagguguguuggaaggcuauccuucugcagugaugugacucagaccagagcauaguggcaggggaguaguggaagggaaauacagguuuuuauuuucacccaagcacuuugguuuugggcagaagcugccacaaggugucaguaaaggcucagagagguuggcugacugguccaaggucacacaggccuucugaugcccagaccugggcauuuccuacuagacccagagugaucugcucugucugaaauugguuggcagaaucacggggcaagcucaagaaggccugagcgaccuugcugggcgguaacauaagguaacuuccugggcucaggccuccaagggggaaggcuaugucagauuacaucagugaaaugggaggaguaggggaugagccugggcucugcaacacugugugaggcugacauugauggcacagcagugaccucuccccgcccccacaccaccccaauucuuccugaaugaucguggcguaacuacuacucacacuuaucugcauaccuuccuucaacccccagaggaagccacuucaucagucagucagauaaagaggccagguccuuucugcugggguuuugaggcugguccuauuuaaucuccuuuucuucaaaggcaaggaaaggccuuggcaggcuugggacccucugaugcucccacccagagaggggcucucugcuuuggggucuggcucuccuuucugccuggccuuguguugaaagcucacuuccucuacugggcuccagggcccaaguugcugggcacagugggggcaaugguuagcauuuguugaaugacuguugaagcgagaccuuucuggaguggccagcuuccccccugccucugcuggcucucacagcuagggggcugagggcugugcuuucuggggugggugaccaccuguagcagaugcuccuggcugguuggcccaagccucuccacaccccuuuuuccccagccaccuuccagugacuggccuagagauggccacgggacccacuucuggucaaugagauaggagugaagucaccggguagggcuucaggacauucuuucuagaagguacagaacuggcauuccccucagccuuuccaucuucuuucugccuggaaguuggaucuagguguggaguugcugcagccaucuugcaauuaugaggcaacaagcaugaagacaaaggcuuucacacuaagguugguggaagggacaaugagaggagccuggagccuugacggccugguggccccagacugcccaucccugaauuucuuuuuauauggaauaaauacccuccucacccccacugcacccuaauaaacaguuaggacacuauuuauuagguucucucuuacucacugucagaugcauccuuaauuguuuuaucacccuccuccaguuagaaaugcugagcucggguagaaagggaucucuuuccccugaccuugauauuggcaggaaaggucagaacacugagcuuccaaugcacugugaguccaggauccuuuggagcaauaaauggccuggaaaugaggcugacuuuugagugaccaguagcuucucuaauagaccgagcucagggaccaugcagugucuuccccuucuguggaagugcccugcuuuucuuaccccaugcucucucccaguuccaccagccuccugacuaacuccuagugucuuucaagacucagccuguguccccucuuccaaaaagccccugccacccccaucacccacccccaggaugggucagacauuuucccuuguaccccuacaguacccuaugccacccguagcacagcauuugucaccaaagaugucauggaccauguguccaugugucugccuugcaccagaugaagugucuuuuuaaccuuucuaagcuggguaccuagagcagguguuccagucauucaggaagucauuguuaacuugcucauucauucauucuagguuuaccgagcuucuccuagagaucccaaugccagguggagcagcucugcucugcuaagcugucacagggcccagugcaccuugcauaguggauccucaggaacagucccagaagguuggccucagggauggguccuccagccacaggccuugcuccuuacagcuuaccagagcagggagaggugcaagcuuggagccaagauagcaaagucggaucucauucuuggcauucugccuccucccccaccccacucugcccugccauucaauaaggaggagagucaaggccagaguguccacaugggggguaaauaaaacuggggguaccuugcagggccugcaauuauaaucaccuccuccaggacucagauuugggagcugaggauuaaggaggaggcaugggcagaggaacaggacugcuucuagaacuccuaaagaaauugaauuuauagucaaaacucuuuucacagagaaaacuccaggcccagaugauucuccuggugaauucuugugaauauuuaaguguaaauaaacaaaccuuauuaugcaaacuccuccagauaacagaaaaagaggaaauucuuccuaagucauuuuaugaggccagggugauguugauaucucaauucccacaucuguaaaguggggauaauaauagguggugcccaccucugagguaggcagcaagauuuggauuaagggaguuguauguauggcccuuagcaugauuccugacaucuaauauguccucaauguuagaugccaauaauugacguggccaagccccaauucaggccaaagccuaugucucaucugcaccaugcugagucuagaauggcauuccuuagacaaagggaacagaaaagaggguuggggaaugauguugaaaacagccccuguccggugauggccacuuagcaaacuugaucuugcugaauccucacgaacacucuucaaaguagcuauaucaaucccauuuuacagguaggaaaacugagguucaaagaaucugcaaguaacuguauaaagucaaagccaggccugucuucaacauaaagcaaguuacuaaccaaccaauccguggcaacaaagcucucugaccuugggcugaggcuaucuagauuuaaggguuccuuucucucucucuuucuuuuucuuucuuuccuucuuucuuucuuucuuucuuucuuucuuuuucuuucuuucuuucuuucuuucuuucuuucuuucuuccuuccuuccuuccuuccuuccuuccuuuuuuucuucuuucuuucugucuuucuuuuuuauuuauuuauuuuuugagacagaaucucacucuguuccccaggcuagagugcaguggugagaucucggcucacugcaaccuccgccuccuggguucaagcgauucucuugcucagccucccgaguaacugguauuacaggcauaugucaccacgcccaggagaggcaguuucaccuugcuggccaugcuggucuugaacuccugaccucaaaugauacacccaccucagccucccaaaaugcugggauuacaggcaugagccacugcacccagccaaggguuccucacuguaaaaugacugaaggaguuucucuccaggcuguuaaaagacaagaaaaacacacaaagaguucugacauaaaacugccauucugucuccaagguucccaugagccuacauuccccugcaggucuccaccugccccagccuuuacauggcucaugucauaaggaggugggucaccccaucuccugccuuaugggagagggagguuguuauugcacaaguaguacauaaauacauucucauuguaauaaaaacuuaaccaauucugaaauauguugaacccuacccagaggggaauaccauucaacccuggauagaucucccuccagaccugcuucugugcauuuaucucauuauauagacgcaucauuucaaguaguucuuuuacaugacugcaauaauccugcagguauuguucugcaacuugcuuuuuucacuucacaaucccacgugcuauuuauaucuccuuuacuuucccgauggauucaggagguuuaccagaguuccagaggguggguacagagccccagaaagaacauggggcuggagucaugcugaccuagauugaaauccugguccugccauugcaucugggugaccuugagccagucccuaaaaucucugagccccaguuuccucaccugcaaaauggagauagcaauagggguuaccucagaggcucagugugagacuccacuaugauaugacaaagcgguguuaauaauuucagauccucagccugauccucagcuucccuagggcuuugaguacaaggauuuaagggucuggaggucccuggugggcaagaugguccuuagaaaucagaucccagggccuugagcaaguccuuccuuacccaagacagacaagacacaggaagagagaaagcagcagagcagcgacacgagacacccagagucacugcuccauggcugcagaccacacugggccucuccagccacauugggagugcuggguguccugcuccuccacaucccauggagguagcaguggugauaucugucuggguucugcuuucccuaagcuggggaaaagcaagcugcuuuuuucuuuuucucuuuuuuuuauauuuucuuuuuuugaacauacagggucuugcucugucacccaggcuggagugcaguaguagugcaaucauggcucacuggggucacugcauccuugaccucccaggcucaagcacccucccaccucagccucccgaguagcuaggauuacaggcacaugccaccacacccggcguuuugauuuuuugauugcuguugcccaggcugaucucgaacuccagggcucaagcaauccucccaccuuggccucccaaagugcuuggauuacaggcaugagucacugcgcccugucccaagcuacucuuaguaaauaucuguugauuccacgauccauuccuucacuucuggagcguguuggaagauucuucuuccuauuucaaaaacggggaaacugaggacagggaaugucagaggcucuagacaucaucuggcccagcucccucauuugacagacgaagugacagagacccuguagggaggaaagcaaaaggcaugggacagccccggcauagaaugaauacaauaaaugcugcaugaggggccagauguuuuauuuaauccuccauccuggcccauaagguagguauugccauuucccauuuuacacaccagagaccuuagguggcuuucuccagggagcaccgccaacaggagccagaguuagaacucuagugcgcgagucucucacccacuggcucccggcacugcccucucuugccuccugccagucgucccacacacugccucaucuuccuggccugcccccugggcugcagcucccuaggaggccucucugaccacccuccugugccccacugcucugauacagacaaccauccugaccuucaggaccccugagcucucugacuugaugaagaaucugucuucucucccgagacugugggucguugaggagaaagagucuaauucugaaacauuucugggucuucacauccagcauagagucugguccagaagaagcaaaugcgaauguuuguggaaggaaaggagggacagagggagggacuccaaggccaugcucuuucuucuaucccacagcuuauuugacacagccaaggcucuaagauuuguuuuuuguuuguuuguuuguuuguuuguuuuuugagauggaguuucucuguuguugcccaggcugcagugcaauggcacgaucucggcucaccacaaccucugccucccagguucaagcgauucuccugccucagccucccaaguagcugggauuacagguaugugccaccacgccuggcuaauuuuuuuguauuuuuaguagagacggaguuucuucauguuggucuggcuggucucgaacucccgaccucaggugaucugcccaccucagccucccaaagugcugggauuauaggcaugagccacggugcccggccaaggcuccaagauuucaucccacauugcacauccccuucccccaccucacugccacuggcccucucccuacuccucagccucccucucccaagugcuagugcuccccacucgugagggcaguaaccccucccccccccuccccugccgcacugcccacagcccucagggacugcccugccaacugaaucccaccagggcccagggccucagugauggcucucucaacaggccgcuccccuuaagcaggugacaaggccuugaccacagacccgcggaggaaggucuuggaggccuggccuugccuggcccuucaaagcaacugagaaaguggccaccuccuccacagugccgcccuccugcuggcuggagccugugugguccacgcuccuuuuccgagguggguagggggcuggggagacucccagguuuugucagcagagaaccauaguuggggaggacugcguuuccauggauacaagccaugggagcugcugggagauggggccaugguguacacagauacagauccacacggaccugcaagaaaaauagcaacagauuugcugagucauuggccccacauauuuauaguuucuggcaaaggcagaccugccuaucagaggcuaauaauacugcagcagcguguuaauugcaaagacggagccuucaagcauccauucagacacccgagaccgcuccuugaauaaagaguggggcccucacaaugaaagccgggaugcguggaggcagcgugugugcuuaggaguguaugugcaugcagguauguggaacccagcucuggcacguucggaaagccagaccgaaaccaccccgcaccagaguguuagaaagcacucuucaaucaccuaaggauaucuaggauucagcccacucuacagaugggcagggugugaggagauugacaagaggagagcaggcugguuggcuaugucccaggggugagaggagguggacggggugcuggucugcagccgugagagaccuuuguggggacagccacuguccucuagcucugcacaguuggguaguuaggagaaagagagaaacaggccucuaucuucuggaaggucagccccagugggccaccugacacaccugagaucccacagggccccaauacaggaggcagagucaaggauguagaugccgggagcgugccugacgucuugaauaaaugcccaagggauaaagucaacccuagaagaccaucuauauccuuugccucagggagccaggaggcccauuuagcucugaaugaggcaagccaaguccucaccuccuaggacuucaccggacauggugguccuguccuuggagcacugccuuacaguagcauuaguuauaucucauugccucugccccucugggggcuucacauguucccagcaccuggaagagcaggcccucagugagggcuuguagaugaagaaccaaaucccucagguucuuugaaagcaguucucagucccccaacucuucugaacuccaaaccaaauccuccuccccuggcuuggguucaagucucauuccuggcuguaguccucucuggacgugcuccuucuuaacgcugagcccuucgcuggaugcagagggcagaagaugggucucugacgggauccccaucuucuuauuucagcacacacacuccugcccucaggacaaggagggcaaggauugcuggaugcagccuucccuuugcugcagcugaaacagccuccuggccucuagccuccagcccagccuaggaggacaggucauccucuuucccggagggaucugacaacagaugggucauggccuccagggacccccgaggagcagcagagcaaggcucugcagggaggaggaguaaccaggcucgcugcaugagcugggccuccauuucucccacuccuacccccaaaacagcucaaucauucgugacugaguucacagcauuccgaaguaaggaggcagaaaaggagggaggaggggagagaagagagggacauccuuucaguucucacuucucuucaggagaagguugacucaagagcuauuauuaauaguaaauuaaauagugcaguuauucugaauaauaaaaagcucuucuguuccaaguuuucacuguccucucucgagggaaauaccugcuguggccugagauguggcaucuagugaauagcauuaauaggacaaagcagaugcucccgcugugcccagucacaggccaccaaguccccuccaaaaugccuccuccacccgagcaucagggugcagggagaagacaggcuucaggugccccagacaccccagaucaccccgcgaugaucacaccacagagcccaggcuauguucaccucaggguggaaaccuugucgauggcaucccugcuggugaauagugguccucccacuugcuagccgugugaccuugggcaagcccucgaacuguuccauucccucaucuguaaaauggggauaaugauaguaucucucucauggguuugcuagaaggauuaagguuaauaugcauaauauuguuauuauacguauaaagggcuuaua

SEQ ID NO: 16026 - RNA, 8834 nt, Homo sapiens
uuuuaugaggccagggugauguugauaucucaauucccacaucuguaaaguggggauaauaauagguggugcccaccucugagguaggcagcaagauuuggauuaagggaguuguauguauggcccuuagcaugauuccugacaucuaauauguccucaauguuagaugccaauaauugacguggccaagccccaauucaggccaaagccuaugucucaucugcaccaugcugagucuagaauggcauuccuuagacaaagggaacagaaaagaggguuggggaaugauguugaaaacagccccuguccggugauggccacuuagcaaacuugaucuugcugaauccucacgaacacucuucaaaguagcuauaucaaucccauuuuacagguaggaaaacugagguucaaagaaucugcaaguaacuguauaaagucaaagccaggccugucuucaacauaaagcaaguuacuaaccaaccaauccguggcaacaaagcucucugaccuugggcugaggcuaucuagauuuaaggguuccuuucucucucucuuucuuuuucuuucuuuccuucuuucuuucuuucuuucuuucuuucuuuuucuuucuuucuuucuuucuuucuuucuuucuuucuuccuuccuuccuuccuuccuuccuuccuuuuuuucuucuuucuuucugucuuucuuuuuuauuuauuuauuuuuugagacagaaucucacucuguuccccaggcuagagugcaguggugagaucucggcucacugcaaccuccgccuccuggguucaagcgauucucuugcucagccucccgaguaacugguauuacaggcauaugucaccacgcccaggagaggcaguuucaccuugcuggccaugcuggucuugaacuccugaccucaaaugauacacccaccucagccucccaaaaugcugggauuacaggcaugagccacugcacccagccaaggguuccucacuguaaaaugacugaaggaguuucucuccaggcuguuaaaagacaagaaaaacacacaaagaguucugacauaaaacugccauucugucuccaagguucccaugagccuacauuccccugcaggucuccaccugccccagccuuuacauggcucaugucauaaggaggugggucaccccaucuccugccuuaugggagagggagguuguuauugcacaaguaguacauaaauacauucucauuguaauaaaaacuuaaccaauucugaaauauguugaacccuacccagaggggaauaccauucaacccuggauagaucucccuccagaccugcuucugugcauuuaucucauuauauagacgcaucauuucaaguaguucuuuuacaugacugcaauaauccugcagguauuguucugcaacuugcuuuuuucacuucacaaucccacgugcuauuuauaucuccuuuacuuucccgauggauucaggagguuuaccagaguuccagaggguggguacagagccccagaaagaacauggggcuggagucaugcugaccuagauugaaauccugguccugccauugcaucugggugaccuugagccagucccuaaaaucucugagccccaguuuccucaccugcaaaauggagauagcaauagggguuaccucagaggcucagugugagacuccacuaugauaugacaaagcgguguuaauaauuucagauccucagccugauccucagcuucccuagggcuuugaguacaaggauuuaagggucuggaggucccuggugggcaagaugguccuuagaaaucagaucccagggccuugagcaaguccuuccuuacccaagacagacaagacacaggaagagagaaagcagcagagcagcgacacgagacacccagagucacugcuccauggcugcagaccacacugggccucuccagccacauugggagugcuggguguccugcuccuccacaucccauggagguagcaguggugauaucugucuggguucugcuuucccuaagcuggggaaaagcaagcugcuuuuuucuuuuucucuuuuuuuuauauuuucuuuuuuugaacauacagggucuugcucugucacccaggcuggagugcaguaguagugcaaucauggcucacuggggucacugcauccuugaccucccaggcucaagcacccucccaccucagccucccgaguagcuaggauuacaggcacaugccaccacacccggcguuuugauuuuuugauugcuguugcccaggcugaucucgaacuccagggcucaagcaauccucccaccuuggccucccaaagugcuuggauuacaggcaugagucacugcgcccugucccaagcuacucuuaguaaauaucuguugauuccacgauccauuccuucacuucuggagcguguuggaagauucuucuuccuauuucaaaaacggggaaacugaggacagggaaugucagaggcucuagacaucaucuggcccagcucccucauuugacagacgaagugacagagacccuguagggaggaaagcaaaaggcaugggacagccccggcauagaaugaauacaauaaaugcugcaugaggggccagauguuuuauuuaauccuccauccuggcccauaagguagguauugccauuucccauuuuacacaccagagaccuuagguggcuuucuccagggagcaccgccaacaggagccagaguuagaacucuagugcgcgagucucucacccacuggcucccggcacugcccucucuugccuccugccagucgucccacacacugccucaucuuccuggccugcccccugggcugcagcucccuaggaggccucucugaccacccuccugugccccacugcucugauacagacaaccauccugaccuucaggaccccugagcucucugacuugaugaagaaucugucuucucucccgagacugugggucguugaggagaaagagucuaauucugaaacauuucugggucuucacauccagcauagagucugguccagaagaagcaaaugcgaauguuuguggaaggaaaggagggacagagggagggacuccaaggccaugcucuuucuucuaucccacagcuuauuugacacagccaaggcucuaagauuuguuuuuuguuuguuuguuuguuuguuuguuuuuugagauggaguuucucuguuguugcccaggcugcagugcaauggcacgaucucggcucaccacaaccucugccucccagguucaagcgauucuccugccucagccucccaaguagcugggauuacagguaugugccaccacgccuggcuaauuuuuuuguauuuuuaguagagacggaguuucuucauguuggucuggcuggucucgaacucccgaccucaggugaucugcccaccucagccucccaaagugcugggauuauaggcaugagccacggugcccggccaaggcuccaagauuucaucccacauugcacauccccuucccccaccucacugccacuggcccucucccuacuccucagccucccucucccaagugcuagugcuccccacucgugagggcaguaaccccucccccccccuccccugccgcacugcccacagcccucagggacugcccugccaacugaaucccaccagggcccagggccucagugauggcucucucaacaggccgcuccccuuaagcaggugacaaggccuugaccacagacccgcggaggaaggucuuggaggccuggccuugccuggcccuucaaagcaacugagaaaguggccaccuccuccacagugccgcccuccugcuggcuggagccugugugguccacgcuccuuuuccgagguggguagggggcuggggagacucccagguuuugucagcagagaaccauaguuggggaggacugcguuuccauggauacaagccaugggagcugcugggagauggggccaugguguacacagauacagauccacacggaccugcaagaaaaauagcaacagauuugcugagucauuggccccacauauuuauaguuucuggcaaaggcagaccugccuaucagaggcuaauaauacugcagcagcguguuaauugcaaagacggagccuucaagcauccauucagacacccgagaccgcuccuugaauaaagaguggggcccucacaaugaaagccgggaugcguggaggcagcgugugugcuuaggaguguaugugcaugcagguauguggaacccagcucuggcacguucggaaagccagaccgaaaccaccccgcaccagaguguuagaaagcacucuucaaucaccuaaggauaucuaggauucagcccacucuacagaugggcagggugugaggagauugacaagaggagagcaggcugguuggcuaugucccaggggugagaggagguggacggggugcuggucugcagccgugagagaccuuuguggggacagccacuguccucuagcucugcacaguuggguaguuaggagaaagagagaaacaggccucuaucuucuggaaggucagccccagugggccaccugacacaccugagaucccacagggccccaauacaggaggcagagucaaggauguagaugccgggagcgugccugacgucuugaauaaaugcccaagggauaaagucaacccuagaagaccaucuauauccuuugccucagggagccaggaggcccauuuagcucugaaugaggcaagccaaguccucaccuccuaggacuucaccggacauggugguccuguccuuggagcacugccuuacaguagcauuaguuauaucucauugccucugccccucugggggcuucacauguucccagcaccuggaagagcaggcccucagugagggcuuguagaugaagaaccaaaucccucagguucuuugaaagcaguucucagucccccaacucuucugaacuccaaaccaaauccuccuccccuggcuuggguucaagucucauuccuggcuguaguccucucuggacgugcuccuucuuaacgcugagcccuucgcuggaugcagagggcagaagaugggucucugacgggauccccaucuucuuauuucagcacacacacuccugcccucaggacaaggagggcaaggauugcuggaugcagccuucccuuugcugcagcugaaacagccuccuggccucuagccuccagcccagccuaggaggacaggucauccucuuucccggagggaucugacaacagaugggucauggccuccagggacccccgaggagcagcagagcaaggcucugcagggaggaggaguaaccaggcucgcugcaugagcugggccuccauuucucccacuccuacccccaaaacagcucaaucauucgugacugaguucacagcauuccgaaguaaggaggcagaaaaggagggaggaggggagagaagagagggacauccuuucaguucucacuucucuucaggagaagguugacucaagagcuauuauuaauaguaaauuaaauagugcaguuauucugaauaauaaaaagcucuucuguuccaaguuuucacuguccucucucgagggaaauaccugcuguggccugagauguggcaucuagugaauagcauuaauaggacaaagcagaugcucccgcugugcccagucacaggccaccaaguccccuccaaaaugccuccuccacccgagcaucagggugcagggagaagacaggcuucaggugccccagacaccccagaucaccccgcgaugaucacaccacagagcccaggcuauguucaccucaggguggaaaccuugucgauggcaucccugcuggugaauagugguccucccacuugcuagccgugugaccuugggcaagcccucgaacuguuccauucccucaucuguaaaauggggauaaugauaguaucucucucauggguuugcuagaaggauuaagguuaauaugcauaauauuguuauuauacguauaaagggcuuauaacuguuccuggcauuuagugcaauguaaagguuucuuaaacaagagggugccaggcugugcagaaggcaagcccaagaucuaagacuccaugcgucagguuuguugugauugaaaccauuacagcagagagcuccucaguaggugucagcccaggcugaugaaggggaugcagcgaugugaugucccgcuccucucugggccucaguuucuccacccaugcaugggggacaaagguguaugaagcgacagcuauggcccagccugugcugaccuguaacuuauaaaacagcuaauguacauugaacuccgacuacgugccaggcacuguguuaagugcuuuauagucagucagucauuucauguaauccucacaacaccuccauagguagguacucuguuccacagaugaagaaauugggucucagagaggcuaaguaacuugcccaaaaucacacaguuagcaagagguggagcuagaacuugaacccgggucugccagacuccacaacccaacuccgaugcccuugaagucaugucaccuaaccucuuauuauauaguagccaggaauguguuguguaacucaggauugcuuggcaaaaaagaaggggcaggucugggcugcuccugucccaccccaggcuuagcagccaagcagcccuccauuugauacagguugaacaucccuuauccaaaaugcuuaggaucauaaguguuuccgauuggggauuuuuuuuucagauuuuggaauauuuacaaauaguuacugguuaagcaucccaaaucuccaaaucccaaaucugaaaugcucugaugagcguuuccuuugagcaucauguccacgcucaaaaaguuucaaauucuggaguauugcagguuucagauuuucagacuugggaugcuuaacuaguaucagcuuuucugaagaggugaggacucuagcuggcugccuaguaguugagggaacacagagaguugaaaauggaucccauggagagucgggugagaagacccugggggaaucaggggaugcacccaaggcccgguggagagccagacacagagcuauugccggcccaggcccagagcaggugccagcaucugggaugugcaggaaaccccagggaugcagccuaucagagccccuccugcucacucccucccaucuaccccgaaucauccggucccuccugggcccacuuggcuuccucuccugcaucuccaauggcagcagcuuuugaggggggaacacucuccccuggggcccggaugcugugcuaagucguuguuucugaggaggaaacaaggccgacugcauuuucuaaagaggcuccagggagcugcagccaccugugaggccugcgacuggggccucucagugcccaccacugggacagcgaacccugcaggucacaggcggugggucaaguaggggguccaugagugugaacaaaauguuugaccuagggcugauugagcaacauuugugauggggcagacacugggcugggagaugagaugggguggaucaggcagguccucaaccuccuggggcuucuagagauagaggugaacauagaaacuaaccucccccugguaaguagcaaugacgcaguaacugagcuuuguggggucggaagagcagggacugauaaguccugccugggaaggaagguggaaaggacauuccaggcaggagagcagccaagugagagggccggaggcauaggagaugugggggagccuccuuccaggaguucugguccuauaugguucuaggugagagauuggaggugauaagugguguggacagaggccaguuguaagaggccuggaaaaugcacacagaagcucgaguuuccugcugaaggcaauggggagccacuaaagggagucaugugauuggacuggccuuuagaaagaucacccugggacaagcugacaccccauccagcucuccagagccccagcucaagcccuuaggcgucacagugcuccugccugacaggccauccuggauuagggggugaugcgggaaaaguuaugaguucacauucaugggacucagcacaauacagauccaaccaauacagauucucccuggcaauggaucucuuccgcaauucaaagaugucuacauuagaagugaugacguuuacauaucagaaaauccaccccuauaauuaaucaugucaauuaccagaaaggaaauaguuuugugaucaucuuaacugacaucaaaaacucauuugacagaacugaauauccauucugcugaaaacccuuaguaaaauaaaaauaaaagaacauuuccuuggcauaauaauaauaaaaaaaaccuaucugcaaccaaccgucaacaucauucuuagcaauaaaacaccuagccagggucauucauauuuuagucaggguagaaugagaaagccugcuauuaacacaauuauuuuacauuguuuuggaaguuuuagccaaggcaagaguacauuaauacacaaaaggaaacacaacauuuggaaaggaggagaaauugucaucauuauuuguacaugauauuauuguuuauccagaaaacucaagagaaucaacuagaaaaguaauaagagacuaugagcgaggucaguaagaugaccaguuuugaaauaaauacacuggcaaaguccaauuagaaaccuuaagaagaagaaaacugaggagugaggcaguagcucaaggguacucaagguugcagaacaagcccaaccaccucaaaggucuccuguuagggcccagccuagcagggaggg

SEQ ID NO: 16027 - RNA, 13556 nt, Homo sapiens
aucuucaugucuaagaggagcucugugaaagcuuuggggccuguggggccagauccuuagcauuuuuaaauuuuauuaugacuucauuuguuuaaauauauauauauauauauauauauauauauuuauuuauagcucuaugugcccaccgcccccggcccccuccccggccccuaguuuuucccccuggcuuucugucuaguggcuguguagggcagaaccgucugcgugcucuugucugacacugucugggugcugcuguuccucgugacccuucgagucuguucaggggccaagguagagccugaguggcggcuggucaguggagagcgccgugacuuguagggggcuggggagggcuugugggggccugcaugggccucuguaugggcaggcucagggggcaagcccacuucuuccuccuccaccuccugcucaccgucccccuccucaucgucacagcacagagcaugguagagcacuuugucacugaaccgcacccucucccgugucccugggguccgcuggggcagcuggcucuucaccguggggccagcaccaaaggccuccucacuggaggagucuggggucuccacucguggcccauuggggaugggcgugccaccauucaugaggcgguagucagggccagccccuggccgagucgacucgggaccauccacggaguccgaggggguagagacguccaggaaggagcagaacucccagcugucugagaggauaucggcugucaugaaguccagguggcccaggucaaaggggccacccaugcccgccuugucacugcuagaggugcugcucacaguggccgugguccagucguccggcuccaguucaaagucgaaguccgagguuagcuuaucgaucuggcucaccaccugaccagggaaggggagaggagaugagaggggccaggugggucccugcaucagccaggugugagugugucuccaccccaucccuguagaccccuggcugaugagcguacuggacaggggagagccuguaggauggugacuggccuggaggucacagguugguuugcccuguggagggcccaaaucagaucaggcuggacagagcuuguuccggcccuucccaaaggucuguuuaccacuguucagugcccugggggagagggaacugcuuuccagcccugcacaccauccauucacucaccccugucucucaaacacagcagcugcucugggggcagcccuggugaucagggaugaaucuuccuuaguuugagagggggccacuucagaggggcugagggccuccagcaagcccauuccacaaagagcugagcagcccaugcacccucagagaggaaaugaugugggugaucacaaggaagacccugugugggcuuucuaaagcauccuggaccaguccuugcagcugacuggugacugucgccccugggucuccaccaucccucacggcaagaacaccagguguacagcacuggcugggucaccccacccccaucuccaucucccggagccuccucauuccuuccccuucccugcccacugacaaguggagaucaauccuggcuuguugagagaaggaauaaagcaagcauuauuugauaagcaauaaagaagccaucuauucugggcccagagcugcuuguucaaugcacucagggggcagcucagcuguggaggucacuccacccuggccugccucgcauaaagugaagcccuuggcuucuauacagaaggcccuggcuugggacacucccuugccuggguggccacugucagcacauaaaucagggaggaagacagugagggaaagagggagauccagucagagacacagggaugggacagggcaagagaagggagagagaagauuccaaccaaaaacaaaacagaaaaacaaugaaaacaaagcagcgaggccaagagucagaguaacagagaccaagagauccacagugagucauccagaucagaauccagcccccagcaccucucuggcgcccuucaaccuggggucagagcaggcaauuaauuaauuaacucauuaaguccuuaauucaacaaacaguugcuaagggcugcugcuguccagggaugugcuaguauuuggcaaggaguggggguagugagugccccaaagugagaggaaagcaaggacaaaagugauggccagaguggcuugggccagugggaagacuacuugaucaggagucaggggcuggaugcaggagaccuggucaaccauuuuuccucuguaggucucaguugcccagucuguaagcgaagagggugggugaacuaguuuauuuccaagguuccuuccaugucugagauucuaggacucuguuuauaggaaugacucugagaggcugcuugggugcugaugccuagggauggccccucaaccauugcccaggccaggaguggggaaaccacuuggcugaggccuccagaagagcuggaggaaucaggacaucuggauuccagacuuagcuuugacauuguucugugugucuuuuggaagaucacagaaccucucuggaccucaaccucauucaccuccaaguggguaugacaaucccagaccaccaagugaguaugacaaucccagccaaccuuaugagagcuucaugaaggacagugagaagggcagcaaaaggacucugcaaagcacuggggaugaaaaugacaccaccucccaucucugagcaccuaccaugcaccaugcuuucgagugcucaccuccacccaugagaucauuaucuccugugucuacagaugaggagucuugggcacuagucccuggaaagcugagaaucucccccugcggcccccugcaaaacugcacaccaucaugaagugcugcugugacugcugggcuugggcaggcggcagggauagggcccuacccuccaaucuggcuacuucuucuugugcuucucccaggaugaugccuuccugccccaaaggaaccucagagaaacuccuaucucccagaagcccuugcucaacccaagcuccacccaagggcuggugggagcacuggccuagcguagggacacucagacuugagugucccucagcucacuccccagaguuucugguucugcuggucugggguggugcuggagaaggugccuaccuagugugccuccaggugcuguugcugcugguccagagaccugcuuugaaaaccacuagccuagggcacugggagauuuaagcugggugaagaccagcaauucaaggcauugauggccucaggagaggcccaccaccucuggggcagcuaugcccucaaaugagacuccccugaucaagccagagcuguggaguuugcugcugccugagggcggggcagaaugccaguaggaauuggaguugcaugacuuggcugugaccucacagggucagcugaggccaggcugggcccagaagcugggucuccugaugcuuagugaggacaagcaccauugggccucaggcagggaagauccaggguacacauggcaggagcccaagccuucaggcuggaacacucccccaacccaagaagcccuuccucuucuuuauuaguacacuccucucugguuccaaccuggggggauggaggaaagagaaagagggaggccugcauucccgagucccacgucugccaccucuuggcugagagaccuuaggcagaugauuaucccccucuggggcuugauuuccuguccuauaaaaggaaguaacacuccccuccucacccagggugaugaaaauuuaacagauaugggccgggugugguggcucaugccuguaaucccagcacuuugggaggccgaggcgggcagaucaugaggucaggagauugagaccauccuggccaacauggugaaaucccgucucuacuaaaaaauaaaaauaaauuaaaaaaauuagcugggcgugguggugcgugcauagagucccagcuacucgggaggcugaggcagaggaaucucuugaacccaggaggcggagauugcagugagccgagaucgcgccacugcacuccagccuggcaacagagagagacucugucucaaaaaaaaaaaaaaaaaaaaaaaaaaaaaagaaagaaaaagaaaauuuaacagauaugaaugugucacagagucaagauagcuaaauacuuaagaaccugggcucuggagccagacauggaguccuacccuggcuucacugcuuaccagcugugugaccuuggccaaguuacucaacgucucugugccuaaguucaucaucaaaggagaauucuaguaauaccuacuugauagggcuguugugaggauuuaauggcuuaaugcgcuuuggacagcauauggaacaaggcagacuaccaacaucuacaaugcaccguugggggcuaacaugugaucaugcccccgcaccaggccuaagagcagugggaauuaguucugcaccaaaggaaugacccucugauguggguccagugacuguggcagaauuuccagugccuguggcagaauaaugggacaugccaggccuuucaaaaccuagcacauggacaguaccuauuuugcccaaaguuagggcugucuccagaaagaacagaaccagaagaaguucuaaaaaccaacuggcuaugaggcccacaggcaaaucuggcccaaccuauuaggugagacaggucacaccacuugaugaaugacauagugaggaugugaaagggaagccaugugcccaaggguaugcagcuucucuguggggggccugggucaguucacaauccccacugcucuucccuggugccucguuuccugggccaauggugagggcagguguggagcagaccccagucuugucuugcucucugcuuuggaugucuugaaaucugugauuuuucccugagguuuaauaaucauuuugccuacauguaauuugggauugucuuggagugcauggaaauaauuauauacacagaaggaaagagagggggagagagagaguggagagagaaauugaaccauaaaauuacagaaucagacaacccccaagccagaagggacugcaggcacuguugaguccaccugucucaauguguuugccgaggggggcaaugaggcucagagacugggaggagcugagcugggaccagagggugagucuugacuccugggcauugcaccuuaagaccaagaaugacuugcucugaagagaccaagagggagcccuagagagcaagggcaggacugagggcuguggcagaaccugcaaaccucgugccagagguguccccaaccucuguccuggucacagccuuagcgccccucgcugaaaaacugcacccaucuagucuuuccaccgauagcaacuuccucccagcucuugcuucaugcugcaccuagggaacuuucuuaucagccaacagguccacguugccccugugcuuccagcccuuccauacuccccaaacuccuaagccucccaaacauaacucccuacccacccccuuuccucuccagcaagcagccuccacccugccaggccugccuccucaccaccccuacacacucacacuccaucgagcucacuucugccucugggccucaccugacacgcccucccuccuuuccuacucacuccgucuucacuucgagaaggaagccuucccugauccccagcugaggucagguucccuaugaaaggcucucaaagcacccugcaccucuccugaaaauguuacacaauauuuaacacugcuacaauuuugcaccuauauguuauaacgugguugaugucugucuccccacuacacaguaaaccccaugaggagcaggacuaggucucuugcucaccgcuacauccccagcucggcacagggaucggcacauucugcaaacacagcuguuggaugagugaugaguugagacagauggcuuaauaaaaacuacucgggaggcugaggcaggagaauggugugaacccaggaggcagagcuugcagugagccgagaucacaccacugcacuccagccugggcgacagagcgagacuccgucucaaaaaacaaaacaaaacaaaacaaaacaaaaaaacugcugggggcuucuuuucugaggaagaguuccauagaccuggacaauccuauauugccagacgccaacccucucuccagcccuggcugagcccccucuccaguggaagcuuugcuguguuccuuaaggccuuagagcuaggacugaggaccuguagucccagaaccagcauccuguacccccggaccccccaccacaccccccacccugccccaccucaccuccccugacaagcugccaccuccuucccucucucccagcuccccaaggcagcugguuacauaacuggggauucugcauuauuuaugaccacugauuauuuuuuaauucugugauuacguuauuaucuucuuggggggcuguggaguuggaggggcagcgagcugaucgugauucauggcucucauccugcaauuuggccuaauuggccagggagcuuugguaaaucuguccggaggaggagaaggcaaagggaaaagggaggaaaggaaggcgugaacaaaaauaauaagaaaaaaauccacgcaauucuugcugagcugcaggugauggagcugacccacuuuggcgcagcuccgugguccccagccucuccugcuccagcugcuuccuggcugggccccauuuaucucacacuugcauggccuauggcuuucccugccaccuucagacaaagccccuugccgaugggacugcacaauggaauggccaggaaacagaaugccaggaugacugcuuccuaggcaaauccggugggggauccuccacugccacccaaggcuggggaaacguugugccaaccccuccaucuuccugagguguuugggccaaagugagcaacugugcccuuaaguuauaucccacccaagagucaccgaugaugugggagacacugguguuaaugcaaggaucacuauugagcccccauguugagugacgccugggggagggggaaaccaaggaugaggaggccaaguaccugcucaagguaagcucaauaccugggggccaaggacaggggcccuuaacccugccuuugggagcuucugguggguggguaacaggggagcaguggggaggcagauucccacccagaaacaugaccagcagauuccuggagagugugugggauucucacugagaacgaauccaaauuccgugcaugcugugcauggcucgacggaaucugacucccugcucccucuuugaccuuuccucuacucuucuccuuguucacugcccuccagcugcucuggcuuccuuagcugaaccugcauaugccaagcacacuuccucuucgagaccuuggcaccggcugcacccucagccgggaaugcucuuccccuagauagccaugugacuuguauccucacuucuguggggucucuguucaaaggccaccuuauuggagacccccuuccugcccccaucccugucacucucuaucugcuuuucccacuggcagggagugagacugcugacugcaggagaaacuaaagggccccagccaggaggccaggaugugguccugaccucccuggucauggcuaagaaacugaugugauuccagaaaacaaggccguacguggagcugaggagcaggccaguuuuagaauaauucauuaaaaacaucaaacagauacggagugagcuuugugccucucauugugcuaagugcuuuauauaugucucauuuaauucucgcaacaacccuggggcagggguaggggaggaugccuaaaauguagucuccccauuuuuaccaaugggaaaacagaagcacagagagguaaaguaacuuucgcaaguucacacagcuaaggagaggguggagcucagauuugaacuacaggcaucuagcugcagagcccaugcucauagccccugagcuguucugcaucucuuacuuaagaucuacagaacuuugaggagcuuagagaaccugcugggacuggcccgguauccuggaguacuggggagccugggagagauaagggcuaauuaacgauugaccgucauaucccucugcagcacaauuuuagcuuucaaagcacuuuuacauccucaccucacuuaauccuuuaaaagacuuuccccaccaaugggauagaacuugcucaucgcccagggagccaguggcagagcuauaguagggguuugcgagggcgagggaggugugggagagggaacuucaacucuucuaggagugugaguagguguugauccccgcgcccccagcccacugcaugccaagccccuaauaaauccuuauaagaucaccgugcagugcaaaucaccacaucccaauuucagagaugagcaaacugaggcugagggaccuggggaggaagugcuuugguguggcucaucuuucagugaauuucaggccauaugcucgagaggaugaggagagucugccaugaucaguggcaucagggggcuggggaaggggagcagcaggcagaggaggaagauggcugaggggaauaaagcuaagcccuuccacuccgcuggccuuguucuuucaccaagcauaugugcagccccccacccccaacagucuuguaugugacucucaucuccacuucuaagugcuuggccugagacaagaacacagcuggugggcucuaagcuggugcugcccaggucauggggugaggugagggaacaagugagugccucucaaccuugagccuacccaugcccccgauaaaaaaaugcuacacaaagggacugaggagagccaggcagauucagcuuuacagcucccuuggagagccaagagccaagaccacagguuccagagagcagggagauuccaacccuuuucuccaaaccggggucuggcacccccccuugguaaccccaucccuggcaaaucccaucucacaggaagacggugauggcaucucuucuuuugcuugggccucccagagcuucaccugccuuccuccacacuccccucugccugucacccugugucuagacccugccugggggacgagagaguucugaggcuuacccacucccccagcugggugccauuggcagcgggcaggcaguggcauacgggguaggcucugguugccguagcaaccugccaaagucuuggguggaggcacauggccuacaggguguguggggggaggggacucauuuucucuguccuggcugaggccucugggcugcauagccugugaaccuggagcucugcuauuggagacaugggagugggugagugugaaagggaaggagagggcaucuaaacgaucugcaaauaaauccuagagcuauugcaucacagaugagcauaagagaucaucucuggaaggccccugucaaaaugcaaagagaucgcccaguagcucaccugcugaaaccccagaaaaggcaucaggaacccgaguucuaggcauacuucugccacugguaggcuguguaaccuuggacaagccccuauugcucucugggccucaguuucuucaauaguaaauggacagagcuggucuggauuaccuaugagauccuuugaagcucuggguggcuaugcgguggggagagggaacacagaugccuggaagaugcccaacugggaaaaggcugggaguuguaucagaguugacucccaggccuagagucaauccuggcucuuuguggguaccugccggggcauaggucucaugucccuggccaagacugagacuuuggacaguucccauggcccugaucuaaaauaagauggaggcagggggaaaacuguagugccuuggacccaagaguuuggaggaggaagcguuccgcaggggcaucuggcgcuugaucuccaaauuguacuguccaaagaugugcaacccagacuauggccggcccaguccaugggcagaagcaccaccaccucagucugccugaagcaacagucauucucaucuucugagaugggauuuccugguaggcuccacgaggcugacccuggacagcucuuguccuggcaucucuaugcccacucccuaucccauucugaacacagugcccuucaaacaaccccuccuccuuggcucucaggccaggcugcaaugccacuuugccagccuggaguugguaccuaccaucaccccaccucuucagccuuccuagagccccuauccucccugcacagcuggccagggagagcuugagcccauaacuccaauucaaucacucucccugccaucucugcaggggcccugauuacaaggaguugaaauuugccuaaagcccaccuggcugguauaauggcacccagugggcaaauucaggcuagcagcucagaacgcuggucaugcauuuuggacucgaacgcagcacagggggcagggcugaagacauguguaccucauuacccuagcgaugugagaagcaguaauuaaaccaggcuccacuuagaaagacagagagggacacacacaucccagcauuucucaguggcuuuucagccuuggcaaaaauauuuagaacagugggauggagacucgcauccccuuagggaagacuccugccccugccaaaauaugcaaggaacucuguuauccacuacagcacccccagacccauucuuacccccggacaaagaggacauagcuggcuuaaauuuuuccaagaucaaggguucucaguaucugugugauuucuagggauaugcuuugagcugggccucaagcaguggaaaccaccucagcacaacuaucugcacucucccagggucccuugugaccagaucagagucugggagacagaugguggguucaagggucagcuugggucccagaagguugucuuccacuaagaagcuguggcgggauucaguccuuacuggccaucuuggcagcccuuugugcuaacccagagcuccaggcccacugacaugcugcucaaguaaccucuacaacaccgaggccccuccagccuuggggucugaugagauuuuuagcaaagcagauuugcggaaaggagagcaaggagaaagaagguccccaguagagugacacaugugcacgcagcuuugcacacuccaacguauuuaugaguacguuuuugugccaaacccaagaagguuggcuuagggucugucuggucccuccucaccccucacuuaccucccucagcuccuuggccaccuccuugagcucgcgaaggaugcccucaagcugcccgaugaccaucuucaugcgcugucgaauccgcucccgcucaccaccacugcuggggucgucacugggcugcccgagguccggggcgccccgaauguucaucguuuaccacguggccgcaggccugcccauacuccccccagcugggcacacacugcgucugccuccacggagccccccucggcugggcagagcuccacauuuuaacggccccccagcccacccuggcccugggcggcccucaaccagccccugcccccugccacccagccuccucugccucuggguggagagugggacacccagagggagacagagucuagcagagggggucaaggugaggacacaggagaggagggggagggaccuugggucccaggaguggccuccaggucuugaagugccugugggugugcagagcugaucucugccugagcuugaacacagaggcagggggaugacucugcagggacuaaggguaagagaugcccuugggaugggggaaggcagcagggauccccucacaacuccuaggcaguugcaaaggcagaggucucuggaugcaacugacaccugcagagggaugguggccagggucuuccagauguggaaggggcuccggauaugggcagcucuggggagggagcuggauuggaagagggcagcccccugcggagagagcgagccuggcgucagcccucccaggcugcagcaccagccggcaaugccgcugccucccuccucucgccagccugcacccuuccucgcuggggauuuuuuuuucuuuguggggaggggugguggaggcagacgguuuacagcacagccccuccucuagagggaaagggagggagccccugcuuuagaagcagaaguccucagccugcuacggggcacccuggccguagcucccgcccuccccccccaccuuccccccagccaggccugcccaggcugguucaccagagggccucuccagucacccauccucccuccuagcgcccccagggugcccucguucccagcggacccucccucccccagccccgccuucccucagaacccccacuccuggacucaccgagggugggggcaccggccuucccuccaagcagcgucgggggccaagccccaagacggaguuggggggcccccaaggcucccuagggcgggcuucucucucuggacccuucggccccgggccucagggagguccuccgagccgugaccggagacaucugggcggugggagggggcggggccuccgcgcuccagggaagggggcaggaaaaaucuuucucaagccucuccaggcucggggucgggaaugagcgaggguccggcagauuuggggcuccgaggccacaggugaccggggcgcggggaggccgaggagacgccgggcaggucccagcgcgugagccaaagucggagggcugggagggcgccgggauccccucagcccacgcccggcauuccccgggcucugcaccguccgggauucgcucuguccaguccagaucggccggguccguguuccgcuggggucugcccugcccuaccccgcccggagugagcuggcaccgccgggcgcccgggacgcgcucagcccggacccagaacguccgugccccggcacccgcggcguccggagcggccgcgagggucugcucagcccagccccgcggucggcccugggcgagaccgcucccacggcucaguucacguuccgaaagguccggaauccaccggguccccgaggaggggcgaugucagccgcggggacccgguccccgccgggcccagccgagagcgcgcgaagccgggggccccggccgggcuggguucggcggcccgggcgcaggcgggagcagcgccgggcggaggagaggagaggaggcgagaagaggcgaggggaggaggcgcggcgaggggaagggaggggagggggcgagcggcgggccgggccgggccggggcgcacuaggcucgcagccuccgcucggcuccgcuaccucccguccguucgcucucggcuccccgccucagcagcccccgggcgccgggucgccgccgguggggcaaacaggcgccgggucggggcugggccucccuucaccgccucgcccugcccugccccgccgggcucccggggccugggcccgcuccccaagcgccgcggcgccgcgccgcccgcgccccggccgcccccggcccgccccgccgccccccgccggacuggccgcccgggcgggcgcuggcucccuuaaag

SEQ ID NO: 16028 - RNA, 253077 nt, Homo sapiens
cgccccccucgcgcugguguguggagccggagucggcggcggguggcggcgccuggaaccuggagaccgacccaccgcccccccccccccgccccggaauguacugacuccccuucuucgcucuccuccccuccccgcccccuugcaggagggaggcgcccuggagucuccccuccagcgagaggggcugcgcgggccgggccgggccgggcugggcuggagcagcggcggccgcgggagccgagcuugcagcgagggaccggcugaggcgcgcgggagggaaggaggcaagggcuccgcggcgcugucgccgccgcugccgcucacucucggggaagagauggcggcggagcggggagcccggcgacuccucagcacccccuccuucuggcucuacugccugcugcugcucgggcgccgggcgccgggcgccgcggccgccaggagcggcuccgcgccgcaguccccagguaagcggcgggcgcgggcccggggguucgcgggggcgcggcaccggcucaggcggccgcggcugcgguguuuuuguuuaggauccaggaggaaacgugcaggaacuucucugccucggcuccgguugccgaagagaaaggggaucgcgcgugguggggaggagaagggcgagagggggcgccaccggggaaggggcggcugccggggggcaggucgggggcgcaggggucuaguucccagcuuuguaccuggaggcagguucaccccucgccucucuccccucccccaggcucaucccacuuguaagagugggacauucuugugcucacacuagcaccaguagaggccacuacacaccucauuaaauaaacaaucagacggccaauucauuaauuuucaggaaaggaaaggggagggggcuugagcuccugguucccuggccagggauuucccagcuuccgaagucucgaggaagagcuggcuagucucgagggacuccucgcgcggggauuggagcccgagucugcggaagagcgggggugucagaggggcacaauugcccgcucacaaccccugguguugauuuaacgaugaggacgccuuggagagcggcucggagugaucguaucuguuaguguuuccguuaugaaaugccucuucuuuccuggggauuacaacuauauuuacagccuauuaaccacucuuaaccaagggaauugucuaagcaucagauuuuagguacuuguacaauguuuucagauggcauuguauaaacauugaaccucaaaagccauuuucaguucuuuuuuggaauauuauagauuacugaaaccaccugcauuccuauuaaggggaccaacgaacaaaaaugccaagccuuccgggaaggaccuuacgguauuguugagcaggauacacucagcaguugaaaggcaaauuagcauguaaucuguuaaaauuauuugaccaaggugguguaccauaaaacuugacaaaacuuucacucgugugagauaugauauuuuuacauuugaaagcagucuuaccgcugaaccaguacuuguuuuucccugauuuauaugaaauaauauuuaaaaucacacugcaagguaacuugacugauaaacuuuucauuuccuugcagaguguguauguagcucauggcuuuugccaauguuaaagaacagcuuuaaacguaaaguaccacucgguauucucuaaacagcuacguaaacaauaguguuuuaaugucaaauuaaacaucacuuaugucaugauguacccuuauacauucaguccguauaugguuuagaacacauuuuggugcugaaaugcagguuacugauccaacugucucuuagaugagcaagagaaauauaacuauuuuggaaaacaaguuccuguuacucaugaucuauuuuauauggaaauucauauguaguucaccaaauuucaaguuuuuguuuaaaguuuugccgauaauuuuguaaguaacuaaaaugcuaguaauuuuauuacuuaggauaauaaaaauaaugcaagcagucucaggaaguggucuuaacaucuguuucaacauuaacucaauugacagguuuuuauuuugcacagaugaggugcaaggcauaugcucucugccuucauggaguuuacagucugguguguggguaggaaagauagccauccaucuacugauuauauaauuaaguaauugugauaagcacuacaaaggagaauagguuuucacaaaguggguacuggagugacauaaccuagucuggguguuaagagugucucacaagaacugagaucugaggaguggguaggaguggagguggggaggcucacagguaauuagucguuuaauugggucuagaacauagaucuccugauucucgguccagaguccuuccuguaaaccgcucugcuucauuacaaaagcgagaggaauaacugcaauaaggagggguuggucaguucugccauaaaacugcggaagagaucaagagacuggagaacugaguaagcagcaacuggaacaagcuguccgcaaaucagauguccuuugucaguaguuuuauuuuuuuuauuuuuguagagugauagacuuauaaaucuuuuuauaggggauuauagugaauagauuguagggaaguggacauguucaguaguagaagguggagaaaaauagagaugugggacaauaggauaaauggaaaguguuuuuccaucugagguuauagacauacggagguggaggaaaaaguaagaaguaaaggacuggugauagaaaauggucagcaagggaggaggguuggaauugaguaggaacauaaucugguauucugaaaaagggcagauuacugaaaagauauguagagaccuuggggaagaugacauggcagcagccugugcaaugcaugucuucucuauuuagagugaacauucuucaccgaggacucuguagcuucugccugaaccauuuauuucaugaugugauucauugccuuacaggguaguccauuucuguguugaauaacuucuguuagaaaauguugcuuuguacaguacauuucacuguaguuuucacccuccccacccuucuuacauuuuuuccucuuugcuuaccuuuuucagcauuacucuaucuucagguuaaucucuucucugauuaauucuucauuugucuuucuggcuuuucuugaacucacucacuuaaauauuaguaucuaaagcuuaucucauuauacauacucuguuugcccucaguugccaccuguaagcuaaggacucucuuaguccacacuuucucacuugccacucgguaccuucacuaaauaggaucuuagguuacugaaguccgaaguuaaacucugugucauuuucccucgugcuuccuucauccccauucucuaaacaugaacaaaccaguuccuggccccugugucucauguuguuggaaggauugcauggauuugucuucuuguguugccugucuuggucaucacuguucauccacuugcccaagcugagaucaagaagaccuccucuucccauugccauagcggauaguucuuuuugcuuuuuaccucucagcuguuucuugacucugaaucgguaucuuuucaucuucauccccaccuggacuaacaguaguggcuccauaauuaaucucuuugucuguacuguuacccucuagaagucuguccugcuagaaugagcuuccugaaauauuuuccugagcaugccacucuccuacuuaaaaucuguuacuaguguucuguagcuuggguguuagaacucuuuggcauggagauugugaggcccuuuguauucuuuaccucuguucucccaaacccaauaaagccucaucucuugucaccccuaacaugcaccuugcauuccaccacuccagauuaacgacacagcuucagaucuccgugccuuugcacaugcuguucuuucuguuaagucacuucucaccuuguccacuucugaaacuccuuaucuagucaaugaauuuuucucuaccagcuuucucuuccaaagagaguuauggucacuauucuguguucccauagcuuccugaguacuuuucaucuucuguuacuuauuuucuugucuuuucugcuagucucaaccucugaagggguuggccggguugucuuauucaccuuuguuucccuaguguagcacuaacauguagcauagagaagauaaccaguaaauguuuguugacugaauguugaauugccuuuguuuuuaacccguagggccauacagcacaaaucugauuccuuuauaugauggcccuucaugugucuaaucacauuuccugugugcaugugugugugggcccccccugcccuuccccucaaaccuuauccuuuuuaaguuaaccauccuuaauuccuucagccacucuucacauuacuuaguuuccagaucuuuugugaucuuggucauccuccuggauaugcuguaguuuuagcguuuuuuuaguuuugucaucuuuggaaagaucuuugaucuuacugagucaucuaaaagaaaagacugauggcguugcucugccugucuguuagaaugaggcacaaaagagaucauagaauucugggaugaaugcucaaagaagauaagaaauaugacugauuuucauaaacuguaugaaaauuaauacaugaugugagauagugaaaagacauacaugaaggcagaggauaugggguaugacuugugguucugcaacuucacauacaucuguaaguugggggauauaggcaggcaagaauaauaccuuaccuaccuaacuggauugucagaaaaauaaaauguaaaauuguucauaaacuauaaaguacuguaccuauguagaauggcuucaguguuucuuugugaacucuaaaaauauacuauauuaaauuauuugaaaguguagacuuuuuuuucuuuuggcuuaauugaucauugcugguuucuuccuuaugaguuuuucucuaccucaaugaaaauauugggguaaccuuaauaaaucucauuauauggaggcuguauuuaauagucuuuuuuccaaacacuuuauuuuauuagugacuuccaugugauugggagcuauuuaccauaucauugguaaguguuuagguuucuggguaaaauugcaucaauaauuggagaacagucagaggaaaugacuguagguaagaucauauugaccggagagcuaagugaagugaggagaaguuuuguguuuacgauuuugaaaaauuaacuuugucauggacauagcuagugaaagaugauuuuaaaauagagcucaaauuuuggauucauuuagaaugaagagaguuuuuuugauucaaaaauuuuguaaauagugacaaaaaaaggcauucagacccacugguaugauuuugguauauuucuuucuacuuacugccuauauggcacauuaucuuuuuacauuguaaucaugguguauguauaacuugaaauguuuuccuuugacauuauaccauuuuucuuuguugucacauuaucuuuaaaucauuuuauuuuaaaaacuuauuuaaaaauacauaaauauauguuuguuugcagucaaacaauauaaaaauacauagaauaaaagauuuuaucacuucuacccacaaauuccauuuuugaaacccauaaguaaccccuuuuaauaucuucccuugcaugugcauauguguguaugguuuuauuuuuuuacagauaagcaggaucauacuaccuauuguuuuuucaacuugcuuuuucacuuaguauguuggagaucguuccaugccaguacauacagauuuuccuauaaccauuauuuaaaauguguguguaauauuccagggagcaaauauaauaauaguggcuaauuaaaguaguaguuacagaacacucccugacuuccaggcauugugccaugcucuuucacauguauuuaaucuuuuauacaguccugugaggaagaugacaauuucuucacauuccacagaugaggaaacugagucucagauauuaagugccuugccgaaggucucacaaccuuucaugugcaagaguuggcauuggaauccagguuuuugcaacuucaaagccuauguucuuuauuccucugcauucugcugcuaauuguguauucuccuguuauggauauggaaguuguuuuuacuguuuugcugugauaaagaaugcugugaugaacauauucuuucuauauuuuggauucccccauauaggauugcuggugaaaaguuaacuuguguguguaugugggggucaggguuccauuuauugcagaaaaguaaugaugucauuaagaauaauuccauugacuaauacuuucauaacuuuuugaagguuuuaccacuuuuaauugugaacuuuggguacuuaaggccauguuuuaaaaugcaaguucaucuguuaacugaaagguuaagcuaauuaauaaguaauuucaaaggucccuucugccuuccagguuucucuuacucugaaguccauaaaauggaacaguggguuuauuucagcuuaauaacuucuauucaguuauuguguuccaacacuggucauuucugguuuucagaugcaaaagucaccuuuuuuucauucgcuaaagcucagguuauuguauaucuuuuuuuuguagugcaaaguaggauaugauuggaaaaucgucuauguuacuugcaaaugauuguauaugauuuuauuuuauauguguaaaaauagcuuuagggcugaguuauauggcuucaguguuaaguaauugugagguauuuuaagauacaguauuaccagaaauauuagaugcuuacucuuaggcuuggaagggauguagaguaaauugaccagguuacagagcuggcuuauguaaacagguuuugauucccugucugaccccuuuacauaaagaaaaggcagagagguauggugguuauauauguuuuauuuuacugaaugaagucaguucuucaguucugaggaguuagcagguugguggucugaagugcagauuacgugucucugcuuuuccuuuuuuaaagaaccauuagaaauaaccuucuuuaaaauuauuucauagcgagaauccuuacauuuaacuuuuuauuaagucaguucuauaggcaaagcuaggaguugcaguaauuuuggcugguugcaaacguuuaucuuugagggcuaauuaugcacaaaacuacacuguggaaauaaagaugaauuggacgugcuuucuguccucaggaagcauuuggucuaaugguggagguaagggagauauuagguaacuugauuuggcgagagaaagugccauuacugcuguagguagaaaaauacauucuggaaucauuguguuacuguugaucaaggaauagugcugcuuucccucauaauuuugguucuguaucuuuagaguaguccuaacuuaguuuuauaaagccaguagacuagaauucucaagaaggaguuauauaucauuuccucugauuacugcaguguuugaauguaugagaaugcucauaauugagcugucuggggguacagcuacucccauguuuuuuggaaaucuggagauugaucauacugauuuucagaauugauuauuggucauuaauaguacaacuuacuaagaaguccugagcagagugaauuuuuguaaugauacuauguggaaauugaaaacagaauguuucuguuuuucugcuguagugguaaaaaaaaaaaucaccaaaauaugucuuuauuuaugaggucuaguuaagauaauagcauuauaauuuacaaauuuagggauagaauaacaaauuauaaguuucauucauaauuuuuuaauucacagcauagcuuuaaauguaacaaguaaaauuugaaaaucuuuuugguuaauuguugaaaguuuuugaaguuggagguaggauaacuaguuuuguuuguuuguuuguuuguuuguuuuuucugagacugagucucacucuguugcccaggcuggaguguacuggugcgaucuuggcucacugcaaccucugccucccagauucaagccauucugcugccucagccucccaaguagcugggacuacaggcgugcaccaccacacccugcuaauuuuuuuuguacuuuuaguagaaacaggguuucaccauuaauggccaggcugguuucaaacuccugaccucaaaugaucugcccgccucggccucccaaaguguugggauuacagacgugagccaccgcugcacccaggcaacuaguuguuuuaaauuuauagaguguuguauauucaagggauugugugcagaaauucuuguggugauaacccuuuuauuuauuuauuuauuuugagaugggcucucacucuaucacccaggcuggagugcaguggcaugaucacagcuuacugcagccucaaccuuccaggcucaggugauccccagccucagccucccaaguagcuggggcuacagucaugccucaccaugcccagcuaauuuuuuuggguauuuuuguacagacaggguuucaccauauugccaaggcuggucucaaacuccuagacucaagcaaucuacccgccucagccucccaaagugcugggauuacaaaugugacacugcacuggccuaaccuguuuauuaaucguaccucaccuacauaggacucaaccauuaugcaaccuaccuccggaauauaacugaagacuagggaauaagagaaauaauuuucaaaguaaaugcauuucuccgagucccaaaggacuuuguucagagccuaucuuuaauucauaggcaguucuaacaaacaguauaaucuaauuucugagcccauagcugaucagaaguggguagaaagacuaucuugggaaaugcccccugcagcagaagguagugacaguugcaaggaaagauacuuaaaauaagcguaagaacacagagauaucuucccauaaacggaaguuacugucucagccaaguugaggaaaauuucuuucccuuuccauuacugcuaauggauauugccuaccccuggccuuuccuuuuauccccuccuacuguagauacaguugcugucugggagauagaucuucccucagaaaucucuugagucuuaaucucuccucaaauuaguaaggguucagguugaugccugagguaggaagaaaggaagugugaccaggaggggaggugagguggcaggguaugguuccuaccccucuggccaugacauuuaucuuuauuaacagcguuacuaaaccugauugcuaaaauauguauguggauuuuuaauuuggggguaaaguuaauuguugaauuuuuauuguuaaaaauguaacaguucauacuauguaaaauaaaaugugaaaucauacacuccaacccuucuucccagaguaaucacuuuuaauagcuauggucuauuuuauauauacaauuauauacuuaaaauaucugguacauauauaacaacaauaacaaguuggauuuugcugugcacacugacuuuuaacuuguuuuaggacaucuuuccaugugaguguguauaaauuuaugaguuguguugauagccauaugaaauuguauuuucuggauauaucauaauuuauuuaaccaauuucuuuuugaugcucccaaauuuuugauugcaaacaaaugaugcagugaacccacguuuauaaauguccccauuugugcacaugugcaaguaaaccauagaauaaguuuguggguguggaauuguagggcaagagggcauguguagucacauuauuuccaaauuguuuacuaaacagcugauuuacacuccuuugagcagcaaaugagagugucuguuuccacacuuccuugccaacauauugguuauuuucagacuuccuagucuuuuugccaauuugauagaagaaaaaaaaccucuguaaauuucauauuuuaaaauuauuaauggaguugagcaucuuuucagauuuuuauugaugguuuauauuguuucugagaauugccuauucauguguuuuauucauauaucuauaucuuuuauugaaucauugauucauuuauaaauauagauaauacguaauuaagaauaggaauaauuuaaaacuuuauaauuugucaaaacuuccauagcugcuugugguucuuaacuuagugauaagcaaacugaguaauuggguuaguuaccugacuccugcuaaccacugcucaugcuaaccugauguggauucauaagcuuuaaaacuguucuguuuugaggaaagaaaguuaaauauuuuauucauugauuugaguaacaaauaggaauugaaacaugcuauuaccucuuuuaagacagaaagaacaauuuugguuugaagugauuaaguucauuuagucaaauacuugagccaguuuggcccaagguacuguggugauuuaaaguggaaaguggauuaaaaauguggcagaagaaacaaguuugggaacaauggauauugguuccauuuuggacaccuugagucugaaaugucagcagaacaucccuguaaaaggguugcagaauuagggcucaguugaaaagucuaggcuagaaacguaggcucacagguuaucugauagagaugauaguucaagucauaaguguaguucaugacacuuaggaaggaaaaagaaagccuggggcaaagacuuaggcauacaucuauauagauggguuuccaaagggaggaagcguuccucuguuuacugaagaagauaccacuauucaagauaccacuagaccuagaauaagaauuauauaaaaugauaaaguucauuucgccuauggaggcuuauugagaaacaccugugugaauaaaugagcuagugcuaaaguaaugucacuucuuucccuaaccccugcaggcaugucauggcccuggguuagaacaguaggcagggagagcaaaggcauacagagccaauuuugaacaauucuuuaagugacauauaucauaaccacccacucuacugggcugaaaugaacaaagaaugacuuaauaugugucccugcuuagaacaaagccuggcuuauucauggaauguaaacuguuauuauugucguuuuuauuauuguauacuagauggagaggcuagcuaaaaauacaugaaaauuagauaacaugauuugguuuuuguuuuuauuugauggcuguguguaaauagauuguuaaaugagugagcuuauguugaagaggauaaggauuuguuuaguuugggauauucagcuaaguuucuuaagacuugagcugauuuugaagccguaaguaggguuuuuagaugcgcagccuuuuuuguuuguuuguuuguuuguuuguuuguuuuuuggccaggaggguaaaauacagagcauuaugaggcaaaguaaaggcaaaagcaacagaaauguuccguaagcuguuucuuguaagguucauuuuuauucuggaauuaauaauuugucauauagcagaggggugaugaugaugaugaaaucauagccagauaaucugucaugguaggaaggaggguggagauagugcauguuccaauuuaaugaaaauuaacuuuauuauuacguauuugcuuuuuaagacuucauuuauuuccuguuagauguugugggcaucuuuuaugaaucagcgauuucucuggaguuuguucaaagcccgagaaguaagcuucaggauuguguguauuaggaaguucuaaggaguuagcguuugccacuuucugaagaauacuuuaaaaaaauucuguaagcuuuguggaagagcgaauuuauuucuucuucagaguaguuacaguuaaguagaggcauuucuguuucagagucagccuuguuaguaauugaaauuuugggguaagaaauguagacaacauugugauacuuggcaguuccacuuuguucacacuuaaacucugggauugcagugugaugagaugcucauacuaaggcauucuggagcugagcucagcugguagaaguucauaucucauguuuugugcucauaugaauggcagguagaauggcuuguucuauuuaaauuaguucauauucucucucucuuugucucucucauucucauaguugaauuguuuuaacuuaaauguguguaugauaugacuucucuguacuuuauguacuuuuauuaaaaauuaauuaauuuagagacauagucucacucuguugccuaggcuggagugcagugguguggucugagcucacuguaaucucugccucuugggcucaagugauccuccugccucagccucccaaguagcugggacuacaggugcacaccaccaugcccagcuaguuucuuaauuuuuuuuuuagaaacaagaucuuacuauauuguccaggcuuguuuugaacuccugggcucaaguaauucuccugccuuggccccccaaagugcugggauuacagaugugagccacuacacuuggcccuguagucauauauuuauguuauguuuguagcacgugguuagguuuuguuuucuuuugccugacaguuuuugucuucuuacuaaaucaugucuauuuaauguaauaguucauauauuuggcuuuaaaccucccauuuuauuauuuacuucugcuugcacugcuuauucuguauuccccuuucucucuuuuccugccuuccuuggauuauuuuaaguuacucuguauuucccucucuuuuagcuugccaguuauaauuucuuucacuauucauuuaguguuuccuaaaugcaucuuuaacuuguuauuuguaugauuucauggacagugcaaggccucuauaacaccugaauuccauuuguccuucucuuuuguuuuaauguuauuauguuauuguuguguauuuuaguucucuguauguuuaagauccaucagauguuauuucauacucacuauucauuuaguuuuaguuauuuaaauucauuaauuuauucauuuagauuuacccacguauuucguuugugaguugcucuucauuuuuuuuuuuucugcaucucugaucuuucaucugggaucauuucuuucugccuggagaauauaauuuagcauuuaguuagguuuguuggagaugaauuuucucagcuuuugucugucugaaaacauuuguauuucaccuucauuuuuagauuuuuguggagagggugcuggauguagaauucuagguaaacaguguguuuuuucaacacuuuacauauguuguuccauguccacugaacucuaucuuuucuaguaagaagucaacugucuuauuuuucuucuuuugugaguaaugugcuuaccucccgucuuuggccacuuuuaagauuuguucuuuaguuaugguugucagaaaugucacuaugaugugccuaguuaugguuuucuuuguauuuaucccgcuuauugagcuuguuguaugugugggcugaucacuuucaucacuuuuggagaguucuuggcuuggcuguuaaucccuucaaauauuuuuuucugaauuaaauuccauuagaauuuaguucacuuaggcucccuuacauccuuaucucucugauggguucagaaaaacuauagauuuguagcuugucugcccuguuuugguuguuaggaaaacaguaauaguccugauaacuuuacauucugauuagaggcagcacucucuauauugaauucuuaauuucauuuuauugaccuuuucaguucuguaauuucuuuuuauuucuuucuuucuuuucuuuuuuuuuuuuuugagacggagucuugcucugucacccaggcuggagugcaguggcaugaucuuggcucacugcagguucaugccauucuccugucucagcaucccaaguagcugggacuacaggcgccugccaccaugcccggcuaauuuucuuauuuuuuguacguuuaguagugacgggguuucaucguguuagccaggauggucuccugaccucgugauccacccaccucggccucccaaagugcugggauuacaggcuugagccaccgcaccuggccucuuuuuuuuuuuuuuuuuuuuuuaaauaguuugcaggucucugcugaaguucuccaucuuguguuuuuauuccuuuaacccacuccagcauguguguucccguaggaguuuugcuuuuaugucuguuuuaucaccugauuugggaggguuucuuuucauguucuuaguugugauugaaugacagguguuguguaugaaaaauuaucgagauaaucuggaugauacugucuucucaggauuuaccuuuacuucugguaggugguuaugcuggagguacuaacagucuccuaccacauuacauagggauugaggugauuuaaaauuaggcuuuagacucuaugaguugaaauaguuuagguauaccuuuaguucuuagauguagcccuuugaggcucugauccacaguuuaagggguuuacccucccucuuggcaggcccucacuccaguuuuuguccccuuagggcuugggucugucgaaagcuaugcucaucucagccucuucagcaguagccuuuagaaucugccgauagcucuaggccaaaaggagccccacauaccagauuugucccuuuggcuuuucuuucuuuuugcaucuugguuccucaauuccucauugccuugauugccuuuacacagauauuuuguguuuugucuaguuucuuuaguuauucucagcgggagaauuggucuaaaccaucuacucuaucauuccugaaagcugaauucucucaaugccucuuucaucauuucuguuauuuguggaaguuugucugguuuuucaucacauguagucugcuguuuggugucccauuuguauuucuuuggaaaauuauugaguagccaaaagcaauccuccugauuucagauuguucuguuuucauauacacaguauucuuuuaaguuucuuuaggauuucuguaauugggauuucugcaguugggaauucuaaugauauucuaaaauuuguuucucucucucuguaaauuuuccggggaaauuuuugcuccaguugauagaacaaucauucuuuuagcuucuaggucuuuucaaaugucuguuuguggugaccaugaugauaugauggugucuauauauauucaguauugcugguugacauggaugcuuuucuuucuuuuuuuuuuuuuuugagacagagucucgcuguguugcccaggcuggagugcaguggcaauaucuuggcucacugcaaacucugccucccggguucacgccuuucuccugccucagccuccugaguagcugggacugcaggcgccugccaccacgcccagcuaauuuuuuuuuuuuuuuuuugagacagagucucgcucugucccccaggcuggagugcaguggugccaucucagcucacugcaagcuccgccucccagguucacgccauucuccugccucagccucccaaguagcugggacuacaggcgcccgccaccaugcccggcuaauuuuuuguauuuuuaguagagacgggguuucacuguguuagcuaggauggucucgaucuccugaccucgugauccaccuguuucggccucccaaagugcugggauuacaggugugagccaccacacugggcccugaaauggaugauuuucaagcuuguguggguuccuguucuaauauuucagguauagaugaaagaagagaaaguuuuagauuugcaaccauuuaacaguuugauugacauuccuagauuauugguuuaacagaaugaucuacauuccuauaucauuaguuuggugguuugcagggaguaggggcaagauauagccagauagcuaugagacagggagguuuacugcuaacgcauuguuugcaaugcugagauucaucaguuguggagcuagcuguggcagccuccuguauuuuuguuuuugucccccuaccccccccccuuuuuuuuugagacagugucucacugcacccaggcuggagugcauugguggguucucggcucacugcaaccucugccucuuggguucaagugauucuagugcccaauagcugggauuacaggugugcacaaccacaccuggcuaauuuuuguauuuuuaguagagaugggguuuugccauguuggccagguuggucuucaacuccugaccucaagucauccacgugccuuggccucgcaaaguacugggauuauaggugugagccacugcaccugguguguuucugucccucaucucuaauccucaacaugagugcugaaccagaugcuuugccagccuuuuuucuuggagguaucauggguccguccacauaugcuugucgcuauucugugauuuccaguggagguacagauuuucccccuugguguuuuuauuuauuaauuuuuuaaaaauuuguucaguuauuuuaguggauauuaagauaagguguuggugggcauugguuaaaugcaugagcuuaguuuugccaucuuggacugagaaucuacacuggguauuuuguuguuguucucauuugguuuaguuugaugucugauccaauuaaaaagaauaguguuuuuuuuuaacuuuuauguacauuuagauugaaauucugcaaucacugaaggacugugcuaggcuaguuagcuccugacugauguaaaaccuuugauagaguggggcuuuuuuuuuuuuuuuggagacagggucucacucucaccuaggcuggagugcaaugggguaaucacagguuacugcagccucgaccucuuggguucaaaugauccuccccccuucagccucccaaguagcugggacuacagucaugcgucaccaugggcuaauuuuuguauuuuuuuuuuuuuuuuuuguagagacaggguuuugcuauguugcccagcuggucuuaaacuccugggcuuaagcgauccucccuucuuggccucccaaagugcugggauuauaggcaugagccacugcgcacagccgaguaggggcauuuuuuauucaacagacauuuucaugauugccagcugcguuuuggggcagugccagauuuugggagcacagaugucagcacguucuuugaucuuauauaccuguuauugaggcagagauaccuuucucugaggccaagagacuuuuuuuuuuuaaagagagagaaacaguguuugaucaaaguuuuuguuuuuuaacccauuaguuagauuguugaauaucaauuaauauauaaacauugauaauaguuuuuauaucuauagaaaauauuccaguuaaaaucuuaucuauaauuucaguugaauuacucauuuuuauaguaaauuucuguuuauucucugacuagaugauuauaucaauuaaggguuuaugguuuauauauuuuuauauauauacacauacguauauauauacgcacacacgcacauauaauagauauaauuuacccauguuacacauauuuagaaaguaggauaguauggauuuuauggcauuuuuauuuuuuaauuuguuaaauaaggaauucagaguuuaguaagguagguaggacaugagacagaaaaguagaggcauuauauauucauuuuuacuuaaaggaagaagaguuagcagucugcuuccaccuuaaagcuagaguuugcuaguugggaaauaaugcuuuggaagugguuugacagauugaguauaguauaaggaauugggaaaaagcaggcaacuguggccaaaaaguagauuggaaaggaaaauggcuagcuucaauauguuggcauggggaaaacaagguuauaucuguuagaggcauaaaauacucuguacagagaguugguugucuucauuuuauauccaacaagaauaguacaauuuagggaaaguuauuaaauugaaccuuucagacuaaugcuuugccaugauguagguuaauuucccuauaugucguucauccuugcucaaauauguauuuuauuuguaauauuauaaaguugauauaaaaaauacacuugaugccagauuuucaguuuuuaauacaguggcuuucacacuuguucagguguuagaacaucuggaaguagugguauacuuugagagauaucaugaacuauauuuuaauuacaugaaacaaaugaaguguaauuuuacuagcuguagauauaacucaugugaguguaacucaacucgguagaaauauuuaaggagcauuuguuauguaucauaaaugcauaauuucaugaugaaagugaaucauggaagagcuagaagaaaauagaaaagagguuuuuaaaaagccuuaucaauaguguauacaguaguccccccuuauccaugggagauacauuccaagauccuaguauacgccuugaaaccauggauaguaucaaaucuauauaccaguuuuuuucccuguacauacauauggcaaaguuuaauuuauaaauuagguacaguaagauauuaauaauaacuagaacaguuaugacauauugucauaaaaguuaagugaauguucugucucucugucucacagauuaucuaaauauuuucauaucaugguugacuauggguaacugaaacuguagaaagugaaaccguggaaagcaaaacuguggauaaggagggacugcuguaauaucuuuuaagauuauaucuucaguaggggcugguugccuuagccauuggcagcaugcugaagugauucuuuuuaaaaauauuuuuagagucaggaucucacucuguaacccaggcuggagugcaguggcaugaucauagcuaacgguagccuucaacuccugggcucaagccuccugaguagcuuggacuacaggugggugcuaccacaccuggcuaauuuuaaaaauuuguauagagacagagucuugcuauguugcccaggcuggucuggaacuccuggccucaagagaucuuccugccuuggccucccaaagugcaggcaugaaccaucgugccuggcccuaagcgauucuuuauguguaguuacuacuuucagggcaucauuacacaucuacugagagaaaauuugugguucuggggccuggaaaucugaauuuugagaagcaucugauggauuuuguauucauaaaguuugagaaacauuuucuaagugcugauugaaaagaacaggauauugcuucagaauuuaaaagaaacaguguuugagaaugaacuccuccuccagggaaaaauguaauuuauguaugaugggguaguugcuauuuauucacuuagauguuuuuuguuuguuuguuuguuuguuuuuuugagacagagucucacuccaucacccaggcuggagugcagugcugccaucacagcuuacugcagccuugaccuugugggcugaguugauugucccaucucagccucucaauggcugggacuaccaugcuuggcuaauuuuuuguauuuauuuguagagacaggguuuugccauguugcccaggcugggcucaaacuucuaggcucaaaugaucggcccaccguggcuucccagauugcugggauuacagguguaagccaccacaccuggcccacuuuuguuuuaagaaaugucuuuauaacugaauauugaaaacaauugccguucucugaaagucuuuuaguuguuuuuccauagaaaugaucauacuauaucugauggcuuuuaauuuaauuuuguuuguuuguuuguuuguuuguuuuuugagauggaguuucacucuugucacccaggcugaagugcaaugggccgaucuuggcccacugcaaccuccgccucccagguucaagcgauucuccugccucagccuccugaguaguugggauuacaggcaugugccacuacacucagcuaauuuuuguauuuuuaguagagacaggguuucaccauuuugaacaggcuggucuugaacuccugaccucaggugaucugccugccucggcuucccaaagugcugggauuacaggugugagccaccgugcccagccagcuuuuaauuuuuuuuuuuuaacugugaaaugucauuagaauuuggauuguauuucauuaauguaauaucuggaagauucaaaguuauaauuuuuaaaaguuuuaauuuugcuuuauuaacugacucaacuguuggacggaagcaggaacauaaaugaaaaggucaucugaaagucucauguauacaagcuuuuucuaacucuccaaaacaaggugaauuucagacaaauucaguaaaccuuuauugaguacauguugcaugcucuauguugggaccaugaggaugauuaaaacuuacauccuguccugguaaaguucacacuugugggaaugagauaggguaggaauacauguaaacaagcgauuugugcuuugccuaaauuuaaugaauuuaaaagguuauuaaauaaagugaccaucauaauacaugaagaaaaagugugugugugcuugcgugcauggaggugggguugugguggugauggucauguuucauacuuaggcccguuguaguagccuagguaguuuacagagguaaauuggauuagcaugauggcaguguagagaaguacauggaauagaaagauauuuagaugauaaaguagaauuuggugauggauuggauaugguggugagggagagggacaugucaaagaugauuccuaagguucuuuaggauuugcauagcaggaugaugggugcugaugucuuuuacggagaaagaacuaaguuugggggacaagaagaacaugcguuuaauuuuggacauuaugaauuugauacaccuuugugauauccaggggcagcauuacagucuggagugugauggaagacaugggcuguagauuugugagucauaugcuuagaaugugguugaauugagaaagauggguuauuauaagacagagaagugagcggagaaguaggaggaaaacuaggagaagguuguaucacaggaaccaaggaggagaguaucugauucugcuggcagaauuaaguaugcugaugauuggagagucuuuugcauuuaccugucagucacuguugaccuuacugacagcuggagauggaauuuggaagcagguugagggacaagugggaagggaggaaaugaagacugaaaaguuccagaaauuuagccaugauggggaugacugaauguagugguugaggucucaugaguugggugugugugugugucuguuuaauggaugagauucuggagcguauuuaaaaauggaaggcucuauuugagagggauaguuuaaguaugcaaggaaaaugggauaacugacaguguaaguuuccugggaagguugggagaacacgggguuuugagcacaaguagaaagauuugcauucgacccauuguaggagagagaacucuccuuuaacgagagggaaggaacauaagaacaggugaauauuauuguuaaugaggcagugaggccuuuugcuguacgugauaagcaggaaaugguuuucaggaguguugaggaauugguugaccagagagguaggauuacuauuaccagaacuaauaugagaauguaccauacuaggagauuuaacaggauuguaaauuauaugggaauaguauuguuuucagugccuuuucccccucaucugccaggccucagugagcccauuggagauuguagauucccaguaaguauuuacccuacucuagaaucuuaaaugaaaaaugcauaaacaguagcuacucuugucugacuugaauuuuguggacuaaugauagaauuaauaagugaaggaggucucuuacuauaacaguguuuaauucaccauuucaacaaaucucucccugcagccuacuaagcuuuuucuuuaauuaaguaccugauuuacacagcagauuuuacucauuugaggacucaagucaugucuaaacagauaaagguaucagcucaggcauaguucagguaccuuguaaaugcaaucagaguuguucugcaggguaauucaguuuuagacauccauuucuaaaaacggguucugucugaaaauggaggccuuaauaaccaauuucucguuauucagaggccaguuaucuaguuuauuuaucaagauuaggcagucaccuuguuuuucacuccuuucuaaucucucugacuguuuuguuguuuuaaacucaugaguaagauaaggagaagaaaaacagagaauguacauaaauuaauggcuaaaaugaaguguuccuuugcauguuucuuuuucuuaugcuuuauuucugugacucauacggagcuguuagaagugacuucauauaauauuauacaguguaauaaaauggguuuucgaugugugaggauacccucauguuauuuagauuauggacacaauuaacaauuccagacagaauuauuuucucauguuugaaguaguauaggcacauggcccuuuaugggaggggggaagcucuucucugugugcccacuuuucacaucccucuccagcaugacucuccccuuucugucagucuuaccccaggagucccuggccuccuuccucuccuugacacuguuugcuuugcaagcauaugaaauacuggcacccuaugaccaggguagacuacaaccaggguuggggugcaggagccagauggagaaauucaaauuaugaucaugagaacauguuccucuagguaguggccauacuuuuaucucuauauccuuaggacguaacacagugccuggcauauaaugugucuccagaaauauuuuguuuuugaauuaaagacuauuucaaaauuacagagucauaggaggaaucauuuaauuuauuuuucugcuuuuauaggugaaaaaagugaggcuuagauucauagcaccuauuuaaguuccucugacaugaccaguuaugcuuuagaccauacaaagaaguaagugaauaugauauacaauuccagccuucuagaaguccaaaguuaaauagaacguccagcagccuuuuaucuagcagggauuuuugugggggcgggaaagggacagagggaaggaugugaugguggugcuuuguuuugguuguggugccuguguugcuugauacuguguuauggcagguacagaguugcauaauauagcuuuugcccuuaaggaacuugucuaauguaaccugagacaacauauuaagaaucagugugucucaaagcaguauaugauuaaaugccagaugaguggugcacuuuuauguaugccaacuuuauaaaaugaaaaaaugcuaaugauccaucacgaggcagacaugcacuuucaguugcuauucugaaaguggaaacagauuggacuugggggaacucugcaucuagaaguacaaguugaugauuauuguccauuugauagagacacuggaagggugucaguguaaacacuggccaugugaagauugagccuguugaugguuucuuuuguaucauaggaugccacgucaccaacuagggaauucugcccaaucaguugagccaaauagugcuguccuauuguaaaauuguuuaaucugugugcuugugugugugcuugucagaauuugugaaucauagaauuguuuuaacuggaagaagacccccaagaucaucugcuucaaccccuuccuuccucucuuuuccagagagguugcacuuuacuugagcugugacuaggauuaugccacauucuuuuguaaguuguaaccuauuuuugucuguuuugaauuuccuuuuuuugcuaagcuuuagcacaaaguucaccagguuuugaaugaaugucucauauuugcaauaauuuagggaacaguugagcauggaaggagagaauagaaauauggggagggagaucgugaaaugauguuuccaguggaauuaauagaaguacaaaggaccaagaauuaaggugcggcucagaucucccuuuugucugcuuuugguuugugaugguauaacauugccugcaaacagccacgaugaauauuuucauuuuuauuaauagcaauaugggggcaugaauagauucugugauauuuuuagauacgcagagacugugaagaaaaugacauuuaguauauaauuuuuacccugcucuuaagguguuuguaaucuaguugagagguccuaccuucaaaagguuuacgaucugauuggagacugaaggaccuaaagaaguuaaguaacaaugucauaucucuguccuuucugcuaaaugaaugcuacuuacuauuuuuccagugccuagaagagugccaggcccauaguugauuuucaguaaguauugguuguauagauaaauagaagguacugacaguaagcaugagaggaccucugagugguguggcauuuggagaaggccugggaucuuguacagugcaaagcuuaaguaacuucauucuaaguuuguauuuccaacucccccaaccucagcauguucuccccacccaccuccucacaccccaaagcagucccugucuuuuguuaacugauuuuuuucuuuggaagcaagccugaucuuucucacauuuauuuugcuacugcucaggcuaccuucuuuucuuaucucuaccuuuccucuuucucacaacauugcuguuccucuucaaggauuuagaaggaucauguuuugguuuauaagacaacuguguuuucuuagguccuucuucucuccagggauuauuguaggagguaaggcacuuucuguggaagaacugaguuaucagaaaaaguucagaaacauauucuaugauuauuuagaggaaaacuguaggauagugauaucuuauaauaacauagcaauuuuuuuaaauuaauuaauuuauuuauuuugagacagagucucucucucuggcacaggcuggaguguagugacaugaucucagcuccccagaaccucugccucucagguucuagugauucuccugccucagccucccgaguagcugggauuacaggugcccgccaccacgccuggcuaauuuuuguauuucuaguagagaugggguuuugccauguuggccaggcuggucuugaacuccugaccucaggugauccacucaccucggccucccaaagugcugggauaacaggcaugagccaccguuuucagguugucauaacuacauucuaauugacugcauauuuuuaaacacaaauuaaacuaguuauguucuccacccuacucaguuuuggcaguauaaaggccuguuucacagagaagaacacauaaacaaguaaguacaaggaagcuugugugaaugaaguucugcuguacagcucagugacuuucucugauuuaagauguagcucuuggcaauuucaaauaguuuguguucucugaaggagaaguccagucuauuuaacuguguuuagcaaaaacuaauuaugauucucugaugggaaauagauucucagacucauuuauucauucaacaagcauuuauugagcagcuauguaugaggcacugugcuagguaacgggagaaauaaguuaccagucuaacaaauggcauaucauacguaaaaauaauacugcugaggagaaggugauauaugcuguaaaaggggugcagagugcuuuggguuuucuaaaaaugagaagguuacuuccaugaagcaacucaguguaagcuuuaugggaugauagaauuugauagaucuugaaggcuggguacaugguuccucuguccauugcgcaggauguuggcccuggcuuagcaguggagacagaccuauggcgaugggaagcgggagaggaaguauaaugagcaaacauccagaagugggaaagcauuggugauaugggcaacagaaaguaauuuacuuggagguuuaggguggugaugugaaguggcacaagaaagggauagaaaagaagcguccuugaucugacagugguguauacugugaauuggaagaguggguucagucuaggcuguuuacccaaguugguguuucauggaccauuguucuucuaaucuaguaguuuaauaguuuuauauuaggggaggggaaaguguucccuguucaaguaagcuagagaaucccugcaggagaagcagggagaaggauauugacaauguagaaugcuuucugugauauacuguauucaguuguguugccguauuaaacacaguggauguuugaauguucuguagauuuuuaucaccugaaauuuguugguuuucaugcugaugucuucaaggaugauucaggaggagcaguauagguggcuggucuaguuucauuucccagccccaguccacaaagggcucuguuuaucuaaaacaauggcaguguuuccuaccguccugcuaaauaagaggucuaacacacaguaaaguguucuuaaaagauuuuagggacacugagguguaggguguggcacgggcaaccguugguugcacagauacaguagaugcucuauguuucuauugaguuaagauacaguuagcuguauuuuccuuguaucuuucugcagaucucuuccuucaugccuccucuagaaacacuagcagcgcuggguguuucuaaggucuuggggaccuuaggcaagcugguuaaccucucugugcuuuaguuuucucauguguaaagcacugugugcuggagauuuuuaaaaaguguguugauauaguaagucauuuaaucugugguuauauaccuaguaaaugacaagcaggaauuugaacucaggccaggcucuuaaccagcuugcugcauuacgaaauacuaaacagugugguuuucccuccuggaauucccuuucuuucuaagugcauuaucucuuauacccuuuguuuagucagacuacuuccucuauuucaaagagaaaggaaagaagcucuuuuuuaauuguucagaguuguguauggcaaagagaaugcccaaauagauuuuguuuuggaaucuuauuguuacugguuguuuacugccccacauccuuagcuccaaagagcagagaggauuuacugugaaguuuggcauguauuguaggcuauuaugccauguaauaggcccaaaauuguggcccuaggaauacaaauuauguuaagacauuuaaggcaauuucuagaaaucuuuuucccuugaaaagaguaccaauaauuuuucucgcuaauggccaaaauuacucaaaucuuacuuuuggacuuuuaaaauauauuuuuacugcguuauaguugaaauguagguaugguugaaacguaaaucuagaucuuaaguguacuauucaaucaauuuugcuguugguacuauucaaucaaauaggccaguggguuuucuuuguauuuaaucaauuaguaugggaaaauauuuuuauuuuaaauaaaugucucucuuuauuuuuuguguauuucuaaauucauauguauuuucaacucauuuuuucacucggauacauaguuuaacaacagccuauuggaaguacucuuuuauaugaguuucugcuauacuugaauaguuucccuucagaaaugaacuguuuguguuggagcuacauagagugaauaaauuuccugggcggaaacgauaauaaaauauucaggaaguuauuaggaaaugagaacuuguguucuuguucagucagauaagcuucugagaccuuugcauauaucaaagcagauuguauuagaggaaggaaugagagauuuggcaacuuucuucuaauagugauagggaccuuggucaauagaaugauggaauauaugauguauaaaugaaagaaaaauucucaaagcaaaguuguuugagaauuguuuuuucucucucuuuuuguuugucagggaagaaaagugagagcuuucugaaguuagguuauguaaauaacccaguagggaaaacuguuccugggggagaccuacaaauaauugauggcaauaagcuucaggaguaugaaagaaguggaugaguaugccuuucccccauugauuccacucacauuuuuucuucucugugcuuugcucucuuguugccauuagacaguuucuaucuguccuuaauuuuagccaguuuguucuaaaguaacugugaacacuguaacucucuagccagugccuuucuuuuauugaauggaauugguguacuaguuguuuuauuuaacaaacagaguuuauaggcuuguuuuuuccucaacaugucuucauggcagagacaauuuacccuuaaguuggugagcccuggauccccucacuugcauagaccucuucuaggaucugggagaggcucuagcaguguaguguguuuguuaguuacauauuuuuguaacauuugcaaaauugaaaaauuuuuuuccauuuuuuuuuuucuucaaaaaggcccucaaauuauauaugcuucaaauuucacaaaacucaggucagccuugguucaugguagagguuggguguugauuucuaauuguggccgagguagauuugguuaguggauuaaaggacaugaggaaggaagcauuagugaggaaguugaaccauugacugguguguauaguggccagggaucucuuucugagugucaggggucaucucuucucccugcaaacaugggccagaaagaggcgggagaaguuggguaggacuggaagaaggacaguggagggaaaggugugcugcagccaaggugguaaacaaauuaagguguucuccuuagauuucaaggaugcauuugcaaauagcguuuucaauagcauuuuaaaauaacugaagagucauuucaagauaauauauuucaucuugauaauaauacauuuuaagaauuuuagaauuauugaaaaauuugaaaagucaauuucauaauuaacugauugacuugagauuaaagucuuuaucuuauuaauuagaauauauugcugaacacauaaaacacagacauguucauuuuugaagggcguugcuguaacuuggguuuugcuagcuucuugguuugguagauguuucaucucucuccccuuuuucucauugucucaccuguauuuuuuucuaccuuuucauuucauguucccuuuacuuugggauucaaacuccucuuagacuucucaggauuuugaaugacuggacuauagauaaucacauuuuaaaacugcauuuuaauauucuguucucuuuaaagaaaauuagguacucugcauggccuggggacaaauuuacaguuaaauagaaguauaauguucugagggccaauuguaacuacccugugguuaacuggcucagguucaaauacaguuaaaauuauuuuacuuuuccuaaaauuccuucuaauuggacuaacuuaucaggguugauaaaaacauuuccagaacguaguauggaucugccaccugguggugaaauauuacagcaaguacuaaguguuuuguuuuuuuuuuucugagacaaggacucacugucacccagacuggagugcaguagcaccaucacagcucacuguagccucgaccuccuggacucaagcaaucuucccaccuuagcccccagaguagcugggaccauaggugcaugccaccacaccuggcuaauuuuuaaaguuuuuguagagauagggucucacuauguugcccaggcuggucuugagcuccugucucagccucccaaagugcuggcauuacagguaugagccaccacacccagccaaauacuaguauuuuuuuuuuuuuuuuugagauggagucuugcucugucacccaggcuugagugcaguagcccaauuuuggcucacugcaaccuccgcacucccugcuccgggcccaagugauucuccugccucagccucccgaguagcugggacuacaggcaugcaccacugcauccagcuaauuauuguauuuuuaguagagaugggguuuugccacauuggccggacuggucucgagcuccugaccucaggugaucugcccaacucggccucccagagugcugggauuacaggcaugagccgccacgcccagccuaaauacuugauaagaauuuaauaauggauucuugccuuuguggccauaauauuuagagucgagucuacuuaagcucuuuagauauguaacauuuuccuccccuaaguuuuuuucacugagaaaauguuacuuaaaugcgauagaguagguaaauuuugacugauguguuucugucuaccgcaucguaauauaagaugacauuuguagaauuacugagcugaaauaaauucugcacacauugagaauguacucuccuuaaauuugaagaugagcuuuugagaagagaagauugcuguuaauuuuucuaaaauuucaauguggauagucauugauucacagaaaaaacaguaauaugaaguucacagaacaaagaaaaaacaguaagaugaaguucacagaacaaaggauuuuuuuuuuuggaaagaaagcauuuuguuuauucacuuaaaaauauuagcaggcauauuaaaacuacuuuuagcaaauagacuaacaguuuuaucacccucaaaugaauuauuaauacauaucaguauuuuauauaugggcacuguguuagguauacaugauaaaauagugaaaauaaaaaugucucuuguccuccuggaguuuauaaucuagcuagaaucuguaaucuaacauaauguuaagggccauaaaggagaagugcauaauagggagaguucacccuggcuaguguaucagagaaagcuucccuaaggaagugacguuucagcugagaucugacagauacagacccuggcuaaaaugugugucuguaucccuuuaaagugggaaggagaguggcaaguaugaggaauugaaaauaacagagugccuggaauguagugagagaagggacuguggugugaaugaaaacaggaaagacgguaggagcaaauaauucagggccuuguuggauguguaucaaggacuuuggacuucaucaugagaguaauggaaagcuguugaauuguguaguuaagcagugucagaucagauuaaugagaaaugaauuggagcagggcaaaacugaaaagaggucaggcaguugguuagaaagcaauugugguaguuguggcuuggacuagagaguguaaaugggcgugaugagaggcugccauauuucaaauauauuugagguagaauagacaagacuuggugauugaaugggauggaagggggagagguagagggagaugccaaggaugggcccaaauuucuggcauucauacauucaauaaauauauaaauauaaaacauauauauauauaaaacacaguuugguccuuaaagauagaaagucgaguagccccagcguucaguucacaauacauuaucauuggacagugcaagauaucucuuauuuuguauuuuuuacucugccuucaucugccacacucagucccauuucccuugucuccuuaggcuucuacucuaauauguuuuauauauguuuuugaauaugcauuaaauacauaaaauaugaaauguuguuuuguguguuuuuaacuugugauacugugcuguacauguuauuuucuucguuauucugccuuauguuccuuauuacuagcuguauggccauagguaaguuauauaaugauuuuucuguuuccucaucuguaaagugaggauaacaauaguauuaacaguacuuagauuauagauaaacuuuuuuaauccucccaacaaguauucaggugucugccucaagggauccuccugccuuagcuucccaaaacacugggauuacaggcaugaggcacuaugccuggccuguuuuucauuuauuuuuuauuuuauuuauuuucauugacaaauaaaaauugaauauauuuauuguggacaacauaauaauguuuuaaaauauauagggauuguggaauggcuaaauugagcuaauuaacauauguauuaccucauauacuuaacguuuuucuguagugagaaugguuaaaaucuacccuagaacuuaaaguauaauuaaaaaaaaaaucucccagcgauuuucaagaauauaauacauuguuauaauauuaacuacacuaaccuuauuguacaauagaccucuugaacuuauuccuccuaucuaacugaaauuuuuuauccuuuugcuaacaucacccaaauccccacccuucaaccucugguaaccaccauucugcugucugcauuuaugaauucuacauuuuuagauuacacauuuaagugacaucaugcaguauuuguuuuucuauaccuggcuuauuguacuuaaaauguccuccagguucaucuuuauugucacaaaugggaagauuuccuccuuuuuaaaggcugaauaguauuccauuguguauauauaccauuuuuuccuuuauccauucaucuguugauggacacuggguaaauuccacgucuuggcuauugugaauaaugcuguagugaguauggaggugaagauaucucuuugauauacuuauuucauuuccuuuggauauauacccaguggugggauugcuggaucauagggaaguuuuauuuuucauuuuuugaggaacuuucauauuguuuuccacaauggcuauacuguccauuuauguuucaauuuuaccuuuuucuuuuuguguguguguguguguuuaauguguguguguuuaauguguguguguguucaguggccccaggucuucuacaguuucuucuuuaauaguuuuagguuucaucuuuagguaauaaauauuuauucaacaacugccuuguucuaggcauuggauguaaaaccgugaaccagguauacaggggccuuagcugaccccauggagaaacaaagcaacuggauggauagugguagugauuuaggaaauauggaugaugaggaaguuuggggcagaaguggggguuggauagaguaaagaucauuaguucaguuaaaaaaguuuuuuuuuaaacuacagagggcccuuaugccagcuuuuuguagucaagcccucccuccacuccuaacucuuggcauucacugaucuauucaccaucccuuucccuuuuccgggcauaaaauauguaaucuuuuggggcuggcuucuuucaccaagcauaaugccuuuaucacacaacaacauagaugaaucucaauguuguaugaaaguuuguuccuuuucaucacugaguaguauuccauuguaugaauguaccauagcuuauccauucaccuggugaaugacaacuggguugccagcaguucguagggauuaugaauaaggcagcuauaaacauuuggguuuauaacguuagguuuuugcgucaacauguuuucauuucucuagggcauauaucucagaguaagauugcugggucauaugguaaguguuuaacuuuaugagauacugcucagcuguuccucagaauggcuguaacuuuaaaauucccaccaacaguguaugggaguuauaguugauuggcauccucaccaguguuagguauucucaguuuuguuuuguuuuagccauucuauuagguauuuuagugaugucucauaguuuuaaauugcauuucccuaaugacugaugauguugagcaucuuuuucugugcaacuugcccuuuuuggugaaguguguaugcaaaucuuuugcccauuaagaaaauugggguuguuuucuuguuguugaguuuugaauucuuuauauauuuuuuauacaauuuauuuuguuaauaauuugcaaauauuuucucccagucugucuuuuuauacuuucaaugucuuucacagcaaaaguuugaaauuuagugagguucgacuugccaguuuuuuucuuuuaugaauuauguuuuuaguguuaugucuaagaacucugugucuaagccagguuuacaaagacuuuucuccuuuauuucuucuaggaauuuuauaguuuuacauuugacauuuagauuuaugauccauauugaguuaauuuuuacauaaagucaagauuuucuuuugcauauggauauccaguuguuccaaccuuguuuguugaaaagacuauccuuuuuccagugaauugcauuaggacuuaugucagaaaucaguugaccauaguugugugggucuacuucuguguucucuguuugguuccauugaucuauauaucuguccuuuugccuaucccacauugucuugauugcuguagcuuuauaguaaguuuucaaguuggguaguuugaauccuucaauuuuguuuuucuuuucugaaauuguuuagcuauucuacuuucuuucuuuuucccuguaaguuugucaguuuaucuuuaugaaaauuuugguugagauuaugacuggaauuguauuaaguucauagacuaauuuaggaagaaugggcaucuuagcuaucaugagucuuucaauccaugaauauaguaugucuuuuuuuuuuuuuuuuugagauggagucucacucugucacccaggcuggagugcagcaguggcacaaucucugcucacugcaaccucugcauccugaguucuaacugccuguuucuagauuucuuuuuuuuuuuuuuuuugaguuggagucucuguugccuaggcuggagugcaguggcgcgaucuugauucacacgauucuccugccucagccuccugaguagcuaggauuacaggcacaugccacccaugccuggcuaauuuuuguauuuuuaguagagaugggguuucaccauguuggccaggcuggucucgaacuccugaucucaugugauucaccugccucgaccucccaaaaugcugggauuacaugcgugagccaccgcgccuagccagaaacaauuuuauuuguuccuuuucauuuguaugucuucuguuaauuuucuuugccuuauuacacuggauaggauuuucaguacagcaaaaaauggugaauguggacaucuuugccuuguuucugauuuuagggagaaagcacucugucuuuuaccauuaaguaugauguuagcuuuaguuuuuuuguagauucucuuuuuugaguuaaacucccauucuguuccuaguuucugagaguuuuuuaaaaucaugaaugguaguugaauuuugucaaauacauuucugcaucuguugauaagaucaugugguuuuccuuuauagucugucauuaugguggcuuacagugagugguuucugaauguugagcaaucuuauauuaggauaaaccucaacuugguaguggcuuaauauuccuuuuauuuauuauauguaacuggauuugauuugcuaaugcugcauugaagaucaugccaucuuuguucaugaggaauauugguuuguaguuuucuuguacugucuuugucugguuuuagugucagaguaaugcuagcugcauaaaaugaguugggacauguuccuuccuuuuuuauuuucuggaaaagaucauguggaauguuauuucuucuuuaacuguuuaguagaauuuaauacugagaugaaaugggucuucuacaagauaaauuuacuuucauaaucagaauaauguaauuguagaaacuuaaacuauagaaaugaaugaugagaauaucaugucucacaauucagaugauuauuaauauuuuggaauucuuuuucuaguuuuuuccucuguauacauaauuguauauuuuugaauugcauauaaauguggguauauauuuaaaacaaaauuugugauuauacuacaaauaccauuuuauuucuggacccagugugguuucuaauuuuguuguauggauaugccauaauuuuacauaaacauucuucuaauguugaacauuuaagugugauaaaugucuuuuauguguuuuuuuccugauaauuuauuugacuuauuucuagaaaagaauuugacauauguaaggcugcucacacacauugcuaaauugcuuucuagaaaguauauauacguuuuuacucuaaaauagguaccuuaaaaaguauguuuauaucuucagauauguaaagacauauaaaauauauaguaauauauaucugacuaugcauauucauauuuuuuuuuaaaggaaggaguggaagugaagagaauauauaucaagggguuagcaagauuaagggaaagacuaaagaaauuuuucuaugagacaucuuuguagaucagggcaaagauucaguggaaaggaagauauugaaccaggagcaaaaaugcagagaguuguuugaaaugaugaaauauggucuggaugaaaauguagggaaaaaugauaucaaggagagaaaugcaggaaacaaaggaacugugcuucuuuuagguugagaccugaaauagcugauauuugaccaguuuuuaccuaaaaacauguaguuucaaacacuuuuaccugauacuugugauggaaaguaaagaggaaagaugcaaaauaaauuuugaagugcaaagaagagaaauucaauuuauagaaaagggauugcauuuucccaaauaggaggcaaggcuaucuuaauagaaugggucaggguaaaaagagugaaaaaguuuuguauaaauaguguggggaauguacaguuauagucacagacaaagaugaguuaaggggcaguagucucaacacaaaaugaaggcuaggauuaaaggagagggaaaggacugaagaggauggggacauucaaaagagagcauuuuaguuaauuuugguaaauuaauugggcgugaaauagagaagaugaaguaagagagaguaaagucuugaggcuagaaaaacuccuaagaagaaggaagaugcuuccuaagaagauucagaaagaguaaggaaggaaaaguguuagauuuuaauuuguugagcuugaguugacuugaaggaagagauucagauuugugcaucauuaugguugauaguugcaguucugagaaugaaaaagcucuuugaggaaacaaauacagacaaaaggucauuuuauuuuuauugguuaguaauucaacaaugucagauauuuucaaaccacuuaucuuucugucuccugauuauaaugaugagugaacacuagauuuuuauguuugauuaaaagcaauuuauuuuugucucccuacccccuuuucagaagugggaaauuucacuucuuuuuaagaccggacauaaguauguguaguaaagaauaagaauaggaggauagauuagaauuaauuaguucagugauuuguauguaccugauaaaguauucuaauaauuguuuuugguaucuuagagaaaaaauaucuccuaggcaauauuuuuuuuucugcauauaaaugaaaauguuuugacauaugauauaggacuagugaaccaauaacuucuccugggcaucuaccucaccauguagaaaauggaaugaagacuuuggcaagcagucaaauaaaaauaugcaaugcauggaaaauaacaaaugcguuaaaaagauaauauugcccauauugagggaaguacaaguuaaaacaacuuacaccauuuuuuuuuuuuuugcuccuuaacuuggucaacauuuaaaggcuucccaguguugacaaagaaaagggaaaaugucuuucucauauacuauugaagggaauauagauugauacagccuuuuuuguagguggugauauuuaucaaaauuuaaaauauacauuauuuuuuacuuaguaauucugcuucuagaaaucuauccuacagauaccucucaagugugcaaaaaguuaugggcacagagauguuccuugaagcauuguuuauaauagcaacaaauuggaaaugacuuaaacacugaccguuggguauagcccuccuacauaggaugaccauaugucuaaauuugcuugggacggacccaguuuacaccagcauaauuauuuagagcauuuuauuuuacucucagauguguccugguuuggaagauaauuuaccuguuugguuuauguucacacuaauagcauggagaacuauguagcuguucaaaauaaugagauagaacuauaggaauugauauagaaauauauucaagauacauuguuaugugagagaaacaaguugcauaacaauauauauuauuccauuuauuuuauuuuauuuuuauuuauuuaagagggagucuugcucugucgcucagguuggagugcaguagcgcaaucuuggcucacuguggccuccgucuccuggguucaugggauucuccugccucagccuccugaguagcugguacuacaggcgcaugcugccaagccuauuacuccaugcauuuaaaaaaguaaaaucucuaagcucucugcaugugagugagagagaaugagagacaggaguuaaaaaugucuggaaggauucauacuaauuuguuaauaugauaaucucugcuuaaagauggcagcccaaugaauaggcauauauugaauuuuuuaaaauauaaaagcagcaauaacaaaaaggugggaacuguugauugccagcagaugcuauaauuuuuaaccagagagcauuaauaaacaacuauuacaauucuuaacauaaaauuauaaguauuauacucuguccuguauaaauaacuauuguauuagaaagaauacuaauggaaaauuuaaaaauuaucacuaucauuccacuauuaccaaucauuuuacauguuaccuccuguuccucguaucuuuauguacauaauucuuacaucguuauaaucagagcauauaguuucauauuauuuuaaauuacacccuauagcauauuuuuuguuacaauauaguaucuagcauuuuuagauguuuuauaugugcuaaguacuguguuaaaugguuugcauguguaauagacuuaauccucccaauugcguuauugaggcaguuacuauuaucccaaucuuauagaugaguaaacugagaauaaguaauuugcccaaggccacacagauacagcaaauggcagaacugggauuugaacucaggcagccugacucuugaacccacgcucuuauccacuacuauuacuaccucccuuuacaauuuuuuagugacuguguaauaacagcauaccauaauuuacuuagccguuuuccugguuguauauuuaauuuguaggcuuuaaaaucugaaccucaaaaguuuuuauuaaacaagcugaugccuacuaugugcaggaaccuauuugagguacuauggacauugguacacauaugcaguuauggucuaguauuguuuuaucuugccuuauguauuacauuccugaaaagcuauauacguuugaggugaaaauuuguuuauacaaacuuuuuuuuuccaaucggguuucauuauuuuaaagauacauuauuccagaaaaacaaauacuuaaaaacuagaaaauauuuaauaaaaauuagcagugagcucagcacuguuuggugccuuuaaggguucugcuuuugcgcauagugaacuguauucguuuuguuguuguuauuguuuguuuguuuguuuguuuuucugagacagggucucacucugugucccaggguggagugugguggcaugaucacuacuugcugcaaccuugaccucccugggcucaggugaucuucccaccacagccuccuguggagcuggaacugcaggcauacaccaccacaccuggcuaauuuuacacuuuuuuuuuuuuuuuuuugcagagacuaaauggauucuguaggauauugugggaaagacugggaaucuuucccaguagaggucucgcuauguugcccaggcuggucucaaauuccuggacucaagugauccucccaccucagccucccaaagugcugggguuaaggcauaagccaccgugccuggccugugagcuguauucuuucaugugacaguugcaagaaaaauuacuuaaauaaaugcaugccaggauuugugauuaccgaauaaaaguacauaaaauugaacucucuauucagauggagaaauuacauggguaaucuccaaaucuuuuguuuaccuuuagaauauuuauuuaugcuuauauugaaauaaggugaaauuacaacuucaggguucauacagagaagucacauuuguaacucagguggauuuauuagauagcguuuuaacuacuucuguucccuggauuagucaccuagucaccacucuugucuuugugagauagagauaucaauuuaauagaggaaccuaaguacuacacaagugucagcugcuguaguugauuaagggggauaauuaagagcuuuauuuuaaagcucaccugcugaauaucuagauaccuguuauauaagagcaaaacacaugguuaucuaacaaauaacuuauaauccacuuuacuuaauuauggcauuaguuuuugauuugcugauccuucuauuaaaauuuuauauuaaauacagcauuuaguugaugaguuucauugaaaauguucauuuuuaaauugauauugaauguaguugguguuugguuacucaguguaucuucuguaccuggucuuuuucaguguucuuauauuuauauuucaagucagucauaaagauuuucacacauaaauaagauuacuauuuugaaauugaaaugauaaaauaccauaaagugcccagcuuuagaauuuuaaauuauuuuaugucauaauuauugcuuuuuaauaagcuuuauuuuuuagaucaguuuuagauuuacagaaaauuacaguuagugcagaguucccauauacuccacacccaguaucucccauuguuaacaucuuauauuaaaaugauacauuuguuacaauuaguaaaccuauauugauauauuaacugaagucuauacuuuauucagauuuucucaguuuuuaguuuuuaaccuaauguccuuuuuuucuguuccagaaucccauccagcauaccauauuacauuuaauuguuaugucuucuugggcucucuuggcugugauaguuucucagacuuuccuuauuuuugaugaccuugauaguuuuaaggaguacuggucagguauuuuauagaauguuucucuguuaggauuugucugauguuuuucucaggauuagacuggggcuuaugguuuuggaaggaugaccacagagguaaagugccaucacaccauuucaaggcauugauacauaauaucaacaugauguaucacuauuaacauugaccuugaucaccuggcugagauuguguuugucaaguucucccugguaaagucaccuaccuuuuuccauacuguacucuuuugagaagaaagucaccaugggcagccugcacuucaggaguggggaauuauguucucccucguagagggugguguuucuaugugaauuauuuggaauucuucugcaugggguauuugucuuuuuucuccauuuaaaaaucuuucaacuguauauuaugaacucauggguauuuauuuuguacuuuggauuauaauccaguaauccuuuauuuuguugcuuaaauuguuucagcuuugaccaugggaaguuccuuuuuuuuuuuuucuuuuuggauacaaggucgugcucugucacccaggcuggagugcagugacaugcuuacagcucacugcaaccucugccucccaggcucaggugauccucccaccucaaccucccaaguagcugggaccacaggcgugcacuaccaaccacgccuggcuaauuuuuuguauuuuuuguagagacaggguuucgccaugcuucccuggcuggucucgaacuccuaagcucaagcaauccaccugccuuggccucccagagugcugggauuauaggcacgagccacugugccuggccggaagcuccuuaauuuggccccggugucucauugacauaccuccaucauugugcuuuuuguuuuguuuuguuuuuagcacuuccuuaccuuugggcacuacaacaugcuccagacucaucauuuguauuucuugccuaauuuuagaauuaaccauuccuucaaggagcccugguuccuucuauaacuauuuuuuuuaauugcgauauaacucacauacuauauaauccaccuauuuaaaaugugcaacucaguagcuuuugauauauucacagaugugcagccauugccgcaaucaauuuuagaacauuuucaucaccccaaaagaaaucuuauaccccauaagcagucuacuguccauuucucauguuccccgguccuagauaacacucuuuugauuuaccuauucgggauauuucauguaaaugaagucauauaauaugugaucuuuugugccuggcagcuuuuacuuagcaugauguuuucaagguucguccauguuguagcuuguauuaguauuucauuccuuuuuauggccaaauaauaacuucauugucuggauauaauacauguuauauaaucauuaguugaaggacauugguuuauuugcguguuuauaccuuuuggcuauuaugaauaaugcugcaauguauauucuauacaauagccuuucuaaagauuuuguuguuguuugaauuggaauuaguaucuacacaauugauugguauacguuuuaaguuucuuuuaagugauaauuauccccucuucaccucccuguuuucuucuuugucauuuguccagaagaauuuccacaugguugggauauugcugguugcuuccccaugguguuucuuaccaucuuccucugucuuuuuuauuuuuauuuuuguuucuuaauuguuaguuggaucuagagauuugaucauuucaggguuuuguuggacugccacauaggugaugguaauuuauucuuucaucaagagguguguaaugucuguuugggucuguuucucuguugcuauuagcuaccaggguuuagaaaaccauagcuaggcugggcacgguggcucacaccuauaagcccagcacuuugggaggcugaggcgggcggaucacgaggucaagagauugagaccauccuggccaacauggugaaaccccgucucuacugaaaauacagaaauuagccgggcaugguggugugcaccugaaguuucagcuacucaggaggcuaaggcaggagaauugcuugaacccaggaggcagagguuguagugagcugagauugugccacugcacuccagccuggcgacagagugagacucugucuuaaaaaaaaaaaaaaaacuuaacagcuaauggucaguugucucuggcuuguuuuuuaaauaaccuauaagcuaauguugauuuuuacauuuugaaaguguuuuuaaaaaagaauuaaaaaaauaagcaaaggagaauuugcgacagcaacuguguguagccugaaaagccuaacauauuuucugucuggcccucuacagaaaauauuugcugacuucuguaccguuuacuuuuuauugccuagagcuguugauucauuaggaguugcaaaauagugauaaucuaucauuuuuucauuuauuugguagaguacuucuauaaacagaaacuuucaccaacaauuuuauugccaccaggaacaguuugauggggaaagauguuuaauuuuuuuccucuuccuuuugaaaaguuuucaagaugauuugguucuauagcauucacgaaagaugaccaauuagucuuuauuuguuuuuuuuuuuuugagauuaaaguaauggaauucaacagauuugaccauuucaguuguuuuauuaucauuauugaagccuaaaugucccaugggucuucagaaaguucauggaaaaugcauauaugaaaaaacuaugcauggauuucaaaauuucuuuacaucaaaauaaacuuguguuaacuuguuauaagaugccugaauaggaucuaguuugaggugcuaccagggauaaaacaucauuuugagaaaagccccuaucagagcaguaugaauucugcuaaaauugaagcaagaacaaacgucaaauuuauggugaagcuuggguggaagagugcuaaaauauugaugcuuacgaaaaguuuauggggacagugcccccaaagaauucagcagguuacaaauagauaacucauuuuaagaagggacaaaacagcguugaagaugaaacccacagcagcagaucaucuacauccauuugcaaggaaaaaauucaucuuguucauguccuaauuaacagcacaaacaauagcaaacacaauagauaucucgguugguucggcuuacacaauuaugacugaagaaguugagcaaacuuuucacucgauagauaucaaaaccauugugcccagaucagcugcagacaaaagcagaacuuugcauggaaauuuuagacaagugggcucaagauccugaagcauucgaagaauugcaacaggagaugaaacguggcuuuaccaguacaauguugaagacaaagcacaaucaaagcauuggcuaccaagagguggaaguggugcagucaaagcaaaugcagaccagucaagagcaaagaucauggcaacgguuuuuugggauggccaaggcauauugcuuauugacuuuuuggagggccaaagaaugguaacaucuguuuauaugagaauguuuugagaaagccaaaauuuuagcagaaaauugcacaggaaagcuucagcacagaguccuucucccccagggcaauacuccuggucauucuuuucaucaagcaagggugacuuugugagaguuuugaugggaaaucauuaggcauccaccuuaaaguccugauuuggcuucuucugacuucuuuuuguuuccuaaucuuaaaaaaucuucaaagagcacucauuuuucuuuacuuaauaauguaaggcugggugcagugguuacaccuguaauuccagcacuuugggaggcugagguuggaugauugcuugagcacaggaguucaugacuaaccugggcaacauggugagacccugucucuuaaaaaaaaagaaaaauuagcugggugugguagcaugugccuguggucccagcuacucaggagauugaggcggaaggaucaauugagcccaggaggucaaggcugcagugaguugugaucaugccacuugcacucuagccugggcuacagagcgagacccugucucaaaaaaacaauuaauaauaauguaaaaaagacugcacugagauggcuaaauucuuaggacugaguucuuuagggauggacuaacugguugguaucauugcuuacaaaaauguuuugaccuuguuggggagcuuguguugagaaauaaagacgauauuuuaaauuuuuaucuuuuaauuucauuuuuccacgaacguuuugaaguccucucauauuuggccagucagagccucuuuuuuuuuuuuuuuuuuuugagaccgagucuuacucccaucacccaggcuggagugcaguggugcagucuuggcucacugcaaccucugccucccagguucaagcgauucugcuggcucagccucccagguagcugggauuacaggugugcgccaccaugccuggcuaauuuuuguauuuuuaguagagacaggguuuugccauguuggccaggcugguccggaacuccugacuucaggugaucuguccaccucagccucccaaagugcugggauuacaggcgcgagccacuaugcccagcccagagccucuuuugaguguuugagaugaccuuaguggccauugauaguuuuauuuucuauuaugaugagauguuucauauucaucucauuuucuaaucccagaccuggaacuagccuuuuuuuuuuuuuuuuuuuuuuguaaguucuuuucaguggaaaaugaugcguagagaccaaaaccugaguauggaaagugcucauugccacuggguuggucaucauuacuaggccuuuuaagugaagugagcuaggaaauaccuauuuuuuaaaguaguaaaaugaauuuauauuaguacuuaaaauugaaggcuaaaagauuauacuuuaauguuacugauuuuuacaucuauaguguuuuucuucuacaccaagaauaucauguucuccaaaucaguaaaguuacucauuugcuuuaucccacaacacacacacacacacacacccucagaauaacaauacuaaugcuaacugcaauaaaauggucauuaaaacagcuuaaauuuuuuugcaguucuuuugguccuuagaguauauccuacuauguauaguuugguuacuggguucuuaaauucucucgaacuaguucucugugugauuuuaaugacagcuggucaauuagguuugucuaauuuauacuuucaauuuuuagagauuuuuuaaaaucuaauuuuguuuuuuaauuauguaaaauguuuacauagccucaaagucaaaucuaugaacaaguucugugaagagacuuagccucaaucccugucucuuucaccauauuuccucucccuguguguauuaaaaguuauauauauguguguguguuaauauccuacauuucuuagguaaauacacucauuuuucuccaaacuuacuuguuuucacuuaauuuguuauagaaaucacuccaugguagaaaauaaacuuauuuuacagucuugcguacaacugcauaguaccuccuugugucagugugucauaguuuauucaacaugucucuuauugagggacaucaaaguuguuuccagguuguuacuacaaguagugguacagugaauagccuugcuuguaccugccuguuuuuauauuuuggccaguguaucuuagggagagauucauagacaugggauugcuagguaaaaggguaaaugcauauauaauugcgcuagauuuugcagauuuuccucuauagugaaugcacuauuuugcauuuccaucagccuauuuuccuauauuugccuacagaguaugucaucaaacauuuggauuuuugccaauaugauaggugagcaauuguaucucacuguaguuuuaauuugcauuucuuuuauuaugaaguugagcaucuuuuuaaaugauuaagggccauuugcauuccaguucaguaauuaauucuacaucuguaugaaaaugauaugcagcaguguggauagucuuauuuuacuccuggagaugcauuuacaacugcuuuugguuuauauauauaugacuucauuguggguauuuugagguugguguccuauucuucugaugcuguuaacuucuuucuuagauuuuagagguuuccccucuuuucuucaauauuauuuuguaucacaaguguguuaucaaacuuuuaagagcucaacgaaugaaugaaauuugucuaugacaggacgacagcuuaccaaugcaggacugaguuaagaagcuuuugaauuuaguuuaucuuuaucaguaaaugcacaguugaauagaagaauucuagaaccugguuuacagaccuugugagacuaugacaggauuuuucuaacacaucuguuuauuuugcauugaaagcuuguguaugcauagaauucuuugcagaaacuagcuuugauaauauaagauucauuauuaaggauuuuuaaucuuguguucuuuuccuuugcuuauguuuaaauuguuagauuguccuaugggauuucauaaauauuacuucuguuaguaaagcugcugacagcagaagcuuucaauaaauuauucaugugcuauuuguuuucuguguucaugaauuaauucaacuuagaauuuuuuuaacugaacuugguaacaauuuguagacauauggguacuugaauaaaaucuguaauacuuguuuuccauaugaggaaaguacucuuagcaauauuuagagcaacaucagcucucuagaacauagcugauuacuaaggaguaauggcaaaaucgcuuuaaaaaugugaaauaauuacucuuauaaaacugcugcuuuuucaagaugugagccacggaauuauaucauuuucuacuuuucuuguucacuaucauuuguauacuuacuguucacuuucauuuauugaaaacuucagauguuauuuuacgucuuccucuccauuccaaaucuaccauuguucucgauaauuuuuaucuacuugacuugcauucucaauagcauuuucaguucuuuaaccucgucaucuccagucacuucucuuccaugccauuucaaacaccagcgucuauaaaugugcccuaucgcuuugucaucacucaggagcgcuaaaauauuaaaauaauaccccagucucacauagucuccagucguuccagguuccucacauuauagccgugcuauuuuuauccaucucaguucaguccuauuuauuuccuucccugccuuagauuccauguacaaccauuuugauaucuuuuuuuuuuuuuugagauggaaucucacucuguugcccaggcuggagugcaaugguauaaucucuacucacugcacccugugccucccagguucaagcgauucuccugccucagccucucaaguagcugggauuacaggugugugccaccaugcccagcugauuuuuguauuuuuuguagagaugggguuucggcauguuggccaggcuggucuugaacuccugaccucagaugauccacccaccucagccuccuaaagugcugggauugcaagugugagccacugcacccagccacuuugaugucuugaacccucuucauugucacuuucaacucaucugccuagaaaaguuuaauuucaaaugucuacuuuccuuccuuuucuacuuuauaaaaucacauucuccuauuugaacuucuuuaaauacaguuaccaacgucagcugggcucucaguguagcccaguaauucuguuuugccucuuuagugcucucuuccauucuugccacagcuauuucagauguuuuccacuaccugcaaauucugguccuucccaacaccaccacccuucucucaucaucagcagaugaacucaucucauauuuuagaggcuauucaagccguuaaugauuccuguaacuaacuaccaccagaccuacucauauguucauucuucuuucuuguuacaagaggggcagcauuccuucaauccaaaauuaauccuucuacacaucuuuucucauguaagcauuuuaaugcuuuaacuuucccuuuaagcguuacuuuaguugcauuguccacauuagacaugcuguauuuucauuuucauuaaauucaaaauauuuuguaauuucucaugugauuucuucuuugaucuguggguuaguuuauaaguguguugcuuaauuucuaaauaucuuaggauuuuccagguuucuguuauugauuuguaguuuaauuccauugugguuagaaaacaaacuuuguacaauuucaauccccuuaugugcacauuaauagucaaggggauucuucugccaaauucuggaguaugcacgcucucacgcgcacgcgugcgcacacacgcucucuuucccacucucucucugcagcucuuuucuguuuguacucugaucugcaaauugcagccaccuuggccuccccaauccuaaucucugccucuucaacuccgugagacugcaaagcucucuuugguuucccccaccaugugcugaggccuggaaauggucuacaggcuguaaaaugguaucauuuuagggcuuacuuuguuuaccucucucucaagggucauaguccugugcugucuauuguccagugucugaaaagcauugucucaucgauuuuguccaguuuuuaguuguccaaggcaaggagggugagucccauccuugauacucuauuguggccagaagccugcaucaucuuaccguguaauugccuguaucuauuucagucuuucuacugguucuuuccaucagcuuuucaacaugcucaagucucuccucuauugcaaagaauauagaagaaaaccaagcucaugucgucuuuauuuaccaaccuaucucuccucuaccuuuuacagccaaacuuuuugaaaguuaucucuauccuugcuacucaaaaauauuguuuguggacugauagcaucuuugucaucuaauaacucauuagaaauguaacaucucaggccccauccuagaacuacugaaucagaaucugaauuuuaguccaggugcggugauucaugccuguaaucucagcacuuuagaggccgaggcgggcggaucaugaggucgggaguucaagaccagccuggccaauauggugaaaccccaucucuacuaaaaauacaaaaauuagcugggcgugguggcacaugccuguagucacagcuauucgggaggcugaggcagaagaaucgcuugaacccgggaggcagagguugcagugagccgagaucacgccacugcacuccugccugggcuauagagcaagauuccgucucaaaaaaaaaaauuuaauaagguuuaacaagguaauuagaauauacacuauaauuugagaacacugucuacauuuuccuucuucacuuuccaucuuguuccuuaguguguuguagucugucaucuguuuauaggacuacauuagagcuguucuugccuggaucaucagugacuuucucaauguauaucuaaugaaugggggucucucuaucuaaugaauggcuguguuuuacucucagcaguucaucuuccuuucugauauauuccuuuggcuuuugggaugcccuguucucuuguccucugaccucuguggccuuuucaggcuuuucuuucucugccugucucuuaaauguugguguucuacagaauuugguccccagcuuucuucagauuuuacauuucucugccugucucaucuuuuccuguaacuccaguuucaacauguauucuucauucugaaucucuccugaguuccaggauuauauguccuccacauaagcaccuuaaacucuccauguuacuguggacacaugaucuccuucaucauguccuccuccucagugacuggcaccauuuagccaucguccaagcuagaaacuugucauucaucuucaacuacuccaucacccuuuccccuccuuuacucaccuuacuuucgcauuuauucagucuuaagacguauugauuccacucuaaaaauucaucaugucugccauuuuuuuuucugucacuauugcugcuuuccuaaacaggacuucaguagguuucaacugagauuaccacaguggcuucccaacugguuucccuaucuccaaucuuguucccuuuaaacuaaucuccauuuggcaguaagaaugauccuuuuaauauuaaguaaaugugaucuuuacuuaccaucuuaaagcccuucaagacccuuaccaacucuucuuaacuuccaaacuuauuagcuuaauguaugaaaucgucacuaucuggucacugccuucccaguugugaauuucuuugaguacuuugccacuuccacugccagcuuguuuccaggccuuuguaccuacuguuccuuugacagagugucuucugcucuucacuggcuggcuccugagguuucaugucauuuugcaggaauguccuccuugacugucuaggccgguuagauucucuucauguacguauguacuuuguacauauccugucauggcuccuaucacacuguucugugguuguguuuguggcugugaucauaucauuguauauguccuccacuauaagcacucuuaagggcagauaguaagugucuuguucccuuaaccuaggugcuuagcauguggcacccacucuacaccaggcaggguuccugcucucauugagcuaauaguguauuguggggauggagguggguuagggugcaagaaacaaaagcaacaaaagaaaaauaauuuuauucuuauacaugauagauccuuaguaauauuuuugaaagaauguguaaauuauuauuauuguuuugagauggggucucacucuguaguccaggcuggaacgcaguggcaugaucauggcucacuauguccuuuaucuccugggcucaagcaguccucucaccacagccucccaaguagcugggacuacaggcacaugccacugugccagguuaauuuuuuuaaauguauuuuuuguagagauggaggucucacuguuuugcucaggcuggucucaaacuccuaggcucaagcgaucaucuugccuuggcuucccaaagugcugggauuacaggugugagccacugcgacuggccaaauuauuauuuuaaagagcccuucaagugcagaaaucuugaauguuacugacauuacugacuuaaguucuugaaaguucagcuuucuaaacugaaagcuaaguucagcuaucuaaaaauguaauauaccuuucuggaccuaguguucugugguaauuagguuauuguucaaacccuucaaaucuaauucuuaguuuuuuuguuuucuuauguaguuucccugaacagaacugugguaaucaaggacuaguggagguguacuuuagaaauagcagugagaauuaaugguuagcuuugaaaauagaaaaguaaaauaauagguguucuaugguauaauuguuuuuuauuaagaaaggauauguuuuauucauuguauuuuauaaaguucaagccauugaugcuaaaauuagaaaaaguuugucaucaaauagcuaaaauauugauuugauagccaacagaugaaguuacuugaaauaagcuauauuagucuauucucacacugcuauaaggaacuaccugagacuggguaauuuaugaagaaaagagguguaauugauucacaguccugcaggcugugcaggaagcauggcuggggaggccucacaaaacuuacaguaauggugguggaaggugaagguggagcagggcacaucuucacauggagaaguaggagagagaguggaggggaaggugccacacacuuuuaaacaaccaggucucauguaucaccagaacagcaaggggaaaugcgccccaugauccaaucaccugccaccaggccucaccuccaacacuggagauuauaauucaacaugagauuugggcagggacacagacccaaacuguaucauaggcagaauauuuagagcaccucuugaaaaauguggucacuuuauuaauuuugaacucuauaugaaaauauuuuauuaaauuucuugaaaaaucuuaucuacucaguaucagugaaguguuuucauuauaagcaucagaaacauuaacuaacuuaaguacaaagggcauuuguuaggaugauaugggguugcuuaaaggauaaacagaaaagauaaagaaccaaacaaauguccacuguuucaguugggccagaggaauuacuuuucugcgaaugauuacuuuucugggcagggcauuggauuucuugagucuauacgccuaagagugccugcugcguguuguguaguuucugguuuauuguaauugcuuagacaacaacccaaugcaguguuuucucuugaugucuuaauauuguaaaaguaucuaggaauaaggacauuuuccuaaauaacaguaucauuaaucacaucuaagaaaauuaaaauuaacucaguaaugcugucuaauauacucagcauuuaaagucaucuggauauucuccaaauguuuuuuguugcccaggauccaguaagguuucacucauugcauuugcuuguuucucauuagucucauuaguucauguaggacagucuucuuauugccuuuguuuuuuaugacauucacuuuauuuuacuugaagaguccaggguaguugucuuguagaaugucucacauuuuggauuuguguaauuauuuuuucaugcuuagauuuagguuagacacuuugggcaagaauacuacaugcugcuuauugcaucucaucaggauguuuaugaagccagguugucccacuacuguuaauaaugaauuugaucauuuaguuaagaugguaucugccaaaucuguccauugugaagguacauuucccccuuuguaauuaaugauuuguggaugacacucaaauugugugacuucuuuuuuccagugguuuuagcauucaucaguaaugaaucaguuauuacugaacuuuuaaugaaaaguuucuaaaaaguuuccuuucuaaauagacauuucugauuaggcacuaaagagaagguacugguagucacuuaaaaauccuuccauuuuuacuguuuagaugucagaccaguuguauuagacagcugggaaagagcuuugcuuugauuccucacaauuauugucaugauucguauuaaucuuuuaccuuuuccagaaauaauacaauuuuuuuauuagagaacuugauuauuuuaaaacacauuaaugaaggguaacauaggccagugcagugcuguacaauggaaauauaguacaagccaaauacauaauuugaaaucuucuagauagcacauuagaaaaguaaaaaacagguugaacuaauuuuaauaauauauuuuauuuacaugaauauauccaaaauauuuuaacacguaauuaguauaaaaauuguugaugaauauucuacauucugugugugugcaauaagucuucuaaaucugguguguauuuuauauuacuuaaaaucuuaauuuagaugagcuacauuaaguuaccaauaacuacaugucacacaucacugucccuauuggauagugcagauauggugguuacaaucuugggcacaaaggaaccagacuaacuugauucagaucuugccuucuucaccagcuggcaucaugacuuugggcaaauucuucauucucuuugugguguaguuuucccauuguaaaauggggauaauaauaguucuuacuacuagggauggggaauugaaauaauuaauguaggaaaagcacugaauccaucucuggcacauaguaaaugcuuaguaaauguuaacucuuaucauuaugccuuuagacuucguccaauaauucccauucugucuuagaaguguccuuguauuuuguaagggaaguuaggacuagauauuggaucccuugacuucuguuuuauaucuugcugguuuuacccucagucccuugcuuuacaaacucuuuuguagugacuuucuaaaccaauaagaugaaauagauuuuuuaggagacuuuuaauuucaagcauucucgccccuuguuaccauaauuuauugaaaugaaugggaaaacccagcaccucugcaaauggcagugaguaaaugagagauuuaucauuaugauuuuuuaaacccacaaaagauugagagcuacaauauauuggguugcuuuuucuuuguaauacaaauacaucucucccacagaagccuauguaauuguagcaguaagguaaaacagauucacauacaaaauuaaggugaucucgaagauugaugaaguguaguuguaucuaguucagaguuauuuaggauggcuuccagauuuguugauuacccagucuuauauuaggucauaauaacugcagaagauagagaagggaguauuaaaugaaguuuugcaaaggagauguccuguuuaaaaauaacuugaugguuuacugugauauaacauuugguaccuagaauacuaguaucauugcccaucauagaaaaauaaaacaucauuaaacaaagaaguaucaguuaguugaagccuuuguaagcauucacugaaucagcauuccuaaagacggugauguugcuaaaaugaaauggugguaguugaauauuacaguguaaaacaaugccaucauucaggggauugaauuguaccuccaaguuaauuuuuacauuauauuaucauugcagccauauuuucaucaguauagcaaaaguggaacugaaaaauacucauuucagaaauuuaaaagacuuugcaacuguauugggugaaugugcaucaguauugggucuuacucuuaggagaaucuucuggccaccaguauuaaaaaguggcuuauaagauauuucuaggcugagugcaguggcucaugccugcauucccagcacuuugggaggcuaaggcgggaggaugacuugaaaccaggaguuugagaccagccugggcaacauagugaggcccggucuguaccaaaaagacaaacaacaacaacaaaacccaaaagcuuucaugaacguucuguaauuaaugugaaacaauucuuauauauuucucaucuagcagaaugaaaaaugaccaauucagauuucccccacuuuugagcuaaaguauagcuaaauaugagcuaaauauugcuaagacuguuuauuauuaauggacuuuuccugagaauuguuuuggagaauuuccaaguaacugguuagaacauuaaugguacuguuugcagguuaucacauugccccuugucuucuugcacaucaugaagaaauuauauaaaauauuaacuuuaguuauuuaugguacuuuaagaaguuacauaaaacauuuuuacaaaggacagacuucaagucaucuugagaucaaauuuuggagacuaaggcugaucuuagaaaaagcaauggagauuugauguuauccacagucauuaaguaccacuaauacuuaauuccaucuuggcccaggcaccuuuccuaccuauaggacacugaaaaaggauaaaacaaaacaacaaacaaaaaccaaggugcaaauagccauggcaagacgggucauuuuaauacucucuaauagucuagccugcucaugggaagauagaccuuagaaaagaggaaaaagcaaacagguaauugcugugaagauuacacauagcguagaaggauagaggacuaggaucucuucagaaauaguuguuagaaaaggccucuguagaagggacaguuugguuaaaacaugaaggaagaagcuagccaugcgacagagagugggugcagggcaaguguuccaggcagaggggauggcacaugcggaggccccagcgugagaaaggacauggcuuguucaagagacugaauaauguggcuuauucacagcccauugagagaagugagaggaagugugauaggagauuagguuggagagaggcaggaaccagauccuguaggcaggccaugguaaugaauuuggguuuuauuuuagcuguacuggggaguucuuuaaagauuagggaagaaagaugaucaaacuugguuuuaagaucacuuaauauuauuuuacacauaacaguugucaaaauaugcguagaaguacaguccauauuauuuuauacauaacaauuucuaaaaugugauugugaaaacuaagguccuagacuguuagcgauuuugggggagauauuauagguuuuugaacugugaauaguuaacuauuuauugaggacguguuaucugccaagcagugaggaauuuuauacaaauucucucucaucuucacagaaauuuccuugaaaggaggcauaauuuuuccuguuugaugggggagaaaauguuagauacagagagaaauuaagcaacuagcacacaagggcuaggauucaaaaauaugucugccuuacuuuacugucccauagcuuuuuuuagugucuuuuugcagggaggaagauggaggggagaagaacaaggcugaaaauugaagaaaaggaaagcacucuuauaaauuuuuguggaauaaaggaauuuagauuuuuuuuuuuauuugggggagugguugggaagguaguggcuguaaauuagaacaguguaucaagguacauuacccuauagaaauugaaucacccuagaauuucccuauaggacauuaugauccugaacaagaauuuuagaucuagcuuugauuagacauugacauccaguguuuuuaugguauaguuguaugccgugaaguuuuaaaagcauauauguuuaucagacaauuaaaaugaucuguauaauauuaacaauuaauugcauguuuuccccaggagagggguucuguaaaguugaaauauagggaagaugaugugucugagguagaucagucuuuggagaaaucagcugugcagggcagagagagacugaacucuggaaccaggagcacuaacuguuacguagcaaagcaggguggaaaauguuuguuaacgcuuaaguguugccugcucuuaguuaauaacaugaauguuguugagaucuuugaauguuaaauuauuuuaauuuucuaauuuucuaagguaguugagaauuugaagcaagauagucugaaccgcauagugauaguggacacuaaagaaucaagauggaugaaauguaggauuuggagacugacgagaagggaugggaugguugaaagaaacauuaacaaguaguaaaaaaagaaaaauaggaaguccuuugacaguagugucuuagcuuaugauaauaaagugauacuuuucuuacaaugaacauuauacagaaugcuugcauuuguagguauauaaaaaugcuacuuauccuucugcccugaguuucugcuacuacuaaacuuugaaccucuuuuggcaauaagacagguuucauuuuacuucugcaaguauucagauaccauauguuaauguuuuacucuggguacaauaaaguuuagaauuauuacuggucacacacaauuaagacaugcaccgagggauaugauuuguugauguuguugggaguuacaacagaaaggaguucccuguggauauuuucuuucuguaagauggaauucuaucaagaagugugaaguauucuaucagaaugugaggaauagucuaucaagaagugagagcuauuccauuaagacgugagaaauuugaagagacuugggaauguagaagauauuagauaggaucauuaaaccuauuucaaaauggaauccagugacucuggccauacuaaaccaaaauuaagcaaauauaauuggcugggagucaggucccuggggagaaguauaagccaguuuuuauacaaagucagcuaaggagugaguguuugauaacccuuuuauuguaacaaaaaguggguaaagaaaaugaugauagaucuuuuagaaaauaaucuccuguuccaagcaaaggauuguucuccaccaccaccaacaaaauuuuuguuacugaaaaaaaagauaagaagaauguguaugcaauuguucauauauauacauauauaaaaguagcaaacagaaauacacggaguaaaaaguguucucccuguacgcucucugcucucuuuuggcagcucaaacccacuacucuccccagggagaaaacaauguuaacuguucaguguuuguuauucuagucuuuucccuuuguauuugcauuuaaauaugggcacacaagcaucuguacauguguacauauuuuaauaucagaagagucauacucgacauauuuugaacguacauuuuuuauuauuuauguaucuugacaaucuuuuaaucucagcauacaaauguaccccagacuuuucauaauguuccucuccugugcagacgauauguguguaugaauuuaugaaugaagauggcuauauuucugcuuaaguaauacuauuuuuauguaaaauauuuagacaauaccaaaggugaaagaaaaaauuaaaaaucaacugaaauccuugagauaauccuuauuuuggcgaccauuuaaaaaauguuuuucuuuagcuauuuacacgagugugaacauacaucacaccugccacauauaaagguauaauauuuauuuauuuauuuauuuagagacaagguuuucuuuggucauccagacuaggucucccucagucacccagacuggaguguagugguguaaucuuggcucacugcauccucuuccucccgugcuccagugauccucccaccucagccucccaaguagcugggacuacugguacaggucaccacuccuggcuaauuuuugucuuguuuuguuuuguuuuuugguagagaugggguuuagacauguuguccagacuggucuugaacuccugggcucaagcaauccgccugccuuggcuccccaaagugcugggauuacaagggugagccacagcacccagccaauguaguauuuauaaguggauuauacauacaagaugauuuuugucauggaacuauuuuaucugcuuggggauuuuuaucuuuccucuacucccuuucuccuaucuuuccucucccaguaaccaguaguaacaaccugguguacauuuuuccuaccuuucucaaugcccauauaaucauauacauaugaaauuauauaauuuacacucaucuucauuauucauuuuucacagaacugauucuacaucaacugaaauguagcccacucauuuuuuuuuugcuggauaauauucuaaggcaaggaucagcaaacugcaauaaacggaucaaauccauccagccaccuauuuguauaaauaaaguuuuguuggaacauagcuucacccauuuuuguauugagcaguuuaaccuuuuaaauucuuuaccuguuauaugugacacaauuuuccccccaauccauugucuuuugcuuuguuaugguauuuugccauaaaaaauuuuuuuuuaaugcaauaaaguaaaacaugccucuucuuuucuagcuuuuaguuuccuauuuugauuuaaaaggcugccuaacuccaggauuauccuuguauuuuccuaaaauuucuucuaagguuuuuaucacuugcauuuuuuauaggccuggaauacauuuuuaugucuauauugaguggcauuguaguauaacguaguauaagaucacagauaaugaacaaauagcuaacaauaauguaguauaagaucacagacccugguucugugauuuacuaccuguucgaccuuugacaagguccuuaacauuuauauguuguuuuccucucuaaaauggggcugauucuuguaccuguuuuguaagaugauagugaagcuuaaaugagugguuauuauguagaaaauauuucgaacauuaucugguacauagaaacaugugcuuuuacuguuauuacauggugugaguaggcaucucauuuuuuucccauauggauaaccaguuguccuaguaacauuuauugaguaguuaguucauccuuuuccucaaucgauuuaaaaugucaucucuacuacauguuaaguuuccaaauauauauagcucuguuugggggcuuuauagccuguuaugugucuuuauccucugcuccagagccacaguggcuuaguuacuauagcuuuauacauacuuguaacuaacaaguggagucccuuuacuuuguuuugcagaauuacuuuggcucuuacuggcuuuuuuuuuuugcucuuccauauaguuuuguaaacacucaucagaauuuacaaaaacuguuuguuauuaagucuuaguguggaaaggagugauacuaaguggccauuauuagaauggaaccugcagucucuuauuaauacuuuaaccauuggaaguuuuuagaaguuaucugguuauguaaucuaaagauuagugccauccaccaugcuagguggguacugggaauauagcaaaugaaaacuguacaaagauagaucauaagccugcauuucccaaacuauacccugagauacccaaaggaaccucagagaacucccagggucauuucaaacuucuagggaaacauggccacaucuguuggacauuaugcgaacuucuagcucaagguaguucacaguuucaacagcugauugugccaucuucauuuuguaccugugauaucuuugugaaguugagcuuuuagugguuacuguuuuaaaaagcaaguacuaugcaaaaaucaguguggaacaggaaauguggguggcaguauuuaguugcacagcaucuaaguuuuagaaguugugcagggcccuguaggugaaaacaucccauaguaacuaauugugguuauuuuaaaaugaaauauauauauauauuuuucaguuugcauguauuauuuuuucaaaaagguguuaauuuguugggacauagauacucauuuuguuugaaccuaacuguuaaaagaaauaggaugguuagcuaucucuuuugaccuauggaauucuugaaagaaauuauagagaaaauaaggguaccaggagccaagcaaguuugggaaccucucuacuuuaacuuaaaguuauuacaaauauucaaagauuaagaacauuuggagugcucuguagguagcgcauacaccaugcuugcuuagaacaggcaaaacuaacauugccugggcaccugggacagacagcauuucugagcaaaugauauuuaagcugagcuugaaggaagacugagaacugacugaaaaggagugguggugggaauagcuugugugaagaggcgggagcgguggggaacugacugggagagcaaugcaggggagcuggaaauaggcagaagcuagaucagguggugacugacguggcagucgacuaaaggaguuucuucagguuucuuuguaaaaggcaacggcaagccuuugagggguuuuaagugaagagaggauaucuuaggucacugcccuccuacugagagaacaaaauacaaaacgauauacagaaauauuuaaguaacuuuuuguaaaaauuuugaagugccuugauuuugaaaggcauuuguaagcuuuccuuugaguguaauucacucuuacuuuuucaaacacauauacuuuuuuucguuguucaaccuggcucaauuuuaaaaaugaaauaaaaagcaagacaguguuaaacugcgaaacauuuaaauuguaauuuuggggguauuuuuucaaauggcaaaaauuguguuguaauuuugaaauagaauguauuuuauuaucaguaauacaauauuucagauuuuuaauuuguguauuuuaaccaccaaucuaacacauuuaucuuuuaaguuucugaguuaaguuugggggguauaauagagauuuaauaguuacauaguaaagauauaaagguaauuucucuuaguuuagcuaucuuuuuauacuuuuuauuuauguguuuauucuacuaugauuccaguaaacuaaugcaacauaaacauuuugauaguaauaagaaacuaauugcagguuacuuuuuaaaaauuucuaagcuuauuuucaggaauuuuaagacuugaaaaauaaauuucauggucauuaaaugggcauagagaccugaaacacuuuuuuuuuuugagacggagucuggcucuugccaggcuauagugcaaugguguaaucucggcucacugcaaccuccaccucccagguucaagugauuuucccgccucagccucccaacuagcugggacuacaggcaugugccaccaugccuggcuaauuuuuguauuuuuaguagagaugggguuucaccauguuggccaggcuggucucgaacugcugaccucaugauccacccaccuuggccucccaaagugcugggauuacaggcgugagccaccgugcccagccaccucuuuucuaauaccugcuugugguguuugggaaaguguaauuagucugauuagaauuagaauuuguuuaucauugaaguauuggaaaacuuuuaaaacaauugaauguuauuucuuuuccucugccaguguguuuuauauuucuuuagagguguuuguucauuauauaauauagaauuuaugucauccuuaaauucauaaugcaaauaaauuauaaagaaguguguagauauauucgaaaaacagucuuaguuucauuugcuggauuggguuucucugauuuuucacaugaagaaagcugaugacaacuugaguuguuuacaagggaauuggucagaaguuuucuugaagaaaagugauaaagcuuuaaguuggaaagcuuuccaacaggcugagaguauaagguuuauaacaaauauuuuucuuuaaauuuuguucuucccauguucaaagaacugacagggacuuagagaaaguaagcuaauuccuuccgugcucuuuacacuaaaaugaauucuagaugaagauuaaauguagaaaaucacaagaguaauagaacaaagcaaggcugaaauuuuuuaugaucuugggauaaaaaagaccuaaguauaacuauguuuaguuuuauguagcuuaaaauuuauucuuauaacaaauauuauaaagucaaauggaaaaaagaauauuuguaaaauaugauagcagauugcuuuuuaagucagucggaugaauaaauucucuagaaaauggacaaaguguguguauaguaaauuuaugaaaaaaauacaaauaacugauaaacauaaaaagauaccucuuaagaaucauuuuaauuuucugccucuuuuauguucaacagagaauuucacuuugaaugcaguaacuuaaaguauuuauaaaucugauucuaggguuugaaauaaaacuuuuauuagauacucaugucauuuaacaaggcuuguuuaucucagguagaagguuuuuuuuuccccuaauguucuucuaaauggcucaaaguuugguuuccuacuugaaaguaaaucuuauuuauuagacauuuguagugagaugacuauauuuaugugucacauucaaagaacaacaguuaauaauuuuuggacuuguuaguaauauauuuucugacaaauaauagaagagagauuugcuuaacuuuguucuuuuucuuuauuuuuguaggagccagcauucgaacguucacuccauuuuauuuucugguggagccgguggauacacucucaguuagaggcucuucuguuauauuaaacuguucagcauauucugagccuucuccaaaaauugaauggaaaaaagauggaacuuuuuuaaacuuaguaucagaugaucgacgccagcuucucccggauggaucuuuauuuaucagcaauguggugcauuccaaacacaauaaaccugaugaagguuauuaucaguguguggccacuguugagagucuuggaacuauuaucaguagaacagcgaagcucauaguagcagguaaguuuuaagugauuuuuuuuuuugcauuuucaaauauuuauaacauacaucuugauaaaagcacuguucucuuggaguuuucuuuuaauuaguagcaacaaauauacucauuuaacagauaucaauugugcauauacucugcguaugggaccuugcuguagggcuugcucagugccguagagaauaaacuguagcguguuuccacuugucugauggcuuaauauugcuaucagaaguacugagcaguucuuuucuccuuuuaaacuuggaaguggcagaggaagugguauaggaaaauuaaaucacuuugacggccaacuucuaucuuacccagcauaaccauuuaguaugguuuuguaaaacuugcaguaaagucagaauccugguuccuugaugccuuaaccaaggaaaugacauucaauuggauuaauuguuuuaaaaucuacagaguguauauuaagguggagagcagaaaguuauaaagagaggaacuuucccuccuuuucagaguauccuuauuugaagaaugauggaaaguguaagaaaaauuagggaucuugaagaguaagaugugguuucuaaguaagucaugucuguuuuguaguagauacuagcguuccugagauaguguuucuuuacuugaguaccagaugaaauaguuuuugugaagggucauguuauacaaaaauguuaucuuuaaguccuguauuuacucucaccuuggugaaacgcccacgugugagacagaaccucagagacaguagucucccaucucauuccuacuccaggauuaugguuucccaucucaugcucacuccagaguauauuugcuuauacauucagagcauaauggcugguuuuuuuccucuuuggggacaaauacucaaaguugaauuugggugugacaaaguuucuguaauuauuccauaaucauagauugaggauggaaaaauaaaagaagaaaaaaauggguccuuuugccaauuucccuuuucuuuccuuccuucucucccuccuucccuucuacccucccuuccuugcuuccuucuuuccucuuuuuauuuuucuuccuuuucuuuucuuucuucucucucccuuaaaaaauaaucuauuugccaggcuuucuccaacauguuucauaaauaaauuaguauaaugacugccucuacaacgucacuuaggucagugucuguuuauaauuuaaguucuuaaauaucucuuaucugggcuuuauucaugggcuccuuccucucggcuguccccccauauacuaucaucaaauccagugaauucugcuuaguaauuucucuguacuuaauccacuuucuccuucccgaggcuacucccagucuucccucaccacagccuuauaagcaucugccugcuaccuuauucuuccccuccuccaguccagucuccacccugucuagaguacucuuucucacccuucagugauccuccaguaacaccaucaagguaacaucuaacucuuaaauaacaggccuguugauuccuuuuaugagcuguccuccacuucuccaaccuuauuucuuaacauuucacccugccucuguccccacccccguccccuacauccaccaucacccucaccacaguuuuaagcacuggcaguacuguuuuguuuccuuucauuuauucucugccuuccagccuuugcucauggcauccccacugccuguuaauuuuauccuccaccuuuuccucacuuucuucuccucugcuaaguuuguccauucuuccucuuugauaccuucaggaagcauuuuuuugacccaguaucuaagcaagcagcaccguagaaggugauacauucugugaugacugcauacaggguucuguaggaaaguuauuuaaaccacucuuggcccuagguaucaggaguaaauagugcccaagcuaagggauuaaauaaaaguucuuuuaaauaguugcaugguauacauugucuagauauacauacugugauuuauuuaaagauuucuuuauugaugaacaauuaaauggauuaaaauuguuggauguuauaggcaauacuauagugaacugccuucugcaaaucuuuauuucuguaaaacagauuacuggaauugggauugcuggaucauaggauacacugugugugugugugugugcgcgcaauuaaaagguacuaguuugucaguuccucaaaauguuaaccauaguguuaccauaugaccuagcaguuccacuuguagguguccugggguaguuauggguuaugcagagugacugcaagugaguacaagauuucuucccggaaugaugaaaagguucugaaauuagauuauggugaugauuacacaacuuuguucauauacuaaaaaauauuaaauuauguacuuuagauagugaacuuuaugguauauaaauuacaucucaauaaaaccuaaaaaaauucugccaaauugccaaucuaaaagacuuagaguuuuuugguugcaagcaguagaaacugauuguagccaagucaagcaagaagggaaguuuuugaaagaacauuaaauagguaacucauagaauuaaguaugagaggucuuuuucucugagcugucucauuucuccacaaccaaaauuucuguuuuucugccugggcaguaugcuggcugugaguauuuugugcccagaggugggguaauaggguguucuaaauacagacauuguuaauaucuucuugucaacuccgggucuuaacucccacucuccuuuuucuccugcaguucuccagaggcagcaggacaaccggcuuccuucuugggagcgcaggaagcugcagcguucccugccuuguuaugucaguuacuaguccuccaucugcuuucccuacucagaaauuuuuugaaaucucuugucugccaauucuccauauguuuuugugagcuuacauuuuaaaaauuauuaauuuucaugagaccucaggaggaagaauuuuuugacucuuuaaaaauacaacugagcugggcgcaguggcuuacgccuauaaucccagcacuauaggaggccaagacgggcggaucaccugaggucaggaguuugagaccagccugaccaacauggugaaaccccaucucuacuaaaaauacaaaaauuagccaguaugguggugcccgccuguaaucccagcuacuugggaggcugaggcaggagaauuguuugaacccuggaggcagauguugcagugagccaagauugugccacugcacuccagcaugggugacagagugagacucugucucauaaaaaaaauuaauuaauuaauuuaauuuaauuuaauuuaauuaaaauagaaccauauuuugguuuuauugauuaagauuuccuccuuuccccaacuugaucaaauucuguguuuaucuuuguuaauucuuaucuucugauauucugguuucuuaaaaguagauuuuuggucaaaucuggggagcucaagguaaaaaagcagauuuuuuagauaauuuuaucuuuauuuuuuuccuucaaaaauccccuugaaauaaaaaaaaaauaagaaaaagaaaaaguuuauugcagggcuguaaaaccugugugauuuauguuuggacuaauucaccaucauaaaacuagaaaaccuguaaucauuucucaugauuuguuugcucuuccuuaaagaaacauauuguuuuauucugagcauagcaaucacuuuuuagauauuauaauagcuaguuaaguguuuaugcaauauacuauauauaaauuauuuauuuuaaguacuuuuuuuuuuuuuaacaauccugugaggccuguuauucucauuuuacuugugaagaaacugagucuuagggagugguuaaauaacuugccaacuucagacacccaugaaguggugguguugggauucagauucagauaugugacuugaaaacugaugcucuuagcugcuacauccuguggcgucuauauuuaugacgacauuuuugguucacauuuuauuuugagaucauuuuaaacguagggaguaggugcaagaauagaaccaagaaaucucauauaccuucaccuagauuaccugauuguuaacaucuuaucguaucugccuuaaccccccaaaaaugcauacauccaaagacauauuuuuucggagccaguaagaguaaauugcagacagguuuuccuguaacugccaccuaaauaccuacguguauauuucuuugaaacaaggacauucuccuagauaaccacagauguccaucaaaauuaggaaauuaaccuuaauacaauacuacuguuuaauuuagauuucacugauuaucucaauaauguucuuuauaguaaaaaccaaaagcagaguacccgccuguccuccucccacacauacucuuauuucuggcccaagauuacauauuucacuugguggcuguguccuuuaaaacucuuuagauauaacuugguuuuuccuugccucauuuugaguuuguuugauuucucccugaauagauucagauuccucauuuuugggagaaauaccacagaaguaaugcuguguucucagugcaucaugccaagaagcaugugauauuuuguucuguugcuggugauguuaacuuuuacuacuuaagauggucugugcaguguuucuccauuguaaagcuugguacuuuuguuaguuaauaaugaguauuuugggaagagauacuuugauacucuguaaauauacuguuccucaugacauuuuuguuuacuaguuuugguguccauugaggauucauacgugaaucaguuauuacuaucaaauggugauuuuucuaguuccaucauuucuauaaggcaaagcuuuuccuuuucuuccacuuauuuguuuauauuugcaugaaccgacagauucuugucuuauucaguggguuauaaugcauguuaauaccauuaucccagauuuaaucagaggaagcucccuucagucugacuucugugcccuuuugauauguccacauuguucuuuggacaguuuucuuacuuuacgucguaagauguaccagguucaucuugugcuuucucuccuucugcacucuuagaauuggccauuucuccaagaaauuauuuagaaaagguagagacaccauauguaccauugcuacugaaguaauauggaugcugcaccuucucuguggacagggcuaggaaauauauagggguguguguguguguguauauauauauauauauauauauauauauauacacauuauauauauuauauauauguauagcaaugaauaaagacuagacaaaauguguacauguuucacacauacuuuuauauuuauauagauaucauauauauuuuuauaucuaugauuauauaaaaccaugauguuuacacugauaccuccauucuagaccaguaccauaggacuuauucuacccaucuccuuuucaauguuuauaccuugcuucucuaacugugaggaaucugauuccaguuauccuuaaugcauuuacuuauuugcccaguaucccuguauuuagcuaauuuccauggacuuucuucucaacccugguucugccauauguuguagccaugugagcugacuugcuccuggcucccaagacaaaauuuuaaaguaauauuuaaauaaauuuuauuucuucucuuccuuuauuguccaggucuuccaagauuuaccagccaaccagaaccuuccucaguuuaugcugggaacaaugcaauucugaauugugaaguuaaugcagauuuggucccauuugugaggugggaacagaacagacaaccccuucuucuggaugauagaguuaucaaacuuccaaguggaaugcugguuaucagcaaugcaacugaaggagauggcgggcuuuaucgcugcguaguggaaaguggugggccaccaaaguauagugaugaaguugaauugaagguucuuccagguauuaacucauuaucaggacugaugguuuuauguuuaugaauggguaaacauuguucuguuagaauuuuuaaaaauaaugaauguuggccgggcgcaguggcucacaccuguaaucccagcacuuugggagguugaagcggguggaucaccugaguuccagccuggccaacauggcgaaaccccaucucuacuaaaaauacaaaaauuagccagacaugguggcaggcgcuuauaacuccagcuacucuggaggcugaggaaggagaauuacuugaacccgggagguggagggugcagugagcugagauugugccauugcacuccagccugggcgauagagcaagacuccaucucaaaaaaaaaaaaaagaggaauguuaauaugcgguaugacauuuuacugucagcauaggaagucucaguuucuuacagaagugaaaagaagaaaaugugccagaagauccacucuuuagggaaugcauuauuaaaaauuuaucaagcaauaaaguauauucacugucuaaugguauucuucuuggucaaaaaaauauuagugcugugucuuuugucaagccuucucuccaacaauaggauauuuuuauuguuaggucuuuucacuugugcaaaucagagacccauccaggcuaguucguauaagggauggguugggugguaaguguuaacaugguggcucuagagacaauggcaggcaagaguccuuggaucuuuauacuccccauuuuaguguaaauucagcuccuauuucagucuuucuucuuuuugugugucuucucaguuccugccccuucugguguuccucauaaucaauuuuguauaucuuuucucacuguauaacuucugcuuacucauaacuuccucccaguuguagcucaucauagccccucuagccuuuugguguuucaugacuguuuaccuucuguucucacugcuaggugcccccuccauauuucucaucucaaauuugaguuucugaauauaauugaacuaucccuacauuauuugggaagaguuauaugucuauuaaauaggcucauuuuuaaucuauggacugguucgcaaagcaggacugugagcuacaacucuugaggguguuccuaauagcccuucaacucauaaauguagguucuuuuuuugucguuaucccucgucauuccugucucaguauauucucagcaaggacaguaucuuuuaaagugugcguuugugcgugugugugugugagcgccugugcacgcauaugcauauguguaugugucuugagacacggucuugcucuguaacccgggcuagagugcaguggugcgaucuugguucgcugcagccuugaucuccugggcucaaguguuccuccuaccucagccuacgaguagcugggacaaacgguacacaccaccacaucuggcuaauuuuuuuguauuuuuuuuagagauggauuuugccauauugcccaaguuggccuugaacuccugggcucaagugauucuccuaccuuggccucccaaagugcugggcuuauagguaugggccacaguggccagcgugagauguauauuauuagaucuugucacaccuuugcucaaaacucccuaaugguuuuccaugucauucagaguuaaaguucugggcuguaaagauuuauaaucuuaauaccacuuccuuccuuucucuccccuaucccaucuccuacucuuuucucccucacucgaagauugugaucacuuuauguuucuagaacaauccagauaugcucuuggccauuuucucuuucuggaauccucuuuccucagauaccugccugggucacugucuuaccucucugcucaaauaucgcuuuaucagugaagccuuccuugaacacucuguuuaaaacaacaaucuuugauuuccacccccaguguuuucuccuucuaccuucauuuuacuucagaacauauuaccaucugacauguucuaucuuacuugucucucucccucauuaguauguaagcucaaccagagcagggaauuuuugucugcugccaaaaacacuuucuggcacauagaagccaguaauauuggcuaugaauuuguuuaauugauucuaucaaaauucaauuaaauauaccuaaguaauucaaguugaauuaaaaaaaagaacuauugccauauaccaauauuauucagucugcuugcucacuugcuuuuacaugacagagguaauacuucucaacaccuaggguagcauuuaagcaaauccucaaaaucugaauccaagaaaacaagauuuguagugucaaaaggugagaucacuacucaacaucugaaacgaaaacauaauguggaauguuuugcuuacuuaaguaagggagaguugugcuugucaaacauaguuuucuugagcaaagcuaaguccuuaucuccuauagaguuuuucagaagacauuguuuuggguuguacugguuaagagacagagguggauuaaugucagucauagaaauauguuuugugguugauuacggaggugggagcaaguuaaugucagccuuaaaagucagugacuccaccauuaguuggcugacuuuuaaagccugggcuuaucacugauuggcuuucaaagccacauucacccuugugaguugucacuaaucgauuaggcaauguuuccuuguuaccauggcuacaagacugucauuaauugguuagacaaguuuaaagcuaguccuggagguuguuaucauggcuguagaacaucuuuuccaaagcauaugggcacaagagucacaucucuucugccugagaccuuuuugucaaaacucaauauuaaguuaauauuaccuuauugaggagagaacucugucuucugcccacaagaguguggccuuuucauguauucacaagaggacaacucuauaaagugaacacacauuaauucuaaugucugaauaagaaauacaaaaauauagugguagcuagauuguugcucaguuacaaaaucaagggacugacagacugagcaaguuaaagagacgaaacucagaaagcuuuucagaaauaacacacagauacagggaaggaaaggaaaccucuuaucccugugaguaaggagaaugccauggguccugagcuugcucagucuccacuguuuguacacauggcuuuuaucuuaucuuucaaugugaaugggauucaugucaaauaucucucgauugauugacaaguacguacccugaaggcaggagcaauaaguuauacauccuuaagaccccuaaagagccuagcacaaugcuuugcacauagaauuuauuugagaaguguuugcuaauuugaauggaaauuuuuguaucacuuuugcuuaaaauauuuugucauauaaagccacacagacugaauaagaaccagucauuccucaagauuaaagcaguaaagugcuuugucguguguguaugugguaaugauggggucuugcuauauugccuacgcuggucucaaacuccugggcucaagcaguccucccuccucggccucccaaaguaucgggauuaugggugugagccaccauguccagccuguuuuguccuuuaauuauugucuuuguuaauuuuuuuuuuuuuuagauccugaggugauaucagacuugguauuuuugaaacagccuucucccuuagucagagucauuggucaggauguaguguugccauguguugcuucaggacuuccuacuccaaccauuaaauggaugaaaaaugaggaggcacuugacacagaaagguaaguguugucugccuaaaagccuucuucagccuuagcuugagacuuugucauaucccauuugggacuauugacuaauuuaaaaagauuaucaacuuuauuuaaacacaucauaaugcucauaugucauccuucaaauauguucauaugauauauaugaugaggauauuuaaagaaaaagauacuuucaaaauauuaagagauaauuauucccuuuguuccuguugaagccgcaguguacucagcuuaagucuucaggauuuucuucccuaaauuguugcaagagcuuugguccugaguagccugagucuucucacacauucucauaugcauuuuuuugauaguaguuuuuccacugcacaaucaguaugagaaacugggcuggccacaguggcucacaccuguaaucccagcacuucgggacgcugaggugggcagaucacgaggucaggagaucgagaccauccuggcuaacacggugaaaccccgucucuacuaaaaauacaaaaaauuagcugggcguuguggcaugugccuguagucccagcuacucgggaggcugaggcagaagaaucgcuuuaacccaggaggcgaagguugcagugaccugagaucgcgucacugcacucuagccugggcgagagaccuagacgccgucucaaaaaaaaaaaaaagaaacuguauuccucauccuguuguuuuugccuuuugaauccuaucagaaaucacaaauucuucaucuuucacaaaauaccaaccacuuuacuguccuuccuaucuccucucauuacuuccuuaugcagugggugcuuuucuuagguguguucucauaagagaugugggguggugguagguagguauguuuuugcuuccaaaauaaugcugucuugugcacuguaggauguuuacuggcaucccugccuucuacccauagguggcaguagcacuuccgcauugugacaaccaaaaaugucccuggauacugugagaugguccuugggaagcaaaauugcccccaguugaggaccauuguucuacagcagugcuguucaauugaaauauaaugcaagccacacauguaauuuaaaaaugucuuacagccacguuuuuaaaaaguaagaaguacauguacaauaauaaauauaauaguaauauuuuaugugauguaccaguuaaugugaaauguaguucuaccaaaagaauaaaguuuauguuuagugggaaacauuuuaacacagcuuuagcuuguacauuuauuuuaaaauuucagaaauucaguucugcagucauacaggccacauuucagguagccacaugugacuaguggcuauugacuuggacagggcagaucuagaguuucccaguugcaaaaucaaaagugaacagacaauuuuaauuuuuauaguucaguauccaagacguagaaacagguaucuaucuaguuaucugggugaucagccuucagugaucacuggggaagauggaauacaaucagauuguuccccacgugcuccauuagcaaaacauggcauccuccccaauaucaccugauuucuuucucaucauccauccacucaccaacuuccugucuucacauuuugcuuccucccugucuuuccacuccucuuuccagcuaaauauuacauaagcaaagaauuuauaagacuucauuuuuuuuuuuuuuugccaacugaaacauagggaaccuuaaaauagugauaaaaaugugaaguucuuacaguagaaauuuuaauuggcuacaaguuagaacaaaaucuuuaucaggaguaggaaggcugaaauauauuauuuuaaaacauauuuugucaugaagggacauucugaagauauaaaacuuauauauaaugauuuuuuaugucagaaauaaaugugaggcuuucuaugauucucauuuguucaauaauuacucaacaaauauuuaccaaaugcuggcuaugucaugcauguucuaggugcugggaauagaguagugaaccaaauggaguucuugaucuuacagagcucauagucuagugggaaagagucagauaauaaguaaaaauuuaaaaaugucaguuuaugguaagugcuaugaagaaaagacaaauuauaucaggagugucaagagaaauagagguaagauugcuauuuuauacaacguguuagauaauuguucuuuuaguagaaugauucucagacuggggucugagugggccaggguaugcacaucaugauagaaaaguuucauaucuuccugaaacauccaauuuuauucaaagauauccuugggagcagaugauuuuuaacuaaaucaaaugugaauauauuaugguuaauaacacugcucugaauuuuaaggauaaagcaguagacuuuaagauugaguuaacuuauuucugccuguaguucucuaggcuccugaauacucagauuagguggcugaaaagucugagaagcacugccuugguaugucacugucucaagaagcuucagaagaaaauaagagcaggacaguguuggugguguucacauuggucuuuccagacucuagcacagugcuuggcccauaacuggggaggggaagugguggccaauauauuuagcuugaauaacccaaaguaauguuggaaaauauaagugaauggagcacaggagugcuuuugguuggauguauguaauuacccaaaauaucuuuguuucugcuagagccuuaugagauauguagauaggccucagcuaauaaauuauuuagacccaaaauuagaaagaggcuuagaaguugaaagaaaaaaguggcuagaaauucagauaguguuaggcuggaucuaguaaaaaaaaaagaucuuaaauaacuaaacauccuucuuuauuacucaucuuaagacuucuuugaaagugaacuuaagaacauuuccauggcuuuuauaaauguccaaaaauugaucuauauauuuaaccuuugaucaaauuuguucagauuuacaauaaucaucgcuaaugaaagagggggguggaaauggaucccauucacuaaguaguuuuauuuuaaagggagagaaucuggaaaauauaaaugcuaguguucaaggugauugacagaaaaauguaauuuaguagucaaauaauguuaucuuuuaauggaaugauagaucugaaccccacugcaagggaacagguuaaaaugcuugauauuauuacaauugacaguaguagaaaaauaagauuauuuaaaaaguaaauggaagacuuccacuucugggaaaauugaguagauauauuuuucccuauuccuuuugcuaaauacaccuaaaaacccuggauguuacaugugaaacaaacauaagaagacucugaaagguagagagagaaagacugagauugaguagcuagggagcuugagacccaaggaacagcauaauuguuaguucuuuuuuuucuuucuugagacagagucucgcucuguuacccaggcuggagugugguggcgugaucucaguucacugcagccuccgccucccaggaucaaaugaguagcugggauuauaggcaugugucaccacugccagcuaauuuuuguauuuuucauagagacgggguuucaccauguuggccaggcuggucucaaacuccuggccucaagugauccaccaaucuuggccucccaaaaugcugggauuacagaugugcguuacugugcccagccaacuuggugguuaguucugugggcucaguuucccgccccccccgccgcauaagacccuuucaggaaccugggcuguguuuugccucauauaucccagacuuggagcuaaagaagcuagcaaccuggaaauccuacuaggcacaaacaaaaaaagccucaacagaaggugcucucuagccaaaggggcaggaaaagagcaucucagcaagacaaaagcuguuagacuguacuuucuccuacuccagucaaacaccgcagaagaaacuguggccccacccuaccaugccagucaaagaccaugccaggagccuagacuuccacccuucccagguuguagugaagcaucucagccuccuugcuaaguggugucaaaguuggaguagggagccaagacuuuuauccuagccaggcaguaaugaggccccucccauguaaguagagaacaaauggagagccuccacuuucaccccauccagccauaagaggcaacccuucccuucacacuggggugguaucaaaggaggcccagcggagagucaaagcuuuaccaucauguaguagcaaggcucgcuucauggugucaacaccaugugaccaugugggggaacaauaaugagacaauccuaccccuucuacccagggaggcaucaguggaggccuaguggggagcuggaacucccaacccugcuaagaagcaaugaggaaaccccuccccacuuacauguuaauggaggcugagugggaaaccugaacuacccccaccugacaguaaugagacagcacccccccacacacacccacuuucucugcuagagugguguuagaagaagagagcuaaaacagaaggauuaaauaagauccagagugucauaacauaguaccuaaaauauccagguuucaguugaauguaaugcaucaugccaagaaccaggaaaaucucaacugaaaggagaaaagacagugacagagauuuuagaauuaccugacaaagauuguaaagcagucaucauagcaucacuucagugagcaauuauaaacacauuugaagcaaaugaaaaaguagaaaucucaacgaagaaagaggucuccucagugcagguuugaaaaaauuuaccucucuuucaaauaacaacaaauacaaaacuaaauuaaacaguuuucuuuuuugcuuuucucuucauucuuaccacccuaaagaaguugucuuuaacaucuguuuucuucuccguuucuuuaucugauguaucugcaagauuuuaccuucuacaugucuuuggaauccauccaugaaggcaccaugugccuuauucuaaguuacagucggugcaguggccuccuaauuguucuuccuacuuguacucuggccucauuccaaauacaccuucacacuccugccagagcagucuuuucaaagcucuuauuuuaccacagcacucucaacccccuacccacuuuuaaaaauguuuaauggauuuccguuguucuuagguuaaggacccaaauucuuaaaaugguuuucaaagccuuaugcagucuggcuccauccucauccuccucuauuuucuuacacuuugccacacugauuucuuuuagauccccaaaccacugugauccuuucugccacaauuaauuugcaugugcuagucuaucuuucugaaauauuuuucgcaccucauuauuuaguuagcuucuacucauucuucagaucucagcuuaaggguuacuuugucaggaaaaucucuccucaucccuaauuuccuggcagguucuuuugcuauaccauuuuguagaguuaucuucuaugucuguguuucccacuugagaugcaugacagcacugauuguguuuuugcucagugcuauauccccagcugcuaccugacacauauagacaaaccaauuaauauuuguuaaaugaaugaguaaaucucucuccuuaccuucuuuauccaacuuuuuaagaguagucaauacuuuuuugcuuucuuuuugucccuauuguuacggccauaaucuuuugcucuuuaauucuggaccauuguaauuauauaaucaaacuucugcuuuaguguuuucccauccuuuuuuuguuucuucacgaagucugagugugucauuacucugcucaaaagccuuucccuaagaccugaaaccauaaaaauucuagaagauaacauucaaaaaacucuucuagacauuggcuuaggcaaagacuucaugacccugaaugcaaaagcaaacacaagaaaaacaaagauaaauagaugggacuuaauuuaaaaagcuuccacacagcaaaagaaauaaucaguagaguaaacagacaacccagagcucgggagaaaagcuucacaaucuauacaucugacaaaggacuaauauccagaagcuagaaggaacucaaacaaaucagugagaaaaacaagcaaucccaucaaaaagugggcuaaggacaugaauagacaauucucaaaagaagauauacaaauggccaacaaacaugaaaaaaugcucaacaucauuaauuaugagggaaaugcaaaucaaaaccgcagugcaaaaccaccuuccuccugcaagaauggccauaaucaaaaaaucaaaaguaauagauguugauguggauauggugaaaagggaacacuuuuacacugcuggugggaauguaagcuaguacaaccacuauggaaaacaguguggagauuccauaaagaacuaaaaguagaucuaucauucgauccagcaaucccguuccuguaucuauaaugaggaauagaagucauuauacaaaaaagauaacuugcacaugcauguuuauagcagcacaauuugcaauugcaaaaauauggaaccagcccaaaugcccaucaguugaugagugaauaaagaaauugugguauguauauauauauauacguauauauauauacacauacuacucagcaauaaaaaggaaugaaauaacaccauucacagcaaccuggauugaaugggagaccauuauucuaagugaaauaacucaggaauggaaaaccaaacauccuauguucucacucauaagugggagcuaagcuaugaagaugcaaaggcauaagaaugguacaguggacuuuggggacuuggaggaaagggugggaggcgggugagggauaaaaagcuacauguugggugcaguguacacuguuugggugaugggugcaccaaaaucugagaaaucaccacuaaauaacuuuuucauguaaccaaacgcaaccuguucccuaaaagccuauugaaauaauuuuuuugaaagccuuuccgcuuggucaaaaaauaaaaguucuccuuagcacuccaagcuuuuccagacugacccuaggcuacucagggauaccuuaugcccagcaauacugaauuuacuugaguccauuggcuguauauauuuuuucacauuguuuuuuuucuuugccugcaucuuugaauuuuggaguucuaaaggcucgauggucuuuuuacugugagccaugaacuaauugaaugaauuaauucugccaagcaaauggacauuauuucucccagccuuuuuuuaaagggaguaaaaucaaucccguuaagaaagacugacugcuaugcuacugguacucacauaugccaaauaucaggcacaucaaguaucaacaauauuuuuuaguguaauuauuagauauaaauuacuguaucucgcuuucaaaaaugacaacuaguguuucaaauuauguucaucucagcuggguaucauauguauacauugcugauuucucauuugaugaacauuaaguuuuuuguuucugaaacuuaguaguaaauuuuauccagguauaaaauguaggauuuuaauuuuuguaaauuuuucuuauuuugugaggcaccaaagacccgucuuaucucuccauuuauuuuaucccagucauuccugcucuauuccauuauauaauaucuuacuucuguguuucaucagguaaaccugggauuuaaggguguuauuaagacauuucugauaggaagguugcuugauaaagguuagucaugaccuugcagggucguauuucuuggagaagucaccaaaucugauucuggcuuucagcuuucuguguccagaaacuuaaucaaguuuaucagauucaggaagacugauuaccuagacuuuacaauguaaugaaauuuaagccagacuagcacuuuauuuauuuagaaugagaauuauaaauguggccaagacuguauagucauuuccucugauuuuuuuuuuaauccuauaaggaauucuuuuuuuuuuuugagauggagucuugcucuguugcccaagcuggagugcaauggcgugaucuuggcuuacugcaaccuccgcuucccggguucaagcgauucuccugccucagccuccguguagcugggauuacaggcaugcaccaccacgccuggcuaauuuuuguauuuuuaguagagaugggguuucuccuguaaucccagcacuuugggaggccggggcggguggaucaccuggggucaggaguuugaggccagccuauaaggaauucuauaugaaaagccaaauuauaaucagaacguuuuuuaauugauccauggacacagacuagaaauguaacaguauuaagauuuggaagaaaaguccagccugugaaaaccaguuuagauguggaacuucaaaauaaaaauguauguauacauuuauuauuguguuugguacuguauuuugaauuuaugucaucucugaaagugacuuuuaaaguggcagcuuuaauuagguacuugucccuagaauuaacugcaucucuugcccuaugucagguaccuuuauaugucugauuuuguuaguaacucuccaaauuaacuaaacuuguucacuuuauacaaauuugaucagaguauugauuguucuucaauguuauaggauuauuuucuuuucucuuuaaaucggcuuaaauaacucuguagaguuggccaguauucaucaacauccugguugauaauggcaugauggugacugauuugugcccagcuaccacacccagggagcugcucucuggcaaccauucucucuuucuucccuuccucuuuuccucucucuccuagauaagcuaccauagggaaacuuucaguaggcacugugaccccaugacuuacuguuucggaucuaacauuuugcccucuuuauguuuucuuucuguuauuaaucucaguguggcauagcuguggugguguaacuaacucucagauugauuccagacuucaaaauuacauaauuuggaaaaaaacuggccagaauagggagacagggaugggcugaaggaagugaaauugguuccaagagugauaccccuuuggaaauaacuagaagugucagggauaauucauuguaacauuugauuugcauuugugauauuuaugcauguaaaauaugagcaaagcaaauuggacuaaauuaaauucugguaauuuuauauuagucuugguucaucuauagcuauauaaauaauaauacucuuuaaguguuuucucuauuuuauguggagaguuuuucagguauuauuuuccuaguacugaaauguaucuuuuuuuuuuuuuuuuuuuuaacacagcucugaaagauugguauugcuggcaggugguagccuggagaucagugauguuacugaggaugaugcugggacuuauuuuuguauagcugauaauggaaaugagacaauugaagcucaagcagagcuuacagugcaagguauguaaauauuuacuguauaauuuaaaaauccuguguacuuucugggucugcuaauuuuuaagaaauauuaacaugggcgaggcaauacagcaaaacaauuaaaagcauaacuccuagaccagacugcuuggguuuaaauucuaaaucuuauauuuccuagauauaugacuauaggaaacuuauuuaauuucucucaaccucauuuuccucagcuguaaaauggaaauaauaagaauauuuaccuuauugggaugauuugaggguuaaaagagcuaauacuuauaaaaccccuggaauagugacuaggauauugugaaagcucaauguuaguuauuguuguuacuauuuguaguggugguggugguggugguggugacaggaaggguaugaucuggggcaucuggaagauucacuuuucuugucucaggauguuuucugaugaagacgucucuguucugugaccccgaauuauuucucuccucucuguugguguccuuuucuuuugggugaacagaucacccaggaaggaguacacugugccucucaauauaacuugguuugaugauuugguguuuauuuuccucucuucauacuucugauaaucacugcaaggguaguuguucuuccuuuuucuccuacucuucccuuuuccccuuauagguucuuugauucagacgucagaaaauaaagauggcaugacuacauagucuuguuuuuauccccauuuccugugccauuccuccauauggaaauguacccucaagugcuggcuagaggugacuaaagugaccaaaggucacuuuucuaccucuucuucccacccccucaaaacucccagauugguagcuuucaaccuaggaagacugcucccagugcuguuucucccuaagaguuaggagugcuguuucacuccuaagaaugaaacucugaccgggacuguugccugaggaaugccccacaaauuggaguaaaucauagugguucugagguuccugggguucuuugcucggggccucagccuccucuuuucuuaaguucaccauuuagauacaauuaagaccuggccuuuagugcuuucacaaacauauauauuaccagagugguugguacccuugaugcacguuaguuuauagccaagcugaacaccugaauaauacaauuacucucagauuggcaaccaagugaauaauguaugcuaucucauagauaauuacuggaaaagacugaccaagaauuaaaaauaaccauaaauauauuuaaggagauaagaaaaauauuugcaauaugaugcaaaaacaagaaaauauaaacacagaaccaaauagaaauauuaagaaugaaaaauauacuaaaaauaaagaauaaagcaaucugcaugauagagaaagguaucccauuuuuaaauuuuguuuuauuuugauuuuuuuugagacagggucucccucuguugcccagccuggagugcaguggugcagucucugcucacugcagccucucccucugucaccuaggcuggagugcaguggcacaaucucugcucccugcagccucgaccuccuggguucaagcgaucauccugccucagccccacaaguagcugagacuacaggcaugugccaccaggcccaguuaauuuuuguauuuuugguagagaugggguuucaccauguugcccaggcuggucucgaacuccugggcucaagugauccacccgccucggccucccaaagugcugggauuauaggcaugagccacugugccuagccagagaaagguauaacauugaugagcaaacucaugaauuggaagauuacauugaggaauucucugagaaugcagcauuauaugauaaagaaagauaacacauggaguaaaaucuaagagauacgauagguauagguagaaggacuaucuagauaaauaggugucuuagaggagagaaaggaagagggaaauauuugaagaaauaauuaagauaaauuuuucagaauuagacuuguagaacaccuuagacuaaaaggacuaguagacuguuaaauaggugaaagaaggaaaaacccaccuugaggcccauuuacaguaacauacaauaauguauaauuauauauacaguaacguauaauaucaaagacaaaaaaauucuaaaagcuuccagugacaaagagcagaucaccuacaaaagaaaaagauuggauuguaccuaaguguugauuugagaaaucugguaucgggaggacaauagcguaaucuuuuuaagguguuaaaagauguugaauacacacaauuuauaugcauccaaaaugugagacauaauaaaaauuaucacacaagaucucugaagguuugcugcacaaagauacguugaaaacacuuuuggaauaaauacucaauaaaagauauaccugggaaauacugcaagagccuuuuaaaacaaagggggaguuggccgggcgcgguggcucgcgccuguaaucccagcacuuugggaggccgaggcgggcggaucacgaggucaggagaucgagaucaucccggcuaaaacggugaaaccccgucucuacuaaaaauacaaaaaaauuagccggcguaguggcggccgccuguagucccagcuacuugggaggcuaaggcaggagaauggcgugaaccugggaagccgagcuugcagugagccgagaucccgccacugcacuccagccugggcgacagagcgagacuccgucucaaaaaaaaaaaaaaaacaaaaaaacaaaaaaacaaagggggaguuuuaaaacagcucccagauucuuugacuauccuucuauagaguggugggguuuauguccguugcucuugaaucuaggcaggcuuggagcuauuuggaucaauagaguauggcagaagucauaugugacuuccgaggcuuauaaaaagcugugcauugguugucauacuuggagagaauuuuuuuaaaaggaaaaaaagaaaaagcagugcggauuuuuccuggcucucucgaugcuaagaauauacaauggggaaagcauagucucuucaguagaugguccuggaaaaacuggauagccacaugugggagaaugaaaucagauccuuaucucauauauguaaaucacauauacaccauacacaaaaaucaacccaaaauggauuaaacacuuaaacauaagaccugaacuguaaaacuacuaaaagaaaagaggggaaaagcuuauugacguuggucuuugcaaagaccaacguuuuuuuggauaugaccccagaaaacacaggcaacgaaagcaaaaauagauaaauuggauugcauugaacugagacgcuccugccaguaauggaaacaaucaacagugaagagacaaccuauggaaugggagaaaauauuugcaaaccaaugaaaacagaagaagaaaaugauaacaagagcaaaaauuaaugaaauaaaaaaacaaacauucaaaacagagaaugucagcaaagccaaaaguugguucuuuguaaugcauaacaauauugauaaaucccugggaagacauacauuacuugacagagaucuuuaucuagacccgggguuggcagaguacagcuugugggcuaaaucuuccugacugcuuguuuuuguacagcuuguaagcuaaaaauaguuuauauauuuuuaaauaguugaaaaauaucagaagaauaauauuuugugauacaugaaaacuuuaugagauuucaaaauuuauuguucaugcagucuuacuggcauacugccacacucauucauuuauguauugccuauggcugcuuucaugccacuacacaggaguugaguaguugugacagagaccauauggcucacaaagccuaaaauauuuacugucuggcucuuuacagaaaaaguuugccaaucccugauguagguuuuacaaagaacuccuacagaucaguaagauaaacaaagacagaaaccaauagaaaaugggcaaaagacuugaacaucgaccuggaagaagaugucuagcuagcuauuaauauuugaaaaagugguugucguuauuagucuucagagaaaugcaaauaaaaaccauagugggauaucacuguauuccacuauaauggcuaaaguugaaaagcucaacaaauaccagacauugguuaggaugaaaaccacuggggacucuaauguacuguugacaggaguauacacugacacaaucacuuuaaaauucugcuuggcagaaucuauuaaaaacuguacacuggcuaggcgcagugacucaugccuguaaucccagcacuuugagaggcugaggcaggaggaucacuugaggccaggauuugaagaccagccugggcagcauagugagacccuauaucuacaaaaaaugaaaaaauuagcuaggcauaguggcacacaccuguauuuccagcuacucaggagacugaagcaggaggauugcuugagcuaaggaauuugagguuacagugaacuacgauugugccgcugcauuccagucugggugacaaagcaaaaccaucucuaaaaaauaaaaacuuaaaaaaacuguacacagaaauacccuaugauauaguaguuguauuccuaggaguauacuuaccagaaauguauaauuauaugcccccaaaaccaugcacaauaauguucuuacugggaauaauucaaaucuccaucaaaauacaaauguagaguagucuuccagucauacaauggcaaauuaucagcaaugaauauugacagaucacugcuacauucgacaauguggguaaauaucacaaacacccuugaagaagccagacacaaaagaauaccuacuauauauauguaauuacauuguuauauauaauuccauuuguguaaacuucaaaaacagacaaaacuaaucuaugguuuuagaagucagaauacugauuacuuuuggagaagggcagaaucguuaccgaauguugcacagcccggcuucugguguguuuauguucaguuucuuaaucugggugguaguuacaauucaagcuguauuguucaugugugccacaugagaucaucucuuuuuuuacuguuuacagauuauaacucauaaugugcaaaaacauauuuggaaaauuuuguuuugagcccugucccauaauugaaagcauuuauuuuucagauagggaaagcagauuuugagaaauaguuggagagauauauauaaauacagucauaccugucugacuucuguuauuuuuuuaagaaguuauagcuauaggaaaugccauagugaguguuaauguagaaaagguuguaaguucauuuuucaucuguuaaauguuucagauuuauugucuuaucauuaacuccuggaguuucuacacaugcagugacgugaauuagcccaucauguauuuccugucaucucagauuguugauaacacuuaaaaugggucaugaggguuuuuuaaaacagaaacuuuuccuuuuucucuucaaacaguuacaacagucugugauacacaugucucccgugccaccaaaaagaaauuuuuccauuuguauuuuuguggaacaaauggauaaauucuaaauuggcuaccccuuugacauuguaaauaccuauaacuaaucuaccacuuaaguuuuaaaccucacugucuuuccuuaagccacagccuaugucacucuacuucuuugacucuucugcucuacucuuaucccuggccacauuaagacauugaucuccccuuuucucucagucuuugugauuucacuucccuuuacuucaugaucaguuacaauauucugcugucauucauuagaacucuuaguucucuuggcuucgggauaaaaagcaaauuccuuaugucauacauacagaguacauccagauccuucauaguuggcuuuuucagcguuaacuggagaggcaccacagaggagugauugagagcaaucuugccccagugcgccuggauuccagucucagcucugucucuuagcuuugugaacuuggccaaguuaauuaauuuaccuaugucuuuguuucuuuuaucaguugaauggguuguuuuaaggauuaaacucuuuuuuuuuuagaagagccagcauaaagcacuuuuauuguaauaauaaaauuggaaacucauaugugauguuguggggagaggggcaacaauuucugucaccaguucacuacacaggacaucaaaggagugacaagggacugaagaaggaaaagccaggaaacguugagaucagcagagagagucaaguggcagaaaacaggagauguugaagcugcgaugacaagcaucauuugcuuaacauucaaggauuugucaugauagcugggcuuucauugggugguuaagucuacaaacaacaccuuuaauuuauacuuucaauuaaaguucuuaaaauuaaggaagugguggagcuuggaaaguuaugagauuacaaaauuucugaaaguccauuagaaaagccacaggauggggcagaggaaauaagccaggccaccaagaaggcuucagagguccccgcuggcccagggacagauaccuguagcauccaacaucgcagugaaaaugaucugcuuucaaaaggcagaggauuucaggggaggguagaguggaacugauggaggcaaaggcuccccauccccaccucaguuuuugguagggcuuuuaauuuaaccgaaggacaucuuucaacuuugagaauaauucagcccucaagagugcgucagaucugcuauggcuuugcagcgcaacagcaagaauguuuaguauauaauagauuaaaauuucauccaaaaaaaauuuaaaauaaagauucuuauaaccuccccccacaacacuaaauccuguucuaaaguuaaccagucacuuguucuguuaauauuugaccauagacuuacuuggaaacuagaucgaaaagacugaagcugaaucaucaccccaaagugaaaaugaaauaaacugaguaacuuaaggcuuauggcauauaguuuaaguaaaaugagaagaaagaggaagaggaaauggaggugccagaagcaaagcugagugacagaacgcauucagucaggguagauguuauacagguuguaguggaucuacauguggaaaagcuccauauggauuuaugugcaugugucuggaggcaccagauccuucuguggcagauguaagaacaggaagccaagggaggaggccauucuugccaucccagucuuagaagcuccauguugaagacaagaguggcaugaugcccuggugcccaguggcacugaaagcauagucuagagauacauucaguuuggcucugugacccacauucaucugggcaaccccuaccucccacucccgggucaccuucugcuugccuagcacacacuuaaagggcucauuucuguccuuugaagagucaaauuucuuuccaucuuaaagcaucccggcuuccggaagguauccaacuccuggggagaugaucuccaccuucgcucccaggacaucggcggaugccggugggcaggcaguguggacugagagggaccugucagugguucccaggcucugccucaucccugcuguccaucaucugcacacaugggcacccccgcacgccccguccugcacuaggaguaaauucuuagcacuuucccccuaaaucuggaauggagauggaguccucuuuaccaaauuaguuuucugaacauacugugcuguuugauagcaguguuccccuguguccccuuacuuccaacuacaauuuccugauagacccucaagauuaguuuacuugaccccucugugaagcuuuucuuaaccauccccucauaauugguuucuuaaaauaguucucuuuuuaccaguaguauuucuuacugauuuguuuauauguccucuucaacuccuacuagacuggaguucuuaucaacaggaacuggucuuacucauuuuuaaaaaucauaguagguuauuaacgaauggaaugagugaaugaaacuuuaaauggaaauuguuaaauguggcaccagaaugauuugauuugauuugauguuugugguuacuuuacuauucauguuuuccuuugcacuuuguuuuucauagacuucuaauguaaaagaaaugggauuaaaagaaaaaucuucugaaaguuauucuggaggaagaugaaccauuaccucuacuuuuaugauugaggucauaauugccaccuucacaugcauacauguuuacaaacaauucaucaguuuuauucauucccauuuuugaccuuuugauaccuuccauaagccaacauaauauuaaaaaaaauaacugaagccauuaaaggugaacuuuccuccacauggcugccaucucugcuuuaaaaacucuuacacauuuauuacugucaugauucaaagcuaagugcauugacgucuuuaaucccaacuccaugagaugcuccacuacuuugacuugauaccagugugucaugcuguuucucuuuuuauuucuuugcccguuccuuuuguuuugccuucaugggcaucuuuucuuccacuuguugauuaaacuauuaguguuccaccgaguucuguugucagccugcuacucuucacacucuaccugcuucugguuucagguauaauuuacauacaguaaugcccagauucccagaccagaccccuugucaagcuucagacauuugcaauuggaugucccacagguaccucagaaaucgcauguccaaaauugaacuuaacauucuucucucaaaauauuuuucuucuuugauuuucuguaucuugauagugucacugccuaccuuuuuaccugugcuagaaacaugaaaaucauucuugauuauuucaaucuuuuuauuuuuuuuccacauucaguucauuagauucucuuucuccuugcuuucacuccccugauucaaguccaagucaucucuuaccuauauuacugcaguaguuuccuaacugauuucucuaguucuaaccuggucucuccucaaauccauucuucacagaguggcaaaagugauuaaaauucuuucauuaaaaacuuggaaaaaugauugcaaugauauaaauggugcuuacaaauuaauaagaacaagauuaauaucuguuaaaaaaggggggagguggaaaacauaguuugcuuacagaaaugagaugaaaauggccaguugaccugaaaagaguucaaccccacuaauuguauaagaaauacagauuaaaguagcccauuuuugcguacugauugaauuuuaaaauaauaaccuacucuuggcaaaauuauauggggauucucauacacugcugguagugguacaaauugauguaaccuuggagggcaguuugguaauuuuaucaaaagcuuuaaaacucacacauucauugaccagcaguuccacaucugauaauuuguuuugaugaaauaaggaugugugcaaagauuuaugcauggaaguaugcaugcaaugauguauauuuaguggcaaaaauuauaaaccacuuaaaugcccaaaaauaggugauugguuaaauaaaacagccuaccuauguaucagaauacaaugcuuccuacaaaaaucauguuuuagaaguuuguuaaauggcaagagaaaauacuuuggguauauuaaaugacgaaaaguaagaucccaaagcaacaugugagaaguaugauuugugccacaaaguuacauuguaaauugcaucagauccuugacuuucuuauaaaaauuagccucacaccaauuaggaagaagcuuuauguaucuuccucuugaggccuucucccuguaauuuucagaauacuggauguuuacuuaucuugaaaggaucauuuuucuucuaagcuccaagcagagagagaacuggauucugaguccauuaaugagugcaugauugucauugcuucucaagguaacuuaauuucaagggcaaccacuagcuacuuaaaaacaccaugcaguuauuuugcuuguacuaucacuucugccuagaauguuccuccuuccacucccuugccuggcuuuccucagaaaccucugaaacucugacuccuaccuauuccuaucccuuguacccuucuuccauuagcugugcauuaauuaugcacauguauuuuauacauuaucugucuuguuuuacguaucacauuuacauuuuccccccaguuuuuguauccaguuucuacccuacuagacugaguucuuugaggacaggacuggaucuugucaaucuuuagauccuuagcaccuaauguaguagugccugaugcuguguauuugaccacaacggauugcuuaagaacauauucuccguacuucuggauaagaugucagacaguaaauuauaauccauucuuuuauaguaugcuaucuguauucagaauauuucagaauuucacuuuauaaacuuuauauuuuuaagguauuacuguauguuagaaaagucuuuacaauugcuuuauaauccuuuauuggggccuuaaucauuuuggauugguuugcaguucuucuuagauuuuuauugcaucaguggucauguuagcuuugagauaaauuccacauuuuacaagcuugaaauaauuuccuaauaguuauguaaauuuauucugaaccacaguagccucauuuccaugguaacuaaccaccuucagaagagaacuuucagauauucuagaaaagaccagaaauauccaugugaaauaaaaugaacuaaugauguaaaguuagaacucagauuuauguggaguacagaugcaugauauuggacccugaaaauguugcagauagaagagccguucaaagaccugaagauucugccuguuugcuguuuguacaucaggcaaaaugcaaccuaagaaaaacucagcuguauugugauuuuuguuacuaaaaugaccccaaugaggaagcuuugugggacaaauaagcaaaauucauggugcagaaauggauuuguggugccacuaagagauuaacauugugcuucacagaaggaauguggucucaugaaaggauauaugguuuuuggaagcauaucccugauuucgagccucuggcaaugugaucuugggcaaauuaauuuauuuacuugaaccucauucuuccuauuuguaaaguagggauaagaguccuucuuuguggugguguugugaggaauauccuugauacagugccugguacauuauaggcauucaguaaauguaccucagcuaauguucccagggcucagagaaucuuuccuuuguaagacuccuucacuugauucuguugucuuugauuucuuuuuugccuucuaaaggauucuguuuccuccuuagauuauuuaaauugacaucucagauaacuuucuguuugcuuuuguuccaugccaccagccauccaucagauggcaccauguuuuguggucuuugagccaagccagucacaccccauuccucaugcccagucuagcuucuuaggcuuucucaccuaagucugugcuugcugggcuccugccuaucuaggacaacaugacaaaauacuaguaaauauucuucauucuuuauuuaaagagcauaacaauugauaauacgaggacaaagucaugucccuuccagcccagaaguaagugaaaagauuugacuaucauuguuggcauuacucugcuucuuagguuaucugucuugaucucagaauuucaagcauuccuuaauaauuagcccacucugggucucuuauuuauuaauuuuaacuaucuuuucuuggauauauauucuuuuauuguauauauucaguuuuauugguggaaugucuuuuuuuuuuuuuugagacaaaaucucacuaugucgcccaggcuggagugcaguugcgcgaucucggcucacugcauccuccaccuccuggguucaagugauucuccugccucagccuccugaguagcugggauuacaggcacccgccaucaugcccggcuaauuuuuguaguuuugcuagagacggguuucaccauguuggccaggcuguucuugaauuccucaccucaagugauccacccaccccggccucccaaagugcugggauuacaggcaugagauuauacugcaccuggcaaauguuuuucauguaguauuuacuaccuuauuuuuauugaaccauauuucuucugccuuaaagggguaucaucaaaucuacaagcuuugguuaagagaaccaugacaggaagaaucuuaguaauuuuaauuauauugucaguaagcuucuuguauuaaauauauugaaucucuuaaacuucauuuaagaaauucccauucuccucuucaauuuuaguuagguuccccuuucuucauuaaagagaugauagaauuaggaacagcaggaaaaguggagcaguuuuauaauuuuuuuaaaugcccccuuucuugcuaaaaaucaaacuaaagagcuccaaagugggcaguggaaagauaauguccuagugaaaagaauaucuaaaacagguuucuucauuuuguauuucuucccccgcuaccuauuucuaccccuaacuguuaaggguguauugauggcacuuucauauaaacccaguuuacacacaggaauggggucuuaccccaucagguccccacaggagcauuuuauaucagagcagcacaguuacccucaguuuaucugaaaguuacaugcauugaauggugauuuaaauucugagaauaacugacaaaaagcuaaaugaaucuaaauuauucuacuuuuucccagucccuauuguaaugauaaccaagauuucuuuggucuuuuuuggccagagaagucucuuagguugaaaucauaucagugguuuucaaacuuguuuuuuuuuuuuuggccagggaacucaagcaaaaucauaauuggaagugagauauuuaaaauagauaaacauggaacuacucagauggaagcagggcaggguaggaauaguugccacacccagacccuccauuccuuguuuagauuuuuuucuuguugaugauuucaaauacagaguuuuguccaggggccguagcucaugccuguaaucucagcacuuugcaaggccgaggcgaguggaucacgaggucaagagauugagaccauccuggccaacauggugcaaccccgucucuaccaaaaauacaaaaauuagcugggcgugguggcaggugacuguaaucccagcuacucgagaggcugaggcaggagaaucgcuugaacccuggagguggagguugcagugagccgagauugcgccauugcacuccagccuggcgacagaguaagacucggucuaaaaaaaaaaaaaacaggguuucagugaccauguuaaaaguaacagcaaagauacuuuucaaacacuauuuauucuguaucuacugcaaauaggcagaaggcagaauccaguaucacuggagauacaaugacauauagggcacauucucaucuucaaggauacaguaggugauacagagaaguaguuagacauuucugucccaggaugauaaaaacuauaagauuacgugucaacuaugucuuugagacuuauucuuguccaggugauuucagugauucuugugcagaaaguagaaggaaaaaaaagauacgauauuuuuaacagauaaauuuauucuuugaauucuuaacaucacauuaugaauuagaaaugauaguacaucuaaacauuuuuaaaauauuuaagaaauuuuuaaauuacuacauaauauuuguacauauuugugggauacaugugauauuuugauacaugcauucaguauuuaaugauaaaaaucaggauauuugggauuucuaucaucucaaacauugaucauuuccuuuuguugggaacauuucaaaucuucuaguuauuuugaaauauauaguauguuauuguuaauuauagucaccuuauuguugcuaucaaacacagaaacuuauuucuucuaucaacuguagguuuguacccauuuaccaaccuucuucauccccucucaccuugaucucuugcccagcacacacaccuuucccagcuccuggaaccugugaaagaucuaauucaguaaugaucacagaccuaaauaguuuguaguuucaaagcagaauuuacauggacugaauuugacuugugaacuuugaaauccugagaaaugggucagaugguuguucugugccauuuucaaaaccaaaucauuuuguaagauccugcugucugccauccuuuuuaaaucauguuuuacauaguauuuuuuuaaaagaacuauuuuucagaauacagugcuuuucuccuuuuuaaaaaaucuuaaucauaguaauuucccaauaagaaagcaaaggugguaaagaauacuuuuuccuaaggaaaaaauauuuuauaauuguuuucaacauuuuuuuguguuagacauuuuucauaauaaaaagcugaaggaauuuuacagcaaauacccaccaccuucagucuucaguugacauuuuacuguaaugcuguaucaaauaucuaucauuauauuaaucaaucuaaauuuuuuguuacauuucagaguaaguugcagacauacccagauccuuaagcauucauaucauuagcuaagcuuuaauauuuuguuugcaguuuuuuucucuuucgagguaaaauuuauauacaguguaaugcacaaaucuuagaugugcuguuuauguguuccagcaaauacacauuacuauacaaccaaaacccauauuaaaauauaaaauauuaccaccacugcagaaaguuuccacauuccucuucucaguaaauccucugcuuacuaccccagagggucuauucuuuuguuuuuuauuccccacuauaaauuaguuuugucuguccuaaagcuucuuauaaaaguaaucauguugucuguguuuguuuguuuaaggcuucuuucacaaagcauaacguauuugagguccauccauguugcugcuuguauuagaaaccuguucuucuuuguuaaugaguaguauuucugaguaguguaugccaggccuuuucccagaguggucauaccaguucacauuccuaccaacaguguaugugaguucugguugcuccacauucugacccacauuuaguggugucagucauuuuaacuuuagucauccugguagguguauaguagcauuucuauaugguuuuaauaugcauuuuccugaugaguagugauguugaauacuuuacgauugcauauuggcuguucuggcaucuuccuuugugagguauuuucuaaacaguguugauuuccuggguagaugguacauguuauagacauauuaaaacuaauucuuaaaguguucugucaggaaacugucuacuuauugauaccugaaaauaguggacaauaaaaaaaauugauauaauuucaagccuguuuuacaugucuuuagaaauaguugauuuuagcuauuauuuauuugugaguuuguucucacacugcuaugaaggaauacccaagacucgguaauuuaugaaggaaagagguuuaauugacucacaguucugcagggcuagggaggccucgggaaacuuagaaucauaguggaaggggaagcaaacauguccuucuucacaugguggcaggaaggagaagugccaagcaaacccuuauaaaacuaucagaucucgugagaacucacuaucaugagaacagcauggaaguaaccacccccaugauucaguuaccucccacagggucucucccacaacauguggggauuauggaaacuguaagucaagaugagauuuggguggggacacagccaaaccauaucagcuucuauuuugauuauuuugggauuugaacauuuucuccauguaaccauuugaaauucucuugaagaagcaaaagaacaaucucaugugcugugaaauaccuguuauuuauaaauggauucuaaauauuuuuggccacauaaacuacugguucagaauaucugugccuuuaguaaauaauugaauuugccuauuguauuagucaggguuauccaaagaaacagagccaauaggaagcauaaguuuuccauauaaauaaauaaauacauaaauacauguaugugugguguuaugaaauauguauacauauauugguuuucauccccaguuccuggcgcauaucucccauagccuuuguuacagucuucucuuauguuggguauguuaggccucaggggcaggccuuaggaaacagaaucucucugaucuucuccugcccuccuuucaccugccccaaggcucuaaucuuccccagccuuucugaugguggguuuuaggacccuucccaaagaggggcccaccucauaugcuggaggaaagaauacugacaucaugaagcuuucauaaaaacucgggaggaguggguucagagagcuucuggauagcugaaaacauggacgcuccuagagggugguaccccagggaggacauggaagcucugcgccccuuucucccuaccucacccuacacauuuccucauuguaucaauguccuuuauauuaaaccagcaaauguuaagaaaguguuucucugaguucugugagccgcuccagcaaauuaauugaacccagagagggaguccugggaaccuccacuugaaacacauuggucagagguucuggaggacuaggcuuguaaccgguugggggugggaggaauucuggggagugagcccucaucaugugcaaucuaaugcugucugcagguagauaguguuggaauugaauuggagaauacccagcugguguccacugcuaggugugugggggggaaacucccacauaauuuggucacagaagcguucuucuguguugaugauugugguggugugagaguagaaaaaaaaugcagcuugagaggguguuuuugaaacuguggguguauguuuagagaaagagagaagagacuuuuauuauaaaguauugguucacgugauuauggaggcugagaagucccauguucugcuguuucuggagaccugagaaagccagcaguauaguuugaaggccugagagcuggagagucagugguuuaaauucugcugugagucugaaggccugagaaccaggagugcugaggguaggagaagaucagugucccaacuggaacaggcagaaaacaauuucagccuuuuuguuucucauuggacuggaugaugccaacacacauugagugccaucugcuguaacucaguccacagauccaaaugcuuuucucuucuggaaacacccucacagagaggcacagaaauagugaguaaccagauaucuaggcaugccauggcccagucaaguugacacauaaaauuuacugucacacauaguauacucgucuucaucuaauuacaaauaguuuaaaaaucuaauuacaaaaucuaaucacugcauuggcaaaacaccauuucuccccaaaacccuggagaaaucuucccaugcuuaugagguguaaauuauuugugaagcauuggcccuaccugaaaucugggucaaagggaacuacagaucuagagcauaucacaccaguguguuaaagugaaaaaauaauguaagcaaguuauauuggcgaaagucguuauugucagccccuuauucugggauuguaaugguugauuuccaaugauuacguaauauaauuauacuuuaaauguaaauaaugcuuuauauuauugagggucuaaagggauuuaauagauaaagugcacguuacaauaccugacuuacaucugauacugaacaaaauuuaguucucucuuguaaaacccuauguagagguauuguuauuaguccacugacugauaaagcuucugaaagccuccgaauuauauuuuccucuuuaaaccuuaucaaaaauaguuguuccauuuuaaaauacugcaagaguuaggguaguagaauuaugaggcauuuugacuugccaagaaauuuaauuauaguagaaauaauaucaagcaauuuuuauuuuauuuccaagguauaauuuauacugugucacauuuacauuauauggauauaccugacaaauuuuuaaaauaucuuucauauuaacaagaaaguauuuucacauauauuaggucuuauguccuuuuaaggaaaauugauuucccuaagauuacaaaacacauuuggaggcaaagcccagauuaaaagcucaggacuucugauuccuagucuaguauucuuuaaaaaaaaaaaaauuuguaauaguugguguauauauuuaucggguacaugagauauuuugacgcuggcauacaaugcuuaauaaucacaucaggguaaauggaguauccaucacccaagcauuuauccuuuguguuacaaacaguccaguuauucucucuuaauuauuuaaaaauguacaauaaauuauuguugacuguagucaccuuguuuugccaucaaauucuagaucuuauuaauucuaauuauauuuuugugcucauuaaccauuaccccccacccacuaccuuucccagccucugguaaccaucauucuacucucuaucuccaugaguucaguuguuuucauuuuuagcucccacaaauaagugagaacaucugaagcaugucuucugugccuggcuuauuucacuuaacauaacgaccuccaguuccauuaucugauaugagcguagcuaguccugcucacuuucaguuucucuuggugugaaauaucuuuuuccacccuuuuacuuucagucuaugugucuuuacaggugaguuuauugcaagcagcauauaguugaaugaaguuuuuaaaauucauuccaccaaucuauaucuuuuaaguggagcucuuaauccauuuacguucagcauuaacauugauaugugagguuuugauccuguuacauugugaauuguuuucuaguuguuuuauaaauuuguuguuucuucuucugucuuuuggcuugauggaauucuguuguguugccauuugauuccuuucuuuuucuuuuuuugugaguuuguuuuauaaagucuuuguguuuuuuuuuuuaacuuguguugucaugguggugaaugucaaccuuucauuaccacauuuaggucuccuuugagcauuucuuauagggcugguuugguggugauaaauuuucucagggaaagacuuuuucugggaaagaauuucuccauuuaugaaucuuaaucuugcuggauauaaaauucuuggcugauguuuggugguggugguggugauacugaugguggugguggugguuuuccuuacugcacuuugaaaaugccagcucauucucuucuggcuuauaaggauucugcugagaagucaacuguuagucugaugggguuuucuuuauagguaacuagaugcuuuuuuucuugcuaauuuuaaaauucuuucuuuuacuuugacuuuagacagucugauuauaauaugcuguggugcauauuccaaguccuuuuuggaauauauuuuccucaggaucucuaggccuccucuaugugaaugucuaacucucuugcuagacuugggaaguuuucaucaguuguuuccuuaaauagguuuucuaaacuuucugauuuuucuuuccccucaggaauacccguaauucacaaguccagucacuuuauguagucacaaacaucuugaagucuuuguucuuuuuuauucuuuuuaaguuuuugucugacuggauuauuucaaaagaccugccuuaaaguucugagauucuuucuucuguucaggcuugucuauuguugaagcuuucaaauguauuuuguaauuccuucaaugaauuguucaguucuagaauuuguuugaagauaucuaucucgauaaauuucucauugguauccuaaauagauguucugacuucuugguacugguuuucagauuucucuugcaaucucauugagcuucuuuaaaaucaguauuuuuaauucuuuaucuagaaguucaaggauuuauuuuugguuaggaccuauugcgggagaauuauuguguuccuuugaaugugucauaauauguugcuuuuucauacuuccuauaucuuuacauugguuucugugcaucuggaguaacagucacuacuucuuauuuuugaauuugcuuucauugaguggggagacuuuuuauugaagauaugucuauaauguugauuggauagggcguuuuggcuuuccuucuggguaugcgcaguggcuuuaaggauucugugugauuuccuuggcuacagauagccuuaguguuaaaucuguggauuuuucuguguguuagugugcaguuauugguggagucugugaugagguuuugcuggagacuggaaugccucauggguccuucagugguagugguggugggcuaaguaugucuaucauugugaccugguaugugguauaugcuggcacccauguugguaguuccagguaggcugauucuuuggccacuggguggcucucucaaaugccuguuguaguagagguagaccaugcaggugagcagacucuugaccuacugggaagccagggugguaugggcaaugggaauagcaguaguagugagaagcucuucucauucacaaguguugugcccuuguuuuaucaguuguugcaaugggcugugcaugucagccuccaggccaguagguggcacuugcagguaauagccagcuauauugucaacaguagguuuuaugccuaaccucuguuucugaggacaagugcuugcacaggugucccagaugguggauugaguugcagaauucucaggaaccuggaucccccuaaccuccacuucccucugcggaguaggggccaagcugaguggagcuggagcaggcaagcuuguacucaggccucccaauggugggugcaucuaccuuccuugacggggguggcagggcaguucucaggccccuggugaaauucuugggugagggaugacuguugcuaugccgaagucuuaacauggguauggaggggcagucccagcagccacagauguggcuuguguaaguaggacuuacuuccuucucaugccccaguccuggcagaguucccucccacuccuaacuguggcagcagaucagccuguucagucauggcaguguucugcaacucaguccagggccuuaggagauacaacccagcuuaaucccaagccuccauggcagcucuccuccugcucaggucccaagcagguagggggauaccccaguuucaguaucagcugcccauaccaguuucucaguucugguugcaggaguccagacucuugcuugagucccaguucuucaagccccagcccgaauuucugacaccaaagccuggcacugccacuuguucccaggaccauccacagcuuguuaagagcugggauugagaauggccucuuacuguagcugccuauaucugauggaauguaugggacgucccuggagcaguuccuuguccagucacuccccaggugagauccaggauucaggagggucaaggugcucuccuacagccuggauuguacaauuccccuguggaaacauggacugcagaaauacacucacucacccucuccccuacuggggauacauuccugauuuucagccaguccuggccacacggguuaccuguuuuccuucuucucagauguugaaguuuccuuuugcuuuucucuugaacucccaugcucccucuuggauaauauauuuaaagugugauugucuacacacaauuuuuguucuucuaaguggaugagauaugcuggaaaugcuucuacucagccaucuuggagagaaacuugaaauuucugaaguucuguagaucuuauccuaacucuguuuuauugaaaacuuuaacaauuccuacaucaauacuaauacuguuucccuuguugauauuuuguuggaaggaucccuucucauuguucuuuuaaaaaaaaaauuguuuuugaccaaaugugguggcucacaucuguaaucccagcauucugggaggcugagacaagaggaucgcuugaggucaggaguuugagaccagccuggccaauauagugaaaccccaucucuacuaaaaauacagaaauuagcuggcuugguagugcaugccuguaguuccagcuacuccugaggcugagacaggagaauugcuugaacucgggaggcagagguugcagugagccgagaucguccugcugcacuccagccugggagaaagagugagacucuuuuuuuuuuuuuuuuuuuuuuuuuacaauuuuuucuucuagauggccugcagauucagcuuguuaaauuugauaaaauuucuccugggauauuaaauggcauuucauugacuuuacagauucauuucaaaagaauugugauugauauauuuacagaauuaagucuuuguagccagguguguguguauauuauuauuaccauuuuuuugagacaggaucucacucuguugcccagacuggagugcaguguguggucaucgcucacugcagccuugacuuccugggcucaagcaauccuccugcuucagccuccuguguaacugggaccacuacgacacccagcuaauuuuuguauuuuuuuguagagauggcgaucucacuuuguuacccaggcuggucuugaaauccuggccucaagcauuccuucugccuuggccuuccaaaauucugggauuacagucaugagccaucacaccuguccucacuuuuauuuuuaauuaaauauuuuuaauagauaacauaugaagauguucuagaaaggauauauagugaaauauuacugcuaugucccagcccuccuccacagaagcaaccauuauuuuuuucuuauccuucuagagauauucuaugccuguucaagcaaagaaguguguaaaaauagcauaauagguguaacaagcaaucuuagagauugucaucaucaggagcagauccagcuuuuuugaggucugcagugaaaacuacuuuggaggccuuguuuaagacagugaguagcgaggugugguaauacacaccuguaauccuagcuauucaggaagcugaggcagaaggguugcuugagccccggaguuugaguucugccugggcaacuauagcaagauucugucucaaaaauuuuuuuaaaaagacagugaauaccaaacuauguacaaaaugaguaguuauuuagaacgagaaaagaaagcacaauaaacuaguuuuucaaagcugauaaacacuacaaacguuaccaaaacccagaaaaaacagcacuuuaaaaauauuaccuuauacacguauguguuguaauauuuguuuuugcugcauuuuguuucauugucuccucauaugucagugauuuuguaagucauuuucuaugaaaauagaaagcuaauuuggucuuuuccuccaguguuuaagauauagucauuugaauaugacuccacaccuuugugucucgguguuggguccuguuaguacagugggcagaaggaguauuccuggaagucuuccuauacugagacaguuuagguauacacaaaaguuuuggcgaaaaccacauaaauauaucccacuaaacccacuaaugguauauguagcucaauuuccucuugacuucucuuaaguacaaaaaugacuucagccacuccaucaugaccuggcauaagggcaagucaacauggaagcagcagcagucuugauggacugugguuaaaauagcuuacuauuuggugguuccuaaucuuuugcugcuucaguguucagggaauauccuuaugucuuuaugcaaaugugugaguguuucugauagaugaaucucuugaggugaaauugcuguaucaaagaguuuauacaauuuagauuuuuauagauauuacuaaaucacccuauaaaagauuguaucaauuuauaucaucaccaauauauauaagacugcccguuucucauacucuuguuauuugcauauuacuuacaugagugagguucaacaucuuuucucauauauuaggaaauucuguguauuuucauuuugugcacugucuauaucuuuuacucaguuuuuauuuguaauuuuuuucuuauuaauuuguuggaacuuguauauauuagggaaauuaguucuguuaucuguuuucccccuguucauugucuuuuuacuucaugauaguuuuuaauuauguauacuuuuaauuuuucuauguaguccucuugaauauacaaaaaccccaaaacaccaaacuguuguuuuuccuauucucuacuuucugcucaacgcagaaaaccucugugaucccagaauguggggguuauuuccccacacaccaagcaguacuucaguggacaccugcuguauguccuauaauucaguucaguucugacacuaccuaccuuucuauuuuucuaauagaaacaguacuacuuacuaaauaccgaguuuauuucauauguauauucuugccuccucaccauuuccauguagagauauggcacuggagagagugucauaucucacagguugagagcucaggaccaccagacuaccaucucucuucaggugguagucccaagucugggucuccagaacuucugacugacuagcuacagauugagguucccaugauccccuuguuggguuuuauuaauuugcuagaguggcucacagggcucagggaaaugcuuacuuaaauuuaaccguuuauuauaaaggauauuacaaaguguuaaacagcauagggcaagguacgugggaaggggcauggacuuuccauguccucucugggaaccacccuucaggaaccugcaugaguucagcuaccuagacgcucucccaaacccuguccuuauaaguuucuauggagguuucauuguguaggcaugauugauuacaucauuggccacuggugaucaauugaaccuugagcucaucuccccuucuggaguuuggggaauggagcugaaaauuccaacccucucauguuugauuccacuguuagguagcccucaucuggaggcuaucaaguaccccaucaagacuugucuuauuauaggacaaaaguugcuccuaucacccaggaaauuccaagagauuuaggggcucugugucaggaaaccaggaugaaguccaaaggcagauuucacaguaucacaagccaauauguuuaaauuuucuuuugugacuuccgaguuugugucauacuuaguccucccuccaagauuauauuuuuuaaaaaucucaugucuucuagugcuuuuauggcaguguuugguuuuaaucauuaaauuuuugauacguauggaauuuacuuugguguaagaaaugagauacaaauccaacauuauucuuuccaagugauuacaguuucuaggauuuuuuauugaguuauguaucuuuucccugauguaaugugucacuucaaucguaugagaauuuucauacauauuugcaucuauaguugugccuccauuuuuuuauuugaauagaaacagugcuacuuauuaaaaugccgagguuauuucauguguacauucuugucuccccaccauuuccaugucugaccacugcuacuacuguguccuaucauaacauuccauauaugcuuaaauccaagcaaaggguggauuuccaucuuuaaaaacuaagcaggcauuuuggacaacacauucuuggcaguggaacuuggacaacauuuaucaaacauauuagggaaaguucucacucuacauuauaaaaaggacaacuguauaucaaauguuacauaagugaaauaagauggaaacauuuuuaaaacugcuuaaacuauuuucuuaaagagacuuucuccacugccagagaucuugaauuaccuccuggucagucuuccagaagcaauucuuuauauaauugacgaacuuggcuuccacuuugggaagaaaaccagcuuuuucuguacuuccuugcuguuuugcuuuaaugucuucuacagaacuagguucucuugguguuuuaggaaguuuguuuguuuuuuuuucuccuguuuuuugaaggauucuugaucuugguguugaugguuuugaaucuuuuccauuuugguuugauuuuugugcauuuuuggcuggagugucucauacagauuucuucaguggagcuuauucuugucuccucuuccucuccacaacccggguaaccuugcuaccaccuccaggggcagaucacuuuccaaauguaccuaagaguuucauguccuccucuucuugaucuucuaagccucuucaccuuccuccccagcuccuaagugcuguuaccugauaugcacaggcccugaaccauacuucaacccaaaggccaugggugguguuauuucaaagaccccaagggaaaucauuggcuguucaaaucaucauguucaaaguugccacuauuacuuuauuuauuuuguuuuguuguuguuguuguuguuguuguugagacagagucucacucuguugcccaggcuggagugcaguggugugaucuuggcucacugcaaccuccaccuccuggguucaagcaauucucaugccucaaccugcugaguagcugggguuauaggugugcgucaccaugcccagcuaauuuuugaguuuuuguauuuuuaguagacuggguuuaauauguuggccaggcuggucucgaaccccugaccucaagugauccacccaccucggccucucagagugcugggauuacagaugugagucaucaugccuggccaguugccaguauuauuuuaauuggacugccuucguaauucauugucucugugucaacaaucugcaguucaucauuugcaccagccucuaagcugaccauucuuaaagauaacugaugcucauuuucaucauuauccaccuuaagaugguaauguuugucagccuuugguucacaaugaaaaacaugguccucaggccucaggggcucauguucauguccauugaaucuuccauggggugguggcacacacuuaggugggagagaaagcagauagaaaugaacaacuauugcuuaagagaacagccacacaggauggaaucaaaccaggcgauucuuuaauauuuuguuuccuuaauaaaauuacauauuuuucuuccuaaagguuuuauacuuuacuuguuagguacguaucuauuuuauuguuuuuguaguuaugaauuugguuuuuagauuuacauuuucugauuuuuuuuugauacguaagaaugugaaugacaacaaaaaacauguuaaucauuuauucugcuaguuuaccagagauuuauauuucauucuaauaguuuuucagcuuauucuuuuggcuuuuauuuuucuuuuaaaaauuauuuaaguaaugcaguaacauuauuaaagaaucaaaccguaucaacaaaguaaaccuccuccuuuauugccccuuccccauucccaccccuuuccucagaggaugacuguuauuaguuuaguguguaugcuuccaggugucuucaaaaagcauuuacauacauguacaucuacaaauaaauuuuuuucauuagcagauauuauaucaucuaguuugcucugcaaauugcuuuuugucauuacuguauuuaaauuucucucuguuuguaccuacaggacuauaaucaguauuuaaaugccccaaagcgauguuuaucaaacuuuaauguaccugcaaaccaccuggagaucuuuuaaaaugcugaaaccgauucagaggguuugggguggggaaacagagauucuguauuucuaauaagcucccagauguugccagugcuauugguccuauacuacacuuugauugggaaggcuguaacauaugcuuuagaccuauuguaguuuguguaauuauuauuccuguucaugaaaucauuggggucccuccccacuacagauaguacaguaaugcacauuggaauuucuccaggugagagagauuuucuugaauauucugaguagacagucauugucaugauguguguguaugugugugguaggggccggugguggauuucuccaacccuuuucccguauuuguauuuuguuucuuuuucuuauuuuuuuuuuuuuucuuauuuuuuuugagacagagucucacucugucgcccaggcuggagugcaguggugcaaucucagcucacugcaaccucugccucccauguucaagcgauucuccugccucagccucccaaguagcugggauuacaggcacccaccaccacgccccgcugauuauuauuauuauugguuuuuuuuuuuuuuuuugagacgaagucuuguugugucacccagguuggagugcaauggcacgauugaucucagcucauugcaacuuccacuuccuggguucaguccauucuccugucucagccuuccaaguagcugggauuacaggcacaugccaccacacucagguaauuuuuuguguuuuugguagagacaggguuucaccauguuggacaggguugucuugaacuccuaaccucaaguaaucuacccgccucagccucccaaagugcuggaauuacaggcauaagccaccacgcccagccucuuuuucuuauuuccuuaaauuagcuaggacgugcaguagaauguugaauagcuucaucaauagcuacucucugacaggaauaugaaauugguacagccuuugguaauauuuaccaaaauguaaaauacaaaaacaccuugacuuaguuauucccuuuaagaaucuauucuucuaaaacccuugcacaugcauacaaagauauguacaaggaugcauauuauagcauuuaccuguaguagaaaaaugaaaaguaaccuuaagugugcauuaauaggagaauaauuacauugggauauggucauaccauugaccuacuaugcuauauauguggcuacauguauacuaauaugcaguauuauuaagagagaaauacaaguugcagaaaauuaguuauugguugacucagucuguauuuuauuuuauuuuuuagagaugggggucuugcuaaguugcccaaauuggagugcagugguguaaucauaacucacagcagcuucgaacuccugggcucaagcagucuccugccuuugccuccugagugacugaaacuguaggcauguuccacaugccuggccaauuuuuuuuuuuuuuuuuuuuguagagauaggggucucacuauguugccuagacuccagucuguauuuuaaaaacaaguuaaguguguguguauaugugauguguuuuaaauacauagaaaaauguuuggagaguucacacaccaaaaauaugaauaguauuucucucuaaggaggguacugguguugacagguaguuugaagcuugauaaagaggaggcuuuuauguuuucuguguucuguacaccuuuuauacugaguacuuuucaccuucuuaacuuugaaaaugauaaaaaggaaaguagagagauggagaaaauaaagcaaacaauacugucaguuaacagaaaaauccaacuguagaacaguagggagaaucagagagcaggugaauucaaaccauccaguagucaauuuucuuaaauagucaacaagcaugguaaaaaaucaaaugguacaaaaacauaugugguacuguuacaguccugccaaugcaccacaguguagcaaucucuugugagauaucaccuggaguucagaguucuuugucucagugaugaagagaauuaaggggcguggacacaaagggugagguuggaacaaaaguuuaauaagugaaagaagacagcucuccacagcagagagaggacccagaagaggauugccguuuuuacaguugaaugcaaaggcuuuuuaaaagaaaccagugagggcugaacaucucauuuacguaaggugagaauuucugauagcucuacccaguccuccuaaugugcaugcaggcgguuagcuugaguuauuccauaucgcuuuguuccccuuacugcacaugugucaggagacgggauuuuccauugugggcaugucugggcaagucaccuguguagccuuucuuaucuguguggcuguggacaugucuuaggcaaaccucccugugcaaguucccuuaucugugccugcagcuugauuuuucagguuguucuguuugaaauaauuccacugaggacccacccuaacugccuaccuuaccgguuucuuccuuucuccucucucaguacugugauaccacccccauaccugcuauaguggcuucucucuaaaaacagaaaauagcaaguguugguaaggauauggagaaauuggaacccuuuugcacuuuugguacagcgaaaaguauaguugcugguaaaaaguaugguggcgccuuaaaaaaugaaaaacuagaauuaccauuugaacuaacaguuccucuucugggcauguuaccaaacugaacuucggucugcccacccagugcagcaaagcuaaacacugacauuuggauugcugcaaagagaaauggagauguuuauugcagggcaccaaacaaggagaaucggauagcucaugcuuaagaccugaacucuccaauggcuugcaagcaaggguuuauaaaggcagggggaaauuucaggaagguagaaguuauaggcaaaaucauaaggcaauacauggagguuauacauugguuuggccuaaaagggcgggagaucuugaagugggguuuacagguuguagguagauuuucugauuugcaguucauuaaggaagagaaguuuuguuuuaaaaucuggggaucagcagaaaagaauauuaguucuggcucaugggugugacuucucccaagucccucaggaagaacuuuaggacaaagauauucaguccucaguucccccuuaccugauguguacaugccaacagauccauuuggugggguccagguuucugaaaaacaacccagggacauguguccaucaaugauagacuggauuaagaaaauguggcacauauacaccauggaauacuaugcagccauaaaaaaggaugaguucauguccuuuguagggacauggaugaagcuggaaaccaucauucucagcaaacuaucgcaaggacaaaaaaccaaacacugcauguucucacucauaggugggaauugaacaaugagaacacuuggacacaggaaggggaacaucacacaccagggccugucaugggguggggggaggggggagggauagcauuaggagauauaccuaauguaaaugacgaguuaaugggugcagcacaccaacauggcacuuguauacauauguaacaaaccugcacguugugcacauguacccuagaauuuaagguauaauuaaaaaaaaaaaaaagauguugccuuuaguuucuauagggaaccaaacaucccacgacucuaacuuccuuggcuauuguuuuaagcugcuauuacccucuugcuuaucaaguuguucauuugcuucucagggccagcuaggugccuggaacuucucuugaaggaacucaagauuuuccuuuauuuccaugcugggggcgggggaggcccauaggccccucaagggguuccugcuccaucugagguccauguucaaaagaauugaaaguaggucucaaaaauauauuucuacacccacauucacagcugcauuauucacaauaacugaaacauggaaacaacccaaguguacgaugaugaaugaauggauguuagauguuguguauacauacaauauugagacaucaagcaaagauuaaguauguuuaacuuuguuaaagaaguggagccuauauuuaauaaagguuuuugugaauuuuucaaaauaaaaauugauauauagaauacaauuuuucaaaguuaagagcuuuagaccguaagacccaaaguuugaggaacauugcauuacaauuaaaucaugugaucacagagcuaacauguaaacaugagcacaaauguuggugcugaaauuucauguucaugaaaauuuuacaucaucauaaacauuuaaaagcaaaauuuaaaauucaugcagaaagucagacacucaagaguggacuuaggagaaacaaugauauaaaacauugaauucuuaagaaacuugagaauccuugaaaaaaauucuacuaauaugcauugagcaccuauuuugguuuaggccacugggauuucaauaguaaauagggcagucaagggcuagaaacaggaaagagugagggacugugugucaggaaaugcuucuuuaaggaaguuuuuuguuuuguuuuguauuuuugagauggagucucccucuggugcccaggcugaagugcaguggcacagucucggcucacugcaaccucugccucccaguugauucuccugccucagccucccaaguagcuggaauuacaggcaugcaccacaggguccagcuaauuuuuguauuuuuaguagagacgggggguggggggggggggucucaccauguuggcuagguuggucucgaacuccugaccuccagugauccaccugacuuggccucccaaagugcuaggauuacaggugugagccaccgcgcuggccgagaaauacuuuuaauuaguaucagauggaugaguaccuguuagcuaaauugagggcuaggguaaggaaaagacaaugagacuaggggcaggauugggaugaaaggagagaaauauaauuucauagucaaguggaaacauuguuauaauauuacuucaaacuuacaucauaaguuaaguuaugaugucaccuguuucucuuggagaagccuauucaccuucauuggaaugggaagcuuucucaagaaaugucagaggauucaaauauauucuugcuuuguuaguugagucaguaccaauaguacacuugugauuagacugucaaacaaaaucccugaagggauuucacacuguuaaaugcuugguuuuuauuuguuuuuauuuguuggguuuuuuuuuuuaaacggcauagauguaaauuugugaauuacagaaaagaagcaguuuuaacaugaaauggacaaaauugauuucuuucucugcuuacagagcuuaauaagaauuucaguccauaagccuuucaaaugaaacaauagaaacuccaacaauucagagcuaauguaaaugaaaacgguuaucuuccaaaucacagcauaauaaaguaaccuugaaucauugguguuggcccuauauuguuauuuauuugaauuaaauggcaauuuucagcauuauguaacagugauggaauuaagugauguuucuaguaaaagaauuuugcaaguauaauauauuuuaguauuaaauuccacuuguacauuuagcaauuaaaauuauuccugaaaugaugauggcauuugaagggauagggagcugucaaagaggauuugaagcuuaauuaucucuuugguaacaaaaugcauaaucuuccauuacaacacuuauuuucuuaugguaauugacucauuuguucucugguuaucaauuuaacuucccaaccacaaacaucugcucuuacaauuguguuuaauuggugugaauacuaucuacagaguaguuaaaauccagaaaacauuuuaagggcauuauuuuauaauucaugaaagggaaacuaaugauuaauugaacauugcuuaugaugauuuuuucuaauagucugugaaagucuguuuacuaaaaaugcauaccgaaauuaucugcuccccccuccuuuuuuuuuuuuuuuuuuuuuggaagaggcuuuugcuguguuuuccagaguaauuauuuacucugccuuagggggagccucaguucuugcaguucuuuagacucaaggaauauguuaaugucuuggaacaugguaccuuaguaguuaagaguauaggcuuugaagguagaaaaaaauuaguaugcuaucauuuauaaucuaaauaagaggauuggggacaaauuguggguguggguaugugcuuauaauuuucauaauggaauaauaaaucauaaauuuaccaguaggguaaaggaggaaauaggaugagagaaacaggguuagaagguagguagguuuguuugaauguaccuugucuuuauagauuuaaaaauuuacaaaguaguuccugaaacuggaaaguaaaaugaaacaggcgacuccaaagguguauccaguugguaauacagccacacaguaaguuacaauucuaaguauauggaauuauaauuccauguaaauuuaaaauuguaauuggacuauaauguaccuagugggauuuacucuaaggacacaacugcaaaaaaucuuugguuguuuucuuuuaucauauuguugguacagauguuuauucugagacuauggguguaggauaaaguaaaugaguaauuauguuagugucauugagaacagauuuuuggcuugagauacagauguaaaauuaagaagauucagcuaaaagcuacagucuuagacuuaauugaaaauaucaguaggaaaucaugaugaaguuuauauuuaaaaaauacaaaauugcugacuuuguccacaaaaagggucucagagcaaugaccauaaacugaaguccaauagagucaugugaaaaaggacucaggagcuuucacuguguucagguuuccuccauuggucaaauaugggauaguuuaagaaucaaaagaauaauaaccugagugaauugaaacaaaccaaauauaucuuaaacuaaaggcucuuaauacuuaaaugaaaaauccucagcaauuaccuuugggagaggauauuagaaaaccagcucacuguuuugaaaacguaagugaagggaaaaagucaagcauuuauucugccccuuuucgaaguacgguacuuuaggauaaccagauaauugugggguuauccuaauaauugaaggaauauaguaauaaguaauauaagggauguuucucuuuacagaaugagugauagaauaagaguauuacuauuuugcaccgccugaugggcaaugauaaccaaaggcuguuaacaucaccaaaagagagauagacacacaugaugaaccuccugauagaugcacauggaacugccuaugaaguagucucgggggaaaaaaaaaaaacuagccugacuccaaucaggguucuacauuuaacugugagcuuucagaaagaacauguuaaauaccacuauggcaauguggucagcaaaagacagauugcaggaaaaccuuauauuacaaaugacuugguuucuuaaacaaauuucaaacaaaagauaaagaggagucuguagauggaaaaaaaaaccuaagaaacaaauuaacaccagugaaugcaccuuguuugcccaauuugaauaaaguagaucauuuuuaagaacauagaggccaggcguaguggcucaugccuguaaaccuagcacuuugggaggcuaagguaggaggaucgcuugagcccaggaguuugagacuagccugggcaacauagugagaccuccucuguauuaaaaaaucaaaaaauuagcugggugugguggugcguuccuguagucucagcuacuugagcggcugaggcaggaggauuacuugagucugggaagucgaggcugcagugagccaugaucaugccacugcacuccagucugugcaacagagugagaacauuggccaguuagugaaaugugaauaccgacuggguaauaggugauauuaagaaacuauuauuauuauuauuauuauuauuauuauuauuauuauuauuacuugagacagagucuuguucugucgcccaggcugaagugccguggcacaauccuggcucacugcaaccuccaccuccuggguucaagcgauucuccggucucagccucccgaguaucugggacuacaggcaugagucaccacgccuggcuaauuuuuguauuuuuaauagagacggguuuuugccaaguuggccaggcuagucuugaacuccugaccucaggugaucaccugccucggccccacuaagugccaggauuacaggcgugagccaccaugcccggccaauaaauuauuuuagauaccagccugaugaugguaucaugguuauguuuagaaaugagaguucuuggcuuauagagguacucauuuauauaugaaauaguguaauacguggaguuugcuuucaaaauaauauguguguaggguagaggcugggaauggaauggauuaaggcauagaugaaucaguauugaccaugacuugauaauuguugaaucaacguaauagguacauaggauuuauucuauucucuuaaauaaaaaguuuuuuaaaagaauauagguuuuggagucagacugccuagguucaaaauccagaucugucacugacuaagccuugugcuauggaguuacuuagcgucucuguguauuaguguccuugccuauaaaauggaaauaauauaauauuaacugcauaauagaauuguucuaggaacuaaaugguuauaaguggaaagcgcuuaugaauguuagcuuugauguguucauuaucacacaucaaagauauacguuaaaguuauaaaucauuggcuaaagaucuuaguguacuuaggaauagucuaguugaauuccuuauuuaguaacccaggaguuugaaacccacauuuagcaaaauguccagugguagaaccagaacucaacuuuaugucucuugacuccuagucuuuacaacugcuucacaguaaaucacuucaaagaauauccaagagucaaaagacagaauuuuuacaaauuuaguuaaaugauauaauggcuuuuaauaguaauucaugagucaggcagcaucucaucuaaagaacagauaagcacuacacugggcaggcagaacaguuaguuuuuguagggaaacuugagcaggaacaaagaaacaguggauugguuaacauuaguugcuucagauuacuuucauuguaagggucaaagcagaggggacuuucuuauguuggcuaaaacugucccauuuggggauuugacacacacacucuccugauuucucagaaggucagauaaauaacuuagguuuaguuuggugauaugcaacuuuggcacgagugacugcauuuugguucagucuguuugguuugaucuguagaguagaagcucaauccauauuaguagucucccauaaauuuuauuuaacacaaguaagcuuaaguaaccuuguucuaaauagaaagacucacaguugcaaacaucuucaguuuuccuguaucuaaaauguauugcaguucaaaugaagacuccaaguucuuguuugucuguuugcuuugagaaggaacagacaaacuuaacauaagaugagucuaaauuuaucuggggaguggaacacuaaacaaacauguuagaaaaauuuugaggaaauaaaggaagaauauuuguuccaccauauauuauaacauauugcauaguuauaauaauuuuaugguucuggcccaggaauaggcagauggaugaaaccaauuaguguccugaaauaaacccccaagaguacguagauuuuaguauuaaaucuuucaaaucugucauucuuuuugggaugacugaucuugccagauauauguaaagcuggauacuuaguaagucuaguuuguuucguagaaauauuagaagaaaauacaagugaauguuguuauaguacagaagaagggaaagccuuuggaguaaaaauagugaaauacagaugcuaaaauggagagaacuuauaaauuuuaccauaugcaaacguaaaacuuuguuacaauagaugccuuaaguuaaagacagaagaggaaacaaauauuggcagcauguauagcuuacuguauuagucagggcccaguuaggagccagaaacuauacuaggcauuugaacagagcaaauuuaauauaaagaauuauuaauggccggucgcgguggcucaugccuguaaucccagcacuuugggaggccgaggcagguggaucaccugaggucaggaguucgagaccagccuggccaacauggugaaacccugucucuacuaaaaauacaaaaauuagccggacgugguggugcacgucuguaaucccggcuacuugagaggcugagguacaagaaucgcuugaaccugugaggcgaagauugcagugagccgagaucacgccauugcacuccagucugggcaauagagcgagacuccaucucaaaaaaaaaaaagaauuauuaacuauuaaaaucuacuuacuaaaaagggcaaaauaggacauuaaagaauacaaaaauaguaaauauagggauuagcuaugacuaccucuugagcugagggagagaauccaaaaaucaggaagacuguuguucagaccuuguugaagaaaguguagcugcugccaaaggacauagcuaugggccaaagcuggggcacaggaaauccccugcugggaggccucagagcuggugugcagaaaacaccugcuggggugcugugggcuggacagaugauaagccgaaaauugcccacugggaugacaugaguuggagcugguguacaggacccuauccaaugggaugcagugugucagagcuggugcacagaaagccccaugcuggaguaagcuagagaaacuuacaggagggugaucauuauugggucuuucacaaucagccucaccauaggagcaaaaagaagagcauccuccaaacugaaaauuaagcccaucacucugcuuugcugugcaacaaagcaccagcugacaaaaguccauauccacuacugcaaagaaggacagauuuggagcugagagccuugaaauaauaacucucauuauaccaaaagcucuuauauauagauaagaaaauuauaaacacucuaauuggaaaaacggcagcauauuuauauacauaauucacaaaagaauaaauacaaaaggcuugucauuguuugaaaggaucaagucaaauuugcuauuaauagauuucccugauuucaucuuguuguacagauuuauguuuucuggaucuuccaucacugugaauguauguuguuuccuaagauuauacaugauuucccuccuugggggagguucugcuugacugggguucuaucuccuuuuuguacuguuguucuucauuuaccuaaguuauguagcuaguuuagauuucucuucagggccugcucuagacagugcaauaggccaaaaaaguucuuuuuuaaaaaaggaaagggagauuggaaaggcauaaauaaaucugucucuacucacauacaagcaugauugucuauguagauaauccccaaacuguauuuacagaggcugauacagcuaaugagauaauuuaggauggccacaggauaaaagguuaauacacauaaaucaauuucauuccuacauacuagcagagaacaacuggaaauuuuaaaaaauuuaaaguaccacuuagaauagcaucaaaaguauuugaaauaccuagguauuuaucuaacagagcaugaaugagauuugcuuacugaaaucuguaaaacauuuaugaaagaaaucagacuuaaauagagagauaaaccuguguucagggaaaagaagacaauauuuuuaagacgucaaguugccacaaauucaacacaaucccaaucaaaaucccagcaggcugggcagauguuaggucaacuguaaauaaagcugcugucguugccauuguuguuguuauuucauagaacuagccugcaguggagcuugcugcuuugugauguagggaguuccugucauucacacuuuucaaauacagaucgcuaagacccuuugucaaggaugucauauaggaaauuauaucauuagguaggaugcuggacuagaucuacuucaacccuucuaauuaaaaauauuaugaucuauuauuuguaaguuagcaauuuacagcuguggggcauguggaaagggagcuacuggaauauucagacuuuuucaaauguacuuauccuuuccccgucacccuguaaaaccauugcauauaaugagggaucuuaguaauaggaguguguugcaugagugagcuguuuaaggacucuaaugugacguuuauuuuacuuuguuguuguuguucuuacuuaucaagcugacugaaaaggaaaguuuuaucaaucuuuuccacucuuugaauucuaauuauagcucuuaaaaaaugguauaaaucuuagggaaguauucuuuaauauuuauuuuuagacauuuuuaauuucuccaauauagucaacuuaguaaauaguuccaaauaaggaaacucagaaauuaucuuuaaaacaguuaguuguaccagcaaaucauuuuuuaaagauaauuguauuccuaacauguauuuuuuauuauauauuuauuuuaugcuuuugcaaaaauaugugaaagcuucaaauaaugaguaaaaauccuguggauuuuaugauuuaaaaauugguugaaauaugaauagcugccuaguucuauuuucauuaaugucuuaauuuccuuuuuauuuuaaagcucaaccugaauuccugaagcagccuacuaauauauaugcucacgaaucuauggauauuguauuugaaugugaagugacuggaaaaccaacuccaacugugaagugggucaaaaauggggauaugguuaucccaagugauuauuuuaagauuguaguaaguauuuuucaaagaaguguguuuauuucuguaaccuuuagauauuuuuaaauguagucaccgagagaucaguuaucuuauauauacuaguuuguguacugcaaaugaaauagaagaauucacauagaauguaauaccuucauuggcugaugagaaagcugagcccagaaauacuuugguagcuuauguaagaucacauagcaagucaguggcuuaccuaagccuagagucuagacucuuacuugaacacacuggcacucugaaacacagcugccaccauuuucuggcagaugauuagcacacaugugugugcguguauguguguccccaguugucuucacagcucucuguucaagaagcagaaaucuuuccacacuucuccuugaaguguggaaagaugauccuuuugaaaaacauaauauguaagaaugcaacugacuauacaaaacuuaaccuuaaaucguauaccgaugcccagacccuucaaaauaaggaugacccagugucggacaauugugguagcaauaguuauaaagauucuuuuuuaaaaaugcauuuaaaaagugucaaguguauuuaagaauacucagccauaauugcuuuuuacuauacuuuauauauaguaaaugauucuuagauauuaccuacuauuaucaucaauaucuaacauuuuaguaauagaauuauccagcuuuaguaauaaagauuaaugacauaccuugagaucuauacaugacauucauaaaaaugaucagaacuauaguuguuaaagacauaaugucucauuacaaauuugucauacaaguaaacauucuuagaaauauauuuucuauuuuugaaaugcaugaucuccuguugcaaaaaguaauuuacaaguauuuaacauuaaaaagcaaucuguuauaguuaaaauagccucuuaaaaucaauauuuggaaacuagaaaauuuuuaaaucauauuuauuauaccaauaacaguaguuaaaaauuuuuuuuguuuuuuaagacagggucucgcugugucacccuggcuggagugcagugguuugaucauagcucaccacagccucaaacuccugggcuuaagcgauccuccugccaaccugaguagcuggaacuacaggcacgcacuaccaugaccagccaauuuuguauuuuuuguagagaugggguuucacuguguugcucagucuggucuucagcgccugggcucaagugauacuccugccucggccucccaaagugcugggguuacaggugugagccacugcuccuggcccaguaguaauaguugacauucauauaguacuuuuucauuuaaggaaagcucacauggcuucauuuaauuuauuguagucuaaucuguuagaacuauugauauuauagauagucuuaggaaaaauaauaccuuaaauucacaaauuggacuuuaacuguggucaguugguauugcgugccagaucuuuuuccaggcaaagguguaguuugcaaacagugagaguaugacuuuccaugcguuaaguucuucaucgugaaugacaguauguacucuucuauucaguuaaauugguaccuugccaaugcuuuaguaugaaauugaguuaacaaguacuuggauaauauuuaauaauuggaucauaaaaacuuuacuuguuuuuuuccucuccaaaaagcauauuuuugagauuuugaucugguauuuaucaauuaaauuauguaauuuuauuuaugcuuuucuucuucagaaggaacauaaucuucaaguuuugggucuggugaaaucagaugaaggguucuaucagugcauugcugaaaaugauguuggaaaugcacaagcuggagcccaacugauaauccuugaacaugguaagaagggcugaaauagucagaugauagaggcugugugcuugaugaacaagcacccauccguccaaauaacucaugauugauaacccauuaguaaaggccaauauguggcauagcuaagagaaaaagaauagcagucuaaaucauuucuauuacauaaaauuaccuagaagcacaauuuuggauaauguugaaaagaaauuuuuacuaagaaaaggaaaacugaauauuauagucuuaauaaauuaauuuuuaaaagaauuuagucaucuuaaucucacaaauauauuucuguccuauaaagaaaaacuucuuuuuuuuccaauucuauacacuuuuauuaauacacuuacaaaaaauaacauucaaacacugagaaaacuaaauaacuuuggaagcagagcucauuguuuucugcuuacauauaagugacaauucugggcuguuggcacaaaauagucaacauucauaaaacccugacuacuauauaucaaacauaaguuaaaaucauaggcaguaguuuaucaaauccacguuucuuagaaaaacuuaguauuuauuuugcauugaaauuuuuaguuuuuccagaauacaauuaauuuaccuuuucugauuaccaccaaaaaaccaaguuuauuauuuaaaaauucagauaacaaugaaaaguauaaagaaaaaaauccauccuguaucucaaauuagggaacccacacuguaauuugagcagaguuuuaacauaaggaauuaacauugauauugggauuggaguaacaaagguuugacuaguaagaaguaaagagaacucuagacaauauaagaauggcaacuaucaggagcaacuacaaccccuaggucugagauagagcccucaggaagaggccccucuuuuuacggaugagauccagacccuguuggagaggguguaaccaugguuuacuggauggcagagaaguugaugugguguuuugcucucuaaacuugcucaaaaucuccuuucuugaggguuggggaaagcugcuuacagagagguaucucacuggaggcauucugcuacaaaaccacccaguggaucagguguaaggggaagcugcuggcuauaggaggcugccaggguaguacacuagaaccaggaaggaaacuccuuucuucuguacuguaucuccauugccuucuauugauaaaguuuaauacauaugccagcuggcaaaggaaaaguauauaaaggacauggcucuguuuuugcagcauaggcaaugaaaucagaauuuggagcugagaggcaguaaauugauaacugguacacacuucaaauccuaccaccuggguacacuguguaugguuuuauaauuuccuguuuuguugcaacagcaugcuguguauaucuuucugugucaacaguugaucugcaucaauauuguuucuuauuaaauaauauguauauauauauauauacacuguuuuauauaacagauuuuauauugguuaacauuuagauugucaccuguuuuuuccuauuacaaacaaggauguauugaacuuuuuaugugauuauuuucuuauacuaaauuacuagaaguugaauuauuggauaacaguucuguguuaaauugauaaggguaccuguugggugcauuauucauuuguuuuagcaacugaaacauuuuucauuuugagcauuucucaaaaauacaugaaaaagaugccacuuuagacaucugaucuuuuauucaagucaaauacaaucagguauuggugugccuccaggaagaauuucucugaugauuguaguuuggccagggaagcuaauuggcaaagauggcaccuacucuggcuuuucacuaacauggcauauauguaggauuuuugugugcuauuuuuugaaaaauauacuugagagugcuguuacagaaaagcauaaaauauuagaacugcuuuuuucuucuuagguuuguauauacccuccccuguuuauuggaaaugauuuuaguagaagcaugccauuuuuccaucuuggugaaaugccugaguacaauuacuaaauaaggcacuagcagaauuagugagguagauaggcuuauuucuuuuuacuuguggcagugacuuuucuuaguaaaccucguagcuauuugggguauauuuauuuacauggaacuaagcaaaggcacuucauuauauuuguguuugagauuacuguuacaaaucuaacucuaacaguagaaaugguuaaguaugccaggaaguuccuaaacuaauccuaauugggcuuuccucugaaaauauuuggauaguguuaaaauuguagucauaguguauuugcuucucucuuuuugagaauagcguuuuaugagcugaugaaauuuuuuagugacguuauugggcauguauuaaagaugcauagauuauaagaaggagaguaagugucauguuauuaauuguguuuucuauuuugcuguuuuaauuugcaagauaaauauuuauacaggaaagcuaaaagaaggaauacaguaacuuacuagaucugagcucuucuuuuuuagaguuuacaauauaauaagggauguaagagauauauaaaacuugaauaccaguccagaugcauaaauaaagcagcauacaguucagaagagaggaauucugucugugugaucagggaauuuuuucauguaagguguccccuuuguaauaggccuugaauuauaagauuucuagauguuaauucaaaggaagaccuggaucaauauggaaauaaaauagaagaccuguuccuguaguaagguagccuuuaacagcagaauaggaucagagugcaugauuauaaauaauaaaaacaaugccauguguaaugaguaugaugauaaagucagguuuagaggaagacagagugcaagcugguugaaggaaaauuguuaugaggccauugugagaugauaaauacuuacacuagagaaaucgguggaaaaggauccuacuaaggagauuguguuagucuguucuugcauugcuauaaagaaauacgugaggcuagguaauuuauaaagaaaagagguuuaguuggcucccaguuccacaggcuguacaggaagcauggugcuggcaucugcuuggcuccuggggaggccucaggaagcuuccaaucaugguggaaggcaagaggggagcaggcaucucacauggcaggaccaggaucaggagagugaggugggggggugccacacacuuuuaaacaaccagaucuugugagaacucacuaucucaaggacagcaccaagccaugagggaucuucccccaugacccaaacaccuccccagguuccaccuccaacacuggggauuaccuuuucacaugagauuugggcagggacaaauauccagacuaugucagagguguuagugauuuaucugauugagacuuuaucaacugauugaacauuaaacauuguuauagagaagccagagauacuuccaagguuuacccaaguucuggguaacuagguguauuaguccauuuucacacugcuguuaaagacauaccugaaacagggcaauuuacaaaagagauuuaaugggacuugcccuuccacauggcuggggaggucucacaaucauggcagaaggcaaggaggagcgagucacaucuuauauggauggcagcaggcaaagagagagcuugugcagggaaacucccauuuuccaagccaucagaucucaugagacucauucacuaucacgagaacagcacaggaaagacccaccccuauaauucaaucaucucccacugggugauuccacugggagguggaaugggaauugugggaguuacaauucaagauaagauuuggguggggacacauccaaaccauaucacuagaagaauggugacaccuuuacaaaaacagaaaaagagggcagaucaaaguggaaggagauuuccacuucuguuuaggauauaaagaggugcauaaagaaaaucccauucucaccacauaaagagcuuaguaaucuacaacgucacagguucucuugagcccagcagagagcugagcaugcaaagcaaauauauuaguucauuuucacacugcugauaaagacauaccugagacuggguaauuuauaaagaaaaagagguuuaauggacucacaguuccacauggcuggggaggccucacaaucauggcagaaggcaaaaggcacauguuacaugguggcagacaagagagaaugggagucaagugaaaggggaaaccccucaugaaaucaucaugucgugagauuuacucacuaccacaagaaccguauggggagaaccacccccaugauuuaauuaucuaccaguaggucccuuccacaacacgugggaauuaugggagcuacaauucaaggugagguuuggguggggacacagccaaaccauaacagcaaccaaauaaccuaaauuccaaaaaggacaacccuccccacacaacccccucaaaggcauagaucauaugcauuguuucacuuuuggcagaacacaagagaaagagacggcuacuguaaaagugaguaagaggaaaacuccuagaguuuuaacuaaaaggccuuuaacugcaaggccaacuauggccuaauuuggaaugucugggggccucagacagaaugggaguuuacacuuucuugcaaacacuuuuccuuggggcuccacagaguacucccaauuaagaggaggcaaaagcaggagacuacagaaagccaucucugugguguagggaugaaggaagugaugaucugcagcugcagagagagaaugaugcagagaggccuuugugccugggagacaggacaaaggccuucccauuuacucagacccuucuccuuuaagccucaaaccagugggggaggggcagaaaaccuucugauuucauacguuucugaagggagauuagaagucaaaccccugugcugcuuagaggaggaacccuccuguccccaggaugcaggcagagacucauugaugccggggaaaggguagaagagaaaacccuuuacuucugaaagaggcgcagaaaucauuuuaggccucaggauucuacacugauaccaaggagaggucuuuuacuacuaggggaagaguaggaaacuucuaccuaagaccgauacaaauacaaggcagauuuugacugccacaggaagaagagccagagggccuaccuaagacugaggcuggaccagaacaauggagaauccuagcugccucaaccaugaacuuucuacuguuugggaaaggucaagagcacagagggauauccugugguauugguaugcuggagugguugaaaacucagaggaaaggaaaaaaaaagagagagaaacucucuggcuccuaagcacaggacaaugguagucucccaguagaggaauuugaaaccuauaguauacuuaagguaacuauaacaauaaaauccauuccaagcucaauuccugacuagauuaacuaaacucuuucacacuaaugacaugacagaaaaauaagcauaccauuuuucagguguaaauaauacuuacuguuguucagcauaccguguucagcauucaagcaaaaauuaauagacuuuaauaagcccaucuauugagagagaaacuaaucauuagaacuaauuucagccuuugugacuucuaugcaauagaaagauguucuuagaaaauauaccauucaaauuucauucuuuauauaccuuuuuuaaaauuaauuaauuaauuaauuuuuuugagacggaguuucacucuugucgcccaggcuguaguacaguggcgcgaucucagcucacugcagccuccgccucccggguucaagcaauucuccugccucagccucccgaguagcugggauuacaggugcgugccaccaugccuggcuaacuuuuguauuuuuaguagagacaggguuucauauauaccuuuauuuuuaaaauuacuugagguauacuccuacagacuacaagaugagucaaaccaagaacucaaaaacaacacacacucuuaacaucugauccagcaguugcacuucuuuguauuuaccugaaugaguugaaaaguuauguccacacaaaaccccucaaauguguuuguagcaucuuuauuccuaauuaccaagauguccuucaguaggugaaagaauaaauaaaccguuguacaucuagacaguggaauauuauucauuaccaaaaagaaaugaccuaccaggccaggugccguggcuuacgccuguacucccagcacuuugggagguggaggugggcagaucacuugagggcaggaguucgagaccagcuuggccaacuuggcaaaaccccgugucuacuaaaaauacaaaaauuagcugggcguaguggugcaugccuguaaucccagcuacucaggaggaugaagcaugugaaucacuugaacccgggaggcgaagguugcagugagccaagauugcaccacugcacuccagccugggugacagagugagacucugucucaaaagaaaaaaagaaagaaaagaaaaagaaaaaagaaaugagcugucaaaccauaaugcacuugaggaauuauaaaugcaaauuaccaagugaaagaagccaauuugaaagggcuaaaaaccgugugauuccaacuacaugacauucuagaaaaggcaaaacuauggaguuaguaaaaaaauuagugguugccaggguuugggaggagagagcgaugaauaagcagaacacagauguuuauggcagugaaaccacucuguaugauacuauaggggaggauacgugucauaaauuuguccaagcccauagaauuugcaacaucaagagugaacacuaauauaaacuauggacuuugggugauaaugaugucucaauacagguuauucaauuguaauaaauguaccacuuuagugggggauguugauaaugggggaaacuaugcauguguagggcagaggaaauuuugguaccuuaugcucaguuuugcaaugaaccuaaaacugcucuacacacuuauuaggauaguuaaaauccaaaauacugacaacaccaucaaacucucacaaggauguagagcaacaggaacucuuauucauuguugcugggaaugcaaaaugguacagccauuuucgaagauaguuuggcaguuucuuacaaaauuaaacauuuuuaucauaaaauuuagcaguugugcuccuugauguuuacccagaugaguugaaaauuuaugcuaacacaaaauuuacacacaaauguuuagaagaauuuuacucauuauugccaaaacuuggaagcaaccaaaauauccuuugguaucugaauggauaaacaaagugugauacaucuauacaauggaacgucauucauugaacagagcaucuaagaugggacaauaucagaggcuauaacauaaguaaauuauaaguaaaugggagucucacagggaaaacagaacaaggacagggagaaacaaauguuugaauagauaauggccaagaauuuuaaaaaaugaauuagaucaaaccacacaaccaaaaagaagcucagacaacccccaagcaaacuaaauaccaugaugaugauaauaauaauaauaaaaagaaaauaugccuguacacaucauagucaaacuucuggaaaccaaacaugaaaauaucuugaaggcaauuggaaauuuaaaaagaagaaagacacauuacauacagaggaacaaagauaagaauugcagcagacuuuuugccagaaaaaaaaaaaaaugugagcuagaagacacugagcaguaguuuuuaguuuaaaaaaaaauaauuaaggggccaugguaaucuucacuguauuguuccaauuuuaguauuaguguaugugcugcccaagugagcacagagcaacuuuuuaaguccuuaaaaaaaaaggcaaccaaaaaaaaggcaaccaaaacuauacccagcaaaaauaucuuucaaaaauuaaagugaaauaaagaccuuuucagaacagaaacugagaauuuguugcugacauacccaugcuacaagaaaugugaaaggagaaaaacaaagugggcuagaguguuuuuaaaguaaauauaaaaauauauuuuuaagauuaauugcuuuaagagauaauugacugucuagacaggcccacaaaauuuuuuucuucuuuuuuuuucacucuaaauaguuuauuuccaccuucacaaacucaugcaccucuggccauuaugcaaggcaccaugaauuaaauagucauaucaguauauauuugucuuacaugauucaagauaaagugaauuuuaaaagcaaaugggugccaaugauggggaggugaggggaauagggcaggcagcaauaggguaacacgcaacaaaauuuucuguaaagggcuagauaguaaauauuuuaggcuuaaugggucagucucugucacagcuacuuaacucuaccauucuagcgcaaaagccaccauauagaucaaacaaccuuggcugcuccggugaaacuuuguuuacaaaaacaaguagcagguccuaauaugcuuacucuggucuaacacagaaauaguugauaacaugaaauuuagaagugugacagaaugguauauguaguguaguccgauguguaggguagaauugaaaauaaacuauuguaagauuauuacugcacacaacaauacugugugucgaagaugcucagauacuuucaauauuauuuuuaaacaagacucaugaagauaacaacuauuacaaaauauuuccuuuuucaauaauucacuccauuauuuuucuaguuaagcucagauagugaucacagagauauguuaguaaacuaucuguaguuuguaguucucccuuuaacaguuccuuuuuggagugacuagggcacauuuccuccucauuauucauacaccaagucugacuuucuucacuuauccuuauauucuucauucuccugcucccuguuugccuuuuuuuccucccacuccuucccccuuuuuauuuaaaaaauuuuaagugaaacagacauccacugaugagaaauaacuuagaaucacaaacuaucacggcugaaagauacguaucauguaguacagugguuggcaaacuuucuguuaagggccaaagaauagauacuucaggcuuuaccugacauuuggucucuguuuacauugcucaccucugcuauuauaaguuugaaaaccaccacagacagaauacagacaaucuguaacaaauauguguagcuguguuccuguaaaacuuuauauacaaaagcaggaaguacacuggauuuggccugugggcacaguuugcgaaucucaaucuaguccaucuucccuugaauauccuuacaucaguguuucccaaauugugcccuuuaagauguauuaaugggucuacuaaaaagcaaauaaaaugaacaaaaaggaugcuccacaguccaacagauuuugggacugcuauauauaaacauuauauucuacguuggaaauucgcaaugcuaaugaacacaaauggaaagaggcucaaggugggccaguuuucaucauuucuccuucaggcugcccaagcgucugccuuucuccuaccaaauccagacauaucagugaagucugucagaauuugcuauauuuacuucuugcaagauaacccaauucuccugugaaaggaauuguuuguagacucuuaacuucugucugucauguuuuuggcagaaagucaucaauguuauaucugguggcuuuucuaaauuuuaccacugauuaaaaggugaguuuaguauuuaaaaaaaaaaagacuuuacuaauuauauaaaaguaauacaugauuauuuuagaacacugagaaaaauaucacugcccaaagauaaccaguguuaacauuuugguauggaaaugucuaaauguguauauacacuuuuuaaaauuaaauucagauuauuugguauauauuguuuuguaucuuguuuuucuacuuguuguuauauccugagaucuuccugauaucauuacagggguucaaaggcaugguuuuuaauggccaaaaaacuuuuccaucauaagguuguacuauaauuauuuuaacuacuuccucuauuuugggacauuuaagucauuuccuauucuucuguucuuuaucccugucuguuuuuccuuuuucaauuacuaaugcucauauuaguagucuuuguccaaaucucugauucuuuccuuaggaaaaauuccuaaaagaacaauuaaugguucgagucaguaauuuauguaauugucaaaaugguuuuaguaaaugauguaacaauuuacauuuuuacuaagagugaagaaaggauacaaaccuaaucacacauuagccaacuauuaaaaaguaauguucauuuaaaaauacaaaauuuaggcugggugcaguggcucaccccuguaaucccagcugggagcugaggcaagaggauuacuugagcccaaaacuucaagacuugccugggcaacauagugagaccccauccucacaaaaaguuaaaaaaaaaaaauuggccaagugugguggcacacaccuuuggucccagguacuaaagaggcugagaugggaggauugcuugagccugagaggucgaggcuucaaugagcugugauugcaccacugcacucuagccugggcaacagagcaagaccaccacccuacccaugcaaaaauaaacuucauuauuaggcaaaaaugacaucuuacccauugaauuuuauaucuuugauugugaaguggaauauuugucauauguuuagaaauacaguuacuccuugguauacaugggagauugguuccaggacccacacauauaugcccagaucugugcauauucaaguacuguagucaccucuguaagaccugaguacaugaaaacuaggcugccuguauagucggguuuugcauccugcaaauaccguauuuuuuguugcguuuguuugaaaauaaaaaucaccauguaaguggaaccaugcaguucaaaaccggcuuguugaaggauccacuguagucugucuuugcucuucugugaguuguauucuucuguuaguuauugaaaaacgaaaucaaucucuugugauggugcuuaucuucaaaaccuucuuuaaaaauaauguugaaaguauuugacugugcaucuuugauaguuuuauuucuguagggagaguuuucugauucccaccugaaguguguggcuauauauacuggccauaggccagcuggcuagugcugggcugcaagaagcugcguuggagcguccacaguaggccugugguauacuuaacaugacuauuagguuaauuaucagcuuuaaacauuaaaugaaacuuaauaauuauaguuaaaauauauaaaacauuuuugcauaucacuggaaaacagaauuucugagcaaauugugaaguagaauuugacuuuuguuccuagcaugcuuucuuaaucaaaacauuuaaaauacaacuuuuaauauuuaacuucacuuuuaugcauuuucgguaacagcagcucuugauuuuagaagaucuuguaucuuuuaaaaauauuuaacugaacauaaaacaggauuauuuuuauuugcugccauuucagauuaacauugccugucauuuuaugcuaaaauccuuuguuuuuuauaauuaucuauuaaauuacauuuucaaaaaaaagcauuggcagguacauuguuauuauuauuuaaauuauuacuggucaauuaagaguaguaggaauuaagguaaaaugucuguaucuuuuguccauuaacuuuuuauuggccuuucuuccugucaguugaauuuaaaaauagauugcgaaauuaucaugugagacuggaaugugaaaacauagaaauacacuuucuuuuucuguccuuucauaccacgucugauaauugccaaauuuuaguucuaguaaaggaagaaggauucaugaaaagggaguaacaucaacuuguuuuuaguaaaggaaacuuacacuuuaccagcuccuuaaaugacugcugggauguuauggccauaguagauaagaauacacacugagcaucccccacccuuuuuuugacagaaauguuuguaaaaaauuccaaauaguaucugagguuagcauugaauaauagaaguucuggaauaagugacuaauggccuggcaugauuaaaaguuggcuagauagcaggaaauuguuacucauuaguggaauauuuuaauuucaaagcacuaggauguacaguaguugguguugauguuaauuaaaggauaaguucuaaucaguuauuuugcuuuuuuguaacgguaauuauaacuuuagggagaguuuuauucaagguaacugguguaauuugacuucuuaaucaugaaauucaugucuaggaacuuucuaaagacugaauauguaucugcugucacugcuuggguucuaguucaugucugcuguuaaugacuggauuacauauuguaauucugugauuuuuuauuuucuauaaaauaaaggaauuaaauuuaaugaucucuuaggucccauaucacuccaaauacucuguuaaaugcaguuguuuuacaaacauaugcauuuaauguaaaaugugcuucagaacgcuuuuuccguauagguauugaaauagauauguuguuugcagacagauugaggcauuuccaguuaaugauuuuauguaaccugucauaacucguauaaugaaacaaaccuugugcuaaaagucugacauauuggauuaaugucccagucccacuguggaugaggugauuaaccucucuaugcaucaguuuuguuaccuauaacucuaaacagucaucucugcacagcacaccuuugaggggcaaauggaauaauauauguaaagcauuuuguaaauuguuaaguacucuguaacuuuaggauaauaguaauuggaaagaacauagaaagacagaguaucgaugagaauucaauagucagcauuaaaggagauuaaaagugaagauaaaagcuuaacuuuaugaagcaaaguuugaagguuuuuucaaaauagacaacagaaaucuuuaggauaauaguaacuuuaggauaauaguaacuuuaggauaauaguaauuggaaagaacauagaaagacagaguaucgaugagaauucaauagucagcauuaaaggagauuaaaagugaagauaaaagcuuaacuuuaugaagcaaaguuugaagguuuuuucaaaauagacaacagaaauccauauaauauucaguuagaucauuuaaauuugcaaaauuagaaaaucuucuuuauaugaccagauuguaaggcaucuguaaugaucugguuaaaacuaaacuugcacuaaaauauuuuaaagcaaauguaacacauguucauugucaagaauaagaauacauaauugacugaaauaaaaguaaauuuacuuuuuaacccuucucuuaauauuacuuucuagagauaacccucauuaacaaacauucuguguauuugugcauucagaaauaaauuguugagcaaaauucuauauggcauauacaauuguguauucauugugcuaaguggugaggaugaaacagcuaacaagcagacaugauucucugccuucauagugcuuauugucuguuaguagagacagacaauaagcaaguaaaugaauaauuauaccuuuuauugucuacuuaaauaaaaguacuacucugauaaagaauuauugggguagaguggaaguuauuuuaaauagguuagacacagagggccuuucugaagugauauuuaaguugagaccugaggguuagaaggagccuaugcguguguguuuuacacuuacacauacauauacacauauucauguauaaacuuuuuauuugcagaagugaaaucauauuuuucugugacuuuugaaaacagugucuuauggacaugguaguccuuauauuacagguuuaucuuuuucauuuuuuuuaaacugaucuauacuucucagacuagaguaugaggaaacauaguuuugaguucuugaaacauuguaaauuuuuuugagaugcaguuuaagaauaauuuaaaauucacacacccuuucaucaaacaauccuauuuauaauaauuuaucuuacagauauaguuacuaaguauuuaaagauucauauguuagacuagcauaaaucucuaaguaaccuaauugauccaaccaauaagggacuaguuaaauacagaauagaguggaauacuaggaagcuguuaauaagauguauggaaaaauauccaauuuauauuauuaauaaaaacaaguugcagaaaaguauguauacucugauuucauuuauggaaaagagaaggaaagauauaaaugucuguguccuuguauguguaagaaaguuuugcaagucuacacagaaaucuauuaaugaugguuauagcugaggaaugggauuggaaaaaccugaagaugaggaggaaggcaaaaauaauacauuugaaauuuuuggaaagccaaauaaaaacaucaauuagaaauuaaacuuggaauauuuaaaucuauaccuggugauuucuaccuuguucaagguaguuauaaacuuuuugaguuuuuauuucuugaaacaaaaugcuauaggagaaaaaauaguuuaauaaaaguauuuggcaacagucugcaaauguuaguuaauauagcauuuuuuuccuagaagaugaaucaugucauauaaaugcugaggugguuaaguauaauuuauuaaaauuuuaaaaacuaauuuguuuuguuaaccaaguacuuaauauguugaguacaugugcuguguaaauagagauucacaguuaucuagcagauacccuauuauauaggcuauuaggggagauaauguaaaauuauagagucuagcuagaauagaccuuagagagcugaguauuuaauuuagcugagcuggaaacucaguuaagugacuugccauaaaauaacuaguuggcaucagagucaggacugauaucuugguuuucaauuucaaaauucacuguaucacuuuagcaaguuuaauguuuucaagacaaaaauuuauguucuuuuuuccgcuuauguucucuuaauuucaaguucagucuuuuaagucaguauaaauaaguguuauuacuuacugacaagguuggucagauguaucauuuugcuaggaugaccauacaucuagugugccuaagacaaucccccagcauaauuaccaaaaagugucuccuuucacuuuuaguaguaucugguuguggacaacauauuccauggucaccccaauuguugcuaauuuauugaaucugaaagauucuacacagugccaggguaaagauuuuggauuaugaaucuaaauaauuauaaugcaagcugugcugaaugccaaagcgcuacucuaauucuaaacuggaagaaauaauuucugcuagguuugacaggcaagggaggcugauugaagaacguggcaugugagccgagccuagaaggauggaugggauuauagauuagucagguuacaugaagaugggaagagguguauaugcaagaaggcucaaagugcauuuggagaauagccagcaucucgguuuaccaguguugagagaaguaugaguacaggaauauacaucugggaaggugugcagagaccagauuauuuaauaccaagucaaaggguuggaauuuguugagcaguuggaggacuccagcaguuuucaguuauguagcacuuuaagaggauuaauuuauuagagauguguugaguggcuuuagagaggaaaauauggaaucuguccuaccauuuagaaggauuuuguaccaaaucagaugugauguuuaaggcccuggacuaguuuauggcaauggagagagagaggcuuucuuuuuauucccuaauggcuuuguauuaguucauuugcauugcuauaaaagaauaccuaaggauggguaauuuauaaagaaaagagauuuauuuggcuccugguucugcaggcuguacaagaagcauggcaccaucaucugcuuccaaugagggcuucaggaagauuuuuaaucauggcagaaggcaaaaugggagcaggcaugucacauggugagagaggaggagguuccaggcucuuuuaaacaaccaguucucaaggaaacuaaccgaguaagaaccuacucagugcaagaaagacaucaggccauuccugaggguucuguccccaugacacaaacacucuccacuaggcugacccuccaaauuggagaucaaauuucaacaugagguuuggaggggacaaacauccagacgauaucaggcuuauacaugguacauauuuauuacauguuggauagauguuucuacaaaagaagauggcacaagauuuaugauuuauuggauacuuaggauaagagagaagaaaacauuagaguuuuacacuaauuaaaaguagagggauuuucuguauaaguguaaggauaugaucuuuguucuacuuagcuuaaggagguuugucuccauuaauuuugaguuaugcuauaaugaaugcuguuuuuagauagcuuugaagagguagacauauaauuaaaguaugaauaauuuguuugauguugaacaucaauuucaucuuugccaaaggucauggacuuuaagaccagaauuucugagguccacauaauaauuuaaugacucaaugauaauuuuugguguuaaauaaaaguccugcagaugaccuuucuggacacaaaguugaauuuagaauuaucaaagagcaagcuugaauuugaauuugaugcuauuauuuuguuauaaagaaagaaucuauuaugcagugcuaaaacaccagaaggaagauaguaugucugaauaucuuuuaauugguaguuauauuuaaaagaugcuaaauuauacaauaaugucauaguuggcaaaauaucauuugagucugaaagauaucacugacaaucuggcugcuuauagacuagcuuucauauaguuuccaugcugcgucuguguguuuuucauuuuagguuauaguguuguuggcaaugagaauaucucccaauugaugcaugcuuaagagacuaccagaaauaaaaaguauaauauaauuugauaugcauuuagagaaauguuuuucuuuaguauuaacauuuuaaauguuacuacugccucauaacugcuguaauaguguuuuaauauuuuagcuguaugaguauuucucauaaaaaccuuuauuuaccaccagaauuauugccugaguuuccccuuauauagcauguaucugaacauuguagaccccaaaugauaaaauaaauuaagagacuuuuuggcuagauucugguuuggugaugauuuuuuccuaauuuuagaguuccucuucauuuuacacucuuuuacaaauuugaguaguuguaguuuauuauagaauaguuuuguuaaaaaucucaauuagggacuacuuuucaaaauaaucucaggaaauaaaaacugcuugaauuuggacuucugcaucuuaaaaaaugcuaauacuauuucucugucaacuacauccuagaaaauugguuuaugauuagaugucauguaaaucacuaagcucauugaaagucaguuuuucuuuuuuauuggacugaauggguaaugagcagaaauaccuuucugcuuuuugucuuccuccuuuccucugggaugugggaaucacauugaggagacagcauuugguuuaggaugaaaggagagaaggcuaucuuuuuucugggcccacugcugugguaggugcgucauuaacaucugucacaccuuuuuuaaugagugcuuuugaugucaggaaaaagucagaugacuuccuuaaaauuaaaacaucucucuugcacgcaagaaugggaggaguauuuuguguucauuuuauuuuauaacuuccuccaauuguuuauauaagucauuuguugaaaucagcaguucacugcaagggcugcuuaucagaaccuacacauauuuaaaacuccccaguaguguguuccuaucagauuaguacuucucugccuuugagacuugguuccuuagaggagaaacuccagugucugugagauuauucacaugcacuuuauucccuugccagugaaauuguuugaauacucaaaacauguagccuuggcuauuuuugugaguuuauguucacauugcauuuuggcccuaaugagucuccuagcuauucaucaaccaugcucauggacauuucagguauuagaguagcuuugaauaauuucauuuugaaguguguuauucucucaccaccagggagacuacaaaccaaauucagaagcaccaacuucaguuaagcugagacugcuggcaaauccuauuagguuucccuagucuacuuccucucccuucucuguaugucaauauuugaaaccuucuugccucucaagccuauaauucucuuacuucggcagaugaucccacauuucccauucauuggaauuuaagaucuuuuuacgaucucaugcguggucaguuuuuuuggugacaguucuauggguguuaaguuugcugcauauuauaguuuguaaauaucuauuggauuaaacuuaauuguguucuuaaaauucauuaaacgcuuaccuaauuuuugucuaccuuaucugucaguuucuaagaaaauauguuucuaagaggccaggcaacgguggcucacaccuguaaucccagcacuuugggaggccaaagugggcagaucgcuugagcucgggaguuugagaccagccugggcaguauguugaaaccucaucucuauaaaaauacaaaaauuagccgggugugguagcacguuccuguagucccagcugcuggggaggcugaggcaggggaaucacuugaaccugggagguggaguuugcagugagcugagauugugccacugcauuccagccugggugacagagcgagacuccaucucaaaaagaaaaaaauauacuucuaagaaaguaugauuggagauuuguucaauguuuuauuuauauuauugcuuuauauauucagaagcuauguuguuaaugcauuaggaauuaugacuuaccuuccuggucaauuacuccauuucaucaaaucuaagguaccaugcauuaugagauacaaccugauugcagagauguuaaaauauggaaaaggaucaagaaaacaugguauuuguuuuaucagcaggaaacauuuguguuguccuaguuaauucuuguugcuuucaacuuuguuuugucugauacugacauuauuauaccuaccuuuuuuuuuuuuuuuuugagacagaaucucauucugucacccaggcuggagugcaguggcgcaauuucggcucacugcagccucuuccuccuguguucaagauauucuccugccucagccucccaaguagcuaggauuacaggcacccacuaccaugccuggcuaauuuuuguauuuuuaguagacacaggguuuuacaauguuggucaggcuggucucgaacuccugaccucaagugacccaccugccucagccucccuaaguacugggauuacaggugugaacccccaugccuguccaugcuuuuauaauagcauugacugaaauauauuuucuauucuuucauuuucaaacuuuugguguucuuuuguuuuaggguuaucaacuguagaccacuuuauacuuacuguccuuaggaguucugccaucuugauuuuuucuuucuauuuaucaaauggcugccuuuaaaaauucaacguauuuagccauuuuuuuuucuagcagcacucaggauucaucaugauaccuuuucccucaccaaacaauuaaaaagaacuucauccuuucacugcccuguuucucauauacuguacauuguccuaaacuauauucucugggcuauaauuucuacuuucuuggauucaucguucuuuauuucacuugauuauauuuuaugauaaauuucucagaguaugugagaaguaaauauucaaaacuuuguaugucugaaaauauauuauuugcccuuauauacaguuucaucaucuuuuagccuaauguuaggaauucaguuucucauucauuucuugauuuuagaugacuuaguuuauucucugaaagcuuuugguuuuuuuuuuuauuugaauuuaaagaauaaaaccgccaguuucauauuguccagauugagugguuucuuuaaagacuuguaucuguuuagguccagaaaaaucuuaugauguaucuguuugauuauuguucuugcuacuuauucuguuagcuccucuuagauuuuugcuuuucaugccaucugcugcucuuaaguguuguauccugggaaaguccuuagaauuacuuucuaguccacuaauuuccucuuuuuucuuuuugaguucaaugugcuuuucugucuauauuguuaagaaacuuuaucuuaggauuauauuagauuuauagaaaaauuaugaagauaauacagauaguucucauauauccuacaccauuuuccccuauauuuaacaucuuaauaugauaaauuugucacaaauaaccaacauugauacauuuuuuacuuacaaaaguucaaacuuuauucagauacuguuagcuuuucuuuuucuguuccaggauccuaucuaggaugccauuauuacauuuagucauuguguuucauuagauucuucuuggcugugacaguuucucagacuuauccuuguuuuugaucaacuuaucaguuuugaggagcauuggugagguauuuuguagaauauugcucaauuagaauuugccugauauuuucuuaagaguagacugggauauggguuuuugagaggaagaccacagagauaaaauacuguucucaucacaucacauugagggcacaugcucucaacgugacuuaucacuauagaugccaucccugaucacauagcuaagguaguguuuaucagauuucuccaccauaaaguuacuuuuuuuuauccuuuccauacucuauacuuuggaaaaaagucauuauacacugucuacauuuaaggauuggagaguuaugcucuaccuccuugugggcuaaguauuuacauagacuauuuuguauucuacacagaauuguccauccuuccccauuuacucauuuauucaaucauuugcuaauauuuucuuaaggauuguuacaacauagaugucugaguuuucugguaaugucuuugucugguuuugguauuaggauaauguuggcuuucuugguauauuugugcugcuauaacaaaauaccuuagacugggugauuuauaaaggacggaaauuuauuucucacaguucuggagguugggagucuaagaucaaggugccaacagguuuggugucugguaagagccuguuuaccacacucuguaagagucuaaguccuuguuuccaagauggugccuuauugcuccacccuauauuggggaggaacacugugucuuccguggcaaaagggggaccuucaaccucaaaaccuuuuauaggggugcuaaucugauguaugagacagagcccucaugaccuaaucaccucccaaaggccacaccucuuaauacugcuacacugaggauuaaguuucagcaugaauuuuggagggaacacugucauucagaucauagcacuggcuuuauagaaugaggaaauguucccucuguuucuguuuucucgaaaagauuguagagcuugguauuauuuauccuuuuacgguuugguagaauucaccagugaaacuaucuaggccuagugcauucuuuuuuuugaagaucuuuaauuauugauuaaguuuguuuaauagacauagggcuauucagguauucagguuaucuguuuauccuuguaugaauuuuuguaauuugugucuuuuaagaaauugguuggcccagaguggucgcuuacaccuauaaucacagcacuuugggaggccgaggugggcagaucaccugagcuuaggaguuuaagaccagccugggcaacauagcaaacuccugucucuaccaaaaauaaaaagaaauuaagagagagagggagagggggagggggagagggagaaggagcaggaaagggaaggggaaaggaaagggaaaagggaaagggagucucuagagagagagagagagaggacugaaagggaagggaaaugggaaagggagucucuagagagagagaguggaaugaaagggaagggaaaagggaaagggagucuuuuucaucuaagcgggcauagaguuguuuauaguauucccuuaucuuuuuuuuuuuuuuuuuuuuuugagacagggucucacucugucacccaggcuggagggacugaagugcagugucaugaucggggcucacggcagccucgacuuccugggcucaggugauccuccugccucagccccucaaguagcuggguccacaggugugugccaccaugcccggcuaauuuuuguauuuuugguagagacaguuucgccauguugcccaggcuggucucaaacuccugagcucaagugaucugcuggucuuggccucccaaaauuuuggguuuauaggcaugaaccagcgggccuggccuuccuuuauccuuuuaaugcccaugaaaugaguaguguuagccccucuuucauaucugauauuaguaauuuguggcuucucuuucuuuuucccuuggugccuggcuacagguuuaacagucuguugaucuuuauaaauaacuaacuuuuaauuucauuuuauuuucucuauuuuucuguuuucaauuucauuuauuucugcucuaauuuuuauuauuccccuucuucugcuugcuuuaggcuuaauuuucucuucuuucucuaguuucccaagguauaaucuaaguuucacuuauuuucauucaguucaaaagauuuucuguuuuuacaucuagcucccucuuuggcccaugaguuauuuagauauauuuauuuccaaauauuuggaguuuuccagcuauauuuuuguuacuuauuucuaauuuaacgcuacugucugaaaacauacuuuguaugauuucuguuuauuuaaaugcguuaaaguauauuuuaugucccagauguugucuaucuuggugaauuuccaugcaagcuuaagaauaaugugcguuuugucauuguuggauggaauaugcuauaaaugucuauuagaucaauugauauagaugacuguucagaucaucuauauacuuaguaauuuuuuuuccuucuugauuuaucaauuacugacagaaggguauuuaaacucuccaguuauuacagugaauuuugccuauccucuugcaguucugucaguuuugccuuauauauucuggcacucuuuuguugggugcauacauguuuaggauuguuaugucuucuuggaaaauugacagcuuuaucauuauguaauaccuuccuuuuucucugauaaucuuccuuguucugaagucugcuuugucuaguauuaauauagcuaauuaauauaucaauauaacaauguaauaaagguauuccaucuuucuuuugauuaauuauagcaagcuauaucauucuuuuuuuuuuuuuuuuuuuuuuugagacggaguuuugcucuuguugcugcgcagccuggagugcaauggugcaaucucagcucaccacaaccuccaacuccuggguucaagcgauucuccugccucagccucccgaguagcugggauuacaggcaugcgccaccacaccuggcuauuuuuguguuuuuaguagagacaggguuucuccauguuggucaggcuggucucgaacuccugaccucaggugauccaccugccucagccucccaaauugcugggauuacaggcaugagccacugugccuggccucccuuuacuuuuuuuguaacuuuuagucauguggcuuuuuaaugaaaggguauuuaaacuauaaucacuaauacaugaagaucuucaaaaaauuauauaauagagauccuccuauucagaauuuugaaguccuuguuuuaaucuguaacaaagagcuguuuugaacucagcugagccuccuuggauggggcauaagaggagcaucuguuaucugcuuucaauccauugccccuuugucccuuuacaaguuaccuuacccagaauugccugugcucaugauucuuucguucuagcuaucuuuguuuucuaccuccuccucucugacuuacuuucuucuccugcuaauauuuucccccauuuuaaaaaauuacaguaaaauguacauagcccuaaaauuaacuaucuuaacuauuguguguauuuccuuggcauuaagugcauucauucuguugugcagcuaucacugcuauccaucucaagaacucuucaucuugcaaaacugaaacucugugcccauucaacaaagacuccacauccuucccucuucccuuuuaccuucuauuucuaugaucaggacuauucuagccuuauauaaguagaaaucauacaguauuuaucuguuugugacuggcuuauuucacuuaccauaauauccucaagguacauccauauuguaacauauguuagcauuuccuuccuuuuuaauucugaauaauauuuuguuacaucuauauaccacauuuugauuaucuguucauccaucauuagacauuuggauuguuuccacauuucagauauucugaauauggauguacaaagaucucuuugagacccugcuuucaauucucuaguguauacucagaguggaauugcuggaucauaugauaauucuauuguuacuuuugagaggaacuuuuauacuguuuucacaguggcuguaccauuuuacaugcccaccacugaugcagaagaguuccagguuuucaguaucaucaccaaaacuuauuacuuucauuuuucgggguguuuuuuauaguggcuauccuaguggguguaaaguaauuaucccuuuacuuuuacucugaaucuuuauauuuaaagugaauuuucuuguagacagcacauaguuugucuuguuuuuuaauuuacucugauaaucccugucacuuaauagguauauuuaggccaguuacauuuaaagugauuguugcuguaaccagauuaauaucuaccauguuuccaacuguuuucuuucuguucauugcauugguuauugguuucuuuucucccucuuuuucugccuucgucaguuuugaguacuuuauauaaucuuaucuccucucucaaaauuuugauuauacuuauuuuaaaaauuuuuagugguugcccucaguuuuacaguauacguuuuuaacuaaccuagguucuuaagacaacacuauacugcuucauuuguacuauagguauuuuauaagaguauucccaauucuucccucccaucccuuguaauagugcugucauuuauuucacuuacccauaugcuguagcuacccaguauauuguuacuacuauugcuuuaaacaaaucauuaccuuuuaggucaacuaagaauaagaaaaauaaaagauuuuauuuuaccuuugcuuuuuccuucuccagcacucuuucuuucuuuguaaauccaaguuucugaccuauaucauuuuccuucugcuugaagaacuucuuuuaacauuucuugcagggcaaauuaucugcugauugauucuccuuauuuuuguuugucugagaaaguuuuuauuucucauuaaccuuugaagugcaauuuugcuggauauagaauguaagguugguggguuuuuuuuucagcacuuugaauauuucacuacacuuaacauggcuuuugacaugcucuccacuguaauucuuaucauuauuccucuggagguagggugguuuuuuuuauucugccgucuuucaagauuuucgcuuugucuuugguuuucugcaguuuggguaugaugugcuuagguguagauuuuuaaaauauuuauugugcuugguauccucucagcuucuuggaucugugguuagguguuugucauuaauuuuggaaaauucucgcuuuauucucucuucucugauauuccaauuagauguacauuccacuuuuugauaaugccccaugauuuuggauauucuguuuuuuucauucuuuuuucucuuugcauuuuaguguaggaaguuucuacuggcuguccucaauugacccauucuuuccacacccacguugaaucuacugaugagcccaucaaaggcaugcuucauuuuuucuuuguagaauuccuuuugauucuuuuuuuacaguucugucucugugcuuacuagucucuucuugcauguucccuacuuauuuucauuacagcccuuagcauucuagucauaguuauuugaaauacccuggugauaauuccaacaucuuugucuuuuucugaugguuguuuuguuucuucagacugggguuuuucuuguuuggggcaugaaaauauuauaauuucuuguugaaagcuuggugucuuguaugcaguaauaagaacugagauaaauaggccuuuagugugaggauuuauguuaauccagcuagaaguuggguuguguguuuaauguuuguuguagcuauagguuaucagagacuugaagcuucuuuagcguacuugauuuuuugucucuacucuugacuucggaacuucccuaaguauuacuccucagagggagccuuuuucuugcaguucuuucagcuaauaguuguuuccgcuauuauucuugagcacuguuuguauaauguuaagaugugagggagaaggacaugcuaugaucuuugauuaagucucagguuuucagggggcuugucuuaugguugugaccuucacaaguguuucuccaguaguacagcuuucuucccccuguucccuauucccuuucccaucuguaguguucccaaucuauuuccugaagccccuguccucucuugacuauggguugucguauucucuucuaacccccacuuaggucaaacaggaaagcugaagaaaauuggaggaacaaggaauuucuuuccucuagcugggauaagcuuucacaauuaauucucuggaacagguucugggcauguuucaugaugguuacucuuccucucccccugccagagacaggagggaaucuuuuggaauccucgugaugacaaccugguaaaauuccuggagggaauguccacagaaauguagucaccccuaagacuguggcccccaggauuuuuucauucucacaauaguccacacucaaccucuagcaauuuguaagauuaccuuuuaaguguuccuaccaguuuaugucucccauggcuucugcuucauguaagcaaaucuugguugcuguaugucucugaaugcaccugucucuacaguuugggguggggauuugcccugcaaucucauuucucuagugaguccaggaaagucauucauuuucaauuuuccagcuuuuucuuguaagaaugaaaaugaugacuuucaagcuauuuacaugccaccauugaaacuggacaucucuccuggcuauauuuuuaauuuucaacaucuguaauuuuuuuuuuguuuuuuuuugagucagagccuuacucuguagcccaagcuggagugcaguggugcgaucucggcucacugcaaccccugccucccaggcucaagugauucucaugccucagccucuugaguagcugggcuacaggcaugugccacuacguccagcuaauuuuuuguauuuuaguagagaugagguuucaccauguugcccaggguggucuugaacuccugagcucaagcaaucugcccaccccagccucccaaagugcugggauuacaggcaugagccaccacaccuggccuguaaacuuuuuuuuauaacagcuuauucuuguuuuaugguauucuaauauugauaucucuugaaguuuucuccuguuuccuuauuugcuguuuccuuuauuauuucucuuguugaauuuuaugccucucuuucauuguguuaauuguuaauucuagauuguuuagcuuucuauacauauuugccuuugauuaucccuauauuagguuguugauagguuguugaccuaucacaaguuuauucauaaaaguuugucauaagcacucuuuuuggggaaggagguuuaagguuuugucccaagaaaaaaagcuaggguagcguguggcucaauaggagcagaagcagcaguauuucuggcucagacuauccaaaaauaguuuguuuuuguuguuguuguuguuuuguuuuguuuuuuuaauuacucauguauuuucucauguccuuuacucuauggaauaucucuggucuugcuuaucugcucauuugaaaacuuuuuuccucugccagauuuagcuguagauuuucucuauuuuuuuguuuucaccaaaccacuuucuaucguuuaagaauucuucaacauuuuaauuuuaagaauggcauuuucuuuuuucuuuuucguguguguguguaugugugugugugcguguguguguguguguguuuagagagacaggguuucacuuuguugcccagacuggaguguggugaagugaucauagcucauugcagcuuugaacuccugggcucaagcaacaauccccccaucucagcuuccugagcaggugggacuacaggugcacaccaccacacccagugacaucccuuguuauacaaguaguuguuucuguaauuuuaagagauuuugguuggaaaggaagguagacaaguauggcucaauccagcuugauccaaucacauucacuuucaauuaaugaauagauuuguuacuauuaguagugguaaguuaauauuaauugagcauuuaguuuaugccaggaaacaugauaaauccuuuaacuauauuuuaaucauuacuuaaacacaguaaaguagauauuguuacuauuuguauauauguuuaagaaaauggaaacuuaaaaacauuaaauaaucuacacagcaccacacagcuaauauaucuguuggagcuaggauaugaacccaaauucuaucccagcaaacucaauuaaccucaguuccucacucaccugaaacuuccucccucaaguugauuugcuaauaagaugccucccuucuaccaggccaaauccuguguaucauucaaggcccagcuuuaaaugccaccucagcagcagugcucugggcaauauuccagcagaaagaaaacucuuaacuuuuaauuuaacuuuacauuuauuugaccucuugucuagcacuuucuacuuuauauguaauacagucauuugaugcauaguuucgucccuacugcacaaugagaucacuaggaaaagugucaauguccuugugucacuuauuuuuacaauucccagcauuccccagcauguaccauuuuaauaaauauuauuaauaaguaauuauauuuauucaguuuaacuucuuuaauuuauaaaugcauccuuauuggcucauuauaaauauuugcauggauuuuauuuaaauaugauuaaaggaucuugagcauauuuguuuuaaaccugucuuugggauuaauauuuaugaauauccaggaaauggcaaauaguuuuagaacuaauuagauagaggcuucucauuauacuuacgucaauaaagauaucugaauauguaugaaaauuucaaggagauucaggauauuugggagccauuugcauacuaacuaaacauuuugauuuuuccuucuggaaguuaaauaaaauggauuacaauauggaaggugauucccaaauuaaaaguaggcaucaaauaaaucauugcuuuugucacauaaaccuugaaggaaaauagcauaucugucaagucuuaaaauucaugucagaauuucacaaagcaauugauuauaagcuaucuuucuuuuaaauaguacguagcaaagaaguuugugccauuucaaauaagugacaugucagacauggagucccugagauuuauuagcaagaccauuuuguucuguuucagaaaauuacagaauuuuggaauuacaaauuuuaccuguacagugguuaucuuuacaguaauccuuaccauuuucuagugauaggguauucuuucucacaagacaucccauucuaguguuuaguagaacuuuauuuuuuuuaaaaacuguuccuuauuuuaaacuaaaaucugccuguuuucuaaagcuucuuuuuuaccuauacuuugaacuuacagaaucuauaaaaaucuuaagauuggcuaggugugaugacucaugccuguaaucccagcacuuugggaggcaggggcacauggaucacuugagcccaggaguucgagaccaaccugggcaauauggugaaaugccgucucuacaaaaaacacaaaaauuagugggacaucguggcacgcgccuguagucccagcugcucaggaggcugaggugggaggaucacccgagcccaggaggucaaggcugcagugagcugugauugcaccacugcacuccagccugggugaaagagugagacccugucucaaaauuaaaauaaaauaaaauaaaaauaaaaacaaaaaaccuuaagauuuucaugcuaacucccaugacagcaguugucaagcauaaugggauagggcauagggaguggggauauaguucuuucucugagucuccugagagcagauguuuauaaacuagauugugacaggauaaguggaugcuaauucugaaucaucaccaauguguaguauuauuccucugcuuuaguuuucuuuuauucauuaucauuauauuuuaaauuuggaaaaaguuaugaauuguauuagcuugggaagggaagaauaaauaugucuuuucuuauacuucucauuuaugagcuucaugaaauaugacuaaucuguugagagacaccauugggaacaaccuguguacagccugaacucauuguaucugccauguauuuuucaguggcuccuuuacaugacagauuacucucaggagcaaauaauaugcagcucuucucacauuuuguuaguguuuuuauuuuuaauaaagugcuaugauuaauagccuaguguuauuguuguuuccccauugaguguaaaugcuucauuugaaugucuuuaaucugaaggaacaguuguuuuauuggacucuuguuauuuuucugugcuucucaagguuuuuugauugcuuucuuugagcucuuugcaauggaggaaaugaacucuaucagaaucauggaguaggacuccguagagaaauuuugaggaugaauacugagauacuugaacauucauacauacauuuuuaugauaauuucagaaugguagacacaccauuagcaauucugauugacucuccaguggcaauuauaaaaguagcuuggccgggcacgguggcucacgccuguaauuccagcacuuugggaggccgaggcagguggaucaucugaggucaggaguucaagaccagccuggccaacauggugaaauccuguuucuacuaaaaaacaaacaaaaaaaagcacaaaaauuagcugggcguggguggcaggcgccucccagcuacucaggaggcugaggcaggaaaaucacaugaacccaggaggcggagguugcagggagccgagaucgcaccauugcacuccagccugggcaacaagagcgaaacucugucuaaaaaaacgaaaaaaaguagccuaugucuggccuacugguauugugaugacauugccauauagauccuaucugaagugccaugugcuuucaauaagucuuucuguuguuguuguuguuugcaaaucagaguuaaaguauaagacaagacaagagguggacacaaaaggacuauugaaaaguugagaaauugugaacugagcuuuuacaagaauauggugcccacuuaccaagaggacagcucuucuuguuauuuuugcccuugaaguggugauacccuuuagccuagucauuucugcauuuacucccaggagccuggcugugauuagaaguguuuccuguagccauagaccaauuuuccuuuuguucaagaauccagaaggcaaguugggccucauuggcaccaaccaucaaggacuucauuagcccuaaccaggggccaacuaaauugucaaauuggaaaugaaggacuuuacaugaauucaaagccacugauaagagagcuugaaggcuuaucuugugaaacugaguguugaaugcauaacuuuuauuugagaaagcaaauaacuuggguggaacuucuacaaauuagagcaaaauaauuuaggauuuauuuggagguuuaauagcuuguuagguguagccuugaauauguagcauaacauaugcauuuauauuauauacuuagaaacauucuggucuuuuugguuaauaagaguauuacuuuuacuggcucuuagauuguuucagaggaauuagagcugucuaguuuuguauaaucaagucuuuauuuucauguaaacuaaguaaguucuguuuagaaagucagccccagaagguuuauuuacgcacuauauaagcucauguuuuaagauucuccauauccccaaaauuaacauuuuuguuuguaaguguucuguuaguuuuuagucauugaagaagcauuuauugaauguauaguaauauuacuuucuacaaagaaaacgaaugucauaacauaaaaauacauaaacauuuuuuacaaugaccagagcuuagaaauacuuuaaauacagcauuuuuuaaaauuacagugguacuucuuugaaagagguugucugauaauuauuguaauaucuuaaaagcacuuggaccuuacuucuggccaugaccgaauaacuaguacuggacuaggccucuugcuguaaacagcuagaaaauuagacaaaauauauggaauacauguuuguagacauuugaaaacaugcagaaccaugaucccuaagacuaaggaaaacaaaugggaugagccccauaauugcccucccagcuuuccgcuuggagccacuuuucuguagcauaagaugccccauuuaugaacaggcagaagggagcagacagcccagcagucucagugagacugagaucagaguuuagguguagaaaaguagguggggccgggcguguuggcucacgccuguaaucccagcacuuugggaggccgaggcgggcggaucaggaggucaagagaucaagaccauccuggccaacauggugaaaccccgucucuacuaaaaauacaaaaauuagccaggcgugguggcacaugcguguauucccagcuacucgggaggcugaggcaggagaaucacuugaaccagggagucagagguugcagugagccgagaucgcgccacugcacuccagccuagcgacagagcaagacuccaucucaaaagaaaaagacaauaaaaguagguggaauuugugcagcaggcuacuggagagaagagaaauaugcagagaagaagcccaaggaagcuauauaggguuccccuugagucuuuugggucucacauuacauuuagucuccuucaguuugugauaguucuucagucuuuccuucucugccauacccuugacacuuuugaaaaguauuggucagguauuuuguccaguguucucaguauggauuugucugauacuuuuuugugauuacauugagguuauggauuuuuuuuggaggaauaccacagaagugauguacccuuuucaauacauucguaucgggguacaugauaucagcauguccuguuauuugguaacguuaacacugaucaugugguuaaggugguuuuugccagucuucuugcagucaucucugagcccagagccucucugauuuauuuaguuucuccugaguguaaaucuccuauugccaagggugagggauuuggagauuuaaagcucuucuuacaggagcuuucaaauaauuccuccaucccccauaucauccuuuccuccugaagugcugcugauuccugaaggucaguuggcuugaggcucaccugucugucccuuuggagguacuuagauugacucuuucccgugaaauaauuuacuuuucuucuauccaccuucuucuuucauauauuauagauuaggauuacaauccaaaauaucucucaguuuuaucagaaauggaguuuguguuccuauuucuuguccuguuuguuguuuggguguauuuaugaagugguggacccagaaauguauucgaccuuccaugcuaaaacugaagcuaaaaauagcuuuuucagaagacaguauuuggcaucauuucucaggcauucaaauacaaacuuuugacucagcauuuccacuucuagcaauuugucuuacagaaauauuuacacauggacccaaagauaacauguauaggaaaguuuauagaagcauugcugauaguagcaaaaaaaaaguaauggaaacagcccaaaaaaaaaggaaaaacaagggaaugauuaaauaaauggugguauaucuauauuguagaauacuauucagcaauuagaaauaaugagguuugucuuuauguacuguuaugggaaccuccuaaagacauuacaucauauagcaguuuguaaagcaacauguuugguaucauuucauucccauauuuauguguauauaaaagugugucauugaaaugaaaaauauuugaaagaauaugcgccaaacuauuaauagcaguguuuuggaggucaucaaaagggaaccauaaucuuuguauacuucuuaaacuuuguauacuucuguaccauauguauuauuuuuauaacaagcauauugcauuuugauuuuucaauaaaaagaugaaauagacuaccuacagcaguaguugagcaaccacuggagguuuucaggcaugggcucuuuuuguuguuguuguuguugguugaauuugaaugucauuccugcauuggucauuuauuggauuucucuguagcauuuauuuauuuucauuuuuccguaaguuauuaggguacaggugguauuugguuacauaaguucuuuaguggugaucugugagauuuugguucacccaucaccugaacaguauacaaugcaccauauuuguagucuuuugucccucgccucccucccaccauucuccccaaguccccaaaguccauaucauucuuaaugccuuugcguccucauagcuuagcucccacaugucggugagaacauuugauguuugguuuuccauuccugaguuacuucacuuugaauaauagccuccagucucauccaggucacugcaaaugcuguuaaugcauuccuuucuguggcugaguaguauuccaucguauaaauauaccacaguuucuuuauccacucauugaguaaugggcauuuggguugguuccacgauuuuacaguugcgaauugugcugcuauaaacgugcacaugaaaguaucuuuuucauauaaugacuuauuuuccucuggguagauacccaguagugggauugcuggaucaaaugguaguucuacuuuuaauucuucaagaaaucuccauacuguuuuccauagugguuguauuaguuuacauucccaucagcaguauagaaguguucccuguucaccgcauccaugacaacaucuacuguuuuuugauuuuuugauuauggccauucuugcaggaguaaggugguagcgcauugugguuuugauuugcauuucccugaucauuagugauguugagcauuuuuucguauguuggccauuuguguaucuucauuugagaauugucuguucauauccuuagcccacuuuuugaugggauuuuguuuucuuacuguuuuguuuaaauuuuuugucgauucuggauguuaguccuuugucagcuuguuaguccuuugucagauugugaagcuuuucucccacucuguggguugucuguuuacucugcugacuguuacuuuugcuguguaaaagcucuuuaguuuaauuaagucccaacuauuuauuuuuguuuuuauugcauuugcauuuggguucuuggucaugaaauccuugccuaagccaaugucuagaaggguuuuuccauguuaucuucuagaauuuuuauagugucaggucuuagauuuaaguccuuaauccauuuugaguugauuuucauauaaggugagaguugaggauccaguuucauucuccuacauguggcuagccaauuaucccagcaccauuuguugaaaaggguguccuuuccccacuucacguuuuuguuugcuuugucaaagaucaguuggcuguuaaguauuuggguuuguuuccagguucucuauucuguuccauuggucugugugccuauuuuuuuagcaguaccaugcuguuuuggugacuauggccuuauaguauaguuugaaaucagguagugugaugccuccagauuuguucuuuuugcuuagucuugcuuuggcuaugugggcuuuuuuguuuguuuguuucauaugaauuuuagaauuguuuuuucuaauuucguaaagaaugaugguggcauuuugaauggggauugcauugaauuuguagauugcuuuuggcacuaugaucauuuucacaauauugauucuaugcauccaugagcaugggaugcauuuccauuuguuuguguugucugugauuucuuucagcaguguuuugcaguuuuccuuguagaggucuuucaccucccugauuagguaaauuccaaaguauuuugaguuuugcagcuauuauaaaagggguugaguucuugauuugauucucugcuugguugcuguugauguauagaagagcuauugauuuauguacauuaaucuuguauccagaaacuuugcugaauucuuuuaucaguucuaggagcuuucuggaggagucuuuaggguuuucagcguaaacuaucauaucaucagcaaacagugacaguuugacuuccucuuuaccgauuuggaugcccuuuauuucuuucucuugucugauuucucuggcuaggacuuuccaguacuguguugaaaagaaguggugagagugggcauucuugucguguuccuauuuucagagggaaugcuuucaacuuuuccccauucaguauuauauuggcuguggguuagucacagauggcuuuuauuacauugaaguaugucccuuguaugcugauuugcugcuaacaauuuuaaucauaaagggauacuggauuuugucaaaugcuuucucugcaucuauugagaagaucacaugauuuuuguuuuuaauucuguuuaugugguuuaucacauuuaauucacuugcguauguuaaaccaucucugcaucccuaguaugaaacacacuugaucaugguggauuaucuuuuugauaaauuguuggauuugguuagcuaguauuuuguuacggauuuuagcaucuaugcuaaucaaggauauuggucuguaguuuucuuuuuugguuauguccuuuccuggcuuugguauuaggcugaugcuggcuucauagaaugaauuagggaggguucccuuuuucucaauauuguggaauagugucaaaaggauugguaccaauucuucuuugaaugucugauagaauucuacugugaaaucugucuuguccuggacauuuuuuuuguugguaauuuuuuuuuaauuauacuuuaaguuuuaggguacauguguacaaugugcaggcuaguuacauauguauacaugugccauacuggugcacuguacccacuaacucgucaucuagcauuagguauaucucccagugcuaucccuccccccuccccacaccccacaacaguccccagagugugauguuccccuuccuguguccauguguucucauuguucaauucccaccuaugagugagaauaugcaguguuugguuuuuuguucuugugauaguuuacugagaaugaugauuucuaauuucauccgugucccuacaaaagacaugaacucaucauuuuuuauggcugcauaguauuccaugguguauaugugccacauuuucuuaauccagucuaucauuguuggacauuuggguugguuccaagucuuugcuauugugaauagugccgcaauaaacauacaugugcaugugucuuuauagcggcaugauuuauacuccuuuggguauauacccaguaaugggauggcugggucaaaugguauuucuagaucuagaucccugaggaauagccacacugacuuccacaaugguugaacuagauuacagucccaccaacaguguaaaagucuuccccuuucuccacauccucuccagcaccuguuguuuccugacuuuuuaaugauugccauucuaacuggugugagaugauaucucauugugguuuugauuugcauugcucugauggccagugauggugagcauuuuuucauguguuuuuuggcugcauaaaugucuucuuuugagaagugucuguucauguccuucgcccacuuuuugaugggguuguuuuuuucuuguaaauuuguuugaauucauuguagauucuggauauuagcccuuugucagaugaguagauugagaaaauuuucucccauucuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuguguccugaaugguaaugccuagguuuucuucuaggguuuuuaugguuucaggucuaacauuuaagucuuuaauccaucuugaacugauuuuuguauaagguguaaggaagggauccaguuucagcuuucuacauauggcuagccaguuuucccagcacuauuuauuaaauagggaauccuuuccccauugcuuguuuuucucagguuugucaaagaucagauaguuguagauaugcaguguuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauugccuugggcaguauggccauuuucacgauauugauucuuccuauccaugagcauggaauguucuuccauuuguuuguauccucuucuauuucauugagcagugguuuguaguucuccuugaagagguccuucacgucccuuguaaguuggauuccuaaguauuuuauucucuuugaagcaauugugaaugggaguucacucaugauuuggcucucuguuuguuauugguguauaagaaugcuugugauuuuuguacauugauuuuguauccugagacuuugcugaaguugcuuaucagcuuaaggagauuuuggguugagacaaugggguuuucuagauauacaaucaugucaucugcaaacagggacaaauugacuuccucuuuuccugauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauaguggcuguggguuugucauagauagcuuuuauuauuuuagauacgucccaucaauaccuaauuuauugagaguuuuuagcaugaacggcuguugaauuuugucaaaggccuuuucugcaucuguugagguaaucaugugguuuuugucuuugguucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccagcuuugguaucaggaugaugcuggccucauaaaaugaguuagggaggauucccucuuuuuguauugauuggaauaguuucagaaggaaugguaccaguuccuccuuguaccucugguagaauucggcugugauuccaucugguccuggacucuuuuugguugguaagcuauugauuauugccacaauuucagcuccuguuauuggucuauucagagauucaacuucuuccugguuuagucuugggagaguguaugugucgaggaauuuauccauuucuuguagauuuucuaguuuauuugcauagaggugauuguaguauucccugaugguaguuuguauuucugugggaucgguggugauauccccuuuaucauuuuuuauugugucuauuugauucuucucucuuuuuuuauuagucuugcuagcagucuaucaauuuuguugauccuuucaaaaaaccagcuccuggauucauuaauuuuuugaaggguuuuuuguaucucuaucuccuucaguucugcucugauuuuaguuauuucuugccuucugcuagcuuuugaauguguuugcucuugcuucucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccagcagucauucaagagcagguuguucaguuuccauguaguugagcggcuuugagugagauucuuaauccugaguucuaguuugauugcacuguggucugagagauaguuuguuauaauuucuguucuuuuacauuugcugaggagagcuuuacuucccaguauguggucaauuuuguaauaggugugguguggugcugaaaaaaauguauauucuguugauuugggguggagaguucuguagaugucuauuaggucugcuuggugcagagcugaguucaauuccuggguaugcuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcucuucuuguugaauugaucucuuuaccauuauguaauggccuucuuugucucuuuugaucuuuguugguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauacagcacacugaugggucuugacucuuuauccaauuugccagucugugucuuguaauuggagcauuuaguccauuuacauuuaaaguuaauauuguuaugugugaauuugauccugucaguaugagguuagcugguuauuuugcucguuaguugaugcaguuucuuccuagucucgauggucuuuacauuuuggcaugguuuugcagcagcugguaccgguuguuccuuuccauguuuagugcuuccuucaggagcucuuuuagggcaggccuuguggugacaaaaucucucagcauuugcuugucuguaaaggauuuuauuucuccuucacuuaugaaguuuaguuuggcuggauaugaaauucuggguugaaaauucuuuucuuuaagaauguugaauauuggcccccacucucuucuggcuuguauguagaguuucugccgagagauccacuguuagucugaugggcuuccuuuuauggguaaccugaccuuucucucuggcugcccuuaacauuuuuuccuucauuucaacuuuggugaaucugacaauuaugugucuuggaguugcucuucucgaggaguaucuuuguggcauucucuguauuuccugaaucugaauguuggccugccuugcuagauuggggaaguucuccuggauaauauccugcagaguguuuuccaacuugguuccauucucccugucauuuucagguacaccaaucagacguagauuuggucuuuucacauagucccauauuucuuggaggauuuguucguuucuuuuuauucuuuuuucucuaaacuucccuucucgcuucauuuccuucauuucaucuucaucgcugauacccuuucuuccaguugauugcaucagcuccugaggcuucugcauucuucacguaguucucgagccuugcuuucagcuccaucagcuccuuuaagcacuucucuguauugguuauuauaguuauacauucgucuaaauuuuuuucaaaguuuucaacuucuuugccuuugguuugaauuuccuccuguagcuuggaguaguuugaucgucugaagccuucuucucucaacucaucaaagucauucucuauccagcuuuguuccauugcuggugaggaacuggguuccuuuggaggaggagaggcgcucugcuuuuuagaguuuccaguuuuucugcucuguuuuuuccccaucuuugugguuuuaucuacuuuuggucuuugaugauggugauguacagauggauuuuugguguggauguccuuucuguuuguuaguuuuccuucuaacagacaggacccucagcugcaggucuguuggaguuugcuagagguccacuccagacccuguuugccuggguaucagcagcagugucugcagaacagcgguuuuucgugaaccacgaaugcugcugucugauuguuccucuggaaguuuugucucagaggaguacccggccgugugaagugucagucugccccuacuggagggugccucccaguuaggcugcucaggggucaggggucagggacccacuugaggaggcagucugcccguucucagaucuccagcugcgugcugggagaaccacugcucucugcaaagcugucagacagggacauuuaagucugcagagguuacugcugucuuuuuguuugucugugcccugcccccagagguggagccuacagaggcagacaggccuccuugagcuguggugggcuccacccaguucaagcuuccgggcugcuuuguuuaccuaagcaagccugggcaauggcuggcgccccuccccaagccuugcugcugccuugcaguuuggucucagacugcugugcuagcaaacggcgagacucugugggcgugggacccucugagccaggugcgggauauaaucuccuggugcgccguuuuuuaagcccgucagaaaagcgcaguauucaggugggagugacccaauuuuccaggugccgucugucaccccuuucuuugacuaggaaagggaacucccugaccccuugcgcuuccugagugaggcaaugccucacccugcuucggcucgcgcacggugcgcugcacccacugaccugcgcccacugucuggcacucccuagugagaugaacccgguaccucagauggaaaugcagaaaucacccaucuucugcgucgcucacgcuggaagcuguagaccggagcuguuccuauucggccaucuucacuccucccccuguugguaauuuuuuuuuuuuuuuuuuuuuuuuuuuuuuugagacagagucuugcucugucucccaggcuggagugcaguggcgcaaucuuggcucacugcaagcuccaucuccuggguucaugccauucuccugccucagccucccgaauagcugggacuacaggcacccaccaucacacccagcuaauuuuuuguauuuuuaguagagacgggguuucaccguguuagccaggauggucucaaucuccugaccucgugauccgcccgccucagccucccaaaguccugggauuacaggugugagccaccgugccuggcgguaauuuuuaaauuaccauuucaaucucgcugcuuguuauugaucuauuuagaguaucuaauuccugauuaaagcuaggaggguuguacuuuuccaggaauuuauccaucccuucuagguuuucuaguuuaugugcauaaagguguucauaguagucuugaaugaucuuuuguauuucaguggugucaguuuuaauuauuccuguuucauuucuuaaugagauuuuuuggauuuucucuuuucuugguuaauuuugcuuauggucuguugguuuuauuuaucuuuucgaagaaccauaaauaaauuguucuuugauguaaaccaaaauaaauuuuaauuuaucuuuuguauuuuuuuguuuguuucaguuucauuuaguucugcucugaucuugguacuuuccuugcuuccaccggguuuggguuugguuuguccuuauuucucuaguuccuugaggugugaccuuagaaugucaguuugugcucuuucagucucugauguaggcguuuagggcuaugaacuuuccuuuuagcacucccuuugcuguaucccagaggucuuguuagauugugucauuauugucauucaguuugaagaauuuuaaaauuuccaucuugauuucgcuuuugaaccaaagcagguuuugaaccugcucuuucaggagcagguuauuuaauuuccauguauuugcauggcuuugaagguuccuuuugaaguugauuuccaguuuuauuccacuguggucugagagagugcuugauauaauuucaguuuucuuagauuuauugaggcucacuuuauggccuaucauggagaaaguuccaugcccuguugaauagaauguguauucugugguuguuggaugaaauguucuguauauaucuguuaaguccauuuguuccaagguauaguuuaaaucuauuguuucuuuguugacuuucugucuugaugacccaucuagugcugucaguggaguauugaagucccccacuauuauuuuguugcugucuaucacauuucuuaggucuguuaguaauuguuuuauaaauuugggagcuccaguguuaggugcauauauguuuaggauugugauauuuuccuguuagacaaggccuuuuaccauuauauaaugucccucuuugucucuuuuaacugcuguugcuuuaaaguuuguuuugucugauauaagaauagcuaccccugcucgcuuuugguguccauuugcaugcaaugccuuuuuccaccccuuuaaguucauaugaguccuuaugugucaggugagucuccugaaggcagcagauuguugguuggugaguucuuauccauuccgcaguuguguaucuuuuaaguggagcauuuaggccauuuacauucaguguucauauugagaugugagguaccauuacaugcaucgugcuauuuguugccaguguaccuugguuuuuuguuuuuuguuuuugcuuuuuaacuuguacuuuuguuuuauagaucuugugugauuuaugcuuuaaagacguucugcuuugauguguuuccaggauuugauucaagauguagagcuccuuuuagcggucucguagagguggcuuggguaguggugaguucuuucagcauuugcuugucuggaaaagacuguaucuuuccuucauaugugaugcuuaguuucacuggauacaaaauucuuggcugauaauuguuauguuugaggaggcugaagauagggccccaaucccuucuagcuucuaggguuucugcugagaaaucuucuguuaaucugauagguuuuccuuuguagguuaccuggugcuucugucucacagcucuuaagauucuuuccuuagucuuaacuguagauaaguuaagcacacugaugacagugugcuuaggugaugaucuuuuugcaaugaauuucccagguguuuuuugugcuucuuguauuuggaugucuaggucucuaguaaggccaaagaaguuucccucgaacauuuuccaaauauguuuuccaaacuuucagauuucucuucuuccucaggaacaccaauuauucuuagguuugguuguuuaacauaaucccagacuuccuggaggcuuuguucauauuuucuuauucuuuuuucuuugucuuuguuggauuggguuaauuggaagaccuugucuuugagcucucaauuucuuucuucuacuuguucgauucuauugcugagacuuuccagagcauuuugcauuucuauaaguguguccaauguuuccagaauuuuuuguuuuuucuuuaugcuaucuccuugaauauuucucucuucacuucuuguaucauuuuuuggauuuccuugcauugagcuucaccuuucucuggugccucccugauuaacuuaauuaaccuccugcauucuuuuucagguaaauagggauuucuucuugguuuggauccacugcuggugaacuaguaugauuuuuugggggggguguuaaagagccuaguuuugucguauuaccagaguugguuuucugguuccaucucauuuggguagguucugucagagggaacaucuagagcugaagguuguuguucagguacuuuggucccaugggguguucccuugauguagucucucccccuuuuccuauggauguggcuuccugagagccaggcugcagugauuguuaccucuuuucugggucuagccacccagcaagucuauccagcuccaggcugguacuggggguugucugcacagaguccugugaugugaaccgucuauggguuucucagcugcggauaccagcaccuguuccaguggagguggcaggggggugaaauggacucugugagaguucuuagcuuuggugguuuaaugcucuauuuuugugcugguugcccuccugccgggaguuuguacuuuccagagagcaucagcugugguaguauagagaggaaccagaggugcgcgggguccuagaacuuccaagauuauauacccuugucuucagcuaccagagugaguaggaaaggaccaucaggagggggcggggcuagauggugucugagcucagacucuccuugggcgcgucucccugcggcugcuguggaggaugggggugaguuaauggaguuguguaccuaggagcauuauggcugccucugcugagucaugcagguugucagggaagugguggaaagccgcagucacaggccucacccagcucccacgcaaaccaaagggccagucucauucucacugugccccaucuaacagccccgagucugccagcaguuggggagccaggcuugagaacuugccccaggcugccugccucccagcugugaaagaaaagggcuugauucuuccccagccuguggagucugcacaccugauucgcacccuuucccgaguucuggccaggaggguucuccccagcuucaaauuguuacaaaguucagcuggagauuuccuucucccugugguguuuuuccccacacuccuccgguugcccucccaaaggaucccuguggugccaguuaggaauggccugccuggggaccuagugagcucccggggccuuucucgcugcuuccucuaccccuguauuuugcuuggcucgcuaaauugacucagcuccagguaaggucggaaacuucucccucaaacaaccuucaguuucuccaguggggauguguguucaggagaggagaaucucccuuucccacuuccacaguuggggcacuuggggcacucacaguauuuggggugucucccagguccugcaugagcaauccacugccuucagaauccacuuccuguggguccucucgggauuucugguuuguucuugcagucaaucuggagcuuaaauucacagugcgagccuccgcacacugcucuguccguccaagucggagcugcagucuaguccugccucucccgucugccauggugauccaaagaaugccugcaugggcucuuuuaaagcggcucucugcuagacaguaucucaggaagcauuuaauucagggauggauccccagacuggauuacuguuuggggaaauagggauuucaugaucaaauaagaaugagaaaugcuagguuaacaaacagaagaggugcuaggagucauuaacauacuaauaugcauggcaaaucucuacaaucucccaaauuugauuguuguucucuuuuuuauuuuacgguauauguguuaacauuucccaaaaguaauauucuguggaaguauacuuuuguucacacuguuacuauguuuggaguaauaagcaccauguaaaucugacuccguucugaauaaugaauucugaauaauguuagagugaacauuccugggaaauaacaauuuaguagauuccuaaugaagggccagagagaaagaauauuucccaugauacuuuccuaccuuucaaaugagcuuagaaauuuuuaaagaaauuucaaaacuauuuucaaagaaagguuaugaaaaaggaacaaaauuuggauuccaaaaagaaaauguaaauguaccuacucacagcuguaguuggugugagugggcgucaaauuaggauaacuggggaucugcuuaaccaagggugcaacaugccuagugcagaauuuaaugaucuccaccuucagaaacuuucaaauacauguauugguuaaacuaauaauuauagacuguuacuaagugacacuuuaucagucacaaaucuaauguauugaaacuggaaccgucaaccacagcauagcuagauuuugaaaguuaauucucagaaauauuaggagcagcucugaugacuuacucaauauaaagccgggucaggccgggcgcaguggcucauaccuguaaucccagcacuuugggaggccaagacaggcacaucacuugaggucaggaguucgagaccagccugaccaacauggugaaaccccgucucugcuaaaaauacaaaaauuagccggguaugguggcgcaugccuauaaucccagcuacccgggaggcugacgcaggagaauugcuugaacccaggaggcagaggcugcagugagccgagaucacaccacugcacuccagccugggcaacagacuccaucucaaaaacaaacaaacaaaaaagccagaucaggagaaacgucaucauucuuuaggaacuuccacggaacaauucaauuucugcuacuuacaacccugugcaggcccuuagguuucagcgacugggccagugugaagcugcugccaagcauuugagcagcaggucagagcggacagcaaugcucacauuugaaaauguaauaccuuuucucaaauagauuucccaguggccuuuggcuugauucagauuuacaugguguuuacauacuguucuaaacauaguagcaguaugaacaaagguauaaaagcuguaaaguuccuucuuguuaaguaaccaagcaaaucaagagcacauccuguuuaggaaauaagccuagaaagcgaggaugggaccagucuggaggacuuugaacacuguccugagauguuuagacuuauucuggaggcuguuugguacaguuacaaugggugaacuuuaugguauguaaaucauacuucaguaaagcuguugaaagaaagacuggauaguugaaacuauuaaacauccuuuuuuuuccuaguguaaaacagcaauaguuacacaguccuaggacauuucuuuugcucaaaacaccugagcuuaaaaucugucugaagucuucauaaaauuaaaguguccagaaauuaucaaagacuuuuauaaaugccaaccagucaucaagggcccaaagcaaacaugaaaaauacagaucuguaggccacauguaguaaaaaccuuuguuucuuagagucaggcugguugcuuucccuucugccaccagaguaguuaucucauugcgcucuuaauuuacauuucccuaaugacuaaugaugucauuuucaugugcuuauucuauguuuucuuugaugaaaugacuauucaaagcuauugccuuuuuuuuuuuaacuuugguuguuuucuuaaugaguuguaagaguucauuauguauuuuggguauaaguuuuuuuuuuuuuuaucagauacaugauuuggaaauauugucugccagucuguugcuuuucauuuacuuaguuuuggguuguuuuuuguuguuguuguuguuuuuguuuuguuuuuuucuggguuuuuuuuagugcagaaguauuuguuuuuaauagaauccaauuuaucagggcauacuuucuuuuaugucuugugcguuugauguaacguauaaaaauucuuugcuaacucaagacaugaagucuucuagaaguuuaguucuuagauuaagacuaugagauauuuuguuaauuuuuauauaugaugugaguucauuacuuugcauguggauauauuguugucccagcaccaguuguugaaaagacuguucuucccacauugaaauuucuugacaccuuggccaaaaaucaauugaccacaaauauaaggguuuauuucuggacacugaauuaucucauugaucgaugugccuauucauaugucuugauuacuguagcuuuacaguaaauuuugaaauuaguaaauuuugaaguacaguaaauuuugaaauccuccaacuuuuuuuguucuuuuugauaauugauuuggcuauucuaggucuuuugcauuucuucuagcauuuugcauuucuucuagcauguuaauaguugccuuauuaacaacuuugaguuguucaauucaugaacauggacuaucuauuuauuuagaucuucuuuaauuucucucugcaauguguuguaauuuuuucuuuguaccagucuuacacuucuuuuagguuuauuccugaguaucuuaaaauuuaucccuagauauuuuuguuaaauuuauuucuaaguauuuuaauucuuuuugaugcuauugugaguggaauuugugaauggaauugauuucuuaauuucauuuuuggauuguuccuaaaauauagaacuacaguugguuuucauauccuccgaccuugcuagccuuauuuauuaguuuuaguuguuuuuuuuuuuuucaguagauucaugaggguuuucugcauagauaauuaugucauucacacaugaaaauaguguuauuucuuccuuucccaucaguauuuccuuuuucucuuuuucuugccauuuugcacuugcuaggacuuuuaguacuaaggaaugagaaacuaauauccuugucuuguuucuaaucuuagggaaaaagcauuuaaucuuucaccauuacauacagugcucacuguaggcuuuucagguugaggaauuuuacuucuuuuccuaguuuguugagaguuuuuaucaugaauggguguuucauuuugucaaaugcuuuuucugugucuagugagauaacuagugguuuuucuuuuuucucuuaaugugauguguuuaauugauuuuggaacauuaaacugucuugaauuccuaugauaaauucuacuuggucauggcauauaauuuuuuaauguguuaccaaauguggcuugcuaacauuuugguaaggaguuuuauacuaugaucauaagggauacuggucuguugcuuucuuuucaugugucguguuucuuucuuuucuuugucgggcuuugauaacagaguaauacugaacgcacaggaaugaguugggacauguuucuccuucucuauuuccugaaaaaguuugugaaggauuaguauuauuucucuuuucaaauauuugauaacauccagcaguaaagccauuuggacuuagaauuuucuuuguauaggaagauuuuuacuuacuaauucaguuucucuauuauaggucguucagacuucauguuuuuucuugauagauuuggcaguuuauguucuucuaagaauuuuuccccuuccucuaauaugucugauugguuggcaauuuuuuuucccaaaauauuccauuaaagcuuuuuuaguuaucuguaggguugguaguauuguacuauugucccuucuuguauucuugauuugaguaacuugugucuucucuuaguuuccuagucuucuaccugagauagaagcuuagguaauucauuugagaccucucuucuuucugauguagguaaagcacuacauuucccuuaaagcaccacucuagcugcauccuguaauuuuuaauacauuguguuuuuauuuuuauaguguuaaaaaauuguguuuuugaggcagagucucacaaucacccaggcuggacugcagugguacaauuaugacccacugcagccucaaccuccugcauucaagugauccuccugccucagcuucucaaguagcugggacuacaggugcacaccagcaugccuggauaauucuuuguauuuuuuguagagauggggucucacuauguugcccaggcuggucuuaaauuucugggcucaagugauccaccacuucagccucccaaagugcuggguuuauauaggcauaagccaccaugccuggccuguuaaaaaaauuuuuuuaaauuuuucuuaugauuucuucuuugacccuaggauuguuuaagagcauguuuaauuuucaaauauuugggguuuucucagauuucuuuuuaauucugucauuuuuugcuuucauauuuuggggcuuuuuuguuagauauguaugcauuuauaauuauuauauucaaagaagaaauaacauaauucaauaauaauugcagauuucaauauucugucaaaaacugcuaaaacuauuagacaaaguuaggaaggauauaaaauaguuaaauaacgcugucaaccagcuugaccuaacugacauuaugaaucuucauaaucuucuuuauaagaaucugcagauacagauuuuuuucaggcacacauggaacaaccuccaggauagaccacaugcuaggacacaaaacaagucucaauacauuuuaaaagaccaaaauaauauauaguguguucucugaccacaacagaauuaaauuagauauccacaguaagccugcuguuugucuggggccugcuuccucuugcuauaaaaguaguaaacaggucacaugugguggcuccugccuguaaucccagcacuuuugagaggccgaaguggguggauugcaugagcucaggaguucaagaccagccugggcaacauggugaaaccccaucucuacuaaaaguacaaaaaauuagccaggcguggaugugcaugccugugguccuagcugcucagggaggcugaggugagccugagaggcggaggcugcagugagccaugauugugccacugcacuccagccugggugauagagcaagacccugaauaugcaggcauccauccuggccccuccguauugccuucaugggacuuugggggcaugggaaacugaccaaaacaaacgagaaacucuagcugccuccacugccaugaguaauaaaguucuuugucucugaugcagcacuuguaccaucugccagcacccaugaaucaguaauaagcuaacuuguuagcuuaucaauaagguaaacucucagauccugcuuaguuccugacaguuucuuuaguucuuagaauauauuuaaauagccacuuugaagucuuuguuaaauccaguaucugaggacauuccaagaaagacauuuuguaaugacugccuuuguaaugacugccuuuuuuaccccuugauuaugagucacacuuuauuucuuugcaugucucuucacuuuuguugaauauuggauauuuuggauaauaaauuguagcaacuguggauucugacucuuccucccacccccuagcaguuuuucuuguuuuguuuguuuaauaacuugccuguacuaaaucugugauuucugccucucccagggugugcaaccacagauguuuuuguugaguauuuaguuuugauuaucuuuuuauuugcauuuucuaaaagucucuguuuagauuuugcccugugucuguauagauuagugcugaaccaaagauuagucagcaguuaugcucaaauaccucaagccaauaagccuaccacuuugagcugaugggucuuugugugguuuggggagugcauucaaaaucuggauuauuuuuuaguuugcccagccuuugcuuucuaccgggcucucucaguugucuugugaacacacacacacagguuucaucugccgggggugugugaguggcuugggccugcugcagucccuaggguacauacacauggccuucagucaaccuaggauaugugcagagguuaccaagccuucucaccacuuucucaccucauggaauaccuuguuccauggcuagucuaccauccauugcuugccucaaugagauacaaccucaggccagcagagcacuggcccuuccuauucacuugccaccaggauugcuccucuaauugacaacacuccauaucaaaugagcucuucuggcaacagcagcaaagccacugguuuguagggccugcgcuagccugguugaacaaucacucuagcagagcuagagggggaugccucagacacuguuugugugugaagucugguaauuuucaugaacagaugcuucucagcuuguuauaugucuuuggucaguuuccaguuuuugacaguuuuuuuccgcuuuauaguugcuuugggggaagaggauuugucagucucaaaccaucaugccaggagucuaaagucccaaucuacaucaucuugccauugaugcuaguguaacuuaacugccuguuugauacucugugauaacauaaguugcuuucucuuaccugcucagcuaggauauggaacagcagcaauagaaucaaccuggggaaagcugauagagaacacuggggccacagugggcauggauuuuucccaugguuaauuaggaaugauuuacaaugaucaggcauuuuuuauacuuuuauucccuguauaacuaauaaaacauuugcuuuacaaaugguauaucauuauauaaauguuauuuauauacacuuugugucaaccaaagagauuaaaauauugccuuuuguaaugagauucuagaaacauugucuucaucguacucauguucucccugaauuuccuuccauuuauuaauucaauaaauguacacuugguuaucuaaaguauacagaggcauguugagugauucccagaugaaauugauacauauuuuguccuuaaggagcuuauagauucguggaaguaauacaauguaaacaugaaaaauggaaauagggugugcuggaugccguuaaagaguuauagaucugugcuauggaaguucaguaggguaacugaguuuucccuaucuaagugauucuguuaucacucauuacucccaucaccucguccucccugcuugcauucccuccccagcugcuuuccuacugaaauccuuauguuguuacucauucaagcuagucauaguaaauaacauguacgcagagcuuccacaugcacuuuucuuguuugguauuugucugguucauaucagcuugggguuuagguagggagcauuauuauuccuaauuuacagauaaggaaacugacaucagagugauuuacccaaccucgcauauuagaagagucaaguuuugaacauaagucuuuguacucgaaguccugggcucuuuccgguaugcucugcugccucucacacagcaaacuuucucuccucucuagccaguagauaguugggaagaauuaaguuuggugaguugggucagaauuggaggcagcuuaguguguuucuagauggacaugcaaaugaggcugcaaagcaagacuguucaggcuacuuuuugaaucauuucccaauaaggguuuuuaaugacuuuuaauuuuacaauaaucggagauccauauuuucauuugcaucucauuuauuccauagguguugaauugugacuuuaaacacagcauauucaaaaccaaauucauaaucucccccucaaucuguugucuucucuguuaaugacaccucaggcuccacagucuccuaagcuaguaacuuggaagucuuugacuccuuccuaaccuuuaucucagcaucuaauccuaucguuuccagccuaccucauaggguuauugugugaguaaacugacaaaauauauaaagacaaacucugaaagcugugaaugagagguauuuauuuccucuaaggcagugcaucuguugauguguacaguacuacaaggccucagcaaccauucagaguuaauguuuuguaguguugacacuugcuuuagugaagcauguacuuaacgucggggcuaaaacugcauuaucuuacauucuuauaacaaucugcacucuuaaaagcacuaccaagggaggagaaaaaaaaagggagcaugagagagaacaaggcucucuuuugugauuugcacaagaacuggaagucaaguuuucagacucugcuuggcuauauccagaggucuuuuaaacugaaaaccaaaguugauuuuauuaauaccacuccaccacucauucucugugaccuagggcaagugauuuagcaaugucagucucuacauauaaguuagagauaaugauuguaccuauuuuauagagcugcuguaaggauugaaugaucuauauagagagccagagugccauauguaagguauucaagaagugguagcuauuggauuacucuucucccuuuccaccuaucuagagauuuuagguugguccuccuuugccauuucccugagauagauaauuuauuucacguggcguauuuauuuagacugcaucacauuacacucucgcaguucacagacauuuccaggagguuguugcuccaccacuucauucaaaacuagguucacgguuuucauguuuuccucucuacaucucuccuacuaauuucccuuuuaauguucgaacaugauucugaugaagucuuucaguuaaaaauugugagauuaaacuuguacucucuaacuccgaagugaaagagauuuuagguucaauauuaggaauaaaauucuacuaucaggacuguuguuuuuguuuuucaucaguagcaugggcugccuuggaaguuaugaaguuacccauggcuaccgcuauacaaaaguggcuuuugacuagcagcuuugccucgccacugcuuccuuucucccauccaguccuugaggucugcaagcuguuucaguauacaucgcagugaagaguguaacaaacagauuagcuaccugacuugcaauuuuuuggcuuuggaauuuuugguucaggauuuuauacuguccuagcuaaaugaauugacaaaacagcaagguauaacuuacaaugaagaaguuuaucaaccuucccccgcaggauuaccaaauacagaggugcaggguuuaauauuagacuaaaguugaagauguggcccucaauucuccugcaaaggagcucugcagugaagucacaauagccaugagccucucaguguaacuagggucauccauacuauuccauauguuaaaguagaagaaaauagugaagucuugucauuugcaagacuuuuaugcaaaguuugacagauguugcaugcugcuuucaggauuaagaaaauuacaugggcacugcugugccuucugugagaaguuuuauucucagcugucacccuccuugucccuugcccauaaccauuauaguggccagaaagucugcuugcucuacagugauguguuuugaauagugcccauuaguuuucaguaguuacccuggccugcauguuagccuucaguuuaauggccuuuuuuauguucauucauuuuauuuuauuucccaucgugguuuuguuuauuucuuuuuuguuuuuuguuuuuucuguucucuuuuuuaaaaccgucgugguuugcccuucauauuccccaauguuugcacaugacaagauguugccaucccaacauuaccucccacuucacugaccagugccacuacugaccaucuagcaccagccacaacgggaccacugccuucagcuccucgggaugucguggccucccuggucucuacccgcuucaucaaauugacguggcggacaccugcaucagauccucacggagacaaccuuaccuacucuguguucuacaccaaggaagggauugcuagguaagugccugugugucugcagccaguuggcugccucuuggucacggcagccuugucaugcucacccuggcucuugguaucuguaccaauuuuuaguccagaaaauaagaucacugagaugcaccuucccuaauuuuaggucauuaaauaaacucccaaacagacuaaaguccugguagucucuccuuuucugggaugacuuagggagaggguagauacagcuauugagguggacguauuuaaauguaagaaggagugcccuuuuuucauaagauucagucaguauaaauucuagagauuaagguagacuuaauuuauuaaaguaaacuuaaaugaauauuugccacacccuuauguggugugggcugcggagcuccagggguucuccuugauggaauaagaguaguuagugaugacuuuuccuaaaauagcauuuucauuacauuccucuucauuuccacccccucaggagcucacauugcucauaggggaagaucuauaauguccaggcugcuuugugccacaggcuggcuucacuuuaucuguccaacuugcuuuuccuuuuuccccaauguaacugacuuucuagugaaaccagucuaaucacuauagccuuuuuuuccaguguguccucuucagucacuucuugccccuuucucagcugaagguaaauucaguuaauccuucuuggcccagguuaagccccaugaagcucucaaagaucuuuacccaccuuuucagcacauagagcauuucccuuguacguguauuuguaucccuaauauuggcacuugauuaugguaauaugugauauuuuacuaccuuaagcuguuauucuucaauuauguucuauguauuugugcuguuuucccaaccagauuauaaacucuuuggaaggaaccaugccacaugcugacuguucacacauugccgaguaguaaauuccuucacugugcucuuccaaccagaauaagaaagcuaagauacguguuuuaguaggagcccuaauacaucagcuaaagcuuguauuuccauuagcaugcuuauaguugauguacauuguaguuaauaccagacuggcaaguuuagcaagugcaggacccuuucuuuaauacucucaagaagucuaaguggcauaauuuaacaccaacagaugggaguuaccugaaugcuauacuguguguuuugaguuuuacaaggguagagaaacauaguucuauacauaaaaaaagguaagacauuccuaccaaacagcaaguuucaauaucaccauuaaaauaucuucaauagacuuugaaaucucauugaaaaucucauaagcuuucacagaaggaagaaaccauuuaguaauucugcguaauaagcuuuauuucugcaguagguuuuuugcucuuauugugcguucuaccagaaaugcauuuuccucacaugaguuacaucuggcuucuuaucuaucaucuuuagaugacaucuccucaggccuucccugaauaccaacccaaacuuagccccucggugacugucacacagugggguaucagagccagccuguucccaagcuaauuguuaaaugcucgggaaauuuugcaaaccuaaugacaugacuuggcagcuugaaauugggcauggugggaguguuuacagugacaaaugcugcaaaccagagccaauuguuaaacauucaccagaacaccacugcugucacaucacccuauuuuuugguaugugugugguauuuuuuuguuuguuucgcuuuuaguuuggguuuuuuuuuuuuuuuuuuuuuuuuuuuuugagagcacuuacuacucucugaaauuuucucuuuuauuagcuuauuuauucugucugucuuguucaauaaaauucuccagcaccuggaacagagccuggcauuuaguaacacucaguaaauauuuauuaaguuaauacauuaauuucaauucguggagaaauaauagauaauucaaguaaucauguugagauugauuauccauuuggugggaaaaauaaaaguuaugucucugucuuaaauuauagauggauuaagagauaaauauuuuuaaaaucuauaaauauauuagaagaaaauauagaaaugauuuuuaucauuuggagaacaggaaagggcuuuuaaagggagauagcaaauccagaagccauaacaggaaagaguaacaaaguuacaaauuauaaauaaaagauaucccaagagacaaauaauacaagcagaugauucauaguacuggaaagcccauuagaguuaaaaaaagguuuucaccaucucaggcgaucuuggaagcaaaaugauggggguuuuuuuguuuguuuuuauuuuguuuuguuuuguuuuguuuuggagacaaaggucucgcugggucacccaggcuggagugcaguggcacuauauuggcucacugcagccuccgcuucccagguuccagcgauucuccugccucagccucccaaguagcuggaauuacaggugccugccaccaugccuggguaauuuuuguauuuuuaguagagaugggguuucaccguguuagccaggcugguaucggacuccugaccucaggcgauccacuucagccucccaaagugcuggaauuacaggcaugagccacugugccuggccaaguuaucauuuuucaucuauaaagcuggcaaaaauuuuaaguugauaauauccaguguucaaugaguugacagcuaggaggaaaaccacucuagguuauugguggcaguauaaauuagaauagucuagggaaggugauuuggcagaauuuuaaaauauuuuaaauauacauagccuuccaucacacuucuagguaacuguccuauagacauacagauauauguaugcauugggcccucauacaaacacguuuauuuauagcauuguuugcaagauuauaaaaggagacuauguaaauauccacugauagaagaaugggcaccuaauauacaaucgugcaucacauaacaacgcuucagucagacagacugcguauacaauggugaucccauaagauuauaccacugucuuuuuacuguaccuuuucuguguuuagacacauagacacuugccauuguguucgcauugccuacagcguucaguacaguaacaugcugugcagguucguagccuagaagcaauaggcuaucccauacagccuaggugugugggauauacaccuagcuauaccaucgagguuugcauaagugcauucugugauguucacacgaugaaaucacgugaugcauuugucagaacauaucccuguuguuaagcagugcaugacuguauguauacccguaaguaugguggcagcaguuuuuuuuaaaugaccugucuguauauuuugauguguauguaaaugccuaaagcagugauccucaaccagggacaguuuugcccccucaucccucgggauauuuggcaaugccugguacagcgucaguaaguaccaguagagguacuuacugacaucuaguggauagaggccagggaugcugaugaacauccugccaugcacaggacagucccacaacaaagaauuauccugcccaaugucucaguagugccaagguugagaaacccuggcauggagacugucuggugagauaugcgucaauaugugccacagucagcucucagggcaggacagguuuugacaaaagagaauugagacuuauuuuuuuuuaacuguguguacuuuuauauuuaaauguuuucaaugagacacacuuauuuaaauuuuaugauagauuguggguuggaguaagcaggaaugauuaguaaauuaauuuguaguuggaagagauacagaaguugaguuggcaggggcaggugggcaugacuaguguauguaaaggaagaggaagugcaagguaaggccaucuguguguaugcugugagaaggaugcaaaggcaagaaagcuggccaaacuggcccagagcuuuuggcagaaauuaguaagagauuagaauaaaguggacguuuggagccagaugcuggaaugccagugagaauuuggacauaaucagauaagaagggaccauuuuugacuguuaagaaaguuguacacugugauuuuauuaaacaguacuuugggaacacuacccaagauuaaaggagagaaaaaauagagucagggagacaaaauuggguaguaauuauguuagccuagauacgugcuagucgucggcuuggaugaagaugaaagcagcgacuugaaguggauaggacaaauuugggaaauauuuaaaaggaagauuuugggagaccauaauaguuuuuuguugcuucauuacuuuaugauuucugaauagaggcaaugaaggagaaguuaauuuuuuuaagucguaagacuauauccuggcuaauuguuacauaaacaaaacuuucuuauuaaucuuaucggcuuaaauuuucucaucuaaaaaacaaaaguaauauauuuacuucacagacgugugguaagaauucaaugugagaauguaugccacuaccugcauuuacaaauucacccacuuccugcauuugaaaauucagccaccagguggcaccauaugccuuggucaugagcuguaauucuuauggguaccugaguugccagagauuucagaggguccuuccucucugccuuuucagcuaugaaaauuucaucuuucuuaaaaaagcaguacuuuucuauauuaaccauuaagugggaaguggaaaguaagguauuucugcuauucauagcacuuuaaaguuggauugaagccuuagagaucuguuagucuagucaagggguuagcaaaccauggacccugugccaaauuggagcaauuauuuauuuuuauggccccggagcuaagaauaguuuuuacauuuuuaaauaguuacauuugaaauguuacauagguaacuauauaauauccuccauuuugccucuuggccuauaaauauuuacuaccaggcccuuuaagaaaaaguuugcccacccugucucauuuuuucguuuaauacauaaagaaagugaggcccagaaagcauuagugacuuuuccucacaagcuaguagcauugccagaacuagaauugcaucuccuaacuuccagcccagugcuuucuuucuauaaagugugcccuuuucuuucccuuuugauucuuagcuuucacauucuaaccugagucccacuguaaccccacacacuuaagagaauuguuguuucaaaugcuccuugaaucuuaucccaaaaccaagggugguuuuucugcacaguaacuuguuucugggaccucagaccaauagugucagaucaccuaugacugauuuuuuuuaaugguaaugcuucuauagaaauuugauguggguauuaguaaccuucacuuauuucucccauuuuuucccuuucacauagaagcaaacaaaaaauauauauaugauauuaguauacaagauuuacauaucagaaggcagauuuucguuuauucauucaauguauguuugggaugcagcuucccuguaugagcauucugcuacgugcuucugucguacacgaacaugaaugagacagucuuuuacuucaguuugaaguaaaauagucccccuccugugucuuucuagaagaaaacuuguuucaacuuuccuguguggggugaacaaaagagaccugaucuguacucucucagagagccuuuaguuuaguguaaaauacaauacaguugacuccccagaacuuaaccacuaguagccuacuguugacuggaagccuugccaauaacaucaacagucuguuaguacauauuuuuauguuauauguauuauauacgguauucuugcaguaaaguaagcuagagaaaaaauguuauuaaaaaaaucauaagggaccagguguggugguucaugccuauagucucagcacuuugggaggcugaggcggguggaucgccugaggccaggaguuugagaccagccuggccaacauggcaaaacuuugucucuacuaaaaauacaaaaauuagccgggcgugguggugugcaccuguagucccagcuacguacuggaggccagggcacaagaaucccuuggacccaggagguggaggcuucagugagccaagaucacaccagagcacuccagccugggugacagagugagacccugucucaaaacaaacaaacaaaaaaaucuuaagagaaacuauuuauuguacauuaagugaaaguagaugauccuaaaggucuucaccuucagguugaguagacugaaaaggaggaagaagaagaaaagggguuggucuuauugucucaggaguagcagaggcagaagagguggaggaaauggaagcagggcaggaaaggcaggcgcacucgguguaacuucuguugaaaaauauccgcuuauacguggaccuacacaguucaaaccugucuuguucaagcaucagcuguacuucccuuuaagacagggaucauccaugaucagaccaagugucagaaaccuuaaauuguaagaaaucaguugauccuuccuuauaaauccugugauugagagauuuagccgaagagaaaauaguauuagguaucucaaguaucucugaaaaauaauuuuuguuacuacaguauucuuuuccaggggaccuagcugauuauagagaaaaaauccucuguaaauauuguguggguacuauuguuggauuuuuuaauuaaaauaaaguaacuuaaaagaacuauagaaaauuaccaaaaagcacuucucugcagugcaaaugcucacaaucagacaaauuggcauauggucauguagaccuacacaaauuuuaaucugcaauuugaaggcaaauuaucaguauuuuaaaguaagaauuuuaauucaauaaauuagaauaauuucuucaauggaguaguuugaggcucuuuaauuacuuucucaagacagguauagcuguuuccucacaugaaugacaguuccuaaaagccaacuguuugucuaaaacaaauuccuucacaauauuuguugaaaacucuugauuaugcagucugguuuucauucuagugaguacaguagacugagcauguuuguggaccuguguuggucacacagaccccaagacagaaccuggaagccaccuuuaguaaagaaccuagauaacugguuuuaagcuuucaucucaugauauuaaauacuagaccgcuggauuugaguuguuugugauaaaguuugucaaacauuucauaucauuucauaucagcuucaaaaucaaugaaguguuaauuuuaagaaauuauaaaaaucaguauuguaaucaguuuauuuuauagacuggguuacacuuaggauuuauuuaaauguuuuauguuuuuauuuccaauuuuaaaagaugauaaccucuagcauucuuuuuauugagagucucuuagccaaaauauacacagcauucuuugauauuuucugugaaauaucauuaggucauaccaauauccaccuuccaucaauuucccuaaaacucagugauuucuaaagccuagaaaguugaugacuagcugccccauuugaaauggcauugagaagagcccugugucuucucugaaaggaaguugugauuauggucagcgauaucaguaacauuucagcaagaacaucacugauuugucagauacguaugcccuugcucuuuugccaguccccaucuucuuugcacuguccuacccccaaaagcuucauuguuugagagcuaauuugacuuacacugauagauuuuuauguggaguggaaaaugaaacuguacauucuggaaguauuccuaauuaaugcuaucucucuccaaauccuuugucuaaagggaacguguugagaauaccagucacccaggagagaugcaaguaaccauucaaaaccuaaugccagcgaccguguacaucuuuagaguuauggcucaaaauaagcauggcucaggagagaguucagcuccacugcgaguagaaacacaaccugaggguaagucuuccaccugucugucagcacccccuagagguagaccucucugaaguucuaccuuuguuuagccuugcacaccauaggggagcagaagauaacaguuccuuacuuucgggguccuuaucaauuaggggaggcaaaauuaauuuacaucaaaaaacagcaaguagggcuggguguaguggcucaugccuguaauccaagcacuuugggaggccgaggcaagcagaucaccugaggucagguuuuuuagaccagccuggccaacauggugaaaccccaucucuacuaaaaauacaaaaauuagccggguaugguagugggugccuguaaucccagcuacucgggagaauagcugaggcaggagaaucaccugaacccaagagguggagguugcagugagcugagauugcaccacuguacuccagucugggugacagagugagacucugucucaaaaaaaaaaaaaaaaaaaaaaaaaaaaacaacagcaaauaguauaagacaauauacuucuguuggugcuuuucuacguguucauauuuuacugacccuuuaagacuuagcucagaugccuucuagaaucuuuccucugauucuaauauuguuaucuccacagucuaagauauuuaucacguuuuuccuucaguuaugauuaugaacuuaccuugcugauuuuguagcaaagacagagccuuugucauccuuacauuucccacagugucuaauguaaugccuugcacaugaagaagguauuuaauaauuguucuuaacuggauugucugucuuuaggcauaccaugcucuuuagaaucuccuugaggcuuuauuuuggaccuguggucuuucgugcuaaauaggguuacuucuaauuacauuucuaagauuuucagugacgugagugucaaucagguuuauuuauauuauaaauguguuguauaucuuaaguuuggauuguaaacuaacuauaggaccgaaauuacaagcagccagaucuuaauaaaugcuuuuccuacuugaggcuuuugucuagacuuuugcuuucuuuuaacacaaauuacuguuuuuccucaguguauucuuuuuuuuuuuuuugaggcggagucucgcucugucgcccaggcuggagugcaguggcacagucucugcucacugcaagcucugccuccuggguucacgccauucucuugccucagccuccugaguagcugggacuacaggugccugccaccaugccuagcuaauuuuuuuuuuuuuguauuuuuaguagagacgggguuucacuguguuagcuaggauggucucaaucuccugaccucgugauccgcccgccucggccucgcaaagugcugggauuacaagcaugagccaucgcacccggccaccucaguguauucuucagucuaauuuuauuauuaacagcauuaguuuuucuguauuaaaaaccuccaguaauaauaaaauauuuuacuuuggguagagaguauuuuagauauauuuguagaggcuacugaccaggcagcugaacagaauaaaugacuuuaccaguggaacuauagaaauaauuuaagaacuuuaccugacggguagaauaagugaagaagcuguagaacuucacuuucuaaugcuauggcauaucauucaccugucaaauauuuauugaguauccccuauacuggguaaugugcaagauacuggagaugcaaggaugaacaagcuuggucuucuucccuuaaagaaggagcaggcaagguaggagaccuuucaucauuucagugacagagauugaagauaagaaucaaacccaggcaagaacaagagggccaucacagagucaggggguugauuuaagggaagaguguguucucauuacaggcagaauguugaauuuuacaguuaccuauguucagacaagagcaggaauacucuauuagguuucaagcucaguuacccuucaucagcuuucauauagaggcaucauucaugagagauacuaggauacagaauagagaaaacuuacuguaaaagauagaaaagucaaggcaggauccuagggaaagaugagaccugaggcuggccuugaggcauuugacuuagagcaagcauuuugugggaaggaauuugcaugacccaaaucccagaaauagaaucuaacagugcacaugcaagguaagucaugacaaaaaugaaggaaaugcaaggguccuauccugaggcugugaaccuucugaaacugcaugaaaauaaauauuugugucuguacauauucacauuucccuuggaaaggaucuguaguuuucauugucauuucagagcucauacaucagauuguugagaaccacugcgagggucauugucaaauuuagagaugaaagaaaaggggugaagaagaguggauuuauugagugcccaccaugugucagccacuguguuaggcagucaggauguaaagaugaguaagacuugacuucuguccacaaggagcuuacggucugguaccauagacaacagugugauguguuaucaccuuaaggaaaauaggcagcauaaccauuuauucaaggaguuuggcuaaaagaaaauaguuguaagaauguagguagaaaaggcaacagguucuggugaggguauuuuagggauggagaagagacuauaacauguuuuggcaaaagagaagcaguuucugaagagagauuuggauuucaucuggagguguucagcuugugugggggaggcauaaauguuggaaccagcccuuggaaaauauuuuacauauuuaguuucacaaaccaacuuaacauuuuuuccauuuauuaugccacuguacagcugaaaugaaagaauucauuagcaccuuuuuuaggaucauauuugccuacacuuggccaaugaauauauugaaaaugauuucaagagaauuuagggacuguuuuguuuuucuucuccuuuaauaaguuagaggaaaguuuuccauagcagcagaagugugacaaaucccaccugucaggcugcacaaaauaugcccuuaacugaagugaauaacgugauucauaacuaaagcaaacaacuguuagaguaaccauauucagauuucucuacuuugauagcaaaauuaaucuuaagcuguggugcuguuauucaggaaagccaguguguuuuacauuuuguuagcuuuuuuucccuucccaguuuuuaaaucuaaugaaugucuauuacagaaacacuagugccagagaaauuguuuucaaauauagaaugucuaccaaaguguaggcauagacagccacacaggauuuguguauaaauuggaacuggaaccugucagucagacaaaaauaauacaguaaaaggguaggugugugagccauuguaggagauagagccagcuagacacuuaagcagucagccagugauccagucuuccagucacauacauccuaucguggguauuguaguaaucuccuuacgggucuucuugagcccacguuuuagaaucagcaaguacucgacuccuggguccaccgcuagcuaacuuucccaucacuugggaaagauuguuaacuucauaaccucaccuguaaaugagggugauaauauucaucucacuugguuuagugcaaagauuauaugagaaaauacaugucaaguauuuagugcuugacugacuguaaccauucaauaaaugguagcuguuuuacaauuauuauuauuuuaucuagucuuguucuuuuacuguuuuucuuccaugcauguguucacauguccuuucuaaacacagaucugaucauaucaugcuccugcucauaauuuuucaguagucaccuaacaccuacuagagaaaaugugagcuucaauagcaggacauuagaggguucuucacuaucugacuagucauuguuuucaacauucucucucccauauccacucuguuucaaccaagcugaaccacuuaacacugucuuuuuguauauucucccuauugaccccauugacuggaaugauuuuccccuugguaucugaggaaaguguucauuuugcuugacuccaagaauucuucaucaaagggguuucccucccaaaccccucccaaagcagaauugugugcucucaucuuucuguuuuuguuauaaccguuaccuaaaucuguuagcacuuacgacauuuuuuguaacuguuuauaugucugacuuuccugcuagacugggaguucuuugugggcaggauucuauucaucacuguaucccuaguggcuaccacaaugcccggcaaaagaaggaucucuuucuguggugguugccuuuuaugucuuguguaggcccacugcaaaacugggauuuuauaaaucacaaggaaaguuuuucaguguaauuucugguuuugauuugaaucauaaaaaggaaaauguguuuauauauuauucuaaaaccacuucaaucaaauccauuguuuucuuagcuucuauuauuuuaaaaacguggccaauaugacaguauugccaagaaugguuauugaggaguguagcauuucauuuauaucuugcuuucucgaacuuuucuuucuaguucagcucccuggcccagcaccuaaccuucgugcauaugcagcuucgccuaccuccaucacuguuacgugggaaacaccagugucuggcaauggggaaauucagaauuauaaauuguacuacauggaaaaggggacugauaaagaacagguaugaagugaagcaacuuuucaaaccauugauuggaauaguagaguugaaauauauuuccaaaacucaguaguugcuugacuggaaaugugagggggaaaaagaaacauaggaaaugaaaaguugacagauucuauuucuuuguaccaagauuuauuguguaguuuuuaccagcaguggucagugaacaucaagcaguauuucuaaguaaauugucaauuuaugauucaucugcuuugacuauugaagaaccuuauguagaagggauaaaaucuguuucauguagaauauagaauuuguguagcuaauucuuuaauuuucaacuuuucuuuuggcuugagugcauauguauaaaguguuuuauuuuauucaaggauguugauguuucaagucacucuuacaccauuaauggguugaaaaaauauacagaguauaguuuccgagugguggccuacaauaaacaugguccuggaguuuccacaccagauguugcuguucgaacauugucagauggugagucuuucuuccucuggaacgauauaccacacuuggugccccuagugguuuaguuguaagaucaugagcuuugaugucuagaagauucaguucaaaucccaauuuuaccucuuucugguaauaugacuuuagucaagucugaacaucuuuuuucacguguaaaauguagauaauaccaacuucauugaguugcuguaaagauucagugagaaagcauagagcauaaagugccucuuacuggauaggcucucagcguuuguguuuuuagcagaagcuuuuguguaaguaaauacuauugcuuguucauaacacagaccauuccagggcuuuuggaagacuagccuuauucuacuuagcaaugauauuugcaugccaaauuagucuuucuaguuccuccguauuugugacuguuuuaucucucaccugugacugaauuucuaaauuaaguuauauauauauauacacccauauauauguauauacacccaugaccuagagcaguguuuuucgaacuacagcuugccaaagagauuaaguaggucaaaaccagcauuuaaaaaaaauauauuuuuagaauagaacagaaaagauuagaguucauugcacuuaguaaggguauauguuguuucaugaaacucagcuaaaucuuauguuuuagaaaaaugucuuuuuaaaaaaacguauuuauguguauaccgcucuuacguaaacacacaugcuuuagaagguaaaguuugacucccuuaagaaaagagucaaacuuaacaucaccaauaaaagaacagacugacaucacgugcccccuuaugugauacauggaggaagacacaauauuacuucuguuauaucaguaccaaaaauauuuaacuugaaucugaucaugaugaaacaaucagacaaauccaaauugagggaagcucugcaaaaaaaauuuuuauuuuaacugacuuggauucuuaaaauauauuaguuuugugaaagaaaaaaaagguugaggaaucauucuagaaucuagauuaaagaagaguaaagacacaugaaauaaaauauguaugaucuuuggauccugcaucuggagauaaaaaaacagccauaaaggacacuauugguauaauuacuuaauauuagauacauaugguauuaggcaauaguaaauauuagauauguuauuagcuauauuagauaauauuuuuguguuaaaauuucugaaugugauuguuguauuguguacuuuguuggagaauguccuuguucauaggagauacauggcgauauacacugaagaauuuuggagugaaguaugaugacugcagucaucucucagaugauucagaaacaauauguagauagauaaaucuguauacauauacauaauaguaagauaaauaaaacaguuguugcagaauauuaguaauugugaauuugaaaagaacagccauucauuguacuauucuugccacuguuuuccaugggcuugacaguuuucaggauuaaaaaguugggaggcuuggugcaguggcucaugccuguaaucccagcacuuugggaggccaagucgggcaacuuacuugagcccaagaguucaagaccagccuggacaacaugacaaaacgccaucucuacuuaaaaaauaauaauaauagcugggcauuaguggcacacaccuuuaauccuaguacucaggaggcugaggugggagggucaccugagcccggggaggucaaggcuucagugagcugugauuacaccacugcacuccagccuggaugacagagugagaagcugucucaaaaaaaaaaaaaaaaaaaaguugggaaaaagaaacaaauaaauuacaggcgguuauaccuuagcuagugaacuacauaagccaguuaggcaagauacuggggaaaaguuaagggaaaaaaauguuuacuguaggcuguuaaaucuacacacgagccaaauuuuaacugcauuaaguguguuggcauguugacuacaguaccugugggaacugaacacaucucagcaugguggcuaggggcagcacuuuggaauaacgcaaaucuugguuccgaugccaggugaaacaaauaucuuggacaaguuaacuucccugaaccucuucuauaguuuucugaucuacaaaauaggaaugagaauagaaacuccguccugagauuauuauaaggaauaagugucugccauguaaugaccaugcagcaaaucuuugcuaugauguugauaaugaagacaaugaugacagauauguuggauaccucugcaaccucagucacuucuuaacauggagaugacuggaaucauuaauguaauuuuuucaaaacacaugugccuggguccuacuccagacuaccugaaucucugaguuuaggcuugaggcacuuugcuaggcacaaguuacagaaaggagcaagacacauucucuugucuuccagaagcuauagcacagugggcacuuaguuguauaccuggucaccaaauguuagagacagaaaaagagaaguuuccacggguggauuaggagagaagggcuaaagucagcaauuuguaagugcagagaaaacaaauccgguuuacuuugcuugcucucaccaauaugaagggagauacuagagaaugugugggccacacacugagauaacucuggauuauguucuaaagugaggaacuaaaguuacguggcuguuuaaccaacagucccaaacuucucacaucuaaaugaguauuuucugguaucugguugccucaggaaaccagaugguucacuuuaccaguugucauugcuuaaauaucuuugcuguacuugggaacugccuucaaaaccagcuuagaaacuccacaagaaagccaggcuuacugauguauguacaucucauuuugauccaucaugucauuacccaguucagucacuugccauauuccuuagaccugguuccagaaaaaccuaugguugucugccaagauaaagauagaccagggccaggcacgguggcucaugccuguaaucccagcacuuugagaggccgaggcagauggaucaccugaggucaggaguucaagaccagccuggccaacauggugaaaccccgucucuacuaaaaauacaaaaauuagccgggcgugguagcaggcuucuguaauccuggcuacucaggaggcugaggcaggagaaucgcuugaacccaggaggcagagguugcugugagccgacaucacgccauugugcuccagccugggcaacaagggugaaacuuagucucaaaacaaaacaaaacaaaacaaaaagauaaaccaucaccaauaauacucaaaagaauacauuuaagguucugaguacauauggggucuagaaaaguugagagucuuuagaagaguucagagcuacuguacauccuugaaauaaauaucugacuucccaaagguacagccuggcuuggguguaggugcuuucccauaugaaagugucuuauguuaaaaauugaaccaggcauggcuauaugucauccacauaguauugucaacaugagggcauuggcagcuaguuuagaucuggucacguaaucaguguuugagaugugcauuuguuuaaaguccagccaagaugaucacaugaugggugauguaugggugauuaaaaaaaaaauuuuuuuuuuuuuuuuguuucucuaguucccagugcugcuccucagaaucuguccuuggaagugagaaauucaaagguaaaacuguaugaugcugcuguucauuuuuacugguauacuguugcgccucagaggggcuuauagaaagggagauucuguaggaaagcaucaaaauaaaugaauggcgaugugguaauaaucugcauuuaaaaauaccaaaccuauaaauuagaacguaagugaaaaaaaucacaagcaaagaaguaaaaagacauagauauuacacuugcauuaaagcugggcuuaaaaacccacucauuuauucuccuuaauuuugcuuccuuccucugacaccaaaacugcuuuaacauuucugcaauuaaauugcucuuuuucuguaaaacauuacauucuagauguuaacuguucagaaccuuagugguacggcagaaggaaauaaguuguuuauaacaugguuccuuagugcugugagaugagccaugugaaucaaaggcagaccucugucagauugguuguaucuccucaaacuguccuuccuauagccaaguuugcuguguucuuaggggccauguuugccucucagaggcccagagcccuucuggacuacgcagacaacuaagauaaucaguccuuucaggaaguacuguagagagccaaaugcaguggcucacgccuguagucccagcugcucggaggcugaggugagaggaucacuuaagcccgggaguugaagguugcagugagccaugauuaugcuacuacacuauagccugggugacagagugagaccccgacucuaaaaaaacaagaaaguacuauagggcuccuuuuuuuuuuuaagaggcaaccagcuguuaauuaguuguccccuuuuuaaagaguuuuauauggaaauugucuaauuucagcucuucugcacuggacacgggaaagaaucuuuauaccuaauaauaguuaguucccuaauccaugugcuucuggccuucuuauacuuuccuucugaaaacuuuucugagacuuuuauccaacaucaucuuucuggcaaaacaaccaggagaucagggguccagaguguacuacucgaauauauaaucuucccauuugaucauugaggguuuuagaauuuaaagguauuuuugagugauuauuaaauaacuuuguaaaacucugaguaccuugcugccucuauguuuuuucucuuuaaacaguaaaaucaggauaaaaauauuuaaaacaggaccaagcuuuugauauauucagccuuuuuucuauaauucugucuugugcagaguauuaugauucacuggcagccaccugcuccagccacacaaaaugggcagauuacuggcuacaagauucgcuaccgaaaggccucccgaaagagugaugucacugagaccuugguaagcgggacacagcugucucagcugauugaagguaagcuaccgugcacaaaggcaaaagguacacugugucuuucucagauauugaauuaugcuagucuaaugacugcucugaacugucgacuuauacaaacaaauuuaaaaugguucagaaaauuuuuaaugguucaauccacuucugacuugauagagauuaauggaaaacacucuuaaagguucugcuauuucugaguggugagaucgaguuugauuuuuccuuucuuguguuuucugcauucuccauguuuucauuuuugaguguauuuauugcuuuuuuguaaucuuaaaaaugauuaaagaaaguuauauaagcauagaaauuaccccacucaguauaguugguaacugaggucuacaaagugguuuuuguaacaccgaccaccacucguguguacguggccugaaacaguauuugugaauagcugcaucauugcaauaaucauacaugcgacuauggacacgauaaaguuuuagaaaauacuaucaggcaaagcuccuucuauauaguuuucccuucauaugcaacagaauaaguggcauaccugguaaaaauggauccacauguguaucuaauaugguuucacccuggagaucacagagaauccucccgucuuccucaaggaggggaaguagaguuggcuaagcaaggggaagguucuuuugcaggagaaacaugggaaccagauugagugcuuucacccugugaauguugagaucaugccuacgaagaauugagacagaugccccaagcuguccuuguuccauuggguuuucauagaugcuuaauauggcugcagaaucgacuguagucugagcagaccccauccugccgacuccuuuauuaguuuagcagugccaagacucuguccugcucaguuauacaugccucagcuucagcaccaucacccuaccucuguccuaggaguaaacucacaugggcugggccuguuggaguauugccucagcugcaucggcuuaguuuugucacucaauagagcccaucuguuuugcaagcaaacagaugaauuugagacuaguacauuuacaaccaaaaggugugaguuaucuguagcuguaacaguauagucacagggcauguuuaaucucgggacaaaagcucugacucggguaauuuuuuugcuaggaaacuccaaagcguguugguagauaagaacuauaagaaugugagauauugucauuauuuucuaagcccaagaauuaauuucaucacccuuuggaaacuuuaacuuucuuuauauuuuaucucuccuggguagacauugaaaggauuacagaagcuuggcaucacccacuuuccugugaccccagggacaggguucuugagagaaccaagaucuggggucaaaaagugucacguuuuccagccaggugcaguggcugaugccuauaaucccagcacuuugggaggcugaggcaguuggaucaccugaggucaggaguucaagaccagccuggccaacauggugaaaccccgucucuacuaaaaauacaaaaauuagcugggugugguggcacccaccuaugaucccagcuacuugagaggcuguggcaugagaaucucuugaaccggggaggcagaggccgcagugaacugagaucaugccacugcacuccagccuggacaacagaguaagacucugucucaaaaaaaguauaauguuuuuacuuguuuauggguauaaguuucuaaaaauugagagagccauugauagugaaaaacugugcucuaguaaucagcaagcuucucacuccucaccucacaaaugggauugacuuccuucagaauaggagaaggugaauguuugucuccaggggcaugucuuucagucuuccagcuucuucacaagaaccccacaucucuuagcugcaguccauaucaugacugcaguagauggugcugagaaauaucacuaagggagcauuggccacagauguucucaaagucauuuucagcugagcgugguggcucacgccuguaaucccagcacuuugagaggcugagacaggcggauuccuugagcccaagaguuugagaccagccugagcaacauggucaaacugugucucuacaaaaaauacaaaaacuuuaauggauaagcagaggcugaaaaaaaaaaaguauaaaaauuagccaggugugguggugcucaccuguggucccagcuacuugggaggcugaggugggaggaucauuugaacccaggaaguggagguugaagugagccgugauugugccacugcacucuagccugggcaacagagagagacucugucuccaaaaaaaaaaaaaaaaaaaaaguuucauauuuuacucuacauucagauaaauaacauuugccauuuguaaggcuuuucauuuugaauauuuaguuguauuuauuauauacuaggcaucauucuuguugcuguuaaaaaaaaaaaaaaagaguauaguccuugcccaugaggagauuauucauuuucucaaugaaacauuugauguguaagcaaaauagaauuuuuaugguaaaaauggcuuuauauuaagaaaauucuuacauuuuaaaaucauaucuggauuuauucauuuaauagauuucauugaacuuuuguuggcauguucuggcacugaguauacaacguugaacaaaaauggagaugcuugcacucuuaaagcauuaacuugaagccugauaaguauuagggagcaguauggaucaccaagauccuuuaccaacaacacauuauaugauuaaauuugaagcagaaguaauuauuguuauagcacuaaacagaucuugccauaucuuuaugauauguauuguauaccuuaguuguagucuauaaacucuauaggguacuuagagggagaggaacucagccucuuugcauaguaccucauuuuugcuugcucucucuuacaucccagugguccccaaaggacagggaaugauugguuggauucuuucaagaucuucauugaguaguguuugcuaguaauccagauuaucgucugucaacaaacacucuaguacuuucugguucauuguguggggagacaaggagauaaauugacuugggcccaggcauuuugcuccugccuuuugucuugcuccuugcuuuguggggcacacagaugucaggaugggccuaccaacucuucuccccuaccacgggacaggauuagcuaaccaaaccagggcuuuucucauguccuggccaaguuauguucucaguacuguugcccugguuuguagaauagacuuuucuaugugcauguuuguugcguuugauacauugguaagucauguacuuuauuagcugguaguaaauuaaaaguugcauaacagaaagguuugggucauuuuccacuuuuacuuacuauauaauauaugagcaauugguuguuaaggaauagauuuugagaccguauuuggugcuuaaaauuuuucugccaugauuaugagguggcucagagaacagagguaacucaauaggaguuacaucuuugcauucuuuccuagguuuuagugccuucuaagaccagauaccuuuguuccuuuuuuauaacucuuucauuguucuuggccucuuuuggccuuagcuuucuuuguaacacaauaaagggauugcauuaaaugaucucugaggugccuucaagcucuuaaacaaaagucuguaaucuccugggagcuucagucauuucuguuuuccucuuagauugugugggcuucagucuuugcuuuauuuggagauggaagcuacucuauguuguauuugcauuuugccuacacuguauuaacuuaaacugaaacuuugccaagcuauauacugaguuggugacugagauguuugccuuaaugagggauuauuaaucuuuuguuuuuccaaagcucuuguuucaguugucuucuuugucauuuggucucaggucuugaucgggggacugaguauaauuuccgaguggcugcucuaacaaucaaugguacaggcccggcaacugacuggcugucugcugaaacuuuugaaagugaccuagaugguaagaauaacaauuggcaagacuggaacacaauagauacuagcuguagucaaaugagucaaacuggaaagccacagacuugggguggauauggcucaagucugugaacuuuagugcaucacgcugcuguuguuccuguauugcaucgaggcugcuggaauggauuuuuugcagugccuuguagagaacuguccuuucaagcagaacuagagcaaauaaaaauguguaugugcuauaaguuggauuuuuuuuuuaaucaaggccauuaaguagauggaugaucuaaaauuuaaggcugagccacauaaaucaugccuuuauuucaacugcaguuucccuuuucuuuuaguccuggacaccuugcccuuuuucucacauguuuauucagugaguacucccaaauggguguguauagguagcaccuuuaucagugauaggugcuggacuugggaggcaaaagaccugaguucuuguucugagucucauuuuacuaauuuuuuuuuuuuuuugaaaagggaucucacacugucacccagucuggagugcagucaugguucacugcagccucgaccucccaugcuuaagcacgauccucccaccucagccuccugagcagcugggaccacgggugugugccaacacacuuagcuauuuuuuuuuagagacagggucucacuauguugcccaagcuggucuugaacuccugggcucaggugauucuuucuccuuggccuugcaaagugcugggacaacagacaugagccaccauaccuggccucaguuuacuaauuuuuaaauuaagguaguaacuuaugcccugaaaacaguguaugugaaagagcauguaaauuuccuccuuuguaagccucuuagucucucaccaauugaaucaacuguggcuccaaacuuucauguuuucugacuuaccauacuacuuaggggaguaaauaauuggugcuauugcuauaaugugaugcuuaaacaccuguuaacaacaggcuucccacuacucaguuuaugccuuucucauuccaccugguagaguuugggaauggaugugggaccaagagagaugguaacuauugaaaggcaauuuauuuuucuccauuggggcagaagagguucuuguaucucuuuguuuucucuuccaaauuaauauugcagugucuuguauuuaaagcuguucaggucuuuuuuuuuuuuuuuucuuagaaugcaguaaaaucaugggcuguauuucacuauacauacagauucuuuuugaacucuugggcauaauguaaaaaacuuagccccaaacagugugguaggaagcuaaacaccauuccccaaggauggugagauauuuuaaaggacaguauaucucaucuugcuuuuccacuuuuccuucccagaaacucguguuccugaagugccuagcucucuucacguacgcccgcucguuacuagcaucguagugagcuggacuccuccagagaaucagaacauuguggucagagguuacgccauugguuauggcauuggcagcccucaugcccagaccaucaaaguggacuauaaacagcgcuauuacaccauugaaaaucuggguauguuugcuaaguagagaaaguuaauugugugggagauuccuuucuuuuuaaccuuuuauguaauauuuuuauuuuuacaagaaaauugcgaaaauaguacaaguaauuucugcauguuauucaccugaauuccccaaauguuaacauuuaaccacauuuacagcuauauuuugcagaaugccccucaauuuagacuuggcuuaauauuucuucauuacauucagguuuugcauuuuuggaaggaauaggguagaaguguuggguuucugucagugcaucauaucaggaggcacauuacagccuauauugauaaugauguuaacuuuaaucaguuggcuaaaacgguaucugccacauuuuccugcuauaaaauuguuauuuuuuuccuugguaauuaaaaguaucuuguggaugagauacuuugagucuuuauaaacaucuuguuucccauuacacuuucacucccuaguuucagcaucuguaguaacaguuauuagaaugguguuuccccaguggugauuuucuaauuccauauuuccucuacacguguuaacauccugugauaaggaagaacuuucuuucaccccuaugaagagaauggccaaugggaaucucuuuauaacugguuccuguguccauuugacaucuuccaucuuucuuugagcacuuucuuccuuuuugacaacauaguaagauguuccuggcucaucuaguauuucacuagccucggcccuggaaccagccauuucucuaaggaacccugauuuauuuuaugaaaaaugauuuuggaaaccaauaucugggcacuauaucuauucauuguaacuaggguagaaaauccuaaggaaucuacaaaagggccacaagauacaaagugaauauacaaaaacaguaaaaugauuuuggaaaccaauaucuggucacuauaucuguucguuguaacugggguagaaaauccuaaggaaucuacaaaaaggucacuaaaacuauaagugaauuuagcaaggccacaagauacaaagugaauauacaaaaacaguuguaucuccauauacuaauaauaagcaguuggaaauuggaauuaaaauaacaauaccacguagaauagcaucaaaaaauaugaaguacauaggagcagacuuauaaaauguguguaauaucugugcacugaaaauagaaaauuguuacugagagaaauuaaagaauacuuaagauaccauguucacugguuggaagccgugauauuacuaaggugacaauucuccccagugcaguccaagaaaagucacaauaggcuuuuuuguagaaauugauaagcugauucuaauaauuuuuaugaaaaaucaaaggaacuagaauagacaauuuuuuuaaagaauaaaauuagaagacccauacuagcugauuucaugucuucuuauaauugagacauaguggugguauuguaaaggaagauguuauacaucaauggaacagaauagaguccagaaauagauccauauguauauagucaguugguuuuuagaaaagcugcuuagauaauuuaguggggagaagacagucuuuuuaacaaaaguugugggaauaccuggauauccauaugagaaagaaaaggaacuuuaacccuugucuuacgcuauaugcaaaaacagaccuaaaugcaaaugacccaaugacuuugggacaacaauucuagaagaaaguguaggaaaaaaucuuuaugacuuugggauaggcaaggaccucuuagguuguaaaacagcacaaaucauaaaauuuaaaaauugauaaauuggauuucaucaaaauuuuaaaacuucuacuuuuagaaacauaccaauaaaaugaaaaggcaagccacagacuuggagaaaauacccaccauuuaaauaucugacaaagaauuugaguccaaaauauauaaaaacucuuacaacucaauaauaagaagguaacccaauaaaaagugggcaggagauuugaacagacacuauaccaaagaaaauauaugaguggacaauaaccauaugaaaagaugcucggcaacauuaaucaucagaaaaugcaaauuaaacccacaaugaaaugcuauugcacacccgcuagaauugcuaaauguuaguagacuggcaauaacaaauaucaacaaggauacagaacuggaaugcucauacuagcugguaggaauguuugacaguacaaccacuuuggaaaacaguuuagagguuucuuguaaaguuauaacccaguaaucccacacguagauaauuaaaagaaauaaaaauacaugucuguguaaaagcuuauauacaauguucauaguaacuuuaugaacaaggggaaauaacaaauuuucaucaacagguaagugguaaaucgugauauauccauggaguacuacucagcaauuaauaggcuaucaagacacaacagaaauuaaucucauaaacaugcugaccaaagacgucaaacacuguuauauuuugugaauuacaaaauaggcagaauuuaucuauagugacaaagcaagaucagugguugccuggaaccagggguguuaggaaucaacuacaagggcaccagggagcuucucggaguauuggaaauguucuauaucuugauuuuggugguuaugaugcaagguauauauauuugucaaaacuguaaauguacaguuaaauggauacauuuuauuauaugcuaauuauaccucauaguugacuuuuuuuuuuuuuuuuuuuuugagacagcaucucacucuguugcccaggcuggagggcaguggcgcgaucucagcucacugcaaccuccaccuccuggguucaaaugauucuccugccucaaccuccugaguagcugggauuacaggcuugcgccaccaugcccagcuaauuuuuguauuuuugguagagaugggguuucaccauguugccccaggcuggucucaaacuccugaccucagaugaucuacccaccucagccuuccaaagugcugggauuacaggcgugagccacugcacccggccucauuguugauuuuaaaagcaaaagaauuugagaaauauuuauauuuuauaauaaauaauuuauuuuguuagguauaauuacuuuuccaaauuggauuaucguuauagaucuuuuuugaaacacuuguuucuaaaauuaaaaucugcccugaccaaauuuucauucagaucguuucuuuguaaacaucuuuucuaagaacaacuucaagugccuaacagaagaguuauauucauccuuucuguuaaaaaauaagcugggauuuaaauauucaaaaaaaaaguaaccuuuagcuuuuuccuuacaaggaagaaacaguacaguuaaccuaggaaauguaucccccacgugaacaucuuuuaagacaauuguuagcaaaaggaaagcuuugcugguagaauaaaaaugucuggccaggcacaguggcucacaccucuaaucccagcacuuugggaggcuaaggcaggaggaucgcuugagcccagacguucaagaccaacuugggcaacauauugcgaccucaucucuacaaaaaauuuaaaaaauuagcuaggcaugguggugugugcuucuagucccagcuacucgggaggcugagauaggaggaucgcuugaucccuagaggucaaggcugcagugaguccugauuauaccacuguacuccagcugggugacagagcaagacuuugucugaaaagaaaaaaaaaaaaugucccuguagugaccagcuucauacuguuuccuuuaugcaacuacugaugugaaacuccuuugcaguauugacaggacaugguccuugaucuucaggugcuuucagucuaacagaacaaaaagaaaacacaagaaacagugaagugaguugaagugaauuuuguucagagaagggagaacgcuauagcaagacacaguagagcagucagggaagaaaccccugagcuugaaagauagaaucaaaauagcguuugaaauagagagaugagaggagugcugcaugugcagaagagaguaagcagauagaauuuauuagaaaauggagugcacauugcagaguagcaaaaaaauuaaugcagcauaaaguaaaauaagcuugagcuauaauuauugaccuagauagaucuaagaugccuaugauguugaguaaaagaagcaagugagagguggagaaaugcaguuagcaauucaucuauucaucauccuggaacucuccccugaccuucagauccauauaaacaucugccuacuggguaucagcaccuggauauaucucauauuccaucuggcccaaaauuaaaguuaaugccuucucccucaaaccuguugaucaaucagcaaauauuuaauaaacacuuacaaugucccagacacugugcuagagauagagcagagaaugagacagacguucucacaauuauuagaaauaauacaauucaaaaauaauugaaauuguucacggugcugagggagagaaaugggcuguguaacuagagaggcuaguccaguguggaaugagcccuuugagaugaauaggcgcuuaccuagguaaacaggaagagugggaugugaccccagcauagggagcagcugcaagcgagaaggcccuguguuggagagaacacagugcucagugaacugauaaguggccgguaaugauggagcacagagaacuaggcaaagaguggugggagaagacaaguaguagauucaacaaaacuugauuguuugucuggaggggaugagggaaaaggaggucuuaauaacucccagguuucuggcuugagcagcaggguuggugguagugucguuuacuaaaccaggggacacuggagccgaucugaagcuggaggcagggugggaagggaaagauuugagacacccaagaggaaaugccaaacagacaauugaacauaaaggucuggugcucauaagaaagauccagacuagagaucuguauuuguaauugaugacacauacaugcuaaucaaagcuaaggaaaugaaugaaagugcauagggugagagcgaagagugggaauagaagaggaccuagaaucaagccuugcacauguguauuaugguugcucuugccccuuuucccaaucucagugaaugacacugcuaucuacuguguugcccaaagcacuuuuuccuugccagucacgaaguaagucuuacugauuccauuuguuguuaguucugacacaggaagaccaggugccucuauuuguugcccucuaguggcaaucuagggagugggugggccgccaagaaaagcagcuguuuuaagcuuuugagccacaugaggcauggcucaugaggcaugauggcuaggugagguuuggccauuucuggauuuggaggccacuuggagagucaaggacauugagcacuuaacugacuuaacaguuuaucuccuucuucucuaccuugucuguucccaucgcuguccuuccaggaaugaaagggguuuguuuaauuccaagcuccaucuauagacuucagcacauuaaaucuuaucucuucauucucagccaagcccuacaccauacccugaacaucacuaaaccauaggagagaccaagagagaauucaaacacagcccaccuccucuacugagacuaaauccgggaaguuggucccagccaguuuuucuguacuguguguacuuccaucuccauaucucccuacaaccugaaauaaucccccauaaaaauuuuuaaaguugucuuucuugaauucuucugugguuaagauuaugcacagccacccuugaauuuuuaaaauucuguagugagcauuuuuuuaauguguguuucuuuuuuuucagaucccagcucucacuaugugauuacccugaaagcauuuaauaacgugggugaaggcaucccccuguaugagagugcugugaccaggccucacacagguaagguauccuaucuuuccuagucuccagcacuuuuccuagcagcuuaggcagaauauuggcaugaggccuaucccauagguguuagggaagaaaaagcauauggcaguuucgggugcugacuucaaaugggaaagugggcuuucagcauggaaaguucuguuaauuuguuuugcuuuuuuuuuuggaagauucuaauucugccacguaagccauucuguguagauauauacacguuuuuaaucuguuaggauguggaaagcagaguuuuuagauaauuaaaagugauuuuccgucuuuugggcaugugaguugaaacuaaagugagucaaaaacaaaaaauguagguuacugacgguggcaauaaaugcaugcgauucgugaacccaacaucauuugguuacuagccaccugaguugguuaggaaaguguuuuucuaugugccuuuuguaagcuugaguauaaggucagagguacuauccauuugaucaguuauacauuuauuacaaacgagaccaaauauucauuguuuuucuuugaauuaucuacuuaaaauaucucuaaaggccgggugcagugguucaugccuguaaucccagcaguuugggaggccaaggcaggcagaccccgaggucaggagaucgagaccauccuggcuaacacagugaaacccuaucucuacuaaaaauacaaaaaauuagccaggcguggugcugggcgccuguagucccagcaacucggaaggcugaggaaggagaauggcaugaacucaggaagcagagcuugcaaugagccaagaucgugccacugcacuccaggcuaggcgacagagagagauugucucaaaaaacaaaacaaacaaaaaucucuaaaauaaaguaauauacaugucauguaaauuuuucuauagauauauaagacaucuaauuuagaucugaaagagaaaguuuauugaauauguuagaguuauaaauuuuuuuucuuuuuuuuauuauacuuuaaguuuuaggguacaugugcacaacaugcagguuuguuacauauguauacaugugccauguuggugugcugcacccauuaacucuucauuuaacauuagguauaucuccuaaugcuaucccucccccuccccccaccccacaacaggcccuggugugugauguuccccuuccuguguccauguguucucauuguucagcucccaccuaugagugagaacaugcgguguuugguuuuuuguccuugcgauaguuugcugagaaugaugguuuccagcuucauccaugucccuacaaaggacaugaacucaucauuuuuuauggcugcauagcauuccaugguguauaugugccacauuuucuuaauccagucuaucauuauuggacauuuggguugguuccaagucuuugcuuagaguuauaaauuuuuuaaaagggcacuggaaaccaaagaauuuauuuucggaaauguucuuuuucauuuauuuccaaaaauuuugauucuuuauuguccagugauaucugcuggauauguugcauaauugugcagauuugguaacauucuuaaggaaggcuuaccuuuccugaaggaagaguacauccuugaguuccuuuugcuuuauuugggugugagcuaugucacucuacugccauuagacccagaacaucagggggccuaauauucucuguccuuuuuuuuaagcuucuauuuaagacuacuacauguuugguaguucuguucugucuucuauaugcuuacaguuuauaauuucuuuuagaaauagcuuuaguauuacaaaaaggagcaaaaauuaagugaaaaaguauuuaaauaaguggucugcuacuuucuaaaaucaggcuauaauaguaaaaaacaaauuugacauuacuuccuuuuauguggcuuaaaaauauagccuacuagcuagaaauacacaagaaaauguuccuaagucauguaaucuagauauguuuucuaaggguugcuacauauaagaaaaaaaauuucuacaagaauucuaaugacuucuacaccugaaggugcauuuucuguaacuaauugguauguguccugccaaacuuugaacaaagcucuugguuauauaauguaugcuacuccucuguuauuuuuaguccucauugcacaggaaauacacaaauggagacuauuacuuuagcuuagcaauuauucauaaacaagguccaugccauuccacauuuugaguaauaagggcuagucaccaugacuaugugagaaacccauuguaaacugugaacuuaaaucaguauguguaaacuuagaaaaccuaagcaugaauugggaaagcccguauggauucugcuguauugcccugggcccauggugcauggugcuuuugugcucauucuggccucagagaaggugucuguuguauauggcacaggacagcuccaugaguauagacuuuccaucaaauaaguacuguacaguacucugauuucuaaaguuugugaaguuuguuacuuggaacugugauaaccauggcauuuccguuaacugaugggaauucaucacuggguuguucucugacucuguggaagaaacuaugguagauaguccagcauggugucagcuuaccuuuccugaaggaagaguacacccuugaguuccuuuugcuuuauuugggugucagcuaugucacuguacugccauuagacccaggacaucaggaggucugaacuugacccuuuguggguaucagauaccgucaauacccauggcugacauucaagacucagguuugaguguuggacccuuacaugaauagugauaugcacagauaacucuugucccaaaaauucagccacauucacugaaaucucaaaccaugagguuuguauugcuuguuuagaaauuguaccccugauucuaaaagcaguuuuugucuucgugagccuuuuugguuuugggguuuuuuuguuuucugagacagagucuugcucugucacccaggcuggaguacaguggugcaaucucagcucaccgcagccuccaucucccagauucaagcgauucucaugccucagccucccgaguagcugggaccccaggcaccugccaccaugcccagcuaauuuuuguauuuuuaguagagacagguuucaccauauuggcuaggcuggucuugaacuccugaccucaggugaucugcccgccucugccucccauagugcugggauuacaggcaugagccacugcaccuggccucaugaggcuuuuugaacaggaaguagaauuuucaaguuauuuuaagaaaauucaagcacgaauacauuaauauaaucacuggauuauaacauuuuaauaugccuauagaaugcaguagagaauauaguuuauuacugcuucucuuaacauuuuucuguaauuuuuuccugaaagaacacaaguggaaauagucuuuuaaaugaauggugguuaucuauuaacucugaauuuucuuucuuuuucuccauuucucaccuuucauuccauuauauuacccugcauuucccuuuuauuuuauuuuuguuuacauuaaaaugccacuucccuuuuuaaauuauuuucugcucagacacuucugaaguugauuuauuuguuauuaaugcuccauacacuccagugccagaucccacucccaugaugccaccagugggaguucaggcuuccauucugagucaugacaccaucaggauuacgugggcagacaacucgcugcccaagcaccagaagauuacagacucccgauacuacaccguccgauggaaaaccaacaucccagcaaacaccaaguacaagguacugacacauuugcccuggcugaaaaaagcuaaucauugauacuuucuaauuuuaaagucucaauucauguuuuuuucagaaugcaaaugcaaccacuuugaguuauuuggugacugguuuaaagccgaauacacucuaugaauucucugugauggugaccaaaggucgaagaucaaguacauggaguaugacagcccaugggaccaccuuugaauuagguauguguugucagaagccaugucacauggcugcuuuuacuucccaaggaaagaauugagugccugaauugacauauuuacaaaacacagugagcaacuacauuuggaauucaguguuugcuauuucagcugacaaguuguguguuuuuaauuacugaacaagaacauuagcaaauaacaggauacuacagggaaaacaugauaaauuacaaagcacuggguagauguaagggauuauugccauuaauccugcuuuacugguaaacugagauagaaaagaugaagugaccugcccuugaccaggcaguuccaaugccaugcuugcuuggagccugaacacuuugcugggugaccccaaagcugccucugcaguuugcuugcaagcaaauuagcgucuuauaaaaucuuccacugaaauaauccuuaaggucuuuguaaguggacacgagagggaaaagaugacuaagcaaauuaaagagagaacaggcuaucuggguuugagauucuguuugguuuuugcugacuuuuagacaugccuuucugcuacccccugggcuuuccuagucuagggauaugcauaaccauuucaaaucucugucuauuuuggccuccuauuucucuccuauaugaauaauggaguuauaaauucuccacaaacugggcuuggccucagugucuuuuugucuucugcacaguucacuggacuuuguacagagagaaggguuggauuugaagaguuagaaauacaguacaucaaaguuuaaauagaccuugaguuugcuuucuuugccaaccauuuuaagaaaauguuuuuacuucaauccuaacccauuagauaacaaaugagauuguguuuucccuuaggauauuugcauuucaccaggcuuccuuacauuuuauacuaagagaauucuaguauuuuaggaagaguugaguaaauuuaaggauguacuuaauuugcucauuuuccuacuaguguguuaaaaguuuucagcuaucacauggaaacacaggaaacguauuguccuguugcauaaacgaacagcuucacuuuagagcuguaaccucaauaguuggcaguauguuugcagaauaaacucauagugaaaaauauuaaucuguaaaucaucuauucuuugaagaaauagggcuuuuaaaaguuauauuuggggcugggagugguggcuugcaccuguaaucccagugcuuugggaggccauggugggcggaucaccugaggccaagaguucgagaccagccuggccaacauggcgaaaccccaucucuacuaaaaauacaaaaauuagcuggaugugguggugcgcaccuguaaucccagcuacucgguaggcuaaggcacgagaaucacuugaacccaggaggcagagguugcaaugagcagagauugugccacugcacuccagccugggugacagagcuagacuccaucucaaaaaaaaaaaaaaaaaaacagcuauauuugguuuggagagccaacuauaaaugagagagaaaacuguuuuacaauuuacaguauucuaacaaaauaauccagugugacagggaagaagucaucuuggacgaauuacauaacuucucuaauuuuuugguguccugauccauaaagcagagauagugauaacuaccuuucaaauuuucuacaaauacuaagugagauacuauguguacguuaccugguauacgguagguacuugguacaaaugccacuugacuuuccuaccuaauuauccuguuuaucccugacucccagccaagaugccaauucuguaucuucauaguaugguauuuccucuuugguacucugaauauucuucuuuugauuggaacuuuugauagacaaacugugauuucuuugaagccagaagcuuuaucuuuuuugccuugugcccuuuauuuugccuuacaaguggaaaagguugaagaaauagugaacuaauuugaaauggacagaaauuauuaaaaauuuuguuauuuuguaguuccgacuucuccacccaaggaugugacuguugugaguaaagaggggaaaccuaagaccauaauugugaauuggcagccucccuccgaagccaauggcaaaauuacagguaaaaugcaaucaagugugcauuucuuugugcgcucuuccugccugacaggaguauuccaggagaguaccauguugcugggagaagugggagucugaaggcuggcuuggucauuuuaugguaaggugugagucaugaugguccuugaaauuggggugaggcugugcuggucgcccauagcggcauaaaauggguugccuguuggugguucugacugcagucggggaugggaggcacuagacagccuuuggcuauagugggacuuuguagacauuuauuuuccuuaggaaagcugcucuucucugucuccgccuagauggacagcuucagaauuauauacccccucccugguucuguagaguaauacccaauaaacagagauucugcucuuguacccugaagccacaaaaaaaaaaaaaaaaaaagcccauuagauauuuaauuccuuuucacugccccccgagaccugcuacuucaaguaccugugcucuuauaauuagaguuaaaagugaacuugccuaggucuuuguagggaccuggaauuuuuuccuuguacuuucagaggaaaaccuuccacaguagaggggacacucugccuuccucagccuuaucagggauggaagccugaugggguucagcugcucuuacuuccuuuggcgccucuggcccauguaggugugugcugaggaacugggguuugcccugaaguuccucuguaugaauagguggccuaaggaaauggaaaguguuucuuagcacuguccugcuucuugcuuucaguaggaaucucuuucuguacauccuggucuuuaugucauuuuuuuagguuuugacuuugccucuuuugugaaagaaugaaucaugacuugacuuggauuacauuuuacuuugucuuuuaaaaccggcaacagcgcagugcccuuuugcugugggucagauagauucaugguugugaugcuucccuucucaauguggggauuaagugcccccugguggaaguaucaggugacaguucacuguggcucugcccaggaguuccuaggagaucacaucgguaagagcuaaaacagccugucaggcaauuccugguuuucaaaacugaauuauuuuaauuguagacccuugaggguacauuauucaaauauuaugcuauaauauucauaugauauaauagguacuuauugauuuacugaaggcaaaaggaaaagcaggagugagauuucuuuucccauuaauuccuuuggacagguuacaucauauauuacaguacagaugugaaugcagagauacaugacuggguuauugagccuguugugggaaacagacugacucaccagauacaagaguuaacucuugacacaccauacuacuucaaaauccaggcacggaacucaaagggcaugggacccaugucugaagcuguccaauucagaacaccuaaagguaaugcuccccaagcugaggguuuuguugugugucucuuuaguggggcuaugcugacacuaucacuugagcauauagagucuguggauaguauaugaagucuuaaugaugagcuugugagccaugaugugaagauuuaucccagaaugauuccucaccuacucauugaccaaaucagugcucccuggguuaccagccuaaacauaucauauaaaagaggacacugguuccaggcuauuuggggcagaucaauugcagugaucuaaaaguuuuuacuggucagaucagauaugauucuuuugguucccauauagagaaagaguaguguguucuugugauggauaguucaacucaggcaggcuauuaaccugaaagacuuauuuguggacguuacagagaaaaagagacuaaaaagagccuuuuaaauaaaacccuagauaagaaaaugaagauaaagcacugaaccaaguaagccuagccuaauaaaauuuaacuggggacugaaucuaaggaauuauggaagcccuguaugaauuuaauuucuguuaguacuaaagucaaguuucaguuuguuuggaaguuuguggggguuuuaguuuuuuuccuuuaaaaaguucugccugucccaucuucaaagcuugugauccuugcucuuguuuuuucuuccccugugcuuggccuguuagcggacuccucugauaaaaugccuaaugaucaagguaaaugaguagauggccucucuuuucuuuccuuucuuuugugaccuauuauuagcuuuugguuuuuguuucuuuuuuuuuuuuuuuuccugaaaaaucagcaccauguguuaaaagccacacaguuauuggccaaaguagaguugaguccauguucugaaaagcuggggaauuuauguagaagcuaacuaggcuggcagaagaaaacugaaccaguaaacugguccugcagcuguaggagauucgucuuaaguguggaucagaucauccuuugugcugagauauugaaguucugugacaacgauaagcauuuaagucaugauuagaccgaucauaccaauuguucauguuugcagcaguuguucauauuugaucauaccaauuguuuauauuuguagcaucuagaauuuuauuagugucuuuaaguggaaaguuguaucacauucagugaauacccuauuuuccucuucccacaaagaauccacaaauuuaccuuacucaauguugugauucugugugacuaaauuacugcuuuguuuauucuguuaccauaaacuuaauucagagcucuuuuuucauuucuccccuuaaauauaucugaucauauuaaaagaggaucaaaacuauuugaaauaaaaacuuaggccacguacgguggcucaggccuguaaucccagcacuuugggaggccaaggugggaggaucacuugagcccaagaguucaagacuagccugggcaacaaagugagacccccucucuacaaaaaauaggaaaaaaaaguuagcugggcaugguggugcgcaccuauaaucccagcuacuccggaggcugaggugggaggaugguuugagccugggagguggaggcugcagugagucgugaucacaccacugcacuccugccuaggugacagagugagacccugucucaaaaaaaaaguaaauaaauaauaauaauagugauaauugaaauggggaccuagcaaacaggggccuccaugucaccauucuugaaaccaucugucaauagucuuuacacuguaacugccaugguggagggauagcuauauuuugugauuuuuaucucuaggaagucagcuaaugcuaguauguuuuccauacugagaaugaacauuaaaaguaaauuuaauuauugcucucuugguuuaagaguaguuguuagaauugcaaguuauuuggaucuuggcuaauggcaaggaagagucagaacuugagguaucaaguuuuccagaacacuuuggaaauguguuugcauucagugagucuuuugcacuacauuggagaaacugcaaacauacuuucuguugugugaaagugcaggaauauaaaaauacccauaauauauauaugcacagaauauaaaugggcucauuguuuucucacuugauuccauagccagagugcaauucuuagcugccugacaccucugguauuuaaaauucuuuacucauugauauuuuuggugcucaguucauccuuggaauuucuuguucauaguuuacauucaagagaaacaauguugggaaauacaggaauauaaaccauccaguuuguuagcaauguguguucuuugacaauuagguacauaauccaaugcucuggauaguuuggcuuaaauguagccuagcugucaacuaaguacacuuaaaccugaagagccuugcaggugcuaagccaucuccaccagcuagacuuugucauagugaaaagcauaugaggaacaacuggacucuuaaucuauggugugugucacuugggagaaaugauggcaucagaaguaaggagauaaaguaauauguguggacaauggaaaaagggccagggacugugaguaaauucuagaauaugcccuuuuggauauccaggaacuccuguuaccuucuuuugguagguuuucaguuucuggaagcauagcauuguuuuagucacuggauuuauucuguuagaugaacugcauacacaaacuucagauuuuaauguuuucauuucauugaauauauguaucuccugauaauuuauggaaguacuugacauuagcucuaauguuuugcagaaacaccuaguuuauacauuucuaguaaggcuuuauuuguagaaauaacucucauuuauaaguguuuuuugaagcuucaugcucucugccucuuuaaagagaagauuauacucuuucgugaagauuuuuuaugcuuguaauaggagugguuaacauuuauggaacaucuacuaugugucagucaguauuaaaaauauuuuaugguauuaaauuuccauuuaauccucacaacagcuuugugaaguggauaccauuauuaucccuguguuacaaugagaaaacugaggcccaaaaagaauaaauaacuugcccaaagucaaacaguuguauaugauggagguaauaugcaagugcagucugucuauuaaacaaugugcuauauuaaccucauaguuaacuucauaaaacagcuuuuacuuugcaauucuuucagaccucuuuuucaggagaaguaugauauugcuuucuggguauaaaccuuagauugacaccuuugcuuuauuggaaaaagguccucguauuugcuuuucccaagcagcuuuuccuauaaaugugaagagcaaaauucaaggccaaguauaagaauuuuuuaaaaaacugauauuugcacuuucugaggccuccuucuggggugguccuaggccugaggucagcagccucacuuaguauguucccugaugauggauuaggagacagugucuuuuugagcaacuaggaggaagacuguuuuuuucagccucuggaauguuuaggugacugagcaggaacugagaaccugauuugaacuuccauuuaccuuccugcuccugcuuagcuuaggguaacuuuauauucagaaggacaacuuuguaauuugagaaaagaaucuaaacaauacuaacaccugcuaggucagguauuaguauccacauagccaggucccuuggaagaguauaguucuuuaauguagacauuaaccuaauuaguccccuugguugcuuuucuaggagaagcuacuuuugcuguaaguccucugagcaguccuuugggaacuguuuccuaagcuagagaaauagcaccuacugucccagcuucuaaacagcagugacagucagcucacagccgugagacaagcgugucagucuuucagaugccucauuacauagaaagcuauaccuuaguuugcuuuccacacauagacuauagauucccaugauuuaugugcuacuuuauuuucucauggacagaauagacuaaaaauuguguuuuuuguuuaaaacacucccuagcuaugaaguggacugucacgccaaauguguggggucauuauugacaugauuucuucuccuuuagccucagggucuggagggaaaggaagccggcugccagaccuaggauccgacuacaaaccuccaaugagcgguaaagccuuucccauggcguuuuuugcuuacuauggacaugaagcacuuuugcuuaaauuuuugaaauguccuuuauagcuugugugugguggguuguagcauauuagccuguuuucuuuuauugcuagauuuaaguguuugccaaaucacuccaagcccaugugucguaggacccauaaaucaaauuguuuccccaguuauccaacuuaagauuaauuccuaaacaauuuguucauccuguugccuacugccucuagaaaagaguuagaguuucgcuuucaaaaauaaacccucuagugggauuagccaccauccaaaccaagccaaacaaaugcuuuuagaaucauuaaguucuuccagugcuacuacauacugcaguguuuuuaguuuagcaauucuagaaaauucuuccacucuccuagccauccugagagcuggugccuucuaauuuaaugaugacacccccgucuuuacagagcuucaccauauauaagcuacuuucacacaugaagucacaauugauucuuacaacauggugaagcagggagaacagauaccguuauucccguuuaauacauucagaaacuaaguggagaaguaacgugccuggggccacgugcuaauuguggcaguccuaggaccaaaacccagggcuucucauuucugauugugcuuuucccacugucacauucagccuaaaaaagcagugggugcuguaccagacgugggaaccuagaguggaaaguguccacagaaguaguuacuaggaaugacccuuacugucucuucacauguggaagagagagacauaugagagaaacgccuguccccuaguaacucauagucuaauuguaggaauacgaugaugucuuaaucuccagcuaucuauuuaaaucaaaaguggaacugcccagacuuuaaugaaaucagccuuaaaagaaccagacaaacuuaacauccuuccagaaauaauugugcuccagguucuaggacucuguuuaugaguuucuucuucuccauguguaugugacauuuauauuguguccacaguauaauuuuuaaggcugugaggaagguaauuacuccuuugucuuucuuucauucauguauucacucaugcaugcauguuuuuuuguuguuuugguuuugguuuuuuuuuuuuuuugagauggaaucucgcucugucacccaggcuggagugcaguggcaugaucucaguucacugcagccuccaccucccggguucaagggagucuccugccucagccucucgaguagcugggauuacaagcgccugccaccacgcccagcuaauuuuuguguuuuuaguagagacgggguuucaccauguuggccagacuagucuugaucuccugaucucaggugauccgcccaccucggccucccaaagugcugggauuacaggcgugagccaccacgcccggggcccgcgugcacguuuuuaaagaugcaggcucuaugugacaagcugugggagcaagaggaguuaauaacaaacuaccugauaaagggaaagcuuccuagaagaggugccgucuaacccggaucuucaaggaugcuagaagauugcuaaaugucaagaaagggauuggacauuccaggaagcaauaucagcaugugcagaggcauggcaauauauuaauaaaacagccugcucucuccaggagucacacugcauagagaaaggauagagauugaguugaaaaugcagguuggaaucagccugucaaaaacucaaguaccagugcuaagaaauaugagcuuuauccuacaaauaacaugugaaauaucugacaccacugguacacuaugacauccaucuuuuauuaucaacuguuauuacucugauagcagugaagaauaaguugggggcuaagaguauaaagucaggcaagagggguuagggagcuguuacaggccaggcguggugguaugcacguguaaucccagcuacucagaaggcugaagcagaagaaucacuugaacccgggaggcagagguugcagugagccgaggucacaccacugcacuccagccugggcagcagagugagguuccgucucaaaaaaaaaaaaaggaagcuguuauaguaguccagaugaggcauaaagaaauggcauauauauugucccugguaggacuguucuuuggcagcucacucuugcuguaucuuagaagaaaacuuuuguccagcucauucgcaagaggucagaugcgaguaaaugagaauuugucagugaaaugcaggaaagaaccaccuccaccucugccugccucccauacuucagcuccccagccucuaauuugcaaugccugcccugccaaguacccaacccuguaguucagcacugcuauuaauaacaguguuauggaaagcccuacucuaauaugaacaguaugguccauuuuaguggccccaguaccauggucuuucccaaauauaaaaacauuauuuuauugaaggucaguauguacaguuuaaguugucugucugcuuaccuuuuucucauaaaugaaagauaaaaaugauugaaccaaauguagaauaggcucuuaaucccuucuaaaucagccccagauuuagcacuguacuuagauguagucuguaaaaucaaagaagcaaaguuggagggucaguuaauccggcguuguggaagggauucccacaaugaguguaaguuuggauuagaacauaaauuugggccgggcgcaguggcucaugccuguaaucccagcacuuugggaggcugagguaggcagaucacgaggucaggagaucgagaccauccuggcaaacacugugaaaccccgucucuacuaaaaauacaaaaaaaaauuagccgggcaugguggcgggcgccuguagucccagcuacucgggaggcuaaggcaggagaauggcaugaaccagaggggcggagcuugcagugagcggagauugugccacuguacuccagccuggacgacagagcgagacucaaaaaaaaaaaaaacacauaaauuuauaagccagguuguuaggagaaccacuucaggagauuuuuuccccccuagacggagucuugcucugucgcccaggcuggagugcauggcgcgaucuccgcucacugcaagcuccgccucccagguucgcgccauucugcugccucagccuccugaguagcugggacuacaggcaccgccaccaugcccggcuaauuuuuuugaauuuuuuauuagagacgagguuucaccauguuagccaggauggucucgaucuccugaccucgugauccacccgccucggccucccaaagugcugggauuaacaggcgugagccacugcgccaagccaagagauuuuuuuuuaaaacacacauuccaggccauacuuugaugguaggaacuucuuccacaacaucccacgcuggcaggaugccucuuaaguacuuccaauaacuaaagaugcauuucuuggcaaggcagcucaucccauuauuguacaccucugauuguuagaaaauuaagagagagaguagcuagaaggaaagagauuagauauccauggugguuagacauguguggugggauuugccacauuuuauaauaugagcauacauaaauaaugaguagggaggcaaagaaacauguuucaagaaauggaagacaguaagacuuagagcuaaauuacaaagccuagagcucauccuuucagcaauggggaaauaauaauaggaaaaggaaaagaaaaucugaauuuccuucuucaggguccuaaaugguccagccucugcagcuuuuccagccuuaucccuuuuuuccuccucacuuccuuccuucugacuugcaucucucugcuuaaacaacacuggcugcauuucucuuccuugagaagagcuuguuccugccucaggguccuuucccuuguaugauggaaucuuucuuacucagaucugaacucaaaugccaucuucucagagaagcuuuuucuaaccauucaaucuaaauuggcuacccagacacucuguaucauaaccccucauuuucuuuuuuucacaccguuaguuauuaacuaauaauuucauauuuaucguuuaucccauucccccgccaaacguucacaucuuuguuguucaccauugcaccuuaguaccuagaacaaugacugacacauaguaaccauucaguauuugucaaauuaagccauacuucagaccuacuguuucuugaaguugaacaagagaauuaacucugcguaggcuguguauuuauaaaaacagacuuuacuuuucaugcaauuuuuauaaucucagauaucugccuguuggggaaaacuucugcuuuguaugaaugaacauuuuuaaaugguuuugaaaaccagaaaacuaaaugacuuauaaguggugcuuuacaaaaugaguuuauauaucacaugagacaccagagagccaagacucuuuaucugucuaaguauaucucaaccuuugaaagcucuugaauguucaguacaauuugagaagcuuuaauuaaguacuaucuuugagcaggcucuguccugagcacuguucauaggacagacucuuagcugucuaggagcucaucaucuagagaagagagccauguucacgcggcacuuuuauauaagucagagcaaugaguguuaucaagaaguucacgugagauauuaaugguucuguagcuugauaguaugcauguuuuaaauucucuaacccuaacacauguaccauuucucucucugcaggcaguaacagcccucaugggagccccaccucuccucuggacaguaauaugcugcuggucauaauuguuucuguuggcgucaucaccaucguggugguugugauuaucgcugucuuuuguacccgucguaccaccucucaccagaaaaaguaagaagccccagaugcaccccuuagauuuuuggcaucuuaucuuuugcuuccaugugacuucuguauauggagugguacacaaaguuaagacauaaaaauacaugaaaaggaauuuaagauauuuuaaaagaaaaugggaagugguuccucuuaucagucaguguccuggcagaaaagagcuggcacauuuaaaaggauuucaaaagagguaauuuacaaagucauaggugggguuagggcaaacuaggcagggauauucagaggcuagcagcuaugauaagacaccaucauccuugggccugaaagggcaagaggagagagcuguuuucagaaaucugaagcaguaggagagggcuuccugacaaaagcaaagugggugcuagaggcaugcagccauugccagccuccucccagcgggcaguggcaggaaaagaaacaccuccuacccuccagccucuugccagugucuaguauuagcuauacccagcuggaagccaggaaacccagcaggauugccaaguaauaguuaauuuagcucaaccucuggggucagagggccaacuagagaauagauguggugagaaaaguagaaagugucuggcauugcuggucacccccuuuggagcaccaucuguacaugcccacagugaacccgaugcccaggagucuguggacauucuuacaggcugugucacagcacaaaugccagcccaguuggaagaagaccauaggccugucauucuaaaucuaaguuuaagaauauuuuuaaagaauugcuaccaaguguagaguuggggguggggguaggauugcuuuaaugaacaggaaaggaucauugauaaucaauuuaucaguuucucagagcggcugaauggcugcuagccuugaacuccucugggauuuugaggguuguggcuaauggucuaagugcagauagcaagggggcucaguuauguagugcuugcuaauaccauacaguccuacacuugaaagaauccuugauccuaaauuacauucaacucagauaucugguuagcaaaauagauagaaaaaaaaaaggagauuccugaguuauuccuaauagcaguaccauaaugugcauaauaaaaugacuuuaguugcaauaucuugaaagaucauaagauggggguguugcuccgcuagagaaagagaaauucauguuuaugugauuauccaugcagacuugaucugcccaaggcaagaaugcauguauuuaauaaucauaaauuuguucauuuucacuguacaggguaaguacaggccacccuguaacugcuacugguaaugacuuuaugucauuuuuuguaaguuaugugauauuuuaaaucucucuuucuuuugcccaaaugaaauagcuuuccauagcuuguacuguaucacuuuuccaagaaaaauggaggcuucuuuuauaauccuucugaccacugccucuuauagcucuuccuuuuuuuuuuuuuuuuuuucuuuugagacggugucucucucuguugcccaggcuggaaugcaguggcacauucuuggcucacugcaaccucugccuccuggauucaagcgauucuccugccucaggcucccaaguagcugggauuacaggcacccaccaccaugccuggcuaauuuuuguauuuuuuaaguagagaugggguuucaccauguuggccaggcuggucucgaauucccgaccucaaaugauccgcccgccucggcuucccaaagugcugggauuagaggcaugagccacugcgcccggcccugucuacuuuuaauaguggaaaacuauuauuuuuaaagccucaaagacuacauuuuuuuuucuacucuagaacuuuucuucaagccucuuuauuuggcauuuaauauuuaucuaucuaugaacuugauuuuauaucaguuuuagaaauauugggaucuuuauuuuucuguuauugaaauaauuugaaaaccaaaaugacagaauuccuuagugcuuuggaagacuucaaauucaaaguaaauuuuuuuuuagacaggauuuuggucugucacccaggcugaagugcaguggaacaaucucaucucacugcaaccuccaccucccggguucaagugauucuccugccucagccucccaaguagcugggauuacaggcaugugccaccaugcccggcuaauuuuuguauuuuuaguagagacaggguuucaccauguuggccaggcuggugucaaacuccugaccucaagugaucugcccaccucagccugccaaauaagguacucagucuucagauugaaaguaagaagaugaguugauaauaggcucuauucucuguauuggcacguccuacagauuugggucccuuuguugaaaaucaucauaucagaucuucaugggguuuuccccucccccacuuccccaguuaucugcuuugcaaguauuccauugacuguugaaaaauauaagcgagcuuuucuuacuacuuuucuuccuacuuuucuuccucuguaauaccugagguucauuuagaugguagcuguuuacagagucuuacaaccucaaaguugauagagcauuuagagaaucuaaacccucguugguucucagcacauucccccuuagccccugacuggcaacagguaagcugggcuucuccuucaugaagaaggcagaagcugucagauaagaacaaccucagcacaccaccaucaaaucugacaccuuucuacacugguaaucaucguuuccuccucccuccuaaguguacuuccccuguuugaagcccguucuacccuuuacccccugaaucucauugucuuccauuuuucuaagaccuuuuaccugcuguuauuccucucuccagcauagcugaccucuuacucguuauuggccgccucuucaguauuuaagugugcucuaacuucuuccagcuuaaggaauaauuauaauuauaaccucacccccacccccacccccuguaugguccuuuucaccggcugcuuacuaaccuuucuucuccaccacagaauuccuugauaacuugcuuauacucuuaugucuguucacugccuacccaugcaucagcccuuucuaaucuuuauucugccccuaccacuucaccagaauugcuuuuguggaggucaccagcgaccuguguauugcuaaagccaaagaacauuuuucaguucucaucuuagucucucagcaacauuucacacagucaaccauuccuuccuucuggaaacauuuucuucuuuuguauccaugacagcauguuuuguuuuguuuuuuguuuuuuuucauagguccuccugucuaccuagccaucaaauacagacauuccucagggccugggccuggacuuacucucuucuccuucuguguucuccccaagugaucucaucugcucccguggcuucagcauuccagcuacuuuuguauuucugucuccagccaaggccucccuccucugaguaucagacuugcacacacaguugccucuucuacauuuccucuugaaugucucagagacauuucaaauucagcauguccagagcagaauucaucaucuuuucaggcaaacccgcuucugcuccuuuauucccaauauuaaguggcuuaaaucagaaaccuuagcaucauccuguacuccucuuucuucuuuacucccaccucacccuacauccauuuauuuaccaagaccugucaugucugccuccugaauaacuuucaaaucugccucuugccucuacucccacugucccaugccaucaguuauggcugagauugcaguagcauccuagcuggucuccucuucuauccccaaccccacagagcuauucuucacaucacagcugguauaaaguuuuaacucaaaaguguucuccuuacucucuugcuuaaaaccauuuaaugguuucucauuacucacaaagggaaguucacacucuuagcauugcccuaaaagcucuuuaugaucuggucccugacuaccuuucuaguauuauuucacaucauucucugcaggguucacuauguccccaccacucaggauuucuuaaaauccuucuaauauaccaccagggcauugcacucugcuuuaggguuuugacauaagcugauuucaccaccuggaaugcacuuucuguucccuuuaggucuuagcuuaaaugucacuuccuccucuagguuuuuccuguucagcuuaaguccaacuguuaagaaguuacucuaacacuugacauuucaguaagcucagaacauuuuaaaauaauaguucaacgucuguauuccucacuuuaucaaaaauucugagggcacagcagucuagcacagggucuggcauauacuggguacccaguauguccucauuagggguaaguaagagagugaauggagaagcuaaaacacagagaaguagacauuguuguccccauucuugacuccaccuaguugguaguccuaguuuggcagucuucgaaguuguuccggccagguacaguggcucacgccuguaaucccagcacuuugggaggccaaggcggcagaucaccugaguucaggaauucgagaacagccuggccaacauggugaaacccugucucuacuaaaaacacaaaaauuagcuggguguggugguggacgccuguaaucccagcuacucaggaagcugaggcaggagaaucucuugaacccaggaggccagguugcaaugagccgauaucucgccauuacacuguagcuugggcgacgagcaaaacuccaucucaaaaaaaaaaaacaaaaaaaguuuuugccucccuccuuuauaagccacagacuuucccucuacuccauuguuauguuucuacauugcucuaauuagaaacuuguggaugaaccuucugguuaugagauuauauaaugaaaaaugcuaucuuaaucuuuuaacagucaaaaaaaguagucacaaggcaggauucaaacauaaagacccugguaaguaucucuaaauauguguggacaaaauagagauacauuuacucuccccaggagcaaacuuguuguuguuguuguuguuguugggggcaggagguauguuuuuaguuuuugcuuuuuuugcuugaaacaucucucagaaaggaaguuuuaaucacucaagccuuuugacaaauacguucaaaugaguuacuuuuuaaaagcuccucugaacuucgugccuaggaaacgagcugccugcaaaucagugaauggcucucauaaguacaaagggaauuccaaagaugugaaaccuccagaucucuggauccaucaugagagacuggagcugaaacccauugauaagucuccagacccaaaccccaucaugacugauacuccaauuccucgcaacucucaagauaucacaccaguugacaacuccauggacagcaauauccaucaaaggcgaaauucauacagagguaccauuuuaagugcagguuuuuucucaaauguuaggaaacuauuuucauuuaaaucuuuuuuuuuuucccugaguuugccuucauuuggcaauuccuauaugagaucagauuuagagaaauguguaugauaagauuugggaacauaugaugaagaauaccuagcuucuuaugggagagagauucuguagccauacgagacaaucuugcagaucuuuuaggucucucaucaggcuucagcagcgugauauucaaggauuugaggcuagcuagcccaugucugugcauuucauucugugucuucagcuggcuuccagcuugcauugugguauucagaacauucuuggucuggaggcucuuauagacacccugugaaguauggugggcagcauugugacauccacauugauucagcaggaacucuuguaaugcucuaaugaucauuuuccucuuuauuucacuucuuacagaaaugucuuguccccauuaugcuguuugugaauucugaauccccuacuagaaauguuucacuguugaggcugcucaguggcauagggcacaugcugguaacuaaccuccacguuuaacaucuagggcaugagucagaggacagcaugucuacacuggcuggaaggcgaggaaugagaccaaaaaugaugaugcccuuugacucccagccaccccagcguaaguagaagcaucucuuuuccucagugcuaccaaucuguucagucauguaggggaacaacuaugaaugaucuuuuugacuucacuugauucuaacacaaagauaaucuaccaaagcuuugacaccuugaaggaggaaguaccaaacacuugccauauuuugcaacaaacauuauucuugaggcuagcgucguuauguuuaugguaaauaagcugaaaagccaaugucuccagauucccaggaauaggggaguaacuagucucccuaaaagugcaucauaucucuaugggagagaugggaaagcuucccuccuccagacuagagcuaaggauggucugauguuacaaguuuucauuacgcugccugacaccagugcugaugagcaccugugaaauuuauuuuuuuaauuaauagauuugaaggccaagcaagauggcccacaccuauaauccuagaguuuugggagaccaaagugggaggauugcuggaggccaggaguucuagaccagccugggcaauguagugggaccccaucucuaccaaaaaaaauaaaauuaaaaauuagccagguauggugguacaugucuauaaucccagcuacucagguggcugaggcaugagaaucacuugaaccugggaagcagagguugcagugagccaaaaucgugcuguugcacuccagccugggugacagagugagacucugucucaaaaaaaauaaaaaaaauaaagccaggcaucguggcacacaaccuguagucccagcuacccaagaggcugaggcuacccaggaggcugagauggaaggauuacuugaacccagcguuuaagguugcauugagcuaugauuuugcaccauugcacuccagcuugggcaacagagccaagagccagucucuaaauuaauuaauuaaaauaauaaaauuuaaaaauaaaauuaguagacuuuauauuuuagaauagcuuuagguuuuacuguguggaauuuuuuuuuuuuuuuuuuuuuuuuuuuugagacagagucagagucuugcugugucgccaaggcuggagugcagugucacgaucucagcucacugcagccuccaccucccggguucaagcaauucuccugccucggccucccaagcagcugggauuacaggugcucgccaccacaccuggcuaguuuuuuguagacacgggguuucaccauauuggccaggcuggucucaaacuccugaccucagaugauccacccaacucggccucccaaagugcugggauuacaggccugagccaccaccacccgcccagccggaauuuuuuaaacaacauuuuucauucuugauucgugccucacuuugauaagcauaaagguuucugagccucuuuuaauaauaguugaaauucaaaauaaauaucaugauuaaaccagaaagcagugggacaaaccgauucuuucaaacuacuauguccucucucgucacuguuuucaaggaagugaagccuuucagacuagcuagcacaguggggcuugcaguugagggaauucucagccaucugucaacaaacgaugcgauuuaauagccaugaauaucauacaugcaacgagguacaccaugacaucgugcacuuggaaaaguuccucaaauccccaaccucuugguggaagcuucaagcacguggaugucugcacacgcauucccucucccacaaacacuguacacaaacauguaagauacuggauuacaaaaaccaucuuugaaagaguaauacccuauuuguuaacagguaauuucagcucaaaguagcuuaugcuugugguccuugauggaaagaaaagccuggacuuggaaaugcaggggaaaaccaugguuucccucuuacaagaggugcccuggaugggguucccagguuuaaagauacaaaugcccaagaagaguaaauuaauccaucccaguugcuucugauugaucaagaagaugcuagcacuauacucuuauuuguuuguuuuguauaagacuugaguuccuaccugaacuggcuuauuuugaaaacuuguaaaauuuuacuaucuuuauuucuagauguauuacuuuuaaauauguuaaguaaaaaagauauguuguccaguugauaucauucuucuuuuuuugauguuggggaaggaguuugcaccaauauacaauauuauuuaauuugugccuuaacaguuggguggguaaguggaaucuuuuaaaaaccugcaaccauaagauccacuuguggucuuuagguuuucagauacuguuuuuaaaacccgcauggcuacaguucuguuucacaagcugguauucccugagcucugggcccuggaaugcugcaggagccauauacccacuccccaccuucccuggucuuaaaugacugagcagugccaggaaggguuugcuggugcugggacauggcuccauccagggccaugcacugaagcaacaaguucagagucagcuaacagcugcugauuuccuacuauauccuaggcaggcacauucacacugcuuuauuuuuuuuuauuuacuuaccuagaaagacuggaaaugccuuauaaaagggaaaaagucaauuuuguuuuucccuugugagaguccuaaaaugcuuucaaauuguacuuuccuagguaaaaaucagguuuauucccccuaccccagccugaauucuggaaaacacugagucugaagcaccuacuucuaaaaacuaccugucuuccccuagaguugcugacuccccaguuaccucaagagcccuccucagacagcuuuccucuguuguuuuauucccgggcacaaccuggagccucugguccccaagagcagcaccugagggaaagccccuuuuuuguuccucaggccuugagaagggaaggaagggucagcagugcucaagggucccagucaugccaccugcuugcuugcauguggccaggacaagggauagcuggaaaguaaaggcacccauuuuguugaccaggauuucuuuucaccagaguaauguugaauagccccacaaagacuuuagggagauccuuggggacagaagacauuucaauaggccacuaaguguuaauuaaguaguauuauuaaguucaugaagccuuuguuuggagaaaaaaagauucccaguauuguuagucagcuuuggccuauuugccuguuugguggggguagagcugguuaucuugaucuuaaacgugccauuucuacaaccacuccaagggaguuccucagaaaaguuuauucucagacucugggcuucuaauuuuaucuguuuccaucucagauggauaaugaagccucauagaaaguaguacauggaaucucugucuucauagaaaguaguaugugaaaucuguguggaaauuucagauucuuuagcuaaacgcaguuaauugaauccuuagccagugugggaaggaaagagccauuuauucucuuacaugcagauggguaugucugaguccccagacuggaagcaguaaaagauggugccaucagccagugguucaugcuuuuaguacuagaugggaccaucagaguucaauuccauuugcauuuauuuuaagacaugaaagccgauuaaacagcuacuuauuuauuuggccuaaauacccauuaaaugcuucauucagcaguuuuaacaaaggcagaaugaauuaggaauguacucgaaaaagaagggacuucuuucuauccuuuuagcaggacaaaauagaaaauuuauguguuggcuuauggauuuauauuuugugacauauucaaauagauacuuguaauaacucauguaauccauguuuauuauaguagaauuggaaaauacagauaagccaaaagaaaaauauuauuuuaauccugaccacucuucccugcaagauaauaacuguuaacauuuuaguguauauuccuuuuuuucuauauauauguagacauaugcaaaagaguaucuucauuuuuaaaaaacaacguaaaaaucaauggcuaauugaccagaucuagccagcugccaccaaaaaaccaagggaguguuuggauuguaugggaggugggaagggggugacuuugcucuuaaacugugauuuguguguguuugugcaagcauguuaagcauuucucugucuuguguucauucacagcugugauuagugcccaucccauccauucccucgauaacccucaccaucauuuccacuccagcagccucgcuucuccagcucgcagucaucucuaccacccgggcagcccauggcccauuggcacauccaugucccuuucagacagggccaauuccacaggugagagaugaggaucaagcccagauggaaaccauuccaaaagagucggcaagcagaaauggggaaggacuugcccuacuuagaagagggauuuggaauuuuucuguuuuauuuaacuuagcauaacauuucugugacugacucaaauuuguuucuguaaaauucaccccauauuucuacuuaaguuuuaaacauucagugcaagguuuucuuuuaguaaaaacaguaucucuaaucacauaagcaucccuuguuccauaaacuugcacuuuaacucagucuuuuuuccaauuucuuucuuuuaauccucuaguuugaaaggaaaacucauccugggugauuucagacacuagugguugccuuugccuggcagucacuguaacauuggguagguccaaagguuaacuguuacauacagguuacuuccaccguggaccaaagugcaaacaacauccaaggagcaguggggccaccagccacgaggaguuguguguauuguaaaccacagggugccugauguaaaccucaggauuauuaaaauuaggaagcgaugcacaggaauagauccucucugaagaaacagaaaauuaccucugaaguguauuuaaagaaauacguugcuagacaaacauguccccaguuuggaaaucuuaggaaaccgcauuaucaaacaguuuuaaggaggaaagaaauagugaaggugugaggacaguaagcggcauaaauauucuucauuaauugaaaauuaauuuucauccucaguuuuaaacggcaagccuaguaacuucccauauauucaacauauuauuuuuccaccauuugaaacuugccuauuaauaguuauuauguuacugauagaacugaguuuugcuggucuggggaauaagggaauuucaagugaguuccauuuuaaaagaaccucaaaacuuuaugcuggaaauuuggguuuccaguaauauccccauucuuuuaaguuuuuuguuuuucuuugguuucuuuguuuguuuuugagacagagccucagucuguugcccaggcuggagugcaguggugcgaucucggcucacuguaaccuccaccuccuggguucaagcgauucuccugccucagccucccaaguagcugggauuacaggcacacaccaccacacccagcugauuuuuguauucuuaguagagacaggguuuccccauguuggccaggcuggucucaaacuccugaccucaagugauccgccugcauuggccucccaaagugcugaaauuacaggcgugagcuaccgcgcccgguccccauucuuucaaguuuucaucaaucauaaacauacccaaaacaucaaaugaagcuuuauuaaggggugccuaauaauuuccaacauuagcuacucccaaagcuauuaccugauuuggagaaugcugcuugaacucacaucuaaauuuggccuuccaggcugagcaguguggcucaugccuguaauucuagcacuuuggguggcugaggcaggaggaucgcuugagcccaugaguuugugaccagccugggcaacaaggcaagaucccgucucuacuaaauauuaaauauauauauauauauauguaaaaauuuggccuuucuacuaucucccuccaaaucccaauuuggaguucugcauuuaggaaagacgguuuccaagauggacaguuacuccagccagcugcauggagagccaaagucugccuuacagacauagucucaaauagaacagaggaccagaaagcagccuccacaccugcucuuagaaaggagguuuugugcccaacccuguuucuccaucuuuaaggccaaggaaucucacaugcuaggaugugguccugccugaguggauggcaggcaccuuccaaucaaaucagccccuuccuccuuccuccuggguuuggggauuggagagaagcauggcagcuccuacccagcccucucccuugugaucuaguauugguaagcauucccugcucuacggaccuaggcagaaagugaagagagggggaaagaauaauuugcauuacugagagaggccaugcuuugaugacuaguuggauaauagaagguaaaacuaaagugauagacuuacugaagacugauuugaaauauagagcaaguauccagaaaugaucaaaguucuuuuucacgauuguacuuugcuaagcuccugugucucuggagcucagaguguugccacagcuugguauauaugggcuaagcagggccagucucugcucuaaggagcauucacuaugucaccaccacuugacauuggaaaagcacuuuccucuuguccaaucacuuggccagugugaacucugugugucuuaacucuuuaagaggcaagucagucaggaaguagcccccuugccaaagcaggaauuuuacuuacagcauggauucuaagcaggccagugauuuugcacacugucagggagcacccuucaugauaaaagcaacgugccuggggcccccggaguugugcaaggcagcccuggucugugguagcaggccugggugcugacucauguaggcaaccccauuuuccuuuuucaccuuuugcgccaucucuuuggcccucagaagcuuauauauccaguuacagaccguugaggcagucaggagaggccgguuugcccagagcugaccuaacauaucugucaguacaggcugacauggccuggacaugagucuacuguucucucuccuccucccugcuacccuuccuagccagcuccuacccugcccagcuucucccuggcccaggaucacagagggggaccaccagcucccccgccguggggauggcuagcuugagcaagccuaagaagauccucagcacaccccuuuaaggggugaggagugaccuaagccugguagggccaacauaguuaggcacacuugggaggguguacgagucccucauccauggacccaagaucagaggugccacucgugacugguguggccugacuucucagagcccaagggcacagauucacugcuacuucagcaacaaaggcagggaaauguguuggauuucugcagauugcucaugcuuuacaguauccccaucugcggggauacauuccaagacccucccccuccccccgcaguggaggccugaagucgcauauaguacugaacccuuuauaucuguuuucuccaucugauaaccgagacagcuacuaagugacucaagggcagguaguguacgcagucuggauaggcuggacuaagggaugaggcacauccccaguggaauggcguaagauuucaucaugcuacucagaacggugcaaaauguaaaacuuaugaauuauuuauuucuggaauuuuucauuuaaauuuuuggacagcaguuggccacagauaauugaaaucauugaaagcaaaagcauggauaagggggacuacuguacuuguuaagguugaggacuccagaagucagaagaggccuucaggccaccugguacaguccauugcccugagcuguguccccaucccucuccucacagguggggaagcuggucaccagcucaugcuguuggaagggucuuccuuauguggucuccccgggccuuggugcugcuucugccccacagggugggggcaagugguagucuggguguggaaagguguguggugguccagagcauguguguggaagucggaaggcagggauucagauuccacccugcuaguucuuaacugugcaaaugggcaauuugcuuaaccucccagugccuucugaguuacuuugaggaucuagugaacuaaugaauguaaagcagcuggcauagugcuuggcuuaaaguaagcacccaguaauuuacaaagaaaagaaucuuaauagauagauauucaagcaccguguucagcacuuuucauacaucucauucaauccucaaagaauuauguguuauucucccucuuuuguagaugaagaaacugagacucagagauauucagugacuuugucaaauucacccagcuaguacacaaagauuggaguccaggucugucugacuccagaguccgugcuuuucuacccugcugugcugccuuccagaacaacucugccccuucuuauauuuugagauuguuaucauguucuuccugagccuucccuucuccaggcuaaucuacccccauuuccuucucugaaucaaaaaugcccuucauuuggugugaucugaaagcugugugcagaccucugggcugcucuguuuguuguccaauucucacuugagcuauggguuuuuugcugugaugaggccaugcacagucccuggaggcacgaaggccuguggcauuggccucuccugcagugaccgccaggccuugucagcagagcuggcuacugucagguacccggccagccuuggugguuagccaugguugucuaugaaaggccacugucuaagauuccagugagugaaguuuuuaauuuucuuuuauacuuauuuauaucuuaauaucuuagucaucucaggaaccuuuacaagugcuucauaauaaauaaugaggagaacuuuaaaucuacaaaauugugaccacuuagcugugaggugaaaaacuggaauagcugguugaguacaaaauuguucgagacuccauucuuaucccuggcaguggugcuaauccauguucucuuggacuagcacugaucgcaagugcuauugagcugguuuagggaaccccuagaaguagccaaacugugggacugucacauauuuaauggcaaaagaaaugcuaacauuuagacuuuccugcuguagaauccguucgaaauacccccagcacugacaccaugccagccucuucgucucaaacaugcugcacugaucaccaggacccugaaggugcuaccagcuccucuuacuuggccagcucccaagaggaagauucaggccagagucuucccacugcccauguucgcccuucccacccauugaagagcuucgccgugccagcaaucccgccuccaggaccucccaccuaugauccugcauugccaagcacaccauuacugucccagcaaggugagugaggauggcagcacaccuggagggagcacaccuggagugacccuuuggcucaagcuugggacaaagccaccccuucuuugaaguauagcaaagcaaauauccuccaagccuaucuuagcaauucuguuagcguagcagugugccauugccccgcccaggaaguuuauggccuccccuuuucugggaacacuuacaaaccggagaauaauuugcugggaaccaagggcugaccuuuugaauuguguuuuaugugcagcaccuuuggugguaaguccaauggcaugggaauggauagcagaucuagucugcccagaccccuggaaucaccucacuucguaaggucccugcaaacuagagaagggaucagggaggccaaggcuuggacucauaggguggugaaagcagaaguaaccucagaauagggaaaggaauccugugaagggaaagucauuuacccaaauccacacagcucaguaacaguccccugaccucaaaggcaugcuugcuuucugcucuuccaaauuguuaccuauucauuugcuuuagaauaagccagugguuuucaaaauuucuggucucaguaucccuuuauagcuuaaaagcuauugagcaccuaaaagagcuuuucuucauauggguuauaucuaucaauauuuaccauauuaaaauuaaaacuaagaaauuuuuaaaguauuuuauucauuuaaaaaagcaaguaucuaucauguuaagauaaguagcauauuuuuaugaaaaacaacuauuuuccuuuuuuuuuuuuuauuugggauggagucucgcucugucacccaggcuggaguacaguggggcaaucucggcucacugcaagcuccgacucccggguucacgccauucuccugccuuagccucccaagcagcugggacuacaggugcccaccaccaugcgcagcuaauuuuuuguguauuuaguagagacgggguuucaccacauuagccaggauggucuugaucuccugaccucgugauccgcccaccucggccucccaaagugcugggaauauaggcgugagccacugcgcccagccgaaaagcaacuauuuucaaaacaaaaauauagugagaagagucguuuuauuuuuugcagaucucuuuaaugucuggcuuaauagaagacagcuggauuuuccuaucugcuucugcauucaaucuguugcaauaugguguuuugguugaaauauaagaagaaaaucuggccuaacagauauguaauuggaaaagggaagaguauuuuuauaaccuuuucagauaauuguggauauucuuuuuugauacuacagcaaaacucagcaaguuguaguuuuuuaaagguuuguuuguaaagugaaaucugaaaccuuaucuaugaaauauucauacuucauuccauugaaauucauucaucugucuugcauuuaaugcaugauacuaaaauaucacacaucggucauuuagaaaauauugguccacuacauuaugcaaauucugcaaauagugauacauuucauuauccaguaucuaaaaacauauucauuaauaucaucaaaauguguaaguauuaaguucucaagaccaugguggcggaugcaaguuuuccaaaauccugauuuuuacuuaaaacuuaaauuuuaucauuggcaagaaacacuauccauuguguuccuugaauugacaggcucacuuuguucauuuucuaaaagaugucucaagaaccaguuugucugucuuugaacuaacagugauauuccaugauaaaaacauucaacucaaaacucaaaacuaucacaaguaccuuuauuuaagacagcuguuggccgggcgcgguggcucacgcuuguaaucccagcacuucgggaggccgaggcggguagaucaccugaggucaggaguucaagaccagccuggccaccauggugaaaccccgccucuacuaaaaauacaaaaaguuagccgggugugguagcagacaccuguaaucccagcuacucgggaggcugaggcuggagaaucacuugaacccgggagguggagguugcagugagcagagguugcuccacugcacuccagccugggcaacaaggagagacuccgucucaaaaaaaaagacagcugucauacuuugcacacagcugaaguacuuuaugcauacuuuccauuuugucacauacaguaaggucaagauuuaguaaaauaaaaaauauguauuccuuuauuaaggaugguucuuagugaaacuggcuuuuuuaaacugcacgugcgugucagugaauggcuuuacaguuuggcaccacugccuuaauuugugcuaaggcuccagcagcucacccacuauugccuuuguauccucagugcaaaggcaaacacaguggaaaggcaaauaaugucuuacuauaaagagagcuuuggccuuccagauauccugcaaggguuuguggacuaccacacuuugagaaccacuggacuaggauauugguuuucuagagacaguggaauauuuucucuggccucaugaaugcccugcuaucucccuccuucccucuuauuccaguaacuuuucagagcaguaucccugcacugggucuguaugucucucucaccccgaagcagcacuuggaccuuagggccuucaugaggucuaggggaggcaggcuuggccacauaucugauggugcccuuuccccucagcucugaaccaucacauucacucagugaagacagccuccaucgggacucuaggaaggagccggccuccuaugccagugguuguucccagugccccugaagugcaggagaccacaaggauguuggaagacuccgagaguguaaguucguggggccaucaguccagccagauugccugggaacaugccccagggccugagacugcuggucaagcugauaaucugugcauaccaggcccgccacccagaacuaugaagcagauacacucauucauucaguagauacaguguugagcaucucuucugagccgggaacugugcugaggacuuggugugcuuucuuucccauauccacucuuuuuuuuuuuugagacagaaucuugcucugucucccaggcuggaauacaguggcaugaucucggcucacuacaacgucugcguccuggguucaagggauucuccugccucagccuccugaguagcuggaacuacaggcacccaucaccaugccuggcuauuguuuuguauuuuuaauagagaugggguuucacuauguuggccaggcuggucuugaacucccuaccucaggugauccaccugccucagccucccaaagugcugggauaacaggcgugagccaccacgcucggcccccauauccacucuugaacaucuuaaauuagcuuuucacacuagcccagcuaauggccccuucccccacauccugccugccuuuuaguucugucccuucugucauuguucuuuucuugguuugaaccauccauacauucccucaguucuacucugugaccuuuccugagcaagaugcuggaggagaaagugccugagugguuguucucgaaacaaaaaucaccagggucuuucuuugaucuuucacucucaaacuccaguaaaaauguuuugccucugaauuuccagguacaggauucucuaagcggaaagcuuggggcccagagauccagggacauaccaacugugcugacuggggcagagaccuagaaggggcaagcagugggccuucuggccugugaagucauugugacccuggggaguauguguugggagaaaggcauugugcauuaucaggaaacgggauccuagugaccuugggucuauccugcuacuuuccacucuucugagccacccugcguguuaguagccaguuuucuggggccauuugacuacugaccacaugaggcuuuggccucucucugggcucuccuuucugagcugcucccuggauccagcccaguaacaguguuuucuuuuccauagagcuaugaaccagaugagcugaccaaagagauggcccaccuggaaggacuaaugaaggaccuaaacgcuaucacaacagcaugacgaccuucaccaggaccugacuucaaaccugagucuggaagucuuggaacuuacccuugaaaacaaggaauuguacagaguacgagaggacagcacuugagaacacagaaugagccagcagacuggccagcgccucuguguagggcuggcuccaggcauggccaccugccuuccccuggucagccuggaagaagccugugucgaggcagcuucccuuugccugcugauauucugcaggacugggcaccaugggccaaaauuuuguguccagggaagaggcgagaagugcaaccugcauuucacuuuguggucaggccgugucuuugugcugugacugcaucaccuuuauggaguguagacauuggcauuuauguacaauuuuauuugugucuuauuuuauuuuaccuucaaaaacaaaaacgccauccaaaaccaaggaaguccuugguguucuccacaagugguugacauuugacugcuuguuccaauuauguauggaaagucuuugacagugugggucguuccugggguuggcuuguuuuuugguuucauuuuuauuuuuuaauucugagucauugcauccucuaccagcuguuaauccaucacucugagggggaggaaauguugcauugcuguuuguaagcuuuuuuuauuauuuuuuuauuauaauuauuaaaggccugacucuuuccucucaucacugugagauuacagaucuauuugaauugaaugaaauguaacauugaaaagacuuguuuguugcuuucugugcaguuucaguauuggggcggguggggggcuggggguugguaauaggaaauggaggggcugcugagguccugugaauguuucugucauuguacuuucuuccagaagccugcagagaauggaagcaucuucuuuauuguccuuuccuggcauguccauccuuauugucacuacguugcaacuggaguuugauuuggaucugguuuuaaaauucuucugugcaauagauggguuugaggauuuagcggcccugaugucuuggucauagccugguaagaauguccaugcugaggagccagauguuguauuucuaacugccugagucacacagaauaggguaagagccugaccccauucuguaaaucagaaagcaaggauggagacccuuuccugcugcuauuauuggcucucuuugaggaaguuggagguuaaggaaggaacuuguuuguuuccguauacgacuccuucuucucucuaguucagucuucagccaguccagcgcucucuuccacacuucagagccccuucagagaaagcauuagcaggaaugagacaaggcagagcugcagugcccccugaggcuuccacacaucuuucugaauauuauuuuucaaguaacaagggcagggacagcggaaacagcugcccaccccccccaucccagcagcucagcuaagcccugaugagaaugaagccacaggaguugucugaggugaacccagccgcucagccacacauggaagccauugccuuugcacauaguucuuggguucuuuuuccuaaaaagguaaggagcugaggugugugguuuuuuaauauuaagaauauauaauggaaaacacacgacugacgcucaggcaucuuccccuacuccccaacagauccccagaagacagcguggaaggcaguguagacaguaaaucgggcuucaguucuauagccaagaagagaucagcugcugaaaccaccaguggguaccccaggccaccugccuuugaacuuggggauuugccauguuugaucuugucacauacuugcuuuuuuacaagaugaacucuuuguauuuaugauuuggggggcaaugaaaggugcaaugcaggaacugcugcugccgagcucgcuggucacaugggggugccaggcgggauucuggaaaaccagugcacuuaaacugauccugaagagagcugucccagcacucuggccaccaggagggccagauuccccagaaacuaccuuuugcccaaagaacaugcucaguauuuggggcauuuccucccacaaacccugacugcuucuguuaccucagggccuugguaccuggauacugccacagaauuggggcgggugggggaggggccuauuuuuaaauaaaauaacuguucaaaguuggggguuuuuuaaaaaauuaagaaaaaggaaagcuauucuguauugcaccuuuucacaauuuaauacauuuucuuacauuuuccugugauuuucgaaacuaaaccauuguguguccuguaguguccugguugagcugccgcucagcagcuuccucggggggauuuggaacaccugugucugucgccgcacugccugugggaggggcccagagggcugcugggacuggcgucuguacacacuuguuuggccuuuucuguaguugaugcuguaaacucuauggcuuuuuaaaaacgauuucauguuuuuauuuaguauuggaaauccaauacacuuuuuuaauccaaucaaacucuggucuggucaaagaguuauuuuccuuuguccuuaaaaaaaaaaaauaacaacaacuuuggggcccccugcuucccagccucuaacugacuucacgguugccuucacaacuguaaagccaguagucuaugaggagacucagggaaggguggcaggugagccaggaggcugcaggagguguuuggaccguccaccaguaccaaaa

SEQ ID NO: 16029 - RNA, 597 nt, Homo sapiens
uucucuuuuuuuuccaccaaaaacuuuuuauuggccuuuuugauggaaacggguuuauuugucaggaaggaugaucccaucauacuuaugcuggaagcaacgcaucaucuccucuuugcugagucuguguuuggccccagugcagccuguccugugcuucuugucugugaugcugaaaccuggccuacccagcaccacagagaaguccaggccguagauaccaaugcuugggucauauaugauacccaaaucgauguguuccuggaucccaaaaccaaaguuucuaguaucugagaaguuauuuuuucuuaacucauacuucugcaccuuuagauccuucuccaggauuucuucugccuuggauccuugaacugugcaguggacagcaaucuuuucauuucucugcaugccagaggaucugauuguaucuagcucuggaaaacacaggacucugcccugugagcugcuccaaugccuuggcugcucggguuagucugucuccacucuccuccacacagauguugaggcagagcuugcagaugugaaguuucugcaugggguucuccuuuucaccuugauccgccaugauagagaaca

SEQ ID NO: 16030 - RNA, 32187 nt, Homo sapiens
ccucuggucacgugauucgccgauaagucacgggggcgccgcucaccugaccagggucucacguggccagcccccuccgagaggggagaccagcgggccaugacaagcuccaggcuuugguuuucgcugcugcuggcggcagcguucgcaggacgggcgacggcccucuggcccuggccucagaacuuccaaaccuccgaccagcgcuacguccuuuacccgaacaacuuucaauuccaguacgaugucagcucggccgcgcagcccggcugcucaguccucgacgaggccuuccagcgcuaucgugaccugcuuuucgguuccgggucuuggccccguccuuaccucacaggugagucggacuugucccgcccuguuccugggcccugagagugccugccuggggacaguucccccagggcuccagagacgcccuaugggcuuuuguccagcccucugaucacaggcacuccacuuccuccucgagcugcauuagguuuucauccaaagauaacuacuauaggacuacgguucaaucaggagauuaauuuauggaaaauacugugccagcagaaaucuaaggugauccuucugaccguguucaagcuagccaggguccuagugagacugugagcaagggcugaguagagaccagagaaaacacucaaaauuggggagacauaauacaagaacuaugcaaaguuacauacaaguuucuggcacauagaauguuuggcgggcggaucacgaggucaggaguucgagaccagcccggccaacauagugaaaccccgucucuaccaaaaacacaaaaaauuagccaggcguggcggcgcgcgccuguagucccagcuacucgggaugcugaggcaggagaaucgguugaacccaugagguggagguuguggugagcugagaucgcgccacugcacuccagccugggcaacagagcaagacucccucucagaaaaacaacccccccccccaaacaaaacaaaacaaaacaaaaaaaguguaaauugugaaagaaaucauagaacauaaggaagugaguuuccagcggccacuuggaaugggaugguagauguaauuagccgggacugaaaagaggguauuccaggcaggaagaagggcuugagcagaggcacaaagaauuaugauugaguucaaaguucaggucuaguggaugugaugagugggggcuggggauugaggagggaugaggguggggaaaaugugggguugaagagucaagagcgcuuuagacauugguuucacauaaaauggaaggggcuaacaguuuucuuuuaggcagcuauguaaucaguacugaaaauuguauuugaggauaauuauuccacagcacauuuguaagucgagccaacaauguaaaggaauacaauucugcugcauggguucaaaauuuagaaguuucuugauaaucuggaaucuagcucuuugguuauauuguauagauguuaugggggugggagccacauuuacgguuaagucuuguaguaauauuuuauaugauguuucaaguguguuuaaauuacuuucacaaaaguuaucauuugauauauagaauuaaaagcauuuaauuauacagaugacccuuagagagugacauuugauuuggggaaagaaacacaaucucagcaucaggguaguccuuaacugguaaaaugcauuaagcuggagaggauaagaggccugcuguugagugugguagaucacauuuuccucugaauccuucaugacaaauaauagagugccuuacccaagauuggcacucagaauauguugauuuugguuuagaagaguuugagccugguuuauggaaaaaaaaauccgucuaacugguauaugucaaucccagugcugggcacucugaagguuacaagaaaagucuuaagaccuaggccuaggcucuauaguucaauugcgaaaauaugaaacagagggagguacacagugaauuauaagauucucaaaagcuuuauagguuguuuccuacuauuguauacaugagaauaauuccuuuccuuuuuuuuuuuuuuuuugagacggagucucgcuuuaucacucagccuacacugaggcugagugcagugauacgaucuuggcucacugcagccuccgccuccuggguucaagcgauucuccugccucagccucccgaguaggugggacuacacgugcuugccaccacgcccagcuaauuuuuguauuuuuaguagagaugggguuucaccauguuggccaggcuggucucaaacuccuggccucaagugauccacccaccucagccucccaaagugcugagauuacaggcaugagccaccgcgccauaccuaauuccuauacuucuaaauuaggccuucaccuccauugcuauagcaccauaguuuaaucaaguagauagaaauggagagauuguaagauaauggaauacuauaaauucccuaacaaaagagauuuagagccagauaaauucaauaagauguuuauuuccauauauuaccuuccuguaaguucauuagcuuuauuaguugaggguucuuguccauugagagaaaaugaaaacuggguugggugaacauuaccaaagacuuaaaaguaacuucuuucucuauugcucuucccauggagucuucccuuuggaauguaguuuccuguggaggcuuuuaggugacuuugagcuaaaauccuaguucugcagaaacaaggaugaagcaauagcaugggaaacaaauagagguagagcaauaccaacaaggcugaagccagaauacauuucuuuaugagucugauuuuaguaaagaaggcaacauaugcagguuaaaucuuaacuaacagauuuccauccucuuccuccaaacaacuuauuuguaggcucugggccaguagguuuuguuuguuuguuuguuuuuguuuuuuugagacagaaucuugcuuagucaccuaggcuggaguucaguggcacaaucuuggcucacugcaaccucugccucccggucucaagcaauucucccaccucagccuccugaguagcugggaccacaggagcaugccaccacaccuggcuaauuuuuguauuuucuguagaugggguuucgccauguugcccaagcuggucuccaauuccugagcucaagugaucccccugcuuuggccuaccaaaguccugggauuacaggguggaaugagccaccugaccagcccaguguuuuuccuaaugcaauacaacuucugguuuuugucugaaccugaaacuaagaauucauacucccuuuucugaaaaagaagucugguauugagguucaguucuauuuugaauucaccuucaaggguuagucccaccaguugcuaaauggucugugaagguguuuaguauuugccaccuuucuuugucauugagagguguuucuaccaauuggaggguguguguugcauguuguugaaccuguuaaauagacuuauuuuaggaacuagauacuugaaugaaucuaguucccuguuugauuauuaagccacauccuguuugcaaagcaaagaugugauuauuuggaauuuggaauggcacccaucuaauguugcuccagacauuuaauaagcaugguguggagcauggugcuugauggagcugauaaaguccaaauuuuuccaaguaaaguggcuaagucuaauucugccauuagacugcauuuuuuuuuuuuuuuugagauggagucuugcucuguugcccaggcuggaaugcaguggugugauuuugacucacugcaaccuccaccuccuggguucaagugauuauccugccucagccucccaaguagcugggaauucaggcacccaccaccaugccuggcuaauuuuuuauuuuuuaguagagacgggguuuaguagcgaugggguuucaccacguuggccagacuggucucgaacuccuggccucaugugaucugcccaccucaagauuacaggugugagccacugcaccuggccaugacugcauucuucuuugcuuuuccugaaacugguugauagaagccauaguauaucauagauauuauaagguucccauccuggucugauguucaccugcacaucccugugaguugcugaggaugccauuguccuucaacagaauaauccugccccccuucuccagcccuuuuauucuggaauggaaguaagauuauuauauaagagccuguguccuucugcagccauuaucaguauuugauuugcucauccucagauauuaaagaagugacuaaauuaauaaauggcauaguucauuauaaucuggaucuccuaaaauaccuucuuuggccauuucuucuguaucuggaacguuguagauauguaguaauuauuuguaaaauauauuaacguuaaagagcuacuuuguguaaacauuuguaagaaggcuuuauggguuuggguuuuguuuucuuuuuuuuuuuuuuuuuuuuuucuuuuagagacagggucuuauuuugucacccagucuggagugcaguggcacaaacacagcccacugcagccucgaccuccgaggcucaagcuguccucccaucucagccucuugaguagcugggacuacaggugcauagcuaauuuuuguagagauggaguaccaccauguugccccagcuggucucgaaccccugggcucaaccacucugccugcuucagccacccaaaguguugggauuacaggucugagaagaucaucaaaaagauaugauuugcagguuuucauugaggauuaccuuuccuuucagguuaccaauuuggaguguaagugugugauuccaggcaaaggauaaucacacuaugcugcuuauugugugaucccaacucgugcugcucuuaacucagcaugcagugagagaugcauugggauugcaucuaggagggaaacagauaaggucaagcagcugggcuggggagaaagaauaaggccgauuaguucucuccacuuuaauugggcuagcggcuaacuauacuuuaaccuuucccacggcaaagacaaggcauauuccugccaaagaugauugccacuaaguuuauuguuuuaaaagcaaagaggaagaaaacaacacgggaagaagguuuuguaguagaauuacuuuuucucaugaagggguuucuggagaacgagggauacauaggagaaauacagugaugaauaaauugucuuuagaaagaaggugauggcagaagcacaguuuuuaguugaagggcaaaauaagugucauauuucauuuugaaucccagggccuagauuagcuuggccugcagucuuccaccagccucucuucucacagcccuguuuuuuucuuuucuuuucuuucuuuuuuuuuuuaagaaacaggucuuucucugucauucagacuggagugcaguggugugaucacggcuuacagcaaccucgaacuccaggacucaagcagucuucccgccucacugaugaguagcuaggacuacagacgcaugccaccgcacccagcuaauuuuuuuauuuuuugcauuuuguagagaugggggucuuacuguguugcccaggcuggucuugaaccccuggcuucaagcgauccucuugucucggccuccccgagugcugagauuacaggugugagccaccauuuauuaccuaaagcaugauacuuuucuaguaucccuguauaguacugaguccaagaagcuaaacuugaucaagguguauguggguagccugggccugguuuaugaaaaauuugaguuuuauuucugugagcuguagguguuccccugcuuuggauauucuguuugaacacaguauacauuggaggacucaggauguggaacaugauucauucaggagucagcugagaaaguguuuauuaaccccuuaacucugugccuucagacuaauugccuaauuuccaagcuguugcugcuacuuccuuuuuuuuuuuuuuuuuuuuaacucugccugccuuccagacauuuccgaggauaacaagaaaauaguuaugaauguuuuuucagucuuuaagggaggguauaauagugggaagaacuuggugauuuuaaaaauaaaacaauaaaaauuaaaaguccaagccccagagaugccuuuccuuccauuuccuucuaccccaguuccuuaccuccaaacaggagcgagaagcauagcauuggaagguuuuugacaauggauaccuugucguuuuguuguuguuuguuuuuaaccgucucaugcuagggcauguugucuguuucuuagccuguucaaggcauaagccucaaucccuuuccuguuguuauauagagggaaaggaguuuuacagccuuaccaguacuucuuuuaagaaauaaagcugggcauggugucucaugccuauagucccagcuacuccagaggcugaggugggaggauggcuugagcucaggagguggagguugcaguuagcugagaucgugucauugcacuccagccuggacaacagagccagaccuugucucaaacaaacaaacaaacaaacaaaaaccuagaaacaaaaacaaaagaaagggaucacucuuauguuucugcaguuuccuaaauuucuucuacugguccugaaaauaagugauaaaauagagucaauuugcaucauccucaagagguuccaugaccuuuuuggagccacugacaacaaagucagcugaagaaaggagguugggucuguaggggucagagagguguaugugugaagaguuuucuguggugugagcugucucaagguuuacauguuuacaguccauuguaauacagaaauggauuauauuuucuucuguauuccuggcuguaaugaauaaaacccauuauugggucaggaacuugagucuucucucuucuuguccuuuguuccuguuucaagcuguggcauuugcuuaagcuuccuggccacacacucagcccugauccccagccaacugcuguaugcuauuguuguguccacaucuugaggcugguuaggcuugggugugguguagagcuccuuucuguggaagcguauacucaaaaauacaggacguauggguguuugucagcugucauuaagcagccuuccccuucuuuuguaaagcucuugggauugaggggguaagagagaugccuuacuagguacacuguuaugcaugaaaaguuuaacuacuuacuguuuguucaaccuuguccuuguuguaacuaggauuccacauuaguggcuuuguuguuuugccuggagcugcaguccuagguugggggagauucagaguucuaaggccaugucccucuuguauuuugaagugucagccuguucauauacagaauggcaucucacaguagugaagccuucagucuccuauaagaggcucaugaaaaacccuucagggaagcugcuccuagaguguggcuuugccauaggagacccugccccaggacuccucuggccaaaugagagagucgagguuugcuggggcaaaacugucuuauugggaaaagggaaguagaacacggaaggaaacuagcauuuauugucuggcacuugauguauguuauugcccuuuaaucuucauaaacagcucugugaggucaguguuaucccaaucuuugagaauggagacauagaggcuaaguaacaugcccaggguuacacagcuuguagggauggagcagaaauuccagucaugcauaaauuuugcuuuugucacuguacagucuuguaauauacucauacacgucuuugucaguccaguuagcaauuuggaaaacuacuggccucuggcaggauuaagcucuaaucacaucuuaguguuaauuacuucaaauagguaguaacuucuaacaucuaguuacucauaagcacucagguuaugaauauuuugaucccuggcccauuguuaccagauuccaguagcauuucuuccuuccucccaucuauucuuaguacagguaguauuuauuaaguaacuuuaauugucaauaguacuagguccaaggaauauuaaauugaacuuccccguccuuaaagaauuuacaguuucuggaaguggggauacagacagagugugauauuuuucuaugauaacugaagcacaagguacuuugggagugcagaagaggaacaccugaccuaaguguauggggggaaaaggagaaagugcacauugaaaaggcuuuccuagagagcuguugaaggagaucuaaaaguagaaguuagugggggugaagauaguauuccgcauagaaagaacugcgcguggaaaaggccuacaggcgagaagccuucaugccauauucaaggaacucaaggugucuagcugaaguacacaacucuaggguggaucagcaaguucugaagcuaaagaggugauagauggaaaggucaugaaauggccuaauaagcccugguaaggaauggagcuuuauccuaaggucaaagaaggccaguaaaguccagucaacaggauaagugaugugacuaaacucuagcuacauuggggcuugcuguagagugggauuagaggcaggaaacccaguuaaaaggcugccaacaguggucuagauaagagagaguaguggcugaaguuggguugauggcuguaaggacagagaaaacuagaaagacugaagagagauuuaggagguggcugcuuggaagugggaguuagguuggagggaaagggugcugaggaugacucccagauuucugacuuagcaguuugaauguuggcucucauucacucgugcugccauuaacaaagauagggaaaauaguaggagaggaagggaaggaguaaaaagagcuaaauugguggucgugguggcucacaccuguaaucccagcacuuugggaggcugaggcagguggauuaccugaggucgagaguucgagaccagucugaccaacauggagaaaccccaucucuacugaaaauacaaaauuagcugggcauaguggugcauuccuguaaucccagcuacucuggaggcugaggcagcagaaucgcuugaauccaggagguggagguugcagugagccgagagugcgccacugcacuccagccugggcaacaggagugaaacuccaucucaaaaaacaaaacaaaaaaaaaacagugaaauuaagagguugagagguagagugagaaucaugaaaaguaaauuugauuuugacguguugacuaugagguaucaagcaaacaguuagcuauguaguacuagagcuugggagaaugaguuugaacacuuccgaggagaagaagguccaaaaggcaaccacaggagggugguugaggaggaggaggaggauguuguuggaugacugcuaagccagaacauggguuaguucuuccucuugggugugaaaaucaucuaggauaauagccagccuugagguggagaggaauacugggcaacaggauccaaaguauuaaguaaauaagguugggcaugguggcucacaccuguaaucccagcacuuugggaggcugaggcugugggaucacuugaggucaggaguucgagaccagcuuggcuaauguggugaaaccccgucuaauuuguaaaaauagaaaaauuagccaggugugguggugcacaccuguaaucccagcuacuuaggaggcugagguaggaggaucacuugagccugggaggcggagauugcagugagcugagaucgcgccacugcaccccagccugggcaacagaggaggacuccaucucaaaaaaaaaaaaaaauuaagugaauaaagaagugaucaggaagcuacagaguguuguaacaaggagagcugaagauuuaacagcuggaugacaugaaccacagaagaaagguguuuuauuacuugguggugguggaauggaugacccagaagcagccccauaucucaacccuaugaugugggaaguggcugccucucagagcauguuguaggggaaguggugugugguauuccuggggagagccaggcuucaguuagggaggaaguagaagaggcugaguaauuaaguaacuacacaacaagaucucagaggguuuacaaggugaaugauauguaguacacagguggucugguggagaagaggaagcaacauguauaaaaauagaagugcaggaccagaagugagcaaaggggguuauauauugggcaaagugacaaaauaugguagagauaugacauggcggauuucccugacaauaagauuaccaagaaaauagauuccagagacaagcaagcauguguauauaugugggaauuuaauauaugaucaaagaaguauuucugaucaaaugugaaaagauguauuagucaauaaauaccuaaggaugacugguuauccaauugggaaaaaaauaaauccuuaccucauaucaaacucaaaaguaaauuccagggagauuaaagaucugaagauaaaagaccauugaaguguuagacagaaaugaaggaaacuauuauuauaauuuuagggguagaggaggccuuucuaaguaagcaaauaaagagaccguaaaggaaaagagucauagcuuugacuacauaaaaauuaaagcaaaagaaagcauaagguuaaaaaauaagggauaaaaugaggcagauauuugcaacaagucaauaaaagaaaaguaacuuuaaaaaguaaaaagaauggcugggugccguggcucacgccuguagucccagcacuuugggaggccaaggcggguggaucaugaggucaggagaucuagaccauccuggcuaacauggugaaacaucgucucuacuaaaaauaauaauaauaauaaaaaauuagccgggcacgguggcgugcgccuguggucccagcuacucaggaggcugaggcaggagaauggcaugaaccugggaggcggagcuugcggugagccgagaucgcgccauugcacuccagccugggcgacagagcgagacuccgucucaaaaaaaagaguaaaaaaaauuuggcuaguaaaugcaaagaaaugcuugaggccaagaguucaagaccagccugggcagcauagugagacccugucucuacaaaaaauaaaaauaaaaauuagccugacaugcuggugcacgcuuguagucuuagcuguuugggaggcugaggcaggaggaucacuugagccuaggagguugaggcugcagugagcuaugauugugccacugcacuccagccugggugacagagcaagacccugucucuaaaaaaaaaaaaaaaaaaaauuaaauuaaaacuuaaaaagaaauacaaauugaaauugaaacaauguauguguuuuuuuaaauccagcuggcaauggugaaaaagaauugagauguucuaguguuggaaagauguggagagaugggcccauauauguggauuuggguguaagucaguacaguaacuuggaagaggaauuuggcaguaucaaaaccaaaacuuuucuuaccuguggccuagcauuuccaccuccaagaauuuauccuacagauaucuuucacaauugcuuauauacauauauaugaauauuuguuuacuagaguguuguuuauaauacuaaaaacuuauaaacauuaccgaaugucuacaaacagaagagaaguuagguaaguuaauguauaucucaucauuggaauuauauucaacauuuacaagaaggauguaaaucuauauauauugacauuaacagaucuacagcucauuuugguaaggggaaaaauguuacaaacuaauaguauuaggaucccauuuuuuuuuucuguuuuuguuuuuuguuuugggguuuuuuugagacagucucgcucugucaccaaggcuagagugcaguggcguggucgcuuggcucacugcagcugccaccucccagguucaagugauucuccugccgcagccucccaaguagcuggguuuacaggcgccugcuaccacgcccagcuaauuuuuguauuuuuaguagagacaagguuucgccauguugacuggcgaaccuugaagucguucgcugggcucgaacucuugaacucaagugauccaccugccucagccucccaaagugcugggguugcagguaugagccaccuagccugggcccauuuuuauuuuaaaaauuaauaaauuuauguauuuacaaaaaaauuggaaaauugugcaaaauguuauaacuaaaguuaucccuugagaucuagaauuuuagggagauguucucuuuccaguggggauaggguugggagggacagaucaguuuuaaaaguaggggaaaauagaaaauuuuuaacuacagcuuuucccaaaaaaagauggguacaacuuuuacccaaaaaauaugggaugggaaugagaggaaggaagaacauucaggauucaucugugggcuggagagagugauacuuccaaguagguauuaauagucuguggagggugaagaaucuuggaacuuacaggaggagguaccaugaucuagacuaaauucagcagcacuaaggagaaggccccagcucagggcagucggcuucacagacucccacuuuacugggauaagaaguuugacaagguuggccuugacuucucuccuagcuacaccaauucacuucccaggcuuggaauaccuuuucuccucuugguagcuuggugaacaccaauucaggguucaagaucccacucagagguccccuucaacgucaagccuuccaccuuuccuggacguggcuauuaaaucuaccauagcccuuaucacaauguuuguaauuauuguuuguguucaucucuccugcuagacugugaucuccucaagggcagggaccaggguuuguuuuucuuuuuaacugccccagcaccuagcacaguuccugaugcacauuaaaugcacaauauaucuugguuggaaugaagaaaugagugggaaaugaaugauauaaugggcuuuuauuaggcagaauaugggggagaugaaaccuggauaugauguguauaaaggugggagggggaagagaagaaagugggcaugggaacaaacuuuggcaccagccuaggaggguaccaggggauaugggagcagaguagacauuaaagagugggaagguggcaaagucuggguugccuuucuuaguuuucaauccagaagcaaaaucagcuaccacuuuauaaccgaaaccaauguguuuuuuuuccauagugcugggauucugugaaucaaacacauugauacgauggaaguguuuugauucaggagggaacgggugguagagggaaaggcuauugugcacugagguaaagauugauaguuuccagguuacccuaauaguuauuagugacccuaauacagcaacgaguucuuccucucagagaaguggaaagaccuaaaucuuagaauuuauggauccagaggucuucagagcagugucugaaaaggcacuuuguguaagucugggcgucuucuuagcaucgcccaccccagucucaggauuucagaaauacuagguuuggggauauaaaaguaaucucuacauuaacuacuugcuauuuaugccugauuaucacauagcacaaucauaaaauaugcauuuuuugaauuccaacaucauucauuuuuucagcaaacauguacugaaugacugcugugugucaggcacugggaauacaaagacacugagauuggucccuccuguugaggaacucacaaccuaggugaggagauagacaaauaaacagcauaucuuaagaaaaguguuuugaaaaauguauguauacauugcugcaugaucacauaggaggguuucuuaggaaagagggggggaauaacagaaaaguuuccuaaaaggaaaauagagcuguuucuuaauuaggggagauguggcgggaaggcaaaguuuguuucaauuggaggaagcaauaugugcaaagaaaaauauggagaaaauauggcauuuucaggguucuguuaagaguucauuguucauugugagaguuccugcacaggagcagaaaaagacaaggcauuuucuuaugauuacccagugaauucuggacuguauucugaaagcuaugggagccauuggaagauuuuaagcggagacugucaugcucuuaucuucauauucuaauaucucugaggauaguagauugacauggguauuccuggaggcaggggaagacugccugggagauuuuuuauagucauccaggugagaaauuacaagaggcugaauuaaggcuuuggcccaguggggcugggaaaauggcgauguguuaagagauuauaaggauuguguaauuguaagacuuuuaaaaaguauuuuuacuguuguaaucucagugcuuaacacaauguuugagauaucagacagucuguaaauguuauuuugaguugaugaacuugugaucuacucaguuagauggaagguguagaagaaggagauuucugguauaggugaauagauggggcuguuaucaaagugagagagaggaucagccaggaggaggaaugaagaguuagauuaguuuuauguuuaagauucaaguggcuuuugagacauuugaguggagguguacaagucuagagcuccagaagaagaguuggcuuggaaagauagauuugggagucauuggccugcugugggaguggaugacauugucuagggagaguguaagcgaagggaaaaagagaaguuuggaaccuuggauacccuggguaacauuaguacauugggauugguaaaggagaaguugaaugaagaagcauauucaaggaguuagaaggaaaaccaagagagcaauguccccuaagcuaagggaguuuaguuucaagaaggucagagaugucugaugcugucaagaggucccagaaggagugagugguuucuauuagcucucugacagcugggauuuuugucuguuuugaccacugcuguauccccagcacuuacaacacccuggcacauaguaagcauucaguaaauuacuguugaaugaaugaaugaauugaaaagagucccuugaauuugguuacagaaccacaggacuuuggugaagccauuuugagagaagugguggugaaggaagccagauuauaguggauugaggaauagauagguuguaaggaagcagcuacaaaauacuaaguaugaccaacaucaugagcacauaggagguaccaggcacugagcuaagcacuuuacauguauuaacucauuuaaccuucccagcagcccaauuauauagguauuaugaucccuauuuuacaguugaggaaacugcagcuuagagaggguaaauaacuugccuagagaaggccugcagcuagaaaguguuagaaccaagauuugaauccagaucugucuuccuuuggaguucagguccuuagcugcccaggcuacauuuccucuagggagucuuuguggcaggaaggcaaaagaaagaguaagugaggccaggaagauugcaaacauuuuaaugcugaugagaguugaaagaaauaauuugaaggcuuugggaaaaggggaaauaauuuauacaagaggagacugagaagagcuccagagcacagguaaaaggaagccccuuccaucaagguggagguccaggagaggguacaggcagguguguguugcagauauuuuugucagcgaggagaggggaagaggguagggauaguugaaaguucucuucugauugucugcugagcauaagggagguggugaucaaguagacuugaggaagguguagagaauagaaugaagcaaugauggagauagaagauuuucaggguagcaucaagggcccagccaagauggagaccauuauuuugcagugguccaguccugcuguuuugugauuuuucucccuucccuccaguaggguacaguagccggggucaggggcacagcaggcagauguuagauugauccaggguugaaaguuuugcccauugguugugacagaagaaaagagacagaucguugggaguauuggcuagauugcguuugaggugaugaaucacuacauguaggccagcagggaaggaagcaagaaugagagaagacugagaacagaagggaaauggaggggucauaguacuggagucuggagaagguucaacaguaggacuuuggugauagagcguccuuguuauuagaauuccauguccagaggugaccugucugugaugaauaaggcaaaauuacucuauaagguacuacagggguagaaaacuaccagugauguuugucucuuuacugaggggacuaaggaaggguaccaaagauacuuuuuuuuuuuaaucguaaauauuuucuacuguuugguaguacuguuugauuuuuuuuuuaaccaguauguacuacucuuuuuuuuuuuuuuuuuuuuuuuuuugagacaguuucacucuauugcccaggcuggggugcaguggugcagucucugcucacuguagccuccgucucuuggguucaagugauucuccugccucagccuccugaguagcugggauuacagggcccaccaccaugaccagcuaauuuguuuguauuuuuaguagagacagggucucaccguguuggccaggcuggucacuaacucccgaccuuaagugauccgccugccucagccucccaaagugcugagaucauggaccugagccaccgcaccaggccuauacaacuguuuugauuuuaaaaaaagauacaaaguuuucagugaacccaaagagaagaguagguuuacaugaaagcagggagaugagugagcugcagagguagcaggcugugguccuggaaugggacccuggaguguauuaucugucuauggaaucacaaggucuuagaucugaagaggaguagcuggaaucuggucccacccugccauuguuuacagggaaggaaaugggagcccugagacuugcucagcuuggcagcagcaaaaccagaaccagaagcaaccuguccugauuucccagcccucuggucuguuuuucaugcuaccuccuaagcccuggaggcuucucaauuuccugcuguuccagccagacucauggcacaugugcucaugacauugcuggcugaccgggcuguuugccauacugugcuucccacacguuggugcuucucaguguucagggugugggcggguguguguagaggcggcuguacuacuguccccugccuauuuccugcccucuucauagccaggcaaaguagcaacuuggaggcggaaaaccacaguggugauacccuauuuacauccuuuacaaugaccuagugucccuccuguuuugccagcucucauguugcugccucccccaaacaucccucucauaauuuguuuaaacagcagccaugcccccguaucuacuucuuucagcccaaacccagaugagucacugagagaacuucggacagggauucuucaccaugagauugauggcagggaguggaagaauuguaauucuggagaaacagcccuuaaauuaggggcauuguucugggaaaaaaaguguuuuccuauucagcagaucugcaaaggagucugugacucuccaaaagacuacagauuuagggaguacagugcaggugucuuuuagaaaaauaaauuuuuuaaaaaucgaaagauuagguauuuuucugucuuccaaguaauaguucagauaaaccugguguuuguguggccucucuuauuuugucaugagggcagcgagccaugguaguugcauauggauuaguugugauuucuccuuauguggcaggcugagccccagaggauuagaacuaaagcucaggacuucggcugucuuuuggauggcugccuggguagauaugcagaugaauucuccacacaaugauauuggggcuccaugaugugugggguugggagugggggcaagaagucagaggaugggguauaguuuuuccucacccuugcuccuagguuaaguccucauuggucucccuguagagucuccuguggagauggguuuguagccugucugcuuggauggcccugcagauucugccuugaguguggucuuugccuugaaggucugcuuguccuuuuguguuguaacaauguaguuuuaggguucaaguauggagcugugaauugaccuggcccagaguugccucagauucccuccucuuugcagaauguaggcagguauugguguggggauccaggguauuuacugguaagggaaagaauguguuguucaugaugguaggaaaggcccccuuauuggcuugcuucuuggcagaccaaagagcugagauacagccaugugguagugcucaagaggucugagcaggcuuccgugagaugaucugagcgcuuggauuccuucugccuggagauggguaacauuugagauuccaguuugguucugaauucucucauugccuucugccaggccauccuaucccugacauuguagugccauaagaagucauggauguugugaugccagugggaugaauauggcuccaggaaagaauagaauagagagggguucauuaaguuaaggcuuggggcuauaacaccagagccacccugaaaaucacagggaagaaccagcaggagggugagaagagacaguguauucauauuuuggcuuuggcauuuuuucugcauagacaagggucuguaaagcuauauuagauacuauguugguucaacccuccacuauuaggguaaaaucuaccuuggauagagaaccuguuugggaagaggaaggaaggaagcaagaugggugggugacccugaucuucucugagguaucaguugcaucaucucaggccuccucugccugauccuucugucaucugcuccauuagcuccuaggcuuuugcaaaacuggaaacccuucaucuggagcccucaagagcaguacuacuuaauaugccaaucuucaaugagauaagaagcauauguaccagaauguaagacugaucucuucaucaagaaaaucuuguaugaaaaaauguuagaacuagacaguguguuuacucugacauaauugauuuacauucaggcuucauauaaguuuucuauauagugaccagccaguaacacaguuugcaaauuggcagcuaaucugcagaccauacuuggaguagcagugcucuagagcugccuuucauucagaagcaguuguugaggucauggaguuguuuguuugguacaggccaagggcagucagaaauauagagcccugguuaagaagagcugucacccagagcauucagacaugggucagggcagcuacugaggagaagaggggcacaacgagagugagacagcugaacagaugaucaggcacugccuaugccaaggguaaaugccauguccucccuuuccuuuaccacaggcgugugagcugagggacuagagcuagggucuugguuuugccuguugcuucuaauggcagguuggccgcaccaagcuuacccugucuuccuagggaaacggcauacacuggagaagaauguguugguugucucuguagucacaccuggauguaaccagcuuccuacuuuggagucaguggagaauuguaaguaccauccuguucccugucuuagaagagcaaacacuugucugaagcuguaacucuggauggccuggccuaaacugcugaugcucggccuggagucccccuugacccuggggaccgagggucaccaagugcugagagccauggaagaugaguuuuuccuaugcagaaacuuaaccagugcuaaagguuggcuguggaacaucacacuggcucuucacugagucccacaggacuucuaccugguguacugaauacauuucuauuuuaggaaaguguauacuuugcuacuuuucucuaauagacccuacacuggggaaagcagggguucuggucacuuauacugagaugaaguuaagucauuaguccagugacugccuccugucuucccugagcagcauuuggggacuucucagucuccaaagugaacaguugaguuuggcuccuuccucacauucuuggaggaaguagcugaagcauagaggaaggggaaaggagggugauuacaaaggcauugggagcaucgcgugcugcacucaccccugcaggcaucccuguucccuuugccaggagaagacuucuuucaucuuucugcuguggaaacugacccaugagguagguggugcuuuguacagaccuccacuccagccugacucuugcuguacaucaucauccagggucuacagagucacuguggugaccacccucccacucuggccccagaccaggccauccuacagcugucuugcucuggggacaucuccucauugaaagauuuuuuaaaauauauggucuuacuguuuuuuuuuuuuaguccagugauuuauauagaauaucuggucuauaaucugagaauagaaaaccuuaaccaacuaaaugaguucauuucugucauuucagauacccugaccauaaaugaugaccaguguuuacuccucucugagacugucuggggagcucuccgagguaacaaauuggggcugauuaaaagagagagagaaaggaugaugugggaagguugguguugguggagugcaguggcccagucccugcucacugcaaccucugccuccuaggcucaagcaaucuucccucuuuagccucccaaguagcugggauuacaggugccugccaccaugcccagcuaauucuuguauuuuuaguagagaugggauuucaccauauugcccaggccagucuugaacuccugaguucaagugauccacccaucucggccucccaaaguucugggauuacaggugugugccaccgcgcccagccaggaagcuuuuuuuaugggaacaauuggcguguuuucccgucucuguggaauugucccuggaaguugacagguuuuacccugugcagcaucagcaacugcugcugcccuagucaggggcucugggaagcaguaggagagucugugggcugauguucuaggugccagcaggggacagguagcugggggcagggggaaugaugcuaccacagacacugucuguccagcucuugcuaaagacauguaauuggaaagguuuuuuuaaaaggaaaacuauaacaaaagaaauagauacaugcaaaaaaaaagauaaauaguagugaaauauuuagaacuacauuauuucuggagaaaaugaguuuacuggcuaaacuauuggcccuugcccuucuucuggguuuacugagaaggcauuuggugccuagauacagacuuagccaaauaucucucccacuuuugguaaacccucugcuggugaaugaugugggaaacucucucggaauuccacaccuugcuuuaguuugucuucauucccuugcuccacuucuaugcuuggagcaacagcaugcugccuccccuuccugcccucuuguaccuuucaugcaggugcugauggugagucaggcuagagguaagggaggaccuggaacuccagaaugcugggugucagagucagaguggggagaagccaaaacaguacacuagcagucugcucaaaucaggugcugagugacugcugaggucucauggauucuuucacuuugaaacuggggacucugauaauuuucauggggcuucugcaggguuuccagaagaggggccccagcuguugagaacauacaauacucuggguucaacauaccugugugugggccuugcuagacucuaggagacagugucaguggacuaggggaguccuucuggggcaguugcuguccaccacaccucagcucccuauagcugggucucuucuuagacucugaagaggaagaguggaugauuuuuuuuaucuucuagguccagccaugaacccaggcuccuuggaaacccaagcuuaugaucacuuucucacaauuuauucugggaccccuuuucucagcucucuuagcuccugauagggguuauccaugaaaaguccaacucuugcaggcugaguugucucugugucuguccucaugaguauaugucuuggccucucuucucaauauucuugugaaggcacaggaaauauagauaagagguauguggguuuugaagguuaguauguuguaaggaagggcacuaaaacccuuacucugacaucucccaaaaugaaauacagaaguaaagauggauaguggcuuccuaauauccccuuuucaucaguguuaaaaaucgucaagccuacacuacauccauuuucccuguguacccaaauguuaugcucugcuacauugagaaccuuccaaauagagacaucucuuuuuccacucccugagucuuuacucugccucucuacaucuuccuaggucuggagacuuuuagccagcuuguuuggaaaucugcugagggcacaguaaguguggacccucaaaaagggcuccuuuuucaucucugggguuggaucccaauauugagaauccuagaaaaaucuuguuuugccuuaggauccugguggcuugagauagccccaguagaaauggaagaggagaugugaguggaaaacugguuugguagauuuggucuguuuggaaucacuguaauuuggucccccugagucaucauuuaguaaugaccuugaggccacacugcuuugaagaaaauaaacuauguuaacaggaaaauccagaauuuguaggcugagugguguuugggacaguuguauuaggcuggcguuggacaauugcucucugggaagguggcugcuuauggucauuuauagagguggggagcauuuagggagagagcgacccugagaacagucacagauuggcuuuuuaagaauccugggagaguugucuucaucucccugugcccccauaguaagcuuccuuugaaacugacauguucaauguuuguucugcacaguucuuuaucaacaagacugagauugaggacuuuccccgcuuuccucaccggggcuugcuguuggauacaucucgccauuaccugccacucucuagcauccuggacacucugguaaccaggccuuaaggccuucuucacacuuaagaguucuagggugauggagcaacggacagaccaaguuccaaauucuuaaagaguuagagagggaauguauggacugggugugguggcucaugccuguaaucccaacacuuugggaggccgaggugggcggaucaccugaagucagaaguucaaggccagccuggccaacauggugaaacucugucucuacuaaaaauacaaaaauuagcugggcaugguggugcaugcuuguaaucccagcuaccugggaggcugaggcaggagaaucgcaugaacccaggaggcagagguugcaguggguggagaucacgccacugcacuccagccugggugaaagagugagacgcugucucaaaaaaaaaaaaaaaaauuguauguaauucuaugagcuccugggaaaaauguagaagaugagcugcuccaagacucaaaaaauaacagagugacuuaaaucuaccuuacaggcuacuguagaucaauguucaggcuguuuccagggauacaaauguuuaggggaauuggcuucauuggcagagcuaacuauauuuguuuuugagacagcgucucaauuuuuuuuuuuuuuuuuuguauuuuuuguagagcugggguuucgucauguuacccaggcuggucuugaacuccugggcucaagcaaucugcccaccuuggccugccagagugguagaauuacaggcaugagucacuacaccuggccggcagagcuaacuuuaguuagaacaaggucauaggagagagacguucaaagccuuaacuuggggccaggugcaguggcucacaccuguaauccuagcacucugggaggccaaggcggguggauugcccgagcucaggaguuugagacuaaccuggccaagacggugaaaccccaucucuacugaaaauacaaaaaauuagccaggcgcgauggcgcaaaccuguagucccagcuacucaggagucugugaugggagaaucaccugagccuggggagaucaaggaugcaugaacugugauugcaccacugcacuccagccuggacaacagagacccugucucaaaaauaaauaaauaaauaaauaagugaaggaaggaaggaggcugaggcaugagaagcacuugaaccugggagguggagguugcagugagcugagauugugccacugcacuccagccugggugacacagcaagacucugucucaaaaaaaaaaaaaaaaaaaaaaaaagccuuuccuggggaaguuccuaacucucuugaguuuaaugugcagucuuaucugacaguucccaauccaguuccugugucugccuuuuccuuugcuccugugacggaaccaaaggaggccacacaucugccagccuuugcuucugagauuaugaguuaagaggcuacuaaguucccaggaggucucacaguugggcuuaacaucagucagacaaccgaacacaaauggcaagaggaaguauugaucuucaggcuuuuggaagauuccaggcuaccacaguagcugcagcccuccucuuaauguggccagaauuuauuucaagaagaggaaagaccacuucuaucauccaucuuuggauguguucugggaaaaguagaagugugcugggccuucccuccaugccaucccucccugaugggaagguuugauagaccccauaaauacuuaauugagagcugaggcaggucaagccuguagggguguguggagcggccugagagcucgcccaacaucgcaaguuugaggcugaaaccggagagacugugauggguucacagugugcacuuuaaccuacaggaugucauggcguacaauaaauugaacguguuccacuggcaucugguagaugauccuuccuucccauaugagagcuucacuuuuccagagcucaugagaaagguauguucccguuucacucagaccaaguuuaugggucaaugucugaaucuggcuguggcccugcuggcaagaacagggucucucauccuaaccagccaguuuuagaccaauauaggggaaggacacuggauuuggagucaggagacuugaguucaaguccaaaacuuugccgauaauuugccuugugaccuucaggagagaaucucuucuggccuuauucccuuuuuauguauuuauauucuguuaaauggacauaguauuaauaccuaccaugauuaucucacuggcauuaugauacucagauaaaacagaugugauaacuucugggaaauuaugaucaaguuuuuugaagauagucccugacaccaaagggcuaugggcagguuuucugauaucuggggagucuugugggcauuuugaguaucuucuacucugcuagcuuucaggaagugugaaccugaagggugucuugugccuuucagggguccuacaacccugucacccacaucuacacagcacaggaugugaaggaggucauugaauacgcacggcuccgggguauccgugugcuugcagaguuugacacuccuggccacacuuuguccuggggaccagguaagaaugaugucugggaccagagggacucugcuuguuaugcucagagugaagcuucagggcacuggcucauggaaguggcauaucccagccuugguccuuagaagaauguuuuccaucgacuucuuccaccugggaauuuagauaggaagaacucacuuuggacaauggaggcugcuucuuacuauuaaaauauguacuguuagacuauguaagggcacauuuuucucagaugccguugcagguaguugugccuagaguggaugcugaggaaucugaccaccaggguagaaucugaaagaaagaagcccaagggcagccugcagaggucagagucagucaguaccccugcucccuuucuucuguauacccucagcccuccagugugagcccccaacacagguuaaaugacaguugaaaagggcuacuggccugauagaaaacugaagauauuggccgggcgugguggcucaugucuguaaucccaccacuuuuggaggccaaggcggguggaucaccugaggucaggaguucaagaccagccuggccaacauggugaaacuccaucucuacuaaaaauacaaaaauuagccaggcgugguggcaggcgccuguaaucccagcuacucgggaggcugaggcaggagaaucgcuugaacccaggaggcagagguugcagugagccaagaucaugccacuguacuccagccugggcgacagagcaagacucugucucaaaaacaaacaaacaacaacaaccaaaaaaaaacccugaagauaucuugugaccucagcgucaggaaguagucucugggccaagggagauaucccuuagcaaauguaaaaagauucugggugaugguugaccccaccuacaggaggagauagagaagaaagauuuugccaguuuggcuggauuaggcucucucucugccucaaggccugugaggagagcagccuugggagcaaggguagcaccugcuagaagcaguguguccaggcaagagugugcgcacugacaguugucuggcuggaacuuagccucugccuaugauuguggauauauuuguaucuuuuuacugugacuaaaugguggugacuaccagugucugugagugccuaagugugccuaccuaaaugugugugauguuuaugaauacacuugucuugcuuugugugacucguguccuuacguguaggacugugcguggggguuuauguauuugugacacucauaugggguuuucucuuggcuuagguaucccuggauuacugacuccuugcuacucugggucugagcccucuggcaccuuuggaccagugaaucccagucucaauaauaccuaugaguucaugagcacauucuucuuagaagucagcucugucuucccagauuuuuaucuucaucuuggaggagaugagguugauuucaccugcugguaugagcccuuugaucuucccacuguggccugaucaguugcuuacucagaauagaaguuagcacccgaggggcugcuuagcucagcugcugcucucaggggucuguaugggcucacauugcucaggucuuaggccuuccucugcccaucuacguagagauccuaccugauuuuggcaaggcuuucacugugaaccucuuccuuccuacucucauauccuugagguauugauagaaaaaacagcccugggcacagaauugucuuggaaaaguucgggauagagaaaaauaaucccuguuuaugaaggcuuaaaauugucuaguugaagagucaagacacagaauucaagacuaauaggugacaaugucuaauuaguauucaguuguaaaguccaaacccuugguucuaguaagcucaaaagaggcugaggggcuucuuugagaagagggcgcuagagcugaaucuggggaaaucaauuuggcuuuuuggagaugugagcaggggaaaauauuccagaaggagaacaaugugagcaaaauguggacgucauaacgcaagggaucugcagcagguguuagacagcaaggcuugucauccaacuggaagagcagauaggaaagccgaaauccagugugcuggagcuucaaguuaagaccuuggauucucauguugcaguccagagaggauuaauauguuuucucuuugggaguuugaacuuaaaacucuucagguccagacucagccuuucucagccugugucaacagcccaccugcuucacauaacuuugcuuggccacacuuuccacauguagggcuucugagauccuugcuuauuugauuuuucaggugaaaagaggaaguuauagggggccaggugacuaauccccaggcauuaggcuuucaggauguugaaagauuaaucuucauuuucucuugggauucaggaaguccaacccagagauccaggacuuuaugaggaagaaaggcuucggugaggacuucaagcagcuggaguccuucuacauccagacgugaggaaggaaggaggguggguggggucccuuggggguccuccugugggguccucccuuuccauaccgagucaggcccugcuuggccacugucuggucccugcaggguucccuuguccuuugucccauccuuucagauuuggagugguugguuuucagcccaggggaaagacacugcuuaaugaggaauaggccccuggccaggcucaaccccuagagcacuggcacaaacagucuagaacccaucugagcuaagcagacacuuacuagacacuccucuccucuccaggcugcuggacaucgucucuucuuauggcaagggcuaugugguguggcaggagguguuugauaauaaaguaaaggugagccggggcagagaagagaagaagccaccagcagugccucccucuggucuccccagcuccucccugccucuacagagacugauccuccugguuuggauugggcuuuaauggucggagcacucuccuuuucucucuagaaaggccacagagugcugggugcaguggcucacgccuguaauccaagcacuuugguaggccaaggcagggggauugcuugagccuaggaguucaagaccagccuggccaacauagcaaaacccucaucucuacaaaaaauacaaaaaucaggaggcugagguugggguacugcuugagcccaggaggcagagguugcugugagccaagaugugccucugcacucaacccugggcaacagagugagacccugccucaaaaaaaccaaaggccgcugugguaugagcccuggguuuaugugucagaguuucuaucuucccucacuacaaacuuaauuaagaacuauuucugcuguuagguuacuuggauaggcuggauuuuucuuccuaaaucauagaugagggucuucugggucugugggaccaagguuaccuucuccuuuauuguugaucaguaagaucccagucuccugucacaugcaaggacucuucaggaaccuugucccguccccagaaacaucuggagacuuuuggacauggcagcuccugggucccacugcuugccucccucagcucacagcugguauuacuagcucuguguggacagggaggcugcagagggacggggaggagagcugcagggaggccucuuagggcccuggauuccuuggccucuguccugaggugugagcucaauggucaggagucacagagacauacuuugcugcuggggaacagagggagcacauaccuguugucccauguugccuguguaugaauaaggcccaggaaucuccucagcuuuguguccuuacugccauuugaccuuuuauaacagauucagccagacacaaucauacagguguggcgagaggauauuccagugaacuauaugaaggagcuggaacuggucaccaaggccggcuuccgggcccuucucucugcccccugguaccugaaccguauauccuauggcccugacuggaaggauuucuacauaguggaaccccuggcauuugaaggugaaagcagagagcucuccuugcuaaccaaaggaggcuggguuggggcacaggaugggaggcaggaaggucugggccagacauuuccaguuaguaaaugaaacaacuuagcuggggugagggccacauugggaaggugguugagagggacccuggaguuaccccaccaucaccagacuguuguugcuuguuuucccucagguaccccugagcagaaggcucuggugauugguggagaggcuuguauguggggagaauauguggacaacacaaaccugguccccaggcucugguaaggguuuucgggggggagguggaggguugggccugagagcaggaguucucccuuagagacccaaucccaucuagccaccucuggacuaguacccuucuuucaggccugagagagagcaggccgugcaacgagccuucugaagauuugugugcaauauucacucuccacaugacuuccgucuauaucccuccagcugcccuuugguaugugggauagggauuguuaaccuuacuucccagagagauaaugaggccuggagaacauaggugaguugcucaagacccagcacaagcauccaugauuccuguaauaaggcuucccucugcuguuuucacugcagccuuaccaaguaugguugggugugcaaaguuuacauuuuaaggaccucugcugcugccacugucauugugguuaaugauggcuuuaagguuuauucuuauucccauaucuuugagagaggaagagagugggauugcuacccacauuuuaaugaagguggagcugagccguagaacucucugggagccauccaaccuggcuguggcucauaacaagguauugaucacuuccuuuggccugagugaguccagggugccuagacaagagguagcagccuguggauguccagcaccuuugcagggaauacagggcccaaucuggcacaugccccuuuuccuccaggcccagagcaggggcuguugccgaaaggcuguggagcaacaaguugacaucugaccugacauuugccuaugaacguuugucacacuuccgcugugaauugcugagguaagcaagcuguggggccuucgcaaggcggagcaggccagauccagggcuggggaaccccuuagagagaggaagacaauaauuaacaauagcuaacacuuacagaggcuuauagucagcccucauccacggauucaaccaacugcgauaaaaaguauucaggaaaaaaaaaauacaacaaaaaaugguacaaauaaaaaauacuguauaacaacuauuuacauagcauuuauauuguauuagguauaaguaaucuaagaucauuucaaguauaugggaaguuguacauugguuauaugcaaauacuaugucauuuuuauauaagggacuugagcauccuuggauuuugguauccacggggguccugaaacaaauccccuguggauacugagggacaacuguauuuuguggcaaacacugugcuaaguuuguuacaaauauugucucauuuagucuucaccacagccccaugagacaggugcauuuuagagauagacacugaagcacagaguucaggaccuugcccaaagucacuaagaagcaggauuugaaccaggcugacuuacaggaugucaugacaccuuugccucugucagggaugugccuguguaagauagucauuucccugauuccuucguuggcuaggucuugaguacuugggggacauagccuagugcagagcagaguccugggcugagagucaagcaugauggugucuaagccucaauuaugucauucacuggguaacuuccagcugguucucuaagcauguugcuuacuuggaugauaagggaagcaugccuagagguccccuaaggagauuggucagguuauagacugagacccaaggacaggauuucgcauccauguucauggacaggacagcaccuaagucccccagugccaccauauuuacagcauuuuagagucaggaacagagggcuaaguagaccaagagcauuggcugccuuucagacauccaucuauauucuaaagggauugaguuauuugggguuaggguacagagaugggcaggauauaaauagaugucgccaacguuucuggaucuccaagaccuguaucagaaucaccugaggcaccuguucagcuugcagauucuugccaauacuuugccccaccccaggugagaaucucuggaauugagauucccaggugcauuugguguacagugacaguuugagagucaccgaaauggggaaggagagacuguugacuggugugaaaaguguugcuggggccccuucugaggggcuuaucuugccauuucuucauguccucuugcaggcgagguguccaggcccaaccccucaauguaggcuucugugagcaggaguuugaacagaccugagccccaggcaccgaggagggugcuggcuguaggugaaugguaguggagccaggcuuccacugcauccuggccaggggacggagccccuugccuucgugccccuugccugcgugccccugugcuuggagagaaaggggccggugcuggcgcucgcauucaauaaagaguaauguggcauuuuucuauaauaaa

SEQ ID NO: 16031 - RNA, 16498 nt, Homo sapiens
cagaagacacccuaaagaaagugaagagacaggcuacaaaccgacagaagacauuugcagcacauauaaccacaaaagauuaguaauaaaaguguacuuuuuggcugggcgcaguggcucacgccuguaaucccagcacuuugggaggccaaggcagggagaucaccugagguugggaguuugagaccagccugaccaacagggagaagccccaucucuacuaaaaauacaaagaaaauuagccaggcgugguggcacaugccuguaauccuagauacucaggaggcugaggcaggagaaucguuugaaucugggaggcggagguugcagugaggugagacugcgccauugcacuccagccuggguaacagagcaagacuccaucucaaaaaaaaaaauaauaauaaauauguucaauaagaagagggaagucccagaagacagagugagacugugaugccuuuuuuauauuguucaaaagcaaacaaaauuaaacauuguuuaggcauauauauguguauuaugugugugugugugaaaacuaaaggaaaaagaaaaaacaaaagaauaauaacucaaauugcaggauagugauuaccuccaaagggaggcauauaguuagauguaagucacugguaauguuuuagguuuagaauuuaguucuuugauugggucucuggguauucauugucuuauuaaaaaauaauaaugaggcugggcaugguggcucacaccuguaaucccagcacuuugggaggccaaagcagguggaucacgagguugggaguucgagaccagccugaccaacauggugaaacccugucucuacuaaaaauagaaaaauuagcuggacaugguggcaaacaucuguagucccagcuacucgggaggcugaggcagaagaaucacuugaaccugggaggcggagguugcagugagcugagaucgugccacugcacucuagccugggcaacagagugagacuccgucucaaaaaaacaaaacaaaacaauaauguguuaugaaacaaagauuaugauuaauccacacagggcaagugaccaacacauauuuauugaauauaugagugaaucuuacucugugugccuggcauccaaagugggguuaggguuggaauagucuuuuugauuugucuggauucuucacuuuuuaucuuugucucagccuaagcaucccucugauuaaguucuuuugucuuuccgaguagugagauucucaugguucuuggugcccacugagauucuucuuuucuguuuucucccuaugcccucccuuucuuucucuuuucucccccuggccuuuguuuacuaccaagugccuaaauaccuuuaguuaccagaugaagccagaaaucucuguugaccucucgucuuucuucaucacuuaaccgauuacauaaagauaucauagacaccuuucaucucccucucucaaaggguaauugauuauagauacaaaaugcaguugaauuuuacuauuggaguuagagaucaucuaauuuaaucccuuauuacuuuacagauaagaaagcugauauacagaaaaguuaaaugauuuucuuauggucacacagcuaugaguagcagagauagggcugcaauccaggucuccuaauuucuaggccauuguuguuaucacuauaugauacgguuuggcugugucuccacccagaucucaucuugaauucccauguguuguggaagggacccagcgggagguaacugaaucaugggggcagguuuuuauuuguuuuuguuuuguuuuguuuuguuuuuugagacagagucucacucuaucgcccaggcuggagugcaguggcgcggucucagcucacugcaagcucuaccucccggguucacgccauucuccugccucagccucccgaguagcugggacuacaggcgcccaccaccacgcccagcugauuuuuuuguauuuuuaguagaagugggguuucaccauguuagccaggauggucucgaucuccugaccucgugauccgccugccuuggccucccaaagugcugggauuauaggugugagccacugugccuggcccaugggggcagguuuuuccagugcuguucuugucauagugaauaagucucaugagaucugauaguucuauaagggggaguuuugcugcacaagcucucucuuuggcugccaccauccauuuaagaugugacuugcuccuccuugccuuccaccaugauugugaggccuccccagccauguggaacuguaaguccauuaaacccuuuuuccuguauaaauuaccaagucuuggguaugucuuuaucaguagugugaaaauggacuaauacacuauauuagacugacagaguaggccuugcuugaaugacgggucucugagggcccuauagauaugugaguauguauaaugggauguugggggaaaugugugcaaauguuccacuuacuguaguuacuccagcauuugaccaacugucuuguauguuuucuucuacgcuauucugcucugguuuucuguuuuuucuuucucacacuaucuuuagccuaauggcauugagugcccucuggaagugaggguugguguaaauagcguucauauaucuaguuccagugacuuggcuauaaaguucagguugaaauaggggacagugaaaaaggaggugauauacuccaucuguuuguuuagucuuguuuagggacuucugauaagugcauacucuggacacagaacaucuagggauuauucuagccaccaugaucucagguucugggcucaggaaauggacaaucauuggaucaguguggaaaggauaguguacaacaggauugaguugggacaagauuuggguuauaucauaagggccaucucuaagaccugccagagaaaucagauuguucuuuauuaucuuuuaugugccuccucuggaguauaaccugaaugggaauuuuacuuuuugucacugacauacccaguuugagagaaggucaugauguuuggguggagagcugaaccuaguuaaggcuaauggggaaggugaaaacagggguuaugaguaccuguccuguaaaaggaagaaaugggcaauucaagccuugaggcucuugguguccugaguuuuguucaggcccuaccuaaaucugucacgagacuugaguguaaaugcaugaugaauugacagccugagcagugaagaaugucaguucaacagcuaucagucuauuucuacaccauggcuaugagaaaaccaagaacugaucagaguggaguuaauaguaauagaaaguuccaggguagaguggugagagugcuuaugaccuauaaugauagcaucaucuccaucuucaucucucucccugguggacacacacaggcacguguguccacacauggguagacauuuuuaucccuaacugugguaagauugggccuaugauaaagcugaguacagagacuuaacguccuauccucaaaccaaaaagagugaggagugggagcacacaagcacauuuucauaucuaaauaagaaaaguccaaguugagucuauaaauguuauaaacggguaaggaagguagagaguuuauggauuuagauaauguggaaacuagaaggaaugggcacuucuuucucaagccugggaagacuguuugaaguaggauucuucaaguuaguugccauugugauuuccuguacaaaauuauucaucacuuaacugcugaugcuuuucucuugaaugacuggucagguuuuuaauguaacuuugagacuagagcaaaucugacuuguucugcuugcuuccuuuccauucauuuuacucauccaggcacuugacaccaagguauugaugucccacucuccugggccccucauuccuggcugauuucaugugcugcuccccuaucuuagaacccugcagugguucccuaauguucugaggauagacuuuaguugccuuaacauggccugcaaagccggcuugaucugauccuagcuugccucuucuacaucauuucucaccacuccucugcaauucacuauucucuaugcaacuaacacacacuaccuuaucuuuccuucaggccuucuguauccuauuacuucuucccagacacuuccccgcuguuuauuuaauuaacucuuccuaauccugcaguucucagucuagcugucaccacaugacuucuuuaaacucuuaggcuaggcuaguugcccuccucuaggcucacaccaugcucuauaaucugcaucacaaccccuuaccaugcuguguuguuaauuacuuguucuugcuuguaauuuccagcagacuaaauucugugggggaaaauaaucuucuuuguuuuauucucugcuguuuugaugagcaucuagcucagugcugggacauaguaggcacuuucguaaauuuuugauaaaugaaguggguguauuguucugugacaggaaugggaaaaggacagcacaggaugcccuccaaggaugagcugguccagagauacaacaggaugaauaccaucccccagguauuggaacuauucuaaugaggcaggaccuuucccuggggcuaauuuaggcuccagagcuggacagggaaacaguggggugagaauggguuggggagugauuugagaucauuuaaaggagucagguauguucuaaagugaacacacgucuggagucauauguagcugaagucaugaguauaaaagcagaggcugaguuuagaugaaaauguaaagauggaagcugugacccuauccagacugauuaugggaaagaagaauuuucugggcggcgagggguguugcugggagcccaggauaucucugauccccacucccaaucaucagcuaaccagccucucuagggaaagcuguacccaucuaccuggcucuggucuccuuugccuccuucucuuccagacccgauccauucagucacgguuccugcagagucggaaucuaaacuguauagcacuuugugaagguagguagcuugcccauguccuguuuuucugggucucuaaccuuuguuucugauguaauuuuggcacaugaucuggccaagagugauguugaaguggcauggcuuccuucuccugccuggacucugugccuuaagcauuguaucuaugauuucuggcccucuuucucccagugauuacaucuaaggaccuccagaagcaugggaacaucugggugugcccuguguccgaccaugucugcacaagauucuucuuuguguaagugucggagggacucuggggauuacucgaggagugagguugggggugugaugguguguggcuacugggaaaagucuauuucuguuaucugagacauguccuuggcuaccugaguggagcugucacugggacuuuaccauuggaggaugggaauggguauagaugguugggaucuaucuagaggaaaccagauaagcugaauaucuuccacuaugaagcagugagaaagggcuuugacuucugggaugggauggccauaccuugaaauacaguuccacugauugauguuauucugguauuguucucccucuuaugcucacacuugcccuaucuuuggcagauaugaggauggucaggugggcgaugccaacauuaauacucaggaccccaagauacagaaggaaaucaugcgugugaucggaacucagguuuacacaaacugagggggccccagcccucguaccaccccuguuaccccaggauccaucugcccucauaaaaguguucagguacagcagcugaggcugcccugaggaaucaaggggccauuaccaaggggcaggaaaaggauauguaagagguggccuucaugguagagcuugacccaagaacuacuccacauucggauggcccagacugacuccauccccugacuuucccuuugacuucacccuguuuguaaauaaaacaauaaaauggaaggugcuguggacuggauaugaucacugugguuugacuagccuuggagcagcaccugccccaagcccucacaaggggcaggggguggggagacuggaauauccugcggauugggacuguuuauguugcaugguaucaaaguuguguccauuuauuguaguauacuacagaugugucagcuuuuuaaucaguggauuaaagggaaacuuaucaguuaugcagaugaaacaaaccgagaauauagaauaccacuaaugacuauuagucaaaauuuaaaagggccauugaggccagagcagcuaagauuuacugccuuuagggccuauugcuuucugcacaaaccugcccagucucccuugcucuauaucucaggaacuggaccccuacucucuuucuccuccaaccuguuucuucaggguaagugagguuaggggagaacuggugggagcaggaagugggguuugucucuaagucgaaaucuauaaagacauccuaagggaaugcagcuucacuuaaugaaacaacccaauuucaccaaguuuaguaaggugguaaaggaaggcagcucuuucuaggaagccuaauuguuguagugaauuuuuucuucucccuguugaaauucccauuucagccuuuugcuggccuuucaggcugugcuucaugugccccagauccuuaguuauaagcauagcugugucaguuggacauuuccaaauauuuugugaaaaaaaaauuuuuuuuugagacagggucuuacucuguugccuugaccucccaagcucaggugauccucccaccucagccucccaaguagcugggaccacaggcaggugccaccacacauggauaauuuccauacuuuuuggagagauggcguuuuaccauguugcccaggcuggucuccaacuccugggcccaagccaucugccugugucagccucucaaagugcugggauuauauacuuuaugaaauauuaaugaagaaaaacaggaauauaagcacagagaauacaaaaagcauuaaauaagccuggcauuucaaggauaggguuuuuuaaucuguuauagcuugauuuacaaagcacacucuaggcuaccuguugucuuucaucaccuucaccguacuuuagagguaccuucuugccuggguaucuuacccugguuuucaguuccugaccugcuuuaacaugcaaguaccauucuuaagguccaucccucuagaagcuguuucuuaaacuuugcucauucuugaucaacacuaacacauucuaauuuacaagucuccuaagcccucuucucccauucugguuucaggucuaggaaauaaccucuucaccaaguaaaugaccucaucacugagcccacucugacugaaauaccugccuccugagaggacuuugugcccaucucuguaguauuagagauagcugaccuuuucuuuaguuuuuacuaagaaggugcugacauuaugcuaagcacuuuaauaauuugcuaacacuuuggauuacuuacugugugcuugguauuaaaaauuuucuuuuuucuuuucuuuuuuuuuuuuuuuuuuuugagauggagcuucacucuuuuugcccaggcuagagugcaguggugugaucucggcucacuacaaccucugccuccugaguucaagugauucuccugccucagccucccgaguagccggauuauaggcaugcaccacuacauccagcuaauuuuuuguauuuuuaguagagaugggguuucaccauguuggucaggcaggucucgaacuccugaccucagaugagccacccaccuuggccucccaaaguagugggauuacaggugugagccacugcgcccagccaguauuauaaguucucuacauauauuuacucguaauucucagaacaagccuaugaaguaggcgugauuauuccuauuuuguagaugagaaagcagaggcacagagcauaaguaacauauuccacagcuagugacaggcagccugacuccagauugcuguucugguucuaugcugaaaaguguucaaacuuuacaaauauuuuuucauuuaauccugacaacaaagcuggaagauagguuuucuucagagaucuuaaauaauguaucuaaggucccacagcugguuauuggcaauguuaaguuuugcuuuuugguuuuuuuugagacuuggucucauugucacccaggcuggagugcaguggcgugaucauagcucauguaacuuucaacuccugaguauaagugauccucuugccucagccucccaaguagcuauuacuacaggcaugugccaccaugccuggcuaauuaaaaaaaauuguuuuguagaaaugggaucuugcuauguugcccagacuggucuugaaucgcuagccucaagcaguccucucaaagugcuaggauuacaggcaugagcuacugugcgcagccagugcuguuucuaacuagaucugaccaacuccagaaccugaguucuuuuaaccacucuguuauccuagauggucuccaacuguucucacugauguuccagcaacugaacuuugguguguggcuacucaaaugguauaacaacauuucuguucaauuucaaagauuguuaauagauuuuucucagucguaagcauuucuuauaguuucucuguaucacugacauccaauauagcaguacuagcaaaugauggaaugagaaggaacaaaugguguauauuaccagaaaaacucaaauagcugagcuagccuuaugggugucacuuuaaaaaaaaaaucaucuguauaauaaucuuuuuaugccaauaaaauuguaauaaaguuaaauacaucauuucauagugccacagaaaagcaauaggacuuuuuggaucuaagaaguuuagaagccacaaaugauaauaucuuaacauauaugagguaaaacaaauauaauuaaaaccccacaaacaacaagaaugccuucauuguagggaaacuugggugggacccugaguuucuggagaggaauccucccacagccuggagggggaauugagguaaaguugccccuuuucucugcccaggccugguucuucuggagguggggaagcuggagccugugaaacccaggugugagcaacaaggcauccuccacagggccaagccuauuacaaauaccauacauacagguugacagcggccuccuacuuuucauguaguccugggcucaagcagucucacuucauagaccuagacaugcuugguuaggacuagggucaggaaaagaacuauuuucuucauuaguucuggguacagaguagauggcuauuuuuauuuuauuuuuuauuuuuguggguacauaguagguauauauauuuauggguuacuugaguuauuuugauacaggcauggaaugaacaauaaucacaucaggguaaaugggguauccaucaccucaaacauuuaucugauuuuuagguugagaaauuacaaaccccuggaguuuaaccuuccguuucccuccuccugguaauuuuccaucaggcagggugugaccaugacucaguuuguggugaggauguggccauccauuggggaggagccugcucgauucugccuuucauucuggcugguggggagaggggagaagagucuggugcugagucauuacuggguuucuuaccagcuucucacaggauggauucugagauggaggucugagggaugccacagcuucugggacuaauucaggagugguguagaggaagcucuauggaucguguaauuccuuguagagcccuccuaccccaggagaagugggaauaagguaggcugcagcucauuugaagauucacuggcuccuuuggagcacaggacuugccacaaaugcaucagaccucuccuccucucacagugagccagagaugccacucuuuaaguuaaaaauuauuuugcuuaggagaagacccaaagucuccucaguccuagcuguccuuccugggauaagugggucagauuagcuggcagccaaugagcaagggcagacacagguggagaguggaagugugucagggaaaaagcagacugguggaacugaagccagagggcuccuugggagggagucacuugaucagggcuucacugaugccuucuuguucuuccaaaucuugauugaugccccaucucauccccauaugccaugugucaggaugcuccagucucugccucuccuugggauggaaagugccaaaguauauccaggcagauuacuuuggggggauagggucuguuuauagugccacuugcaucuuuggggaccugagcucuggcuacacuuaacagggaaaaaaagagcacagggccucgaagggaguugcuugguggauaggauuagaucacucuaacggggcuuuguccagugagcccagcauuucugggcuggagaaagacugcuggaggucacauugguugacagggucaccuuggcuaagacuauacuuccaucagagugaccaaggacuccuuaagcuucucccuuccauucuaagcacugaugagguugcaggagccuggggaaaccuagauacacaguugcauucagaaaacacucaguauuuguuuaacugucccuccccauggccaccccccacaccauggccuugccauaccuaucucuauucuaaccaauuuuccaugccuagcuugaaugucuccuccaugaagcaugcccuuuccacacagacagccuguucucuuuaucccuaacuccaaagucuaacuuuaucuuccaggauuugucuggggaaacugauaugccacccucauaggccugaagaaauuguaggaguuugaaggaagaccuagaaaaaaaguucaggcugggggcaguggcucaugcuuguaaucccagcacuuugggaggccgaggcagguggaucaccugaggacaggaguucaagaccagucugaccaacauggcgaaaccccgucuguaccaacaauacaaaaauuagcugggcaugguggcgggugcauguaaucccagcuacuuaggaggcugaggcaagagaaucgcuugaacccgggaggcggaaguugcagugagcugagaucacgccauugcacuccagccugggcgacagagcaagacugugucucaaaaaaacaaaaaaguucaccugggcucggugcagugacccacaccuguaaucccagcacuuugggaggcugaggcaagcagaucacuugagccuaggaguuugagaccagucugggcaacagugagaccccaucucuacauacuauuuauuuagagauggagucucccucuugucgcccugccuggagugcaaugguacaaucucagcucacugcaaccuccgcuuucuggguucaagugauucuccugccuuagccuccugaguagcugggauuacaggcagccgccaccacgccuggcuaauuuuuucuauuucuaguagagacaggguuucgccauguuguccaggcuggucucgaacuccugaccucaguugauccgcccucuucagccucccaaagugcugggauuacaggcgugggccaccaagccuggcccuggcuaauuuuuaaauuucacauagaggccgggcgugguaggcugcccuggaaauuguauuguccugagagaacacugccauuucagauagaggcuaagaugucacauaauugauguaaagccuguaaucucacccucuucaucagggccaaagcuugucuuuaggcuccaggauuagguucauuacaguuuguugacacacuuaccaccccuucuccaaggacucccaaugauuuuagagaguuaaaccauuaaacugcagauucuguggucaagaauccaaacagaaaacauaccaauuuccacuuuuacucacacccaaauccagugaaccuagcaguuucccaucccauccuggucaaguccaggaacacaguggaagggcuggcucuagggggagaagccuguguccuccuucagcaaccccaguuuccuguagucccgaccuguuacugggucaaaggagugaugguccagagaagggcaagcuuaaauucaggaaaacauucuggcucuggucagaagguguuuguggaaaagccaacucagacuguauuuuuccucuguucucaugccaccacuacaacaaucaacacagacuucugugaccaaauaugugggggauuugcccucacaccaaacaggcaaucaguucugcugcgggcaucaucuggguguccuccaauucaauucuggcacuguaccuggagauaauaucagaucccacagguugaggucccaguccccaagaaugccccugguuuggacaucaguaguuaguaugggccuccagaacuucuguccgaccaacuucaauuugggauucccaugauccccuuuuuggguucaaccaauuugcuacagaggcucacagaacucagggaaacacauuuacugguuuauuacaaaggauauuauaaugaauaaagaugaagagaugcacagggccagguaugggggaaggggccuggaagcuccaugcccucccugggaguggcauccuccaggaaccuccuaucugaaagcccuccaaaucauguccucguaggccuuuuaugaaaacuuccuuggauaggcaugauugauaaccauguagaaauaugcuuggaccaaaagguaugaucucauagugauacucuagacugagugagggaacccagcaaggacugucgagauuugucuuggccucugugcagcaucccuuccuccaagguacagggcaggaccccuucugaaaugggggucuugcaaccuacaaucagaaaagauaugacaaauaacuuauuuauagccagcuccaagacacaaaguugggggaagauuucugccuugggggaaaaggaacaggugaaaggaaggcagaagaaggccagagagggagagagagagaauucuguucucugaggccugcuucugagccuaaagugcccccaacauuauaaacaaaagacuaacaagagcugugggaguuauaagcaaggaacuuuggaugaaaacuucugugugugugugugugugugugugugugugucacaaggacagcccuccaggacuagucaauucccaaagaaagaggaugccuauugggcaguguuggaaucauucacauacaucaucaaacuccaccauaaaaguaaauuguccucaauuuacuuuugaggaacuggacuucuacacauuaaauuacaauauuuggucauagggaacuggaacuaagguaugauggaacccaagcuugaucuuuuuuuguuuguuuguuugagacagagucucgcuguuagccaggcuggagugcaguggcacaaucucggcucacugcaaccuccgcgucucggguucaagcgauucuccugccucagccucccgaauagcugggacuacaggugcaugccaccacgcccggcuaauuuuuuguauuuuuaguagagaugggguucgcuguguuagccaggauggccucgaucuccugaccucgugaucugcccgccucggccaaccaaagugcugggauuacaggcgugagccaauggcuggcaccaggccuccaagcuugaucuucuauacugugcuacuuaucggcaaaaagaaaauuaccuucagugugacaaauuuuuacuaugcacuuguuuguuuauuuauuuauuuauuuauuuauuuauuuauuuauuuauuugagacgcagucucgcucuguugccaaggcuggagugcaguggcgcgaucucggcucacugcaaccucugccuccuggguucaagcgauucucuugccucagccucccgaguagcugggacuacaggcgcccgccaccaugcccggcuaauuuuuguauuuuuaguugagacaggguuucaccauguuggccaggaugcucucgaucuccugaccucgugauccuaccgccucugccuccaagugcugggauuacaggccugagccaccgcacccggccuacuaugcaccuaaugugagcaacgauucgcuggauuugucucugccagaggcucguggacagcauuucuagaacugucagaucaaaaucugcaacugaggaguuaguuugccaucaacucuacauguacauuucagucuugugaacauaucuagauuuagaacuuuuucguuuguuuguuuuugagacaaggucuggcucugucacggaggcuggagugcaguggagugaucucugcucacuacaaccuccaccucucggauucaagcgauucugccucagcuucccgaguagcugggauuacagacgugcaccaccaugcccagcuaguuuuuguauuuuuaguaaagacgggguuucgccacguuggccaggauggucucaacuccuggccucaugugauucgccggccucggcuucccaaaguguugggauuacaggcgugagccacugcacccagacaauuuagaacuuuaaaauacaauauaguccagcaucggccagauccuugccaucccaguguuguccaccacuguucuuaguuuguccucagcucaggggccagggagggacuuuuaugccaucccucuuucucugauagagaggaaucuaacccucccuaggggggcaugucuuuuuuccuucucaacaacuucauguucuuucaccaccuuaauaaucaagcauuuccuucccaacaacaacuaaagggaccaggaaagacuuacagaagaaagugaaagauuuuuaucucacuucaaacagaaauuuacuuuuaggcugucacugucuccucccagcuuaucugagcuaacaggaagcgaaugaaggccugugauucagcugcaggcagcggguaugccugagcaggucacacccauuuggucucuuuugccaggaaaauaaaaaaagaaccuaagagaacggucuucacauuuugaaugcgcaacauuguaucugugaaugaaggcaagaguuaacagcuguuuaauugauaacugcucgcaucauuaguugcuggcuaacaacugggaaaucagaaaaugucuuguagaaaaauguaagaaaaguuccaacaauacugacuuaaacacgacaaaggugaaaacagaaaugcugacuccugcauagguuaucggcccuaauguucugacuugauauuuccagaugcccagcucugcgcuaauaucaacaccgucuauuuacuuucuacucugaggcauucgcucugcaggauuccagacccuacuaaauuauucacauggccccaaccgguccuuccuuguuccgcgguccuaacacaaugaaugguccuaagaggaaaacggccucgcgcucccgcuccaggcccacuucgcagucccuaguucucccuacugccgcuccagugccagagccccuccgaaggcggccaggaccuccaaccacgcacaagucugcagcucuccccaacuuuccguucagcucagucuccgagggugcgccagagcagacacccggaggaguggggaguggcagggcggggccgggagaaugcugccccggaacccauaaaucugggcccugcccagguaggccgggacagcugggguggccugggccgagagccaagaaaagacaccccaucuggcagcccaacuuggcggcaacagguggcccggcgcccgggggucugggaggaaagucgcuccgggggcgggccccguugccccgccgcguccccauuggucaucagguuucuuaaaaugugacucugaaucuguguccuuccgccgcagaauuuagucccaccgaaagggcaaccugcccgcgcguuccgccgccgccgccgcgcuuccuccugaaggugacugcgcccgcggggacgcagggggcggggcccgggucgcccggagccgggauugggcagagggcggggcggcggagggauugcggcggcccgcagcgggauaaccuugaggcugaggcaguggcuccuugcacagcagcugcacgcgccguggcuccggaucucuucgucuuugcagcguagcccgagucggucagcgccggaggugagcggugcaggaggcuacgccaucaguccccaccaagggccagucgcccggcuagugcggaaucccggcgcgccggccggccccgggcacgcaggcagggcggcgcaggauccagggcgucugggaugcaguggagcucagagagaggagaacggcuccucacgccuggggccugcucuucagaaguccccagcgccguuccuuccagaucaggcggguccgccggcuccuuucccgccccagcccuacccccucauucuggucccauccucuuccuccugccccaauccucaaugcgccuccauccucgccugccuucucucggucccucgugauugauuccacccuugcuuccccuuucuccgcgccgccuguuccgugcucguuuuccccucuuccuccuuaagucugguccuuccacccccuccucuucaagcugugcguguccccu

SEQ ID NO: 16032 - RNA, 1926 nt, Homo sapiens
uuuccucucuuuucugcuggggagggggaggugguugaacccugcccucugagcaggcugggaauggcugcagccucgugccccgcagugggagcuaugguggugucaccugccauccugcccaccuccuggugcagaggcgcugggaaagcaguagcuuacuaucuuaggguuacagguugcccccuucagugcugcggggagacuuuaauggcuuacgugaaccgaagaugggaaagagcagggacaaggccucccucccacucugguagauaaacccaaauugcaaaguggccuuggccaugguucuuccacuuuggucuuccugcauuagcguaucccuuaugggggcuguaggaggagucagcucugggcgccugagacuggguuuggcucccagguccucaguuguggaccuaggcuccccuugggaccccuccuguuugcuggugcccucccaccaugaugcuguagugccaaagggcugggggagagaguugggaaugggaccaaaucuggccugcgcuuuuccucuccccugaccacacucccaaggaccaaguguccugguggggauggaagaggaaagggccugcaggccaggcaaaagcucauugucacacugagcgcacgugccucugcuucccugccuuugauuuguguccaccuucagccccuuugcagacuccuccaaaaguguauuuccuuggagaaacugcaauguuaacuccggcaaaagugcgugggagcauccuggcucccggguucgugguggugacuuggcugucagaccaugguguucaauauccccuuugguguuccccacugacgguaaaauugaaacuuauccggagcucuauguugggaaggguuagguuggagaggggccggaauugguuccugcagagggacccaagccgcaagacuaggacgacagaagcguccagaggggacacaauacccucgacgugagggacaggaggugccgcgccaggcccuggccuccgggaccucccaguccggggaaccgagcgcuaggaucugcucagagcuuggagccccaccuggggaagguggggaaggagagaagcuggggaagcuggggaaugagggggaggaacggccaaugggcugugcccggcccgcgcgacccgccaaugggcgggcgggcggggcgggcucucgacggggcgggcgggguccggcgggcgcugggucccggcgcgcggucggggcgcugggugcaggcgccgggaugaccgcuuuaagccggagcgaggccaccgaggagggcggguaagggguugcggcccgggggccggucucggggguuccggaggccgccgcgaggggcugcugccgcgcggggcaggacggcuccuggggccgcggcaacucggcgcguucugcccacggggcaggcacuucccggccgccggaaugcgggcuccgggccagagcugcaccgcgcgcccaggcgucucccggggcccgcgagguguucgcacuaggaccgggugucuuggcugagucugcugcgaccugggggaugagggacggucccggcagcaucggggcaaggaagggcacccuccucgggacgccccgcauggcccaucuccgccucgccacucuguucauccuuucauuuauucauucaucauucguugcccgcgguaucgacucccaguccuaauugcccccgacccaaagguuggauuucccugcguccccuggagggccagacuguuuccucucgccgccgaauccguauuguagcggcccgcggcugcggggaggcagcucggagcugucucagcacgacgcggccucccccgggcgccaggcccaucccggucgggcgggcuggggccggucucccggccucgagaccugguccaaagucgcccugggagaaagggauaa

SEQ ID NO: 16033 - RNA, 25361 nt, Homo sapiens
uagauucucccuguacuggaaagggaugucgcaagguuggggacgaaaccucugaguuugcgaccguagcugucgcuuuccggccaacacagaggugccugaaggcugguugggguggugaggcccgaggcagguaagaagccuccuccccacuucgguuugucucggcaguggaucgcucucccacccacucagauucuggcguauccgugcucccucccgauucuggaccuggauucucagcgccgccggucauagcccccgccccuuuucaaacacgcacgcucucuccacccacugcccccuccauuguccccgccccgaccuccguuuccauucauuucucagacuuuucacugagugguuuccaugccuuggguuccagaaugucagaggcgaauuaaguggugucagcuuuuugaagugcuuuuguauaggagaccgugagagaauccgcagugguaguacaauaaagugacaauagagaaaaaugcacgggaugcugucugcgcacagaagaggggucccagguuguguaggaggauaacgugaggaagcccuuuccagggugacuuuugggucacuuuuagaggacuguguuaaaagacuaguaauccaguaccuggucaaagaaauacgaaaggagguaaaagcagaauaacgggcgcaagagcaugugacagugguggucugaaagagaaaaaagaaguaaaauaaaccugauggaaaccguacuaguguagacuucccuuuaaagaagcaucguuauaaaguuagagaaaugaggaacgagaauauggcccucaggaauguuuucuguuuagguagaagacucaaaagcguaccaugaaaccgagaaguggccucuucgagggugagggaggcuaauuuauaagaucaagaucacuaguggaacgcaaccuuguaugugcauuugaaucaccugggaaacuuuuuguuaaauaaaaccaauacuguugccccacucuagaccaauuaaauucuggguugugccaggugucauuacuguuuuaaagcuccacaggugacucuaaugcuaaagauugagacucacuaaacuagagagaaggaaguugagacaguuggcucuguaacauuaagauggaggucauuuagccgggcgcgguggcucacgccuguaaucccagcacuuugggaggccgaggcggguggaucacgaggucaagagaucgagaccauccaggccaacauggugaaaccucgucucuacuaaauauacaaaaaauuagccgggcgugguagcaggcgccuguagucccagcuacucgggaggccaaggcaggagaauggcaugaacccggaaggcggagcuugcagugagccaagaucgcgccacugcacuccagccugggugacagagcgagacuccguccccgcccccagaaaaaaaagauggaggucauuuaacuacagagaggcuuggagauggaaugagaaacuugagcggcguuauguuuggaauaacuggucugggaaaugggagaaggagccacucuugccuuucucuucagcacuguucauuccucaguguuuaucagguccaaauuaguuacuugucucuuugcucucccguucccuuccguccaggauuggucagcuguugucuccagccuuaaagcucaaaggccauccccacuucuguccccaaaaugaucagagcuaagccaauuuaugagaugcagagaccaacauccagagcuaagccaauuuaugagaugcaaagaccaacauccacucucauagagauuacuacauacagugccuugccaauuuagaaucuuuuucuauuauuuaucauuuaaguuaguaaugagauauaaagauauuuaaaauacagcucaauuaggauggaaaauuaccguauuagggaaagcaggccuuuaaacaaagaauucacuuggcaggcagagaagcuguaugagguaaagaccaagacaguguauggcugcuaucuauuaacuaggguuaauccaaaaaccugucuaucagacccagauaagaacgaguuauuguugucuaguauggcuagagcauaguauggagaguagaggugggacagagaugaagaugauaaagugggugugaacagauuaugaggagccuugaauuccauggugaagaguuuagauuauauuacuagaaguaauuaauaaguacaaaaaagguucuuaaccucuuuuacccaguggaccuuguuggcaguccaccuuauagauucagucucagaaaaauguucuuaaauauauaaaauagaauacguaguaauauaaaggaaacuaauuuuguuaaguuuuuaaaauauuaaaacaaaugugugauauauaugcacuuuaugcauuaaauaaaaucuggcagcaggucuaauuauauaauuucuaaguagugaugacuauaaauuauauuuugaaaugccugcagcaacuuuaaugugaugugaaaauaucagauuucuauugguaaaaaagagagugcuaauauuguaguuugugguccacacuuauugaagaaaugcuaaauuucagcuacugauuauugaaaacaaagaugcaauuguuuucccagucuaaguucacagaacccugauauucuagccacauccuggucuauggauccuaaguuuuaaaauaucucaguauaaugguuuuaagcaagagcaugacaucaaaucuguguuucagaaaaaugaugaagcaguguucacuucccaaccucucugcugggaugagaggcuggcucuggggcagcaaccaguacuaucccacuguuuccuaauaaccagggccugcagagggacugagcuuguggguguauaugucugugagaguaauaccagaaaauaaaucaggaaagguagauuggggcuauuuuuguggaaaucauugaaugccaggcuguaauuuguaguuacuuugguagacaauggaggguuguuaaaauuuuuuggaguagaauaaugugauuagaguucuguuugaaaaucuagaauaaugugcagguuagauuaucaaaagagaagauaggaaugaagagacuagaacaauaaguuaauuaauuuuugaaaaauggaaucuugggccaggugcaguggcucaggccuguaaucccagcacuuggggaggcugaggcaggaggaucacuugagcccaggaguucaagaccagccugggcaacaaagugagaccgugucucuccaaaaaaaaaaaaagaaaauuagccagacauaguggugccugccuguggucccaucuacacgggagacugaagcaggaggauuacaugagcccaggaggucgaggcugcaguguucaugccacugcacuccagccugagugacagagagccugucuccaaaaaaaaucuugaggugaucucuagagucugcuaaauuccuuuauuuccacaaugugcugaccagucuagaguaacauacauuggaauaaauggcauaccugucaacaggaauauauaccccagugugggagucaguuaacuuuauguggucaagaggcuagcccagucuuuuguauuauaaaugauauuguuaguacuucuaauaaagcaauggccuuaccauaaguucacagaucuugccaaggccuuccucagucaaacuccaucuauaccugugaguccuacauuucugacuuuuaaaagucagaaccugucuauaccugugaguccuacauuucugucuuuuaaaagucagaacuccucucuuuuugccaauuccuuaaacuucuuggaugggaaagaaguuuaguuuaaacacauuagcaaaagaaugggagguccucaaggcccaggcaacccaucuccuuugaaacugaucaauaccggacuauaaaaacuuacugcucaaauccagcuaguacccaaaguauguacugucuauauaccugucuauaccugugaguccuacauuucugacuuuuaaaagucagaacuccucucuuuuugccaauuccuuaaacuucuuggaugggaaagaaguuuaguuuaaacacauuagcaaaagaaugugaaguccucaaggcccaggcaacccaucuccuuugaaacugaucaauaccggacuauagaaacuuacugcucaaauccagcuaguacccaaaguauguacuuuuuaaauguauucuaaaaaauugaauuugggguuuagguauuacugauccaaaugaguccuauaaaauuaacuuccagaacuagguucucagagaggccaccauuaccaccuucuucaacauaacuagccuauauugacuuucuguccaucaaauaauuggaggccauuuggguggugauaggaagaauuaaguuuaugcagaacuugagguucagcuaucugacaccuuuugcgggaggaggaggagugggucuaucugaaaucagaaauaauacuuuuaugaggcuuuuuaauaauuuuuauuacuuacagaaaauuucugaaaguuccuuucucuggcucccaauuaaauggcuuacuccacaaucaacuuauaaaagcacuggaucauugucuugaucccaaaaaauuugucccaacuauaguuacuauuuugagcaucuguauuauuguuugaaaaccuuaggcuugcuuucccugauggccaaugaauaaaacucucaaagucgugugauucauuacucauuaauucauuagauauuuauugaaccucuacuaugugccaggcacauuuuugaaacccacuaaugagcaauuuguaaugacaauuuaccucuuaacuaucuaugaaaaaaauaacuugccaggauuugaaauccuuagaacaaaugagauuaaaagaucauagcuuuuuuguguucuuucaaauaguguguuugcauagagcugccaugugcugaccacagugauuaucugugaaaugagguaaaucauggcuuuaaccacuccuuaucagacuuuguuaccacauguacuaaaauaaaguucugucuacaccuuuauaaaauauuaucuuacacagacgucuuauuaauucuaauggccucuccacaccugacccucacuccuagucauuucaaaguuugcaauuguguaaagucauuucucagaaaauuugaagcaaaacaaagucaccacaagaaaaacuugguauacaccagguuuauauugaggacaaaaacugugacacaauuacaaauggaacuuuuuuuuuuuuuuuugugauggaguuuugcucuuguuccccaggcuggagugcaguggcgugcucuuggcucaccacaaccgccaccuccuggguucaagcaauucuccugccucagccucccgaguagcuaggauuacaguuguacacuaccacgccuggcuaauuuuguauuuuuaguagagacaggguuucuccauguuggucaggcugaucuagaacgcccgaccucaggugauccacccgccuuggccucccaaagugcugggauuacaggcaugagccaccgcacccagccuacaaauggaacucuugagguagaaaugguagaccaggaauaaaauuauuuucauggucaaugacaccuuagccauugauagcugugccuaguuacagagcaauaaauggagagccuugguguuagaugaaauccuaaaaagucaccuguuuuaucuccuuggccccagacagaauaaaguggaauuuauagcaguagaguuaccaagcaucaucaucacaccaaguagguuuuguacuuugagagcugaauuccucucugaaauauugauguuacaggaauguuguuuaaauucauagcucauuuauaaaauugagaauauuucuuacauuuauaacuguguuguguuuuccugaguuuuucaagauauguuucacuucuguacuuugcucacucaggaaaaauauuuauuuauuaaaacucuagcuugucaggcacugaaguuagaaggaugaguaaaaucuaaucuguguacucaagaggguuauauaauaaaucuugauggucauucuuacaugccacauuauacagaucuccagauggcuuaggcuuaguuuuaaaaggaaacguuuuaauuggggggaaauugaaaccccaaaaaaaagccaugaacuuccuuccuggaaauauuuuugccauaaaaagcauauuuggucuuggaugugauucuuuuugugaaagugcaaguugaaucagacauuagaaguuggacauaaucuucuaauuuuaguaaacaucaaauuauuuuuaaauauuuguguuugaacauuuauggaaaagagauuagauuuaccuguuuuauccagaggacagaaguaagacucagaaguugaaaaaauggaaauauuuuaugucauuauaagagugggaacugguacaucuuuuauuccucuucaauauggaaaucacuguauuuacuaauuauguguucauuauuaaaaaagggggaaaaauuaaagcacaauaucaaaagguagaaggaaaaaggcaaaaaaguauuaauccuauuucuuaaaaugauauuuacacuugauggauaucguucuugauuauuuuucuguauauuuuuaucauauacagauguuuauaucaaagcauauuaugaacauuuuucuuuuaauaaauuuguauugacaauauuauauuuaauggcugaaaacuauuccaucguguggaaacccuguuguuuaauuuaccaguccuuuuuugaacuccagauuguuuccaguuuuucuguuacaaauacugccauggugaauaucuuguugaauuuuugcacacauuguuaaugucucccuuaaguuaaauuucuuaaaguauaauaccuacauauauaaauuucuuaagaauuccaauauaauggcaaauuacccuugaaaaagcuugcauguaugacaguccuaucaaaauggggcaucauuuacucauuucccauaaucucucagcaaugcuaauuauuauuaguuuucuucaccuuugcuaacuugacagguaaaaaaaugaaauuuuauuuuaacuuacauuuauuugauuacuacucugauguccagugucuuuucauguguuuauugacuagucauguaaguguauuaacuaauauuuucuaacaauuuuuuuuuuacuuuuuaacauuuaaauuuguauucuaucuaaaauauaauuugauguaagguaugagguaaaacucuuuacuuuuuuaaucaaauaauuaacaaguugugccaaugcuacuuauuaaaaaauccagcaagcauaucccauacuucaauauacagauaauaaaguacugauagauauuccuccaaaaaaaagaaagacuauuucgugguuaaauaaguuugggaaaagaucauacgaaaaaaaguuaaaauuuuuuaucgccaaacucucguuagccucuagugugugugugugcauuaggaguuagcauuuccuaauuuaauuaaccauguaaucuuuuuucuuuuuuauuuauuuauuuauuuuauuuauuuauuuuuuugagauggagucucacucugucgcccaggcuguagugcaguggggugaucucggcucacugcaaccucugccucccagguucaagcaauucuccugccucuaccucccaaguaacugagauuacaaguaugcacuaccauauccaacuuguuuuguauuuucaguagagaugggguuuugccauauuggccaggcgggucucaagcuccugaccucaggugaucugccugccuuagccucccaaagugcugggauuacaggugugagcuauuuuuuuuaaccauguaaucucacuucauagguauuucaggaaauaccuaugaaagccuguggaacugagcuguccaguauacuagcacuagccacauguggcuauuuaaauuuuaguuaauuaaaauuacucaguucuucagucacacugaccauauuucaagaacucaauagccacaaggggcuaguggcuacuguauugaacauuuugcagauaaaagaaaauuuccgggccaggcacaguggcugaugccuguaaucccagcacgcugagaggccgagguggguggaucacaaggucaggaauucaagaccagccuggccaagcuggugaaacccugucucuacuaaaaaacuacaaaaaauuagccaggcacaguggcaguugccuguaaucccagcuacucgggaggcugaagcaggagaaucgcuugaacccaggcagcagagguugcagugagccgagauugcgccacuacacuccagccggggcgacggagugagacuccaucucaaaaaauaggaaaauuuccgucacaagaagugcuauuggacagcacugcuaugggaacauaauguucaguggaacacgugaacacgcugaaaacacuggaauaauccauaauuucuccugauuugucaggcaaacaugauuacuacuacacuaugagaacagacucucucauugauuuguaaagacuccaucaucauauuuaaaauuucuaaucuacauaugauuuuuuuaugcuauugauuuaucuacuucugcuccaauaccacaccccuaguuuuaagucaagguucugcaccuuucucuuucagagcagaaaugaagaauucuugcauggaguaggaaauuagauuagaagugauaguaaaggcgcuuucacuucccagacucuaaauguaaacauuucucugccgaacuugauuuauauuauguugagcuguauacucaauuacuuauucauuuauucuacaauuauuuauugaguaccugccugguaagcacuguuuuagguccugggguuaaaauggcaaacaaggcagacaaggccccucgucgucuuauuuucauagagcuuacauucuuguuuuggagagggaaagagaagaggcagggggaggaaaaaagaauaugaaccaauaaacaaauaaauuaaaaaacuaucacauaguaaucagugcuauucaaggaauugaaauuagagugauaguaacugguggccucuuuguuuuggcugcccugagaccucugugacuuaguggcauuuaaacuaagaucuguccaaagaagaagcuaauuacuagaagguccaggcagagcuaguaccacccucaggagggaaaaagcuugguguauuugaggaguaaaaagaaagucuuuguggcugggucuuagugggcaagcagggaaauaauaggagauaagguuggagaaauagcugaagccacauuuucauguaggguuuuguaaacuaggguagggaauuuucauuuuuuucugaguaugauagcuacuagagacuccuaagcagggaacagaccuggccuaauuuaaauuuuuaaacaauuauuuugauggagaauuuauuggcacagucaguaguggaaauaggagaccuguuaggcuaggucaagaaagaaauggugauagauuugacuaaggugauaguagugaagauggaaagcauuggacagauuuagaacauuuaggcuauagaaucaacaggacuugucaauuggaugugaagugugaagacaauagaaaacucugggaugagccugggcaacauagugagacccugccucuauaaaaaaaaauauuaauuagccagacauggugguaugcacguauagugcauauagcuacuuggaaggccaaggugggaggaucacuugagcccaucaguuaaaggcugcagugagcuaugauugcaccacugcacuccauccugggcaacagagugagacguuuucaaagaaagagagagggaaaggggagaggggagagagggaggggaggggaagaagaaaaaacagagagagagagaaagaaaaaaacuaacucuuggaugaugucuguaauccauuauauaguaaccagguucaauuuucagucugauuauggcaggcaaaauugggacacauaagacaccaauaaauauauuuuaaccaaaugaauaaauuuacuuuaauaaauguuucucuccuguacacauuuaagcugcuaaagcauaagcuugugcucauuccuuuauuauuagggaaucugacuccuaagaauuugagguuuaugucauaaacacaucagcuauagguaauuauuagacuguuccccugaaguauccaagccaacagaggagacugaaugaaacagaaaaaauugccugccacaguugcaaaaguucugugagauucucauauuuuauuuuuaaauuucaugcugauuuugcauuuuaugcccaaguuuauguuaauaauuaaaauauuuuuaguugcugauuuaaauguuuuaagucaaugauuaagugguuuagcucuuuccccuaaaguuggucaaauuaaagcucuaggaagaugcccugugauuaacuuguguuuguuuuuuggacuuucuuuguugcuaucugcuggcacaugggcauguauccauuuagagaaguacagaugcaucucugagcauuuguaguuugguacaacuuaaaaucguagccaaagcgagugaggaaggcaauagcauuuagaaacaacugacuuuuauaaucugcacuuacuuuguaauguuuuuaaaaaacauaccugaaugaggcuguuucucucuuuuuauuuuuuuaaggaaugcuuacugaauaauuagaaaaaaaugaguaaaggucacaauucuggaauaguauguuuucaguaaaacagauuuaucuggaguacuacuuaagucaauagccaacaggcuuauuuucccugaaguuuugagaauugcuguaugccauauaaaauccuuguuaauuuaaaacucuaauacauauuuuaaucccauaaaauaaauacuuauacaucuauaaaauagacaauuaucguuaauauccauuguaaauuaguauuuuuaagcauuuccauucauuaaaaauccagauugaguccaggugagguagcucacgccuaucaacccagcacuuugggagggcuagacaggaggaucacuggagccaaggaguucaagacggccugggcagcauaaugagaccucaucucuacaaauuuuuuuuuuuuugagacaguuucgcuguuguugcccaggcuggagugcaauggugccauuucggcucacugcagccuccgccuccuggguucaagcgauucuccugccucagccucccgaguagcugggauuacaggcaugcaccaccacacccggcuaauuuuguauuuuuuuuuuuuuuuuuuuuaguagagacuggguuucuccauguuggucaggcuggugucaaacuccugaccucaggugauccacccaccucggccucccaaagugcugggauuacaggcaugagccacugcgucuggccacauuuuuuuuuuuuaauuagccagguguggugggaggcaccuguggucccagcuacuuaggaggcuaaggcaggaggaucacuugagcccaggaggucaaggcugcaguggccgugauugcaccacugcauuccagccugggggacagagugagacccagucuaaaaaaaaagaaaaaaaaaauccagacugaaacagcaauaacaccuccaguuaaaaguuaaucuggccaggcaccauagcucacaccuauaaucccagcauuuugggaggccaaggugguggaucaccugaggucaggaguuugagaccagccuggccaacauggugaaaccccgucucuacuaaaaacaauacaaaaaauuagccaagcauugugguaggcaccucuaaucccagcuaccugggaggcugaggcaggagaaucacuugaaccugggaggcagagguuacagugagcugagaucgcgccauugcacuccagccugagcaagaagagcgaaaugccaucucaaaagaaaaaagaaaagucaauuuaucuggaaacugccuuuaagauaguuuaauaaauguccccagugcuuuauuagaauuguaaaaguucuuaaaauuaauucaaccuggaaauuuacagauuacauaacagugaucuagaauagggauuggcaaacuuuuucucuaaaaggccaaauaguaaauauuuuagacuuugcagacuacucuguccuuagaggucaaaaguagccauaaacaguaugugaacaaaugaacaugacuuaguccaauaaaacuuuauuuauagaagcaggcagugggccagauuuggccugcaaacuguaauuugcugaccuuuggacuagaaaacuagaauguuuuaggauuuuuuuuuuuuuuuuuuuuuuugagacagaguuucgcccuuguuccccaggcuggagugcaauggcgugaucucggcucaccgcaaccuccaccucccagguucaagcaauucuccugccucagccucccaaguagcugcaauuacaggcaugcgccaccaugcccagcuaauuuuguauuuuuaauagagacaggguuucuccauguuggucaggccagucucgaacucccgaccucaggugauccgccugccucagccucccaaagugcugggauuacaggugugagccacugcgcccggcaggauuuuuauaaacaggaugacagaauuuaaaaauuggcagagaugacagcuuagaaucauagaauauagagcuaguggaaacuuagaaaagagcuaguggaaacuuagacaucagaauaacuuggaaauaucuuaaaaaugcagaggcccagauucuaucccagguguaugcucuuuaaaauccccacagauaggugggcaugguggugcaugccuauagucccagcuacucaagaggcugaggcagaaggauggccuugagcccaagaguucaaggaugcagugagcuauaaucacaccacugcacuccagcaugggcgacacagcaagaccucaucucuuaaaauaauuuuuuuaaaucucauagaugauucuaauaugcuucccuggcuagaaccacuguuuaccugguccagaccacucaguuuacagaugaugaagcugaaauucauagguuaagugacucuuccagagucaaacaacugguuaauuguagaucugaacugaaucccaggucugacucccuaacuaauauuuuuucuacugaaccagcagcuucuucccuuguaucagcaggccaucagaaugacuccuauugaauugugaauuuucccuucaaguugguuuuuauuacuuuuuauuuaauuacuuuguuuuuuauaacaaauauucaaguagugugcaucuuaaggauuuuaggauuaauaagaaguaaucuccuucuauuaaaauuaauccuuuguuaaggaaguguucuacacuuaugaauucaauauuagcuucauuuaauuacagaauuuggaagauacaauaaacuaaccccuguaaugacaggguuuguguauacugacaacacauuaacaucauugcuucacucagauugagagaacaauuuucccuggacuuagcauucucucucuuuaugccaaagauaaagcacaagagcagagucaugccauggcuaguuccaucuuugauaacuuuguggcuuuauauaaagagacaagugcuuuauuuucaagaaaucuuugggguccauuauugccaccucaaacauagggaacagggaaggaaacuaaguuuuuuugagagccuacuguagaucagacaaggugcugaguguuuucacucauguuuuuaauucguguaacaaccugugauuauguuauuacuaccucaucuuacagaugaggaaaaugaggcccagaaagaggaagaauaacuugcccacgaucacuuaaauaguaaguggcaaggucagagccuagacccaagacuuccuagcccuaaaacauagaacuauguguuugguaagauuuuacaaauagaacuauaaggaggucauuggcuccccaguugacucaccuuucuugcccuuccccuagucuugcuuaccauccaccaagaccaaguacacagauccuuuuaacucuaaacgaauuuacuauuaacagcagaacaauaaaggauaacaggcaaagcauaaaaccaaagaauaaggauguuacaaagaauacagaaaucuuaaguggccuuauuucuuuuuuucccguaaucuaaauuuucugacuucccuuuaaaaauauuucauucaucuggcaaacauuuauugcacuucagauaugccaggcacagugcucacuacauagaaaauauuccuaaaugauuauagauggcucuugguuuuuugcuagguccccuuccaucuccuuuucucccaccccauugauaauguuauuaucauccucucacucacccccaacugaaaccuucagaccauuucauaauucuuuuuuuuuuuuuuuuuuuuuaaacagagucucacucuaucccccaggcuggagggcaguggcgaggucucggcucauugcaaccucugccucccguuuuaucuacccuccucugaucacuuacugagucuuauugauucucugucuacaauaucuauuccuccacauuccuacuaucauuucuccugcuuuaggucauuaccuccuaccuuuacuugcaauaaaaaucuaauugggcugggcacaguggcucaugccuguaaucccagcacuuugggagggcaaggcgggcggaacaccugaggucaggaauucgagaccagccuggccaacauggugaaaccccgucucuacuaaaaauacaaaaauuagccaggcauggugccaggcaccuguaaucccagcuacgcgggaggcugagacgggagaaucgcuugaacccgggaggcagagguugcagugagccaagauugcaccacugcaccccagccugggcgacagagugagacucaccucaaaacaaaagaaaaaaauaucuaauugaucucugcuuucaauuuuucccuuaccaauuaguucuauauauuauagcugaauuauuaucuucccaaagcauugaccuggccauuaauggcucccacuuccuccaguauaaauuucaaacuccuucacuggaauucagucugucaccacuuagcuucuaagaauccucuaauauuugccugcaccucuacuacucccacuucauucuagcacgcuagacuauucaagauucucuccacauuugaaagcacuuucuuuaccucucugucuuccacaugcauccagcuccaccuguccuucaagagcccacuuuuaugccacuuuccucaaagccauuucugaucugagcacucauuccuuuucauccuguuagccaggaaugauuauucucucuugugaauucccauacauucuguuugugccucuuauggauuucuuaucucauugacuagaagccaccuuauacaucuuuguaucucccauagcaucuaauaugaggugcucaguagguauuuauugacuaaaauaaugguauaugcaguacguguucauuauaacaaaauagguuuaagcucaguaaggguagaaacuauuucauucucacucuauauugccacccccugacacaaaggagaacacucaguagaccuuuguuaaaugaaauacauuacaguuaucagucauuggguuauaaauuuccugaugccauaauagauaccuagaaacacuuugucuuuuuuuguuuauuuguuuuggggguuuuguuuuuuuggauggagucucgcucugucacccaggcuggagugcaguggcgcuaucuagacucacugcaaccucugccuccuggguucaagcuguucuugugccucagucucccuaguagcugggacuacaggcacccaccaugccccgcuaauuuuuuguauuuuaguagagacagaguuucaccauguugccugggcuggucucgaacuccuaagcucaggcaguuugccugccuuggccuuauguuguauuuuaaaauccuaguuauguauguuucuuuauuuuauauugacaaauaccacaugauaaaggucauauauucuuauucucacuuuaagcugggcacgguggcucacaccuguaauccuagcauuuaguggggcagaggcaggaggauaacuugagcucaggaguuugaaaccagccugggcaacaaagugagacccugucucuacaaaaauuuaaaaauuagccaggcauggugguacgcaccugcaguccuagcuacucuggaggcagaagccagaaacuugcuugaaccuaggaguuugaggcugcuccgagcuaugauugugccacugugcuccagccugagcaacagagcgaaacccugucuuuaauauaaaaauaaaaaauacugccuuuuggcccaaaaugccaucuuccaguaauuugccaaaugacuaacacaaagggaaagaggagagguauccaauauauguucucuaggccuuggaaaaaacauggaguuguuccuuuggccauguauaugcgaaucuauaagaaauaugauaucguagacaucaaggaaauggauacuguucaaaaaggaaugucccagaaguguuaccauggcaaaacuggaagaguuuacagugauacccagcaugauguuggcauuguuguaagcaaacaagggccagauucuugccaagagaauuaacgugcauauugagugcauuaagcacucugagaacagagauagcuuccugaaaucgugaaggaaaaugaucagaaaaagaaggaagccaaagagaaaagagccuggguucacccugaagcaccagccugcuccacccagagaagcacacuuuuuuguuuguuuuuuguuuguuuuugagacagagucuggcucugucacccaggcuggaaugcaauggcgcaaucucagcucacugcaaccucugccucccguguucaagcgauucuccugccucagccucccgaguaguugggauuacaggcacccaccaccacgcccggcuaauuuuuguauuuuuaguagagacgagguuucaccauguuggucaggcuggucucgaacuccuggccucaagugauccgcccaccucauccucccaaaguacugggauuacaggugugagccaccaugcccagccucagagaagcacacuuugugagaaauaauagaaagaagccugggcugcugguagguguuaaaaaaaaaaaaacucuggacuauaaaaaauaaaaauagaaaauauuuucacuuuacagaaaaggaaagugagaguuaaggaaauuuaguaauuuauuuaugaucacacagccaaugaguaacagaauugaaucuaaaauuuaagucuucaaauacgaaguuuagaguuauuuuuggcaaaggguggguuuggcuaaaggcuaguugaguucuauuugcauuagaauuuuuggaguuaaacuugcugucaugcuguauggaacagaauuaaggccuugauuaacauuuugucuaugugcuugguauuuuaaaaaucaaacagacaaaacacaaaaacuauuucugaagaaaaucuuagcccagcuuguggacauucccuucaaggugagagaugacugacuguugaggcagucuucuugcagguuccuuucccuaguuggguugguguugaagacugggugugauuucagcaggcaguguagagaguaggucuccggguuuuugccaagcuauaugaccuggcacucacaaguaugcaguguuuauugaagacaugagagacagaugcuguagccagggagcagucauucugccuuuauauuauaaacucuuacaucaagucacaucgacaagcugauuaccuaaacucugucaaauugcuuuuguuugauugaucugugcccauuugccauaaggcuagauaguaaagauuauuauaggaaacaauccugucuguuucaucuguuguaaggauacugugaggcacuauuuguuaugaugcaccaugucuuuuaugaaaaucucuugagaaaaaacuaucggacuauaauacaaagaauuauuuuaccucuccugagcaauugcuuuguuuuugucuuauggacauugugaauguuuaccuuucucuggccagaugccaaaaagcuuagagccaaauuuguggcccacccauaacaaaugugcucuaugccucauuaacuucauucuuggcuccaguuuaugucucuccacuagucuuuuuuucuuaagaagauccuaauucaugccaucuuauuauauauuuuuucuuuuuucucauaaguagccuuauguuguuucucaaauagucagauuaugacauacugugucuacauaaaaccauguuggaugccccuucauuuacuuuggcuuuuuuucuugagggguguauugauuuuucauauagguuuuugcagcguuuuguuacacgaaaaugguuauaucacaaaaauuauugcuuaauaguguagacaagugguaaaauaacuggucuaauggucagaauugauuaaauugaugucauaauucuagucuugucuuuuacagcauuauuacuauuuucuuauaauaugcuuuguuuugcacucucaaucugcaugugacaguuuauugcugugugauuuucagaaauauugucgugcugccaggucacugcauaacagcuaacucucuguuaacucuguugagucuguuaggcucaaauauucuacacccaucagacuugucucacuuuggguggucacaggcauauuaauuucaucacacaacuugucuugcuucuccucuaaauuagucauucuuuuauuuagacaagauaaugugaauggauauuuguuuucaaaccucauuuucuuugauugguuuggagcucuagcuggauuuucugauuaucuuacuaaugucaucuaauugauaaauauuauuguacaacuuuuuaaacucuuuuaguacuuccaaguaaaauuauuuggucuucucuacaacucucuaggguauguaagguggguauaugccuuuuuuacagauggcauacaaaaaugauuaaaugauuuuauaugccaucuguaaaaaaggcguauaccuuuuuagaaaaacaaggacaaagucauuuaaaugacugcucaagaugauaccagcaaaucagugguaaaacuaggacuagacccagguuuccagaaucuuaucccauacuaccuuuuaaaagaagucaaaagaaguucuaacuuauauuguaaacauuacuucaucuuuaucauaccccuugaagcuaaagcuaugaaacaggcaaacacauguuauaucacucaugcucauagcagggcagaaucaggaaugaauuucauuuguauuagucucaugauucucuguuuuuaaaauuacaguuccuuuuaacuacuaccguaaucacugucacguuccauuauggaaggaggaagcaauauuuuaucuuaucuuuugaaaauuaauguugaggccaggcgcgguggcucacgucuguaaucccagcacuuuggguggcugagguggguggaucacgaggucaggagaucgagaccauccuggcuaacacagugaaaccccgucucuacuaaaaauacaaagaauuagccggguguuguggcgggcgccuguagucccagcuacuugggaggcugaggcaggagaauggugugaacccgggaagcggaguuugcagugagccaggaucgcgccacugcacuccagccugggugacagugcgagacuccaucucaaaaaaaaaaagaaaaagaaaauuaguguugaaaugaaaaguauuucccuuggaaauuaguaacuuuuuagauucuuugaauucaucuuuaauauaaaaauaauuuguugucauuaugcauauucauuaaggagccaaauaauacaguuaaugguaugguguuugguaaaacauuagcuauaauuuuaaucucugugcuucaagaggauauuuaaaauucaugcuuacuguguacauggcaaguuuccaguucucauucuaacuaaucguuuacauguagcacauaagcuagaauuucuuauaguuacaguugacccuugaacaacacaggggcuaggagugccaacccccguaugcagucaaaauucuagguauaacuuuuuuuuuuuuuuuuuugagauggagucuugcucuguugcccaggcuggagcgcaauggcaugaucucagcucacugcaaccuccaccuuccagguucaagcaguucucccaccucagccuuucgaguagcugggauuacaggcaugccccaccacgcccggcuaauuuuuguauuuuuaguagagaugggguuucaccauguuggccaggcuggucucaaacuccugaccucaagugaucugcccaccuuggccucccaaagugcugggauuucaggcgugagccacagcacccagccuagguguaggauuugacucccuaaaaaaauacgccaggugcgguggcucacgccuguaauuccagcacuuugggaggcugaggcgggcggaucacaaggucaggaauucgagaccagccuggcugauauggcgaaacccugucucuacuaaaaauacaaaaaaaaauuagccgggcaugguggcacaugccuguaaucccagcuacucaggagguugagucaaaagaaucgcuucaacccaggaggcagagguugcagugagcugagaucgugccacugcacuccaaucugggcgacagagugugacuccaucucaaaaaaaaaaaaaaaaaaaaacuuuacuaccaauaacauagccaauuaacaauaacauagccaauuaauacauguuuuguaaauguauuauauacugcauaauauauaccuuaccaauaacauagccaauuaacacguuuuguaaauguauuauauacauuuacaaauaaccuuaccaauaacauagccaauuaacacguuaccuuaccaauaacauagccuuaccaauaacauagccaguuaacacauguuuuuuaauguauuauaaacugcauucuuacgaaaaaguaagcuaggggaaaauauuaagaaaaucauaaaagaaaauauauuuacuauucauuaaguggaaauggaucgucauaaaggucuucauccucaucaucauguugaguaggcugaagaggaggaggaaaaggagcaauuggucuugcugucucagggguggcagaggcaaaagaaaauccauguguaaguagaucugcacagaucaaacccaccuuguccaagggucaacuguguauuuuuuuaccacaacccuauaaaaguaacuacuauuuuccagccgcauuuuacagucagguauuuauugacaauaauauugucuucuagcucuuguucagcuucuggaauuucugagcagcccucgucaguacaagauggaccccguagucuugaguuacauggacagucuacugcggcaaucagaugucucacuauuggauccgccaagcuggcucaaugaccauauuauuggguuugcguuugaguacuuugccaacagucaguuucaugacugcucugaucacgucaguuucaucagcccugaagucacccaguucaucaagugcacuagcaacccagcagagauugccauguuccuugaaccacuggaccuccccaacaagagaguuguauuuuuagccaucaaugauaacuccaaccaggcagcuggaggaacccacuggaguuuauuggucuaccuccaagauaaaaauagcuuuuuucauuaugauucccauagcaggagcaacucaguucacgcaaagcagguagcagagaaacuggaggcuuucuuaggcagaaaaggagacaaacuggccuuuguggaagagaaagccccugcccaacaaaacagcuaugacugugggauguacgugauauguaacacugaggccuugugucagaacuucuuuaggcaacagacagaaucacugcugcagcuacucaccccugcauacaucacaaagaagaggggagaauggaaagaucucauuaccacacuugcuaaaaaguagcuauugaaguauauuugcgacuuuugaaggcuccucuuucugcccuuccccauuuguuggauggcugcaaucucagugccugagggaagaugccuaguagaggaaagcuuaauacucuuuuuccugaaagaauaucauccucugcauuauccccauggaacguuucacuuuaacccugacuggggagcaauauguucugugaaaauaucuugaaauuguacaccaaaaccuuacaaccaacuuauuugaacauuuauuacacacaggguuuacguaagacuuuucuuauugguauauaauuaauuuccuuuggucucccuuauccacauuggcuuauucuggaggaaaagcagugaucuguaaaacaaaucaagaauauauuaaaucuagaggaaugcagagaagaaaacuauaaaacagaaccaaaaacuuguugcacagccuacauaauuaagagaucaacuggcuggaagcagaucaaggccuaacuucauucaagaccuaaauauuaugagacucaguuauucgguuuuaugugacaucucuuccauucaccaugcacaggcuuuuccagcuaucuauauaauguuugcaaauauuugauaaagaugauguuacccuaucuuccuccaucugauuccuggaaugcuugaagaaaggggaaaucuugaguaaccucauuaaaauuaaugucugguggaccucucaguuugcucacugauuggguagacuugcuacucuggauuaauaacugcuuuucucugccuugucuauuagccaugcacacacuuccuccuuauauccaaaguucuuugguucuaaaauucauaguugauaccuucccaagguuaccuguuguuucagauaaacauuuguucuuccugauaguuauagguuuuccucucuguccuuaauucuggcagaauuguuuuuaguuaugucaugguaauuucaggaugauuuuuguaucugaaacuuaacagacuuagaguugguuuguuuuuuaaauauaaaggaagaaaagugaccuuucucagcccuuuuacuuaauuaaaaaugcagggaauguaauuuguaaaauguggaaccaagaguagaacgaaauacuaucccuccagaagcacugauguguuucaguuguuucaaauaguaaacaaccagaugacauguuagguacacaaauuaauucuauuccuaaugagaauuagauugcaaggccuaugagacuugaaaaccaaagaugagcuucagccaugaaacuuauuucagcuaccuccccagccuaacccugcccccagcccucauggcccaaaauaaccucaccacucagugaccacagagaaaguaacuugguuccuuuuagccgagaagggaaaacacaguaaggguaaauaaguacagguuacauagcaggccugagugagcaggagcugaaacuaaaagucaaagagaaagcuaucaaaaaaaguuuccauuucaagucgguacauuuuggauaaaaaccaguccuaauggaagauggggcuaggaaaaagauuaggaacuggcagucauccauagaggugaaauacagagggagggacagcaagagaagugacaaaggucacugaugauaggccacaaguguagauaaagauaagaaaacaauguuauuucagugacuguugacuuaggcagcuaaucuagacuauuaaagucaaauccucucugggaaaaguuaucuuucugacaaugcaaaguauguuuauuuaaauaucagaguaucuucaaucugagaauuaaagcauaugaaagcaaucuuuccuaacucccuacgauucaucuuauaaguaaauuuauaaguaaauuuuuaaacuacacuagucuuuuaaauauauauagaaaaauauauauacacacguauagacauguauauguaaucuaucuacauauauauaaaaaaugcauuuuccaaaugcauuagccugauuggacugugccacagauuaguguccuccuaugaaauuuugaguaugucauuuguaaauguuagcauuauaaauugcaggagaauuuaagaauugacuuguauuucacuggauacuauaguacccgguaaguuacacaccugcuugaccacauaccauucauguuacaugacacaaaauaggaaaaaaucuuuugcugguauugcguucccuucucucuuagagucaaaaggaucuauucugcaaaauuaaucaaaauauucaaaaggaaggcagguuuuucaaaacugggcuaagcaauuaucaaacugaacuaaccugcuuucagauauccuguuguauugcccgguaaguauagucacacuuguccaacccgugucucaauauggaauucagaaaaguuaccauauauaaacccagcuauaaaugguuguagaaaauauaaguaucaguggguuuccuauguaauaguguuuaaaacacaaauauuucaaccauuuggcaagguauauguugaaguucacaagcgcugguccuaaccagaucagauaaaguggauuauguuucugauauguaccuaauuauuuugacuauacuauaauuuuacaauaugcauauugaccguauguuuuaauaacacauuccauugaaaugaccaaguagaauuucucaguuacauggggcaggccgggcgcaauggcucaugccuguaaucccaggacuuugggaggccaaggcaggcagaucaccugaggucaggaguucaagaccagccuggccaacauggcgaaaccccgucucuacuaaaaauacaaaaauuagccgggcaugguaggugggcgccuguaaucccagcuacucagcaggcugaggcaggagaaucacuugaaccugggaggcggagguugcagugagcugagauugugccacugcacuccagccuaggcaacagagcgagacucuuaucucaaaaaaaaaaaaaaaaguauuuacagaaauguacaugcuaugguguuagagcaugaaugucaaauccagggucugucagauucaguagucucaucuacaaaauaaaccuuguuuuccuucuguccuacucaguuccauuuuaagacuaacaacaaguuugaaaacuuaguuuuauauugcuaugcagcuaaacagcuguguaaaaaauggcugauaauuacuguuauguacaaaagagaaacuuauucaaggauggugaauagcaacaacuaaccuuuuuaucacucuguaaugugcaggguacuuuaugcacacauauuacacaaguaccuugcauauuauauaugcaucauuauauauauuaccauauauauaaaguaacuuguacauuuuugagguucuauagaaauauauaaucucauuaauucuuauguucucauguuucaacagguacuguuauucucauuuuauaaauaaacucagaagcucaguca

SEQ ID NO: 16034 - RNA, 8319 nt, Homo sapiens
agcaucucugcccugcaggcccugggcugggcauuucauguccagcagcucauuccacugcagccuugcagaugaggaggccagcugagcacugguuguccaagguuacugaccaggaauaggugggcuggcucuggagucugugcuuucaagccuuggcucuacauacuaggauccucguggaugggccuuuggaaaugaugcugucuugggccugguuagcccugugggggcugcuuccuccccuguuccuggccccuggcuccagucuguucccuaugugcccuuuagacccugaugaugaguuccccgggcugcucuugcccacugcacccuagaaagccagcucuccccugucuguucuccaggauucaacauguggaggaggaguccaggguggggauguuuaagacagcugccuccugccugugcugauuguguucauccagcaggugauccuggugccugagcccuggccuggaugucaggagagugaggcaauugcaucuagucauucuuuuaacaaagauggauuggaugccugcaaugugccaggcacugugcuagguguuagggaugcagcagggagcucacggccucccaccuucuagugggggaggcaaauaauggaggcccaaauagaucaugcaaaccccucaggucaggauaagcacugggaagagaaauaaagcaagggagggggaagagaaugacagucaagggagggagaggagaacuuucaaugguucagggaaagccuuucugaggaggugacauuugugcagagaccugaauuaaacccaggggaagaguguuccaggcagaagaaacaguagguguguggucucugaguagccaaugaacucaguggguucaaggaacagccaggaggccuguguggcuggagggcagugagcaggagcucggacaggccagagucacguguggaccgaggaggaaagcgggugugugguuugauucucacccaaugagggguccuucagggggcugaguggaggaauggcauuggccagcuaaugguugacgaggacaggagcugcagcugugaggagagucccuuucaguggcaagaggagaagcagggaggcaguguucuuucccagacauugcuuuagcccuuuggguuugcagccucugaggcuggccugcuggaguagaagcccugcccugccacuuacuugcugugugaccuugagcaaauugcuuaaccuuucugugucucuguuuccccaucuagaaacuugaaaaaauaaucauaccucucucguaagguuguugugaggauggggugggagaacagugguaggacauagugaguacuccaugcguguuagccauuaucacuaccuuauacuaucauuagcaacuuaacauggucucccggugggaggacgaagagcuagcaaguggcugccucuccuucugcuccucucugggccucaggguccuuaucugcuaagaaaggauucauggccaggcacaguggcucaggccuguaauccuagcacuucgggaggccgaggcgggcagaucauuugaggucaggaguuugagaccagccugaccaacauggugagacucugucucuacuaaaaauacaaaaaaaaaaaaguagcuggguguggugguccaugucuguagucccagcuacucaggaggcugcgacaggagaauugcuugaaccugggagguggagguugcagugagccaagaucaucacuacacuccagccugggccacagagugagacucugucugaaaaaaaaaaaaagaggauucauuagcagaucuuuaaagaccucuccaacucucuaacaucugaauaauuagaaccaauaccccucguacacaaaaacaaaagcaaaacauuaagcacccccaaugugccaaucugccaggagagaccacauagaauugcauucaaucuuuccaguaacucaaugggagaaucuuguccauuucauaaagaccaguguuuccaucuuucucuuucuuuagucuguauuauuuuuucaccuguuagauaauacauugguggaagaauuuccauuuuauuuuuauuuuauaaauuuuuaaauuuaaauguaaaauuuaauuuuccuggauguguguuccaugugccuuuggaagcaaaguuuccugaggugcucaccauaaucuuuccaaugggguuaggauuuagaaacacagagaauggaaauaaaaccuaguuccuaccccaagacuaaggcaaaacaaguguaaaguuuucucuccuugguccaagaucaaugggaauuaauauggaguuuuucagaggucagucuucuggggaccuccuggugaccacucagcccaauuuaguggucggcuggacaaacacgguugucacaaagcccguguccauuucacaaagccauggagucacauggcaaguuggguauaaaagaaggcaggagauacagagcaggaacauaguuauagcagagcugagaaggaagcaaaaagaagugugcacauaccuugcuuagacuuccggcuagacacuguguuagguguuuuuuuuuuuuaguuuguuuguuuguugagacagagucucgcuuuguugcccaggcuggagugcaguggcgcaaucuuggcucacugcaaccucugccucccggguucaagugauucuccugccucagccucccgagcagcugggacuacaggcgcccgccacuacgccuggcuaauuuuuaguagagacgggguuucacuguguuagccaggauggucucaauuuccugaccucacgauccgccugccucgccucccgaagugcugggauuacaggugugagccaccacgcccggccagguguuuucacauguacaagccaauggaugagaaaaggcaggauaguaaacagaagacagacccaaauguaggcuggucauaaaucagcuacugguuucauagcucauuuaacaaaccuagccaaaauagguugauggaugguuccauuuccaccuagagggggucacugguagccugccuucaaggucugugcuuggcccugaacucaucagcacacuuggaucagcagccugguagaugcagacacagagggcagguugaucacaaagcugggagagagagugaucauucaaguguuucagagugucaggcugggcgagaccuuagagaucaccccuucccacucuacaaagacacagaacuuguucaaagucacacagucaguuuguggcagaccagccuaagggcaaauuucuccaccucccugugcugugcuggccaauuuaggauucacaugauccuggcaggccugggccggcggcugauucuagcaggauacagccuaccagggaugagugagugugcgcuuugcauuucagguucagaaaaaucgauugccuaaguacaggaugugggaggcuggcuugcagccggucuugugcaaaagaccggggggagucuguuggccacgagaucaauagaagccagagugugaugcagccgcuaaacagggaagucucuccucuuccacggacugggcagagccaacgcguccagagccggaagagugacagccuuauuuuugucugugcucaucggccacuuuccaagauuuuuauuuauuucuaggugucauagauuaaaaagcacaucaagguuugaagacuguagagaggagaacggcugagcugucaaggggucugggggagccugucagagaccuuauuaagguagcagaagacccuuaacuggaaaagaggagaaggauaauggccuucaguuuaugaggugguugucauggaauaaaggcagaggcucgucuagggggccccagaggacagaacugggacgcaaagcagugugggguggauuaccaacuguuucccauggaaugccaagaagacagcggguacccaagaaaggguccacagucaaccaagaguaggaaauguauauaugcuauucucuauccccucuugcagauucaaggugcauauuagcacauacauauaugcuaauguguauaauauguauauuauauacauauguauuaguagguacauuacaagggaugaaaucuaaaggugcaaaagagcuugucugugcucaagcccccuaaaaaacagagcuuagaugcuaugacuugauuagaagugcaguccuagggagaggguuagggaguggccacagaggaggaagagccgacaugagaauuugacacugagcuggcugccgcuaagugcaacugauugcuggaucccaagggacuguucccugagaagccauauuaaacuguguuucaggguugcuauagcaaaggacaagugagaagaaauuuccaucagguccagucuccaauuggcugaagauuggcuccauggaagauaauuuucccuugugucugaguugggcaaucgugggcacuaggggugguccugaagugguaagguccacagagaugcccugaaggggaagcaagaggaagugcaagagcaggauggcacuucugugaagugggcugaugcucacacagugcugucacugcuugaggcuggaagaagagacagguaagguggaaaggacgggcuaggucugcuaugaguugugauuuacaugcagcagaaaguaagucuccuucccucuccugucccaccacccagguccccgcaucagaggaacacauuguuuucuugggaagccuucaagagacagucaugcaugggugagccuauacgcauauaaauauaugacauagguaauuauauaugcacauauuuucauagaaugggagcauacuauacugcauagcacuuuuuuacauaacaauguaucuuggcacucuuuccuuaucaguacacauagagccgucucaugcauuugaaugaccauauagcacuucauccagcugauguaccauaauuuauuuaaauguccuauaaugcacauuuaggaugcuucuaaucucuugcuauugcaaucaucauggcgguaaauacucuuguacacaagucauuuugcaauccuaggagguuaucucuaaggcagaaaaccuagaaauggaauguugggucaaagggaauaugcauucucaguuuugaucaauguugccaaauugccuuccaggguaguugugccagauucccucccaccagcaauuuaggcgcaagccuguuucccucuguccuuaccagcacaaugcauuaucacacuuuuguucuuugccaauguaaaagguagaaaauuauauuucacugugauuuuaauuuucauguguuaagucauagugagaaugagccuuuuuucuuccaguauuuacauuuuuuuacauuuacauauaaugccauuuacauuuuauuuucugugaacugucuauaacuuuugcucauucuucuuuaucuaucuucuaucuaucuuccuaucaagagauuauauauuugcuuaaacaaaauauuauuguauauguuuaaggcuuuauauaaaugguauugaacuauauauauaguucuauaacugauauuauuuuauucaacauuuuucgaaguccucagcauuguuuuugaaauguguccauguuacaauagcuacaguuuguuaauuuucaaugcuguaacauauuuuauuguaugaauaugccacaauuuacccuuucuccuguugauggcuuugugggucaccuucaaauuuuuguuauuacaauguggcuaggaacauucuaguacauaucuccuagugcacaugggcaaaaacuucuaaagcagaguauauauagccagggcuggaauugcugggucauagguuguaugcaucuucagggaacaagauaauacacuuuugcccauuuaaaaaauauaggcugggcacaguggcucacaccuguaaucccagcacuuugggaagcugagguggguggaucacuugaggucaggaguucgagaccaacccggccaacauggugaaaccccgucucuacuaaaaauauaaaaauuagcugggugugguggcagucaccuguaaucccagcuacucaggaggcuaagcacaagaaucgcuugaaccugggagguggagggugcagugagccaagaucaugccacugcacuccagccugggcgacagagcaagacuuagucucaaaaaaaaaaaaaaaaaauagauugcuggucuuguuauugauuguagggucucuucauguauggaagcauuugcacuuugugauaugggcauauuaguguuuagaugcucagaaaagcccugcagcaaagaaaucuuuuuuuuuuuuuuuuuuuuuugagacagagucucacucuguugcccgggcuggagugcaauggcgugaucuccgcucgcugcaaccuccuccuccugguuucaagcaauucccugccucagccuccugaguagcugggacuacaggcgcccgccacccugcccggcuaauuuuuguauuuuuaauagagaugggguuucaccauguuggccaggcuggucuugaacuccugacccugugguccaccugccucagccucccgaagugcugggauuauaggcaugagccaccacgccuggcaaagaaaccuuuuuaacuggguguuuccuuaacucaacugaccaugaaccccuuuccucauugaguaucugauaggacuaacucggggaauugcuuuuguaagggaacacgcaucaggaccuggucaagcaagaugcuggcaucugggcaaccaucaacaguaguacacagaccccucugcccugcucaaaggaccuuaaaggucucagaggcugacccuggcuggaaggcuuucuggucugcccuccauccuacaauuuaggggacccauccucauggugcauccaccgugucaggcuuugugcuggaugcuuccugucacuuaccucugcuuccauaaccaagugagaaacaaggcucagagcagugagcuuccuuaagggaagacaaaccaucaucugauccaaagccauccucccuccauuacacuacaggacuugcuuagaaccaaaacagugcccaagacccagccccugagaaagccagauacuggcuucaucccuuccccaccuugccacaacaccucgggcccuggucugucccucuccucuggcucguggccuggcugcauggcggggcuggcuauuuugacaugcaugcccuggcucucccaucucaugauggcaaggcugugagguuccuugcacuuggcacagaucuuggcauaugaucaaugucuuuuggaaugaccagaucagugaugauaaugccagugagcauguauccggugcucaccauaggcaggcucugugcuaagggcuuuaugagaauuaucccuuauauuuguucacagcgacccucugcagguucugguaccaucaucuccauuucacggaugaaaaaacaggcugaggggaguuuggucacuuguccaaggucacacagacauugagugguggaggcaggauuugaacuugaguuacagggccucuaccugccucaugccacacaccugacccagaugggugagcuagguggccucugucuagcaaugccacaugcgcaguaguacccaggaauucccccaugugacaaugacauaaacccaggagucuauucagcacugcugcgaggccucagggagcaggccgccauggguggggagaaccccaggccugguccucugccccuuccuugcucccuuccugccagcuggggucacagguccagcccaaggccacuugagguucaggugacaaaacaucccaguuugcaggaguuggcaguugcucugggcaagcugcaagcaaacagcugugacuccaguccccaaagcucccccuccuuaccugugucaacacuuuuauuuuuaaaguggcagagccaaggugggggcuggggaugggcaauggggaaggagggagccugucccuuaucagcgcugggguccuugcauauguaacgcugucauauaauuaacagugaagaucauuuacauugucgcuuagcuaauuuucauaauguuuucuuuauuaucagaggaagaaauuaacccaagaauuuauuuacauagcagccucaaacaguaacagcuugcuaauugccuguuaggugauuaauaagcuuacagcagaugcuaaugcgucgugggcuccccguuucaaaggugcucuugccucacgcuuguguuuuggcagcuuaauuagugcaauaauuauguacuuguugcuccuucuuucgagcaaauacugucaaaugcuuaaaagauuaaagugaauuauauccugagaacg

SEQ ID NO: 16035 - RNA, 1447 nt, Homo sapiens
uaaugaaugcugcggccagaugcucgcaucugucgagccgggcuucucccucccccgucuucggugcgcgccgaaacacgauuuauguuuuuauuuaggagaauaaauaaaugaagaggggagcgcgguucggggcuggcggccggagcgggcgcggggagguucaguucugaggcgggugcucacguguaacuccccgcgcuccggccuccgagcgcccgcuagcucucagcuccucauuaagaugcaaaagcgaaccuccggcuccuaaugaggggaaaauauagauccggggacgcgcggccggcucgcgcgcgggcucgcggacuugccggggagggccccgggggucccgccuuggccguccaccgggcggugcgcgcuuugagguccacucccugcuugcucgucugccccgccguaaccccgagcgcgggagggcgaggccaucgguuugcgggcaagcuggccccggagucgaguggccugugcgaccaagcgggggguccggggggcccggggccggggcgagcgagcgggggagcguccgcgucccucggaguguccaggcuagcgaccgagacaccuacaggcuuccgccaacgccguggcacugccgggagcaggcugagcaaaccaggugggaacucggaguucccgggccucggccgagcagggucccgaccccauccccaacccccucagccuggggaugcagugaggagcccgcgcggcgaggcugcgucgagggugaaguugugcccacggggaaggcgccccgaauggggccagccguggcugagccuguuguccacgggcagccgggcccuuccaucugcgcugcccgccuagccagagucccucagacuucuccucgcaggcagccgccgcacaucaaaggagcuguuuauuuggcuuucugaaaagaagggcgagugaacaaaggagagcugggggcuaaugugggggaggcgggcagaagaaggggugaagaaaaggggacauccugaguuccgagcaaauuuuuaaaggucggaggcaacuuuaggagccaccguuuuaucaguccuaaaucuuuugaagugaaaacauuaaagugacaaagugauuguuuguuuuauaguaucuaauugggcugcuuugcagaccuaaugagauuagagggaggaaucguucgccgccgcugcagaauaaacugauacauuacuaccagccacagguuuugaagauuguacagcuugucuuauuuucuuuuguuguuauuccucugucuucccucuuuccuccucccgcuaaauaauuauuugcuaguagaccgugggaaaaaaaaggaggaaaaaaacucgagcagcccaggacuauaauauauaucuauuuauuauaugucuuucgguuaauuccugaucugaggagcgcuguuuuucacucccaugcgaaagucaccagc
